United States Patent 6,812,339 (POLYMORPHISMS IN KNOWN GENES ASSOCIATED WITH HUMAN DISEASE, METHODS OF DETECTION AND USES THEREOF) - sequence listing, part 72

SEQ ID NO: 16800 - DNA, 26896 bp, Human
agacactggctttgaaatggctcaactacgtcccaagcaccctttgtgcatcttaattgccctgggaaatcagggaggggtggcagtttggagcttggaaagctggaaggtggggacgaaaggagtttttgcccctcatcgccaatccttgaggttcctacagggaacctcagacaacagctgtcttaggggtttccttccagctccaagcagctgtattatctatagctttgagagggtctgtctctgtcaatggggctgattcctcagcacctggcagggcctgggggggactgccagagtctgttctgccgggcatgttagtagcacagactactgggataacctcagcaactgtataccttagcactgcagagctgcggtgttgtcagacacagcccttgcagttcgtggtctacccccacttgcctgcaccccccttatagctgctcaatgtcctcagactgtaccttagtgccttggttaccaagcaacccccacagaggcctcctcctggattttcccttccctgctatgcccaccccaccttcaaaatgtacctgctgcacccatcccccaggcctgcctcactccttccaagctgacagctaatcagatggactaatccgcatgcgcggaagagctgtgcttgggaagaagggggagatttcacaccaaatcgtgcagtggttgcctagacacggagccagtcaagcttgcatgccccgttgctagaagagcatggcatcggttgtgttctgtgctcgtaggctgggccccagctccctttcctcccctcctttgtggctgttcctcaggcctgcagaggggaagatttttcctgtcctgttactctgcctcacttgccagaacactagtcgcctccagctctggataaagctgaggctgggtgggccagacaacagctgtcttaggggtctccttccagctccaagtagttgtattatctatagctctgagagggtctgtctctgggctcaggcctttagtacctgtggggcagagccaggaacgtgagtcaggcaaaccgctccaaactaggaccaatgcagctgggtcctgctctctgcgcatagggggtccccacatctttggaatcccagcccacctttccaggctaccctccacaggccgggctccactcccatctgctgaggtttcccaccttgaatcctgctgccccgattagctgtataaccttaaagaatgcactgtccctctccattaaatgaagtgcttggatggattgctaaaggcctgtctggctcggaggcttggtgacctcaacacattgcctgctggtccaaggaaatcagtgcctgagccagagtccccatctctaagctccatggttattgttcttgccacctggctaggaaatgtccttccagctgccccagtctagctgcctcaccctggggccatgcccccaactctgtcctacccttctctgctgctgacactcagccccttcccagcttccagttggatacaggacctgggccaggagagcagggaggacactgtggaaatgcggccaggccatcaggggcctcgcagcaggggactggagggggagcagtgtccagggccagaagtgccctgcgggagagccaggacattggctgcctgtggtcttggtggtcgtggtcagttccctctcctgccagctgtggaatgtgaggcctggcctgggagatatttttgctgcactttgagccaccccgccccctggaactcagaccctgcacagtccatgccataacaatgacgaccacttccaattgtttcctagctggagaggcggggaggggagcactgtttgggaagggggggagcctgggggaaatgcttctagtgacaacagccctttctaaatccggctagggactgggtgccgttgggggtgggggtgccctgctgccccatatatacagcccctgagaccaggtctggctccacagctctgtcctgctctgtgtctttccctgctgctctcaggtaggagcgggagctggaggctttactctgggataagggggctccaggcttaggaagggattcctcttggaatagcaagcttcatgcaggacttcatgcagagtaccaggtccagtcactgggcacacatgtgcaggtctaaacatgggcgtatgtgccacaggagttcctaggggaagatatctgcatctgagcatatgggaccaatatgcattacagggtgtgtgtgtgtgtgtgtgtgtgtgtgtgtgtggacaagcctgcatagtctgaatgtgagaaagggtatgtacctcactgactgatacagaaatatcaagtgggagatgtgggtgtatgatcacgtctgtgaacgaggaggttcctttgcagggagggagaaagaatggtggagaaggattctaggaagtgtgtatgccttcatgtgattctgtgaggcctggaatgtgtagctacccctgtccatgcatgcagaggttcttgtctatgcctccacgagtcatgactgttatagtatctgtaccctctgcagaaggaactcacaggcacgggggtgtaggatgttccaggtctttgtgtactgaagaacacgcagtgatgtgatctacttacgtggcacacatcctgaaatgtgcacatttgctgttgaggcatatatggcaccctggggttggggtgcggattgaggtatgggaaggaagcctgtcttcatgtgagaggcatgcccaagcagcaggcatgagtgttcatcagagggcttgtggagggtgtttggctatgtgatgggtgtgtctgtgagaggaagcccacagtgtcttctctctgagaatgtccacaaagtctgacaacaaaatggggacaggatggaaaagaagtctctttagagtcatcagacttgcattcaagtcttggctctcccacttgttgtcatgggctcttggccaagcaagccatttaacctcgatttcctcatctgtcaaatggggtgaagactgagtaggagaaagtgcattgaagtgcttttagactggaaagtgccgaacaaatgtgaccattagttgtctctcagatggctcaaagaaaggtaccactagatgggtacaggcaggggtgggaccatctcgcaggagtgaagaggattagggttcaggttgagttgacaccaggaagctgttagaactagttcttgaggaaaaagggaatagggtttgaaaaacaagaaggatgggaccagagaagctgaccaccctttccaccttgttttggaagagggtggatgctgaagaacagagccagggagaagcaggaaggtgggactggtcaggttgggcacagcctgccctgacacagcctcttccctctctccaggtcccctgcaggccttggcccctttcctcatctgtagacacacttgagtagcccaggtaagaaaagctgaagctagagcgttgaaaatctagtaagactgggcattagagccccaaagccagcctatggaactctagtttctgccatgtgctggagagaatatcttggctatcaagagctacttacctgtgaccagggggtccagggatagatgagggtcagagatggaaatagttagatttctgctcctacagggagctcagaatgctcttccttcccctaggagagccccagcttgaacaatagttagttgttccttttaccctggcaggtttgctaggctgctcctctggttaaggggtaacctcaaagaggaagggactcactggtaactcctcttgactcttgagcatggtgctaggttttggggctcccactgaaggggagagcccagggagggaagggaagaatgggcagatgggagggcagccagcttctgctcactccaggcacagccatgggagattcggagatggcagtctttggggctgccgccccctacctgcgcaagtcagagaaggagcggctagaagcgcagaccaggccttttgacctcaagaaggatgtcttcgtgcctgatgacaaacaggagtttgtcaaggccaagatcgtgtctcgagagggtggcaaagtcactgccgagactgagtatggcaaggtgggtgtcaggctgatgtgagagtccaccctggccacctgtacacctgggtggacagagaggggtacacccatgccccatgcccatgcagacctgaggatggtcccattctccttccctttggggaagaatccagaccctccaaagagccctctccttcccaatatcccttctgtcttccctgtgagatcctggttccttctctcttgagcactattgccctgtcactcaccaactcctaaccctcttgaggaaggagggaaagcccaggctgacaggagggcttgggtgggggctcttgcagacagtgaccgtgaaggaggaccaggtgatgcagcagaacccacccaagttcgacaaaatcgaggacatggccatgctgaccttcctgcatgagcccgcggtgctctacaacctcaaggatcgctacggctcctggatgatctacgtgagtgctgcacctggccctacgttgggatctctgttcttgctccatccatgtccaccccaggagccaagagtgtcttctgtttgtgtctaggcagggttacactctaacctcgtcccaacatccttggttcaattccaacactctggggactggcattactcagattgagtgcatgcagaggttttcctttctcttctttctctcctgggatctttctctaactcccaaaatcaccagccctcccccttcgcaactggcaagtcactgctccttttctatccccagacctactcgggcctcttctgtgtcaccgtcaacccttacaagtggctgccggtgtacactcctgaggtggtggctgcctaccggggcaagaagaggagcgaggccccgccccacatcttctccatctccgacaacgcctatcagtacatgctgacaggtgagaggccctggaagggtcttcctgaagggaactgggataggccgggagggagagggagaaggaagggagaagccccacgagagcatcctgtgcagctcctgacctttcctccccaccctctccccacagacagagaaaaccagtccatcctgatcacgtgagtgtagctgctactgtattccctttcagaatctccctgatcccagcctccagccccatcaggtgtcccaggccccgaggcatagactcagcctctttccccccaacctcgtgcccatctccttcttctctgaccattaccctgacccctctctttgctctccctcttcctttctgctttccatccccttcatgtttttcctctcccacctccttcacccactctccaactcatcacgcgtttatccagaagctcattatcgccatgtcttcacctctgcattttctttcccttcagaaacatttcccattcttccagccctaccaacttttcccaaaacagcccaggcccatctcccctgtttactttgcccagccaagcacaggctcagcctgcccaaaccagtgccttctggtggcatccttcctggtgtcagccctgacctctgtgcatcagaagacagttgtggattttgggtgtagataacctggcagcttcttgcccagggctcctactctcgggtaggcccaggcattctctcctgatttgaggcttgctggtctccagtagtattgttcactgcccaataagcccctgtcttcacagcggagaatccggagcagggaagacagtcaacaccaagagggtcatccagtactttgctgttattgcagccattggggaccgcagcaagaaggaccagagcccgggcaaggtaggcctgctgccctccaaggtcctgtaccgcagaaagggagggagaagagctctcacctgcctccttcttggcctctgcagggcaccctggaggaccagatcatccaggccaaccctgctctggaggcctttggcaatgccaagaccgtccggaacgacaactcctcccgcttcgtgagtggtccctgaccttggccttgggacttggactggtggaggaatggtctcagatatgagccttcccccaactcatcaccactctcttccatctctccaggggaaattcattcgaattcattttggggcaacaggaaagttggcatctgcagacatagagacctgtgagtgccatgaatctgctaggctcagcctaagctcacccttgctctagaccatctggtcttgacctctctctctctcccctccctccctctgtttttctcctctttaagtctctgtctgtaggtgtctctgtcttcaggtctacatatctgtctctctctgagacttcctctgcatctttctccatttctgtctctgcatggctaggtgtctttctctgggatttctctctgagactatttctctccttctgggtctctgtttccatctctctgttgtgatctctttgtgtctgtccaactagtctctctggctcttcccttccctctgccttttgcttgctacatttatcattaattttccttgtgcccaaaccctaacttttctttctctccttcttctccccacctgttcacagatcttctggaaaaatccagagttattttccagctgaaagcagagagagattatcacattttctaccaaatcctgtctaacaaaaagcctgagctgctgggtgagtcagagccaccgactgagaccaactatctccatggcaacctggtcccctctgcttgtggctggactcagctggcatgccctgggtttcatggcactgctggattcaattcagctgggatgtggggccaagccaagccctgtcctgtgctcttcctcaggccatgtgctgtggcgagcagcctccatgagagccgggggcttgtgtcccaccctaaccatgttttttcccctagacatgctgctgatcaccaacaacccctacgattatgcattcatctcccaaggagagaccaccgtggcctccattgatgacgctgaggagctcatggccactgatgtgagtgtgtgaggacccagccagggggtgggaggattggcagtgaggggcaaacaggggtccaaaagcagagctaagacgctggccattggttgtttaaagtggtatggacctcctgagagccagaatgtgccctgtgatcagggtgtactggggaatggatgaggtgagacaggactggccagtatctggtgttctatcaaaccaggaagagctgaaagccatgagacagagagacacacaagccaagaaacaagcatcaccgagggagcaggacgaggagggaaggccatgcagacggcatggggctggaggggctgttaggtgaacagatgcagacaggtatggaaggccaggcaggaagcaagtgtagggccaggaagcataagtgggtaactcagaaaagctgtggccactgacactggggctgcggccaactgacgtctgctctgctcttgcatcttacatcctttgttttggagttccctgcatcttacatcctttgttttggagctccccactgggtatgggagtctcagaacccacagggattaaggagacaagttttctctccaacttacaagggatctcacttacccatcatacttctttttctggggtccgccaatatggggcctccctacagaacgcttttgatgtgctgggcttcacttcagaggagaaaaactccatgtataagctgacaggcgccatcatgcactttggaaacatgaagttcaagctgaagcagcgggaggagcaggcggagccagacggcactgaaggtgggaggcagggattcttgggggcagctgtcaagtcatggagggccatgtctgctcagcagtcatctctcttctcttttttctttttttttttttttgagatggagtcttgctctgttgcccaggctggagcgcagtggcacgatcttggctcactgccacctccacatcctgggttcaagtgattctcctgcctcagcctcccgagtagctggaattacaggcatgcaccaccatgcctggctaatttttgtatttttagtagagatggggtttcatcatgttggccaggttggtctcaaactcctgacctcaagtgatccgcctgccttggcctcccaaagtgctgggattacaggcatgaaccaccacacctggccagcagtcatctctttaccaactttgctacttgccttttccttccagaggctgacaagtctgcctacctcatggggctgaactcagccgacctgctcaaggggctgtgccaccctcgggtgaaagtgggcaatgagtacgtcaccaaggggcagaatgtccagcaggtgggtccatcttcagatgataatgggtgggcagggtagggagactggcatggtgggatgagagttttcaagttcactcttcccaacaaccctgctcaatatgggtctctcctccaccttgcaggtgatatatgccactggggcactggccaaggcagtgtatgagaggatgttcaactggatggtgacgcgcatcaatgccaccctggagaccaagcagccacgccagtacttcataggagtcctggacatcgctggcttcgagatcttcgatgtgagttgggacccctgggagtgggagaacaatcactcactcgctcccacattcaacagctatttgcttagagccagctgtggaccagacatgggaaggcagtggggactgtgtggtgacagaggcagtcattttctctgtcttcaggggaagccctccttcactgccttgacatggaggggaccagccacgccctgctgggctcaggcacagtggacgggcacagccccaatggccactcacacccactttctgactgctcccacccctcatgccccctgcagttcaacagctttgagcagctctgcatcaacttcaccaacgagaagctgcagcagttcttcaaccaccacatgtttgtgctggagcaggaggagtacaagaaggagggcatcgagtggacattcattgactttggcatggacctgcaggcctgcattgacctcatcgagaaggtgcctctttggccttaccacctgaattctccctgcacacccaacaagaacaccatagacaaaatagcagcccctctcccttctggggaatataaaaatagaaggggctgaaggatccgagcccttggttccagagcctatgttgtgctgagcacccaggacagggtggcaccagggacagctgatttcccaggggcttgaaagtggacacatggaggatgggcacctgcatgatgacctcccacacctgcatgtttattgggcctggtttatgcatccaaggatcaggaagtgtgagggtggtgtaggggatcataagagtgcacctattttcaaccctagcatctcaggcatctgggtcgtggagtggtgtgtacagcatcgatagaatccatattcccagactttcacaaaggtccttctgtcatcagacaaaatcctccaccttgaaccggttccagtcagtagataactgtactcagagctgagcctactaccttaacacccaacatggcacctccacgagcaagtatattgaccatagagcagaatccatgtccacctgtgtgaaggacactcagtgatgctctctcctgcttcctcagcccatgggcatcatgtccatcctggaagaggagtgcatgttccccaaggccaccgacatgaccttcaaggccaagctgtttgacaaccacctgggcaaatccgccaacttccagaagccacgcaatatcaaggggaagcctgaagcccacttctccctgatccactatgccggcatcgtggactacaacatcattggctggctgcagaagaacaaggatcctctcaatgagactgtcgtgggcttgtatcagaagtcttccctcaagctgctcagcaccctgtttgccaactatgctggggctgatgcgcgtaagtagggactgaggctcccggtacagaggagcagggattctgccaaggttctgagccaggtcaattgctacaccccaccacttcaatgtcaggttgtaccccaaggtttacagactcagtgggatggaactgggtgaagaaactgaggcagccacattgaaggccctcacccaggggccaaatgccagcaaggatgtaaagaggggctgtgattctttactcacaccctacctccccacactgatgcttcttttgttgactctccttcctgcagctattgagaagggcaaaggcaaggccaagaaaggctcgtcctttcagactgtgtcagctctgcacagggtgagtgggacacagccccagccaacttggctccccatctgcccaaccccacccagccccacccttccctgccttgttcatcccctactcctcccgttccctgtctccttggtgcattcgggaccattttcactctgtcttctcttcccgtcatctcctggcctcttcacttatttacttcccatctcccttctctcctctttcccttctgtctcccaccctctctccttatccctgtctgcccccagggccccttcatctctgtgacttctcgaattctctccatctctcttttccttccttcttctcctctcttcttcctgcatctctttctggcattttctttacttttctctattgcatttttggccacaggaaaatctgaacaagctgatgaccaacttgcgctccacccatccccactttgtacgttgtatcatccctaatgagacaaagtctccaggtgaggccacaaactcaggccaacccactgctgggcatacaccgccctgggaacaggacctcctaggacatctccctacctaccaccacagtggtttccaaaccacattcttctcctcccatcccgcatgaggcctcccagggtacctccctctcagcgctaccttgcacttgcagtgtgtaatgagggtgatgtgtaaggcactctgatggacattacctcatcagtggccctacaaccccttggatagctggttgtccaagacagaatcttagttcaactttaaatttacctgcagaaccacttaatcccccaatgagacatattcaaattgttaatccatttttggctaattaggagacagaggctcagggacctgggttcaagacctggctctgttcttgatcagcttagtgaacttgggccagtcccataacccctctgggcttaatttactcatctagaacattggatatatctgttctggctaccacctatgataataggtgtgaatcatataaaaaaggaatgtgaaagccttttagttaaaaatgtggctagaagaaaatgaaacaaatgattattactaactgacttgctaagattacaagctaatcagtgacaaagccaggatcagaacccagaacttcagtccagtgttctcacagactcctcctacttccttcttgccacaggggtgatggacaaccccctggtcatgcaccagctgcgctgcaatggtgtgctggagggcatccgcatctgcaggaaaggcttccccaaccgcatcctctacggggacttccggcagaggtgggtatgagggtgcaccagagctcatagaacagggggagccaggctgccctgatgggaatgggatctgcaggtgaccctggaattctatgggcagagcagatcactgcagagcatgggtgactctggacacttccctcctcaggtatcgcatcctgaacccagcggccatccctgagggacagttcattgatagcaggaagggggcagagaagctgctcagctccctggacattgatcacaaccagtacaagtttggccacaccaaggtgaggaaaggagactaattaattaaaggaagacatctcttttccattgactcctctgatgcttttcctgttgtaatcatcttagcaaaatctcttacctgtatgctacccctcccagtggaacatctagcaccactcccctcatcccagctccagctgccattgacctcctccctgcaatccttttctaggctgttacccttcctaaggtaatccccaccatctctttccctcgtacccctccctagtcatggccaacacacaccttgcctgcaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtaggtgagagatctcaagaggaggtttcccgcttctctgaggcccaggctggttcaggggcagtgtcaggaaaaaaagctcagcagatcttcaaacacagagacctgcaggaggggctcatatgaacacactgcagtcacagggtcagaggcctcaggaagggtgggagggatgaaggaaatgggatattcccaaggtttcaggacctcaggtaggaaggaggcaggaggctcagcactcctttcaatgggcccctgcagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggtgaggctcctgggctactgttggctcttccaccctgctctgccttcacttcccacaaccctgcacctccctgcacaggggctcactgtcttgttccttcagtcagaggactctgggatcaacacttctaaagacctccaaagaggtccctcaggaggaggaaagggcagagggaaaagagctgacttttaaaagcacaggctttctacttgggttcaacctagatacacagcttaattattttgtgaccttgggcagaccatgcatcatctttgagcctcaatttcctctagacagggaataaagctgtccatttcattaagccatcatacataagtgcttggcatcagcaaatgcaattcccacccttcgatggaggagaccagaggaagaggtccagatgaagatttctggttcctttcctctctgctcccctccccagtgttcccaagttatactatcctgaaactcttcccctccccatacttctgaagctcttgccaagtggggatatcctagagttaccctcctatttgagtgatgtgcctctccttccctctacctgcaagaatgaggaccttaccccctgaacagcctcccctctgttcctcaccttcaggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtaagggcagctccctttggctccagcccgggtctcatcaggactctcagaccatactgaccttgacccaggctagccactcggcatccagagagcagcatggaccttgacatggagctccccacagatggcaccaagctggtgacctttgaccctaaaggagatgggattcttggtcggcaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatgtgagtagattgagagttgtggggcctagatatgccatgtctatctgtgcccagagctctgtgtgtgtgtgtgtgtgtgtgtgtgtgtgtgtgtgtgtgtgtgtgtttgtgtttatgtttagaggggggtagggttagaggatgttaacttttctgatatctttctagaaaggagctggggaatgaaaagtcagaggtggtgatcaattctgaattatgtatctaatctcactggtatgatcaataatagagatgagttttcttatttaatttaagtgcaatcccatatatctctgcctttgacacaagatttagagggtcatctcataagaacatgataaatttctttggaaattttgtgaggctccccaagtagaatttttgaaattccaatatttaaggcagaatctgatcattgttccctctgatgcacatatgtctgttgactcacttatcactctgtattttaattatttaagcttctatctcagccataagactacaagcttcctttagataggaacttagatctattcaatttggggactgcagtgcttagcacagagcctgatgcccagtaggtgtttataggatgctgaaagaatgaatacggcggccagccgcggtggctcacacctgtaatcccagcactttgggaggccaaggcgggtggatcacgaggtcaagagatcgagaccatcctggccaatatggtgaaaccccatctctactaaaaatacaaaaattagctggatgtggtggcgtgcgcctgtagtcccagctactcaggaggctgaggcagaataatcccttgaaccagggaggcggaggttgcagtgagccgagatcgcgccactgcactccagcctggcgacagagtgagactccataaaaaaaaaaaaaaaaaaaaggaggaaggaaggaaggaaggagagaaagaaaggagagaaagaaagaaagaaagaaagggaaagaaagaaagaatacggctttggggtttcatcccacagtcatttattcctttatctataaaatattgattcagcatcccctatatctaggcaatctcacagtcccctaataacatttggcccactctggggaaggtttcccaagtcctgaacacaaagatttaccaagtcctgaggtaactgaacaacaaaatcaccaagtcaggatgctttgcctcactgggcctggctccttctctctaccagctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaagtactgtgtcccctccctgctgcccttcctcctccccagcccataacagtacaagcagacccaagacagccatcctctgaggcaacaacctcacgcagcctccacaagtggaggcgcaaaccatgggaaaaggcctcccaggcaagggctttcctcccctagtcccagatatcagggttagttagatggtcctccctggcaaaaagtccattgtatcccatgagtcctttcttcttgttaggcactcagtgggaatgaaaataacagccttcccccttcatacacatctctctttggagaccagttccttgacatggaggaaggctccacatgagagcctcttaggaaagtccctttgtggcttttcacagagagcccacagggcaccaagaaatgccctcacattaaagaagtcaggggatcagggccatttctttgttttgcttaacttgtggttccaattcttagtgtaagttcttccaaaatgtatagactttccagacttggtaaacagtgagcttgcagaacatattttgataattgaaggtcttatggtgtttcaggctcaggactttgaaaggctttgagaatcatcataatctacatcctcatcaagtttgtgtttgcacaggaatcttcataccttcccaggcacagaatgtgttgaataaatgaataaatacacgatcctatttgattctcaaaacaccttttaaggatggtatctttaatttcactttaccaaagaggaaaataagtttcagaaaggttagctgagttacccaaagcaatagtgacaaaattaaagaccatcagagctaaaaaggacctttgaaacaatctagtccgaccccctcattttacattatgagaaaacaaggaccaaagatgggaatgtcctgtagagcccaggccccatcaccctgtctacagcactcctcccattacattcttgttggatttcaatctcaccgcaggtgttacacttccagggatcctacatcacccccagaagctgtttttctaatgaaatcctactctttacctgtatcattaccattttcaaccactggtggaccctcctgaggccccacgagtctcccttacctcaccatccctccttccccacagaaaagactttgagctgaatgctctcaacgcaaggattgaggatgaacaggccctcggcagccagctgcagaagaagctcaaggagcttcaggtgaggtctggacacccacgcgggatgctgagtccctgggctggttctgtttcccctgccccctcctctagggtgtcctgttcacagcattacaggaactgattatgtgtccatggaggcaggcacgcagctatcacagtgtgcccatggatacatccaaaaggggtcaggtgatccacagagaccctgaaaaggtcacaggcctggagggcagaattcctggcttcctgtctcagctctgccttagttgggtgacctctgggagcccactccagatctctgggtctccatgccctcccctgttacatggaggtttttaagagtccttcgactctgatggcatgactttcctccttactctagagcagaagctgtgttaggtctttagttgtctggtcagacaaatacggctctctcattttcaacttttgttatttttttatgactaaactgcttaaaatatccccagaacacaggtctctttgtccatctttaagagcaagtttcaaccactttccttccaataaagagcatgtagactgtcaggccctcgcctaaaggaaggctcttcaaactatcttccccaaatcctttaattcccacctctccactggaagagctaaactgacttgctgttccagagaagccgagagccttttagagccggggggattccagtggaggggtccaggcggtgggtctgagccctttgtgtctgaccaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggcaggctctgctcggcctcccctcctccaacttcctcctcccacctcccctttctgtccatgtagtgtctcttccttcatggttcattttcccacttcccttcctctgcctggttctcagatcccctccttcttttcacaccttccctcttcttttctccttcagttgcacctcttacaccccttcattccccccgcccccaacatccatcatataactctccttcccttctcaggctaacctggagaagatgtgccggaccttggaagaccagatgaatgagcaccggagcaaggcggaggagacccagcgttctgtcaacgacctcaccagccagcgggccaagttgcaaaccgagaatggtgagcctagagcaggggctccatggttcccaccacagtctccccaacctcctgagccactccagcctcgggcacaagccaatacacgcacacacagacacagagtctctccagaaaatggggcctgagggctagaggaggaggtggggatagagaggagtgctgatctagaatggtgcttccccaggtgagctgtcccggcagctggatgagaaggaggcactgatctcccagctgacccgaggcaagctcacctacacccagcagctggaggacctcaagaggcagctggaggaggaggttaaggtaagggctagactcgggccacctggcccaagcaaggagcacactgactagccttgcatcaaatcacttcccttcccagcaataaggctggctgtggaccaacagttctccaagaattctaaaaagaaatcacagcccaaaccctgccacatgccatctactccccaggctgaggccctctgcttctgctgcatccctggacgggaggcagggtgtgagaaggaggagagaaaatgaactagggaggcacgagatggccttgcccgggcacggctaggggatgtagggactgcacaaatgggtcctgggatttgcagggccacctgaaaactggagaaagaaattcaactggagcctattcctagcactttgctggactcatgaaaaaggagaaagaacatgatttttaaaaaactccagggttcatactaacctgcctcttatagctcagtgatcttaggttagggaagtcccctaacctttctgagcctgtttccctctccccagccaggtaaaatggcggtgatgatgaccatgtctggtgtggggaggagctcagggccaatggccatgaagcttttcttaaatagttcactgctgtattggcattctttgttatcagcaaacagtaaaccatgacaggtccactgggggtttggacatagatgaggccaagggatgatgttgagattggggtgaggagaagggcaagggtggggttgctttatggagaaagctgaacccacctcctggtgcccacccctccccaggcgaagaacgccctggcccacgcactgcagtcggcccggcatgactgcgacctgctgcgggagcagtacgaggaggagacggaggccaaggccgagctgcagcgcgtcctttccaaggccaactcggaggtggcccagtggaggaccaagtatgagacggacgccattcagcggactgaggagctcgaggaggccaagtgagttctgagcagcctgacttctggctgaggcccctttgcaggcaggactcagcccagccccagcctcagcagatcccacacaggcgatgcttagctagtgtttgacaacacaggaggactctgccccggccccacctccttctcctctcagggaagctttttgctcgaattatgtttctgatccgaatataagacgaacaaaaggtttgtctgagggcagagtgcttccgtctggggcagggcactgtggcagggaaaggcagtggggagggctgcagaagcccatacctcctcaatgtccatagcgcagaggctgggccagggtcagagggtgcctgggtctccacgccctgctgggatcctctgcctgatgttctcggcccctgggacctgtcctcaggcttctccagctacacttctgaggtttcaaggattgtctttgagaaggttcatgttgtttcctcttgtccccatccacaccctccatcctccccaccctctgccaccctcccctgggcaggaagaagctggcccagcggctgcaggaagctgaggaggccgtggaggctgttaatgccaagtgctcctcgctggagaagaccaagcaccggctacagaatgagatcgaggacttgatggtggacgtagagcgctccaatgctgctgctgcagccctggacaagaagcagaggaacttcgacaaggtgggccctgggtgggggccgcagccagcatgcagggcaagggggcatgaggggttcagtgagaggccagagccatcctccttggaggtgggggaggagggctgagcccaggcaggtcctgagacagaccctggacatggggctgaggctggggggctgaagagtgagccttgtccccgggcagatcctggccgagtggaagcagaagtatgaggagtcgcagtcggagctggagtcctcgcagaaggaggctcgctccctcagcacagagctcttcaaactcaagaacgcctatgaggagtccctggaacatctggagaccttcaagcgggagaacaaaaacctgcagggtgtgctgggggcccaagaggctggggaggggctgcactggcagtgttcccatatggtgccacccaagggctccaagaggcgtctgggcaaagaggcgtgtccctccaactccactggacctcagcagccctcaaccgagttaccgtgttccccacacagaggagatctccgacttgactgagcagttgggttccagcggaaagactatccatgagctggagaaggtccgaaagcagctggaggccgagaagatggagctgcagtcagccctggaggaggccgaggtgtgtgtgtgtgcagggcacggggtgcagggagctgagctccaggcttttggtccctgttctcatcccccgctttgtcgttttgttcactgtcccatccccagagcctaggacagagcctggcacatagtaggcattcagtgaagatttgtggagtgaatgaatgaccagtcactgaactctcttcacataaacattttacccattgcatcttagctgagcttcccatttccacatacctcccggttcccacctctgcctccctctgttttcttttatactctatacctgattgcctctgtttccttggcaacacttttctcttcattttcctccttgtcttcatagctggctctcccctgtgagggcctgaatcactttctcttaggcttatttttattttctcttagattctcttttcctccaccttctgcttctttgaaccacttacaccactcttgaagtcacttcgtatccatgattagtgagcaggcccccaccctgccctgtgccctgactgtctgcctgcatcccctcccccaaccccttcccaggcctccctggagcacgaggagggcaagatcctccgggcccagctggagttcaaccagatcaaggcagagatcgagcggaagctggcagagaaggacgaggagatggaacaggccaagcgcaaccacctgcgggtggtggactcgctgcagacctccctggacgcagagacacgcagccgcaacgaggccctgagggtgaagaagaagatggaaggagacctcaatgagatggagatccagctcagccacgccaaccgcatggccgccgaggcccagaagcaagtcaagagcctccagagcttgttgaaggtactcacccagaggggactggcctccacgtggcctggcgaagcagtagtgtcttgatacaggcaccagattcctcctgcccctaggttactgcagggacctctgacaggtgcctttagtgaagggaaccgaggctggctccctgctcatgcccactctcctgatcctcaggacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccaggtgagcagctcccctgctcattcctgaagggagcacaggctggggctcagcaagcaaggcttgagagctatgcatagatgctcaatgcttttcctgctctgcccaaccctcccccaacccagaacaccagcctcatcaaccagaagaagaagatggatgctgacctgtcccagctccagactgaagtggaggaggcagtgcaggagtgcaggaatgctgaggagaaggccaagaaggccatcacggatgtaagtcccccactccaccgacccgatccagaccagtgtctctccgtgggctgggcagcaagtgtgtgaggacttgaccagaccatgtgccacctctctcctgcacacaggccgccatgatggcagaggagctgaagaaggagcaggacaccagcgcccacctggagcgcatgaagaagaacatggaacagaccattaaggacctgcagcaccggctggacgaagccgagcagatcgccctcaagggcggcaagaagcagctgcagaagctggaagcgcgggtgcgggagctggagaatgagctggaggccgagcagaagcgcaacgcagagtcggtgaagggcatgaggaagagcgagcggcgcatcaaggagctcacctaccaggtgcgacgggcggtgactccaggcagagccctggcaccatagccacagtgacaaccagctgaggagaatgaagagtttgctcttagcctcttccagggcgaggatgggaatgcagcccccgtttcactttgcctagccctgccccactctgaatgtcccctagctcagaggtcagtctctgagcctcctggcctgggagctccatctcaacacccactcttagcccatcgccaggggacacacacagaattccagacaaagctcacccagtacagctcaccagaaagcaaatatgtagccagggtcacccccaaaagacaccaaaaacacacccatcccattcaaacaagcataaaaactttttcattgcccagggcagtgtggactctagctttctgaggtgttttctagaatcagactctgaattagaatttgtttcttttccaatccaggatgtcactatccctctaagcacactttgtccttaacttagattaagtcagtgttttcctggcctgcattgcagcccaggaaattccatcacactcatagccccaaagtcactcccagcatgtgccgaggtccagagcaggggacttcatcccgcatggggtccccggaccctgaaaaacctgctccctggagcactgcacacacacaattttgtgcataatttcaggagtcccactagttctttggactctttcctggtacagatcatttaaaatatttacacatatttggtaagaaattataaggagaattcaagtgtttagtgaggatcagaaagtagaattgggtcaggatatcagatgaagcagggcagggcggaggggatgctaccttctatgactgtgccatcttcaccccctgcctaccctctggcccccagacggaggaggacaggaaaaacctgctgcggctgcaggacctggtagacaagctgcagctaaaggtcaaggcctacaagcgccaggccgaggaggcggtgagtgaccctgctggggactaggcccaggggaggcataggagagctcgtcccccaagccaggagtctgagaacccaggccccctctcacctcatgctcccacctcccgcaggaggagcaagccaacaccaacctgtccaagttccgcaaggtgcagcacgagctggatgaggcagaggagcgggcggacatcgccgagtcccaggtcaacaagctgcgggccaagagccgtgacattggcacgaaggtgggtccctcttttgggctttgctagtcacccccacagcaggcatacccagacagagcaccctcaaacccgggatgcttccttttcatttattccacacacttgagccacatggccccagaggccaaggtaatgcagttctctgtgatttcaaggattcttccagctctaactttttttttttttttttttgagacggtgtctcactctgccgcccaggctggagtgcagtggcacaatctcagctcactgcaacctctgcctcctgggttctcctgcctcagcctcccaagtagctgggattataggcatgtgctaccatgtctagctaatttttatattttagtagagatgcggtttcaccatgttggccaggctggtcttgaactcctgaccttgtgatccactcgcctcagcctcccaaagtacgggattacaggcgtgagccaccactcccagctcagctctaagtttcagtggttctgggaatttcagccttagggaggggtgccaccctagaagaccctaatttatatacaaccagtatatcccagtttccccccaactgctagtttccagttcccttccacctaattttgtcctgcaatcttgtaactcaaacctaaaatggacatcccagagaacccgggcctggctttgttctcgcccaggcaacttccctctgaccaaccccagaaccctaccctccagaacttgccccccgaacatcgatccctggaaacacatgtgctgctgccacaggggcttccacctgcccacaaagcaggccccccaccatcagacccctctcacctttgttcccatgccctgtccctgcccaataccatctctccaaggactgattggactttgtttcctttcaaaagggcttgaatgaggagtagctttgccacatcttgatctgctcagccctggaggtgccagcaaagccccatgctggagcctgtgtaacagctccttgggaggaagcagaataaagcaattttccttgaagccgagatcctgactccagactcttcttcactgccctgaggacccggggatggggtctggactaggggaggtggaaatgcaggggagtgggggcaaattcaaaggcctggcctaggaggccttcgtggagcagcactgaaaacccctttcacttcccccaaaccagccaaatgcagcagaggcgacacctctcctcccagccttctccctggtccagccaggatttaaaggagatttagggagacccctaaagttcacctagagcaccctgagcccatctactgtggacctgcaccccagcttccgtcaaccctgccccacccaccaccatggatactgcccagggctgggcaaagggcagcggttcggggtgtgggtgctggccagtgccctttctgagcccgcagaagtgtgaaccactgggccaggtgaggcaatggctgcctaagtgccagtcccaggcgagtctctgagagtacacaaggattcacagctgtagcctgcatccccttttaaatagagccaccaccctctccagccaccgccagaagccagcataccccctgcccaccacaggtgggagaaacacaccctcagcccacctgccgtcctcctcagctcctcctggtgccgagcccccttggcccagggtgctcccttcttcccactcatttcttcccattgtaattcccattaccaagccctttgtcctctgggcttgtgggaagatggggttctcctggcccatttatggcaagccatcttgaggggaggcagacagatgaggggctggggaaggttatgtgtgaacaggactctggggagagggagggaagggatggctcccgagagggccaggaggtggaggaaagagtaagtctcctccaactaaacaagttcagcccctttggagttcctgccacagctgggttgcttaggcaggcctgggactgtgggccacagaggtcaggggcttgaaaggcactggggctgtcggccccactgggaacctgggaagcagtggttcagccctggactggatctcccccaacccaccaacatacccactcggagcccactcctgctctgtacccagctctgagctcggagctctgaggactgcggcagccagagccaagggccctaagccggagaaggagaaaccagtactggacaatagcaggtgacagcagaggagaaaaagggggtagggaggggacaaggaaagacctgagggggtggcagtggacaaagagattgagcaaccacaggacaaggtaaccagaggaaacagagacaaggaaaaaagatgcaggaaatgaggaggccccagaaagatccgcaggcgccgccacctttctcctcatagccacctccattctccttccctaggccaacccagacagagctccctcaaaccagggatgcttccttttcatttatccagctcaattgaaccacacagccccagaggccaaggtaattcagttctctgtgatttctaggattctttcagcctttttgtttttgtttttgtttttgtgacggagtctcactctgctgcccaggctggagtgcagtggcacaacctcggcttgggccgagatccctagggccattcctctggctaggaacagacttggacagcaatgaagagataactagaaacaaaggagagaacccttgaaaagggagctatgcagagagacccagggcacctaagcaaccagagcaagagagaccgcaagagatacagatcctatgagaatggtcgggggctggatgcagacagcagggttgagagaggtctgagagccaagccagggagaaggaggggtgctgagggggatggggagagaggaaaagagagggagccttggagggagaagcttgaagagctgcgggtggtgatcccgagtgaaggaaagaatcctgggtcacttgcaaatgcaaggagagtcaggaaggcgcaaggagattggagaggaggaagagcctggagcaa

SEQ ID NO: 16801 - DNA, 9293 bp, Human
tccctctgtctgggtcgtctggctcaggccagcactgcccaggctctccggggctggtcagttcacggggaagcctgggcagctgtggatgacaggggaggaggggtggggagggagaatggctgggcgggcctccagaccccttcatccttggttctgcttgggattccaatttatattccccattccaagatggggacactgaggctccagccagtgaaggagagagccagggccccctcttaacccccacccaatgccatctcctgcagcctcagtgggtatttggggaggagaagggcctggggaggagtcctctcaacaaggagttctggtttgggtggggacagtgagtcaagagctgcagcaggcatgggtggcagctctgatggccccacagccccttgctgcccagctccatggaacttttccccttgaaaacttttccctggtccaggcagagtccctccacactgggtgagttggggtggggtgcagggaacgtgggggagcctgtatgaggagtagggtttgcaggtggagtgggatgagtacaaccaagcagtcagagagggaagccgaacccctcccccaagagcagactcctagaagccgtgaaatagtgggctgactggggccacgggtctgggggttcctttctgcagtcagccctgaggtggcagcagaggaatcccagctcctccttccccaaagtttctgaagcgccacggggggcgaggggaaggggcaggtccccacagtatggggaagctgctataagtaggggagtgacggtgcatgtcagcgcccggggtcccctctgcagcccctcccccagacacgcacactctggcctctttgaggcaccagggatgccttcggctgcttccttctcctgtgagcggagttgctgcttccttctcctggggcgcggctccctccctgcctgctgtctgatgtgtgtctcgctcttggtgggtcctcagcctggcgctggtggctgcttccctggcctgtgggtgtctgtgtatctgagtgtgggcatgtctgtctgtctgccctcagtgtttcaggaggaatctgtccttgacccggtgtatctgagcgcatgtgtctggtggtgggggcgctccctcctgccacctctcctctcctcccccgtcccctcccacaggcgctaacacagccaccacctgcgccctgagcgcagtgacctcgtctgtccgctgcagtggcgactgcccctctgtccacaggggtccgtggctgggctccgagcggcttgctgctccctcctcagcctgaggccgccggagcccaggctagacgcgctcccctccggctgggtccgcccggcgcctcatcttcccttatgtaactccacatctgcctgcgccttgcgggtcaccctggaccctgcactgggccctgtccacacggaggctggcacccagggtccgtgcaaacgggaggtggagcggacccctggtctgggcaccggctttccaagaccccctcctccccatcccttctcctccagacgttccttgccccggagacccacattcccaaaacatgcaccgaggaaatgccccgcagggcaagtccccggagcgcgggtgcaggcgtttcccccacccccaccccgggtccccacaggcgccagggctctccatgatgaccgggcaggggtcaccagggccgagggcacgggaaaggccgagcaacccagaccccggctccgagtgcgcgggctgactgaccgcaggcgagcccccagacccggtcaagccccggccgggctcccagccagctgctgtgagcgcaggggctgggctccaggcagcctggcgggcacgcggcgctgtccgtggtgctgccggcgccgggcggggcgggggcggggagggggcggggcgagggcggcagccaatggcgggggcgctgcgcggggcgcgcggggcggtgggctgggcgcggggcgcactcggctgcgcgttgcgctccggctgcacggtcgcaccggcagcggctcaggctccggctcctctcccgctgcagcagccgcgctgccggccccactgggctcggatccggccccggccccctcggcaccgcctgctctggccccggccccggccccgcggaccatgcgctgggcgcccccaggggaacccgacccggccaagggcccgcaaagacgaggctcccgggccggggcccctcccggccgcccagctctcggccggcgccctgccccgcgtcccggagccgcgtgagcctgcggggccatggagcgcgcgccgcccgacgggccgctgaacgcttcgggggcgctggcgggcgaggcggcggcggcgggcggggcgcgcggcttctcggcagcctggaccgcggtgctggccgcgctcatggcgctgctcatcgtggccacggtgctgggcaacgcgctggtcatgctcgccttcgtggccgactcgagcctccgcacccagaacaacttcttcctgctcaacctcgccatctccgacttcctcgtcggtaaatccccagcccctggccgctggggacccaggggcgcccagcgtggccgggccagcggggactggaacacggacctgggtggctcccgcaggcacacgccccaccaggggacccggcctgggaagggggcgtccggagcccatggggtggggggcacaggcgaagttccttgccactcaggcctcgggacaggggctggggagagatgtccccgggaagggacacgggcactgggcgaggcgcaaggcgcaaaggcagcgggtgcagctctggctcctgcgctgtagccaaacaaaggctgctgcggacttaggacgcgcggagggcgcagtggggcggtttagagaaggtctgggggaggggacatggaagggggatttttagagctgtgttgggggaagggacggtggggaaggtgggggttgggggagacgctcggaggagcgtgctctcacgtgtccaggctctgctgccggctggggggcggggcacgcggagggggctggagcgccagacacctgttggggctgtgaggtgcgtctcccagacgctccaagcccgcttggcagtagtagtagcggctggcggctggcggctgcaaccaagtgccctttcagccaggagaaaggctttctccttgtctaagctgagaccgagggttgtccagcgccagggtaggggctggagtccagcgggggaggggagaaggaaattgtcttctttcctcctttgagggctgggagggctggacagaagtccagggaatcccgactccaggctctcgggggtcttgtggtggccagagttccccatgcctggatcatccctcctgcccccaggcccaggggacacagatagtgctgggagctatgtgggggtgaaggctggcggcagggcagagtttgtggctgacaccaggtggaggggtggtaagatgaggatggctagttccagaaaagcagccaccatgtgaccccaggtcccgccggtgtctgcgcttaggtccgtctgtcccctggcccctggctgcatggtcccactgtggccctactccccacaggcgccttctgcatcccactgtatgtaccctacgtgctgacaggccgctggaccttcggccggggcctctgcaagctgtggctggtagtggactacctgctgtgcacctcctctgccttcaacatcgtgctcatcagctacgaccgcttcctgtcggtcacccgagcggtgagtcctgggctgcggagctcctgttcactccgcagggacagtcgggacgcccatgggaggcacctgggtggggacggccacttctgagttgtgggcagaagtgggcttggtcccactggctttgctgctgacacatgggccactcgacggccagctgcccactcggggccatggctgcagccagactgacctggcccaggcaggagacggggaatctggatgcagatggtcctgaaggcagggctgtcgctgcagcccccgccctggggcaggtccacagtccccggagttaagggaggatctggggccagacgccctgggtgacatccctcccacatgcgtgtgtgcagcgtgcacacacacacaggccccgggaaggcaggcggcagatcctggctccgcagatttccctttgtgggagcggccacctgagtcagggaccctgccccacccaggctcccgcatcggggccatgcagcccagggagccgctgctgaagtcacaccttccccttctcatctccttggcagctcacgtccccagggctttatgagggcctctgcaggactgagggcaggttgtttggttctagcctagaaaggctaagagacagggtgcaaagagcatggctttgggttcctcttgagcccatccccctgtggtctctccctcctttcctggagccaccaggcatggggcacaaggagagctgccacgaagggtaaagcggccgagcagagagcctggcatgggggtgctctgcccacctctcattagcaatagctgtgaacattgctcccaccgtcaccaaggtaaacgccatcaggctggtgggggagggtggcaggggctctcaggtcctcctcctcgagctgtcctacctgagacccctcagtgggatcccttggccctcctgccccctgcccccaccagctggttgctctctgccctgaggagggccctgccctctctccctcttcttcccaagaggccctgatgtcgatctgggatgctttgttctgtggcggggcgggggatgtctcccagcagtgggccaacttgtggcttcacccctgcacctccagctcccaggggtgcgagcacctgtgcaggagtggggctggacctcccaccccaacctctgcagatggctcgggcctttgcaggatcaggatgcatcatgtcagaaacagctgtgtgtgcacgtggtctggggctgatgctgagtctggtcccaagggtgcaggggccaaggacaggacccccagggagctcacagctggtagggggtggtaaacaggcagcctagcagagagtgagggttcaggttggtcccagggagcttctgaggctctcactgagtgtggcagggcaccagtccgggaccccagtggggagggttagaggaagggaggggaaagagggagggagggaggacaggaggggaaaggaggagcattgctgctgagggaagggcccacataggggcccacaggctacgggggcgcacccagcccaatattccttccgccccgcccctgaccagcctgcccttctgcaggtctcataccgggcccagcagggtgacacgcggcgggcagtgcggaagatgctgctggtgtgggtgctggccttcctgctgtacggaccagccatcctgagctgggagtacctgtccgggggcagctccatccccgagggccactgctatgccgagttcttctacaactggtacttcctcatcacggcttccaccctggagttctttacgcccttcctcagcgtcaccttctttaacctcagcatctacctgaacatccagaggcgcacccgcctccggctggatggggctcgagaggcagccggccccgagccccctcccgaggcccagccctcaccacccccaccgcctggctgctggggctgctggcagaaggggcacggggaggccatgccgctgcacaggtatggggtgggtgaggcggccgtaggcgctgaggccggggaggcgaccctcgggggtggcggtgggggcggctccgtggcttcacccacctccagctccggcagctcctcgaggggcactgagaggccgcgctcactcaagaggggctccaagccgtcggcgtcctcggcctcactggagaagcgcatgaagatggtgtcccagagcttcacccagcgctttcggctgtctcgggacaggaaagtggccaagtcgctggccgtcatcgtgagcatctttgggctctgctgggccccatacacgctgctgatgatcatccgggccgcctgccatggccactgcgtccctgactactggtacgaaacctccttctggctcctgtgggccaactcggctgtcaaccctgtcctctaccctctgtgccaccacagcttccgccgggccttcaccaagctgctctgcccccagaagctcaaaatccagccccacagctccctggagcactgctggaagtgagtggcccaccagagcctccctcagccacgcctctctcagcccaggtctcctgggcatctggccctgctgccccctacccggctcgttcccccaggggtgagccccgccgtgtctgtggccctctcttaatgccacggcagccaccctgccatggaggcgccttcctgggttggccagagggcccctcactggctggactggaggctgggtggccggccctgccccccacattctggctccaccgggagggacagtctggaggtcccagacatgctgcccaccccctgctggtgcccacccttcgcagttactggttggtgttcttcccaaagcaagcacctgggtgtgctccaggcttcctgccctagcagtttgcctctgcacgtgcacacacctgcacacccctgcacacacctgcacaccgtccctctccccggacaagcccaggacactgcctttgctgccttctgtctcttgcataagcctcaggcctggccctttcacccctcttcccaccaactctctctgcccccaaaagtgtcaaggggccctaggaacctcgaagctgttctctgcttttccattctgggtgttttcagaaagatgaagaagaaaacatgtctgtgaacttgatgttcctgggatgtttaatcaagagagacaaaattgctgaggagctcagggctggattggcaggtgtgggctcccacgccctcctccctccgctaaggcttccggctgagctgtgccagctgcttctgcccaccccgcctctgggctcacaccagccctggtggccaagcctgccccggccactctgtttgctcacccaggacctctgggggttgttgggaggagggggcccggctgggcccgagggtcccaaggcgtgcaggggcggtccagaggaggtgcccgggcaggggccgcttcgccatgtgctgtgcacccgtgccacgcgctctgcatgctcctctgcctgtgcccgctgcgctgccctgcaaaccgtgaggtcacaataaagtgtatttttttattggtgctgattcctgaggactttgtggggtgctcagagccttcgtgctttgaggagagactccagggagtccagaaaccactgagaagcaggcgtgaggatgagggctctgtgttttcttctaagtcgggggactgcagtggggatgaaagaccagcctgccacaccagggtttaatcccaagaagggtttcatgtgccctaccgccagacccctgcacttctcaagacctggctggcgggtgaggagatgcagcccacgccctgcacaggaggggcccgctctggccctgagaacacagacatgcagccttcctgcccccaggacaggtgcctcatctttcttggtcaggagcagggttgcaccccagcaaaacttgggacccagggaggatcatggccatgcccagcgtgtgcagggtctgggtggcaaagggactgcagtgaccagaggggagggattgggctagctggctggagctaggctggaggggctgctagaagggatgagccctggagcgaaggcatctttgggagaggagctgtcctggacaaaggcctggaggggggactgagggtgcaggatgaggacgctgggaggaagatggagggagggaaggtagcacccttcgctgtggcccgtgagcctttaatcccgaaggccgttgcacctgctccaggggccccaggagagggaggcagacaccagcccgaacccaggcagatgctggcccacacccaggtgctcagaggccacttggaaaccagacaagcccaacctaggtgagatgcaaactcggtgggccaggtgccacctcccccaacgtcccgtcccccagctccagcctccagggtcctgacgtctctgagcccactctacttccgacagtgcagccttgctaggcacgcttctgctcatatctttccttcctacccagggagagaatctcgccattttctggctactctcacagccagtgctgggggtgggtggagggtccacctgggcagggagacctgcatctccccctcaaagcaccgcttcccagccatgccggctctcagcactgcagaggggaagctaacagcaaaatgcctcacctccagacctttttcacgccctgaagctagaagctagacctgcacttttgttttccaaactccccggaaacttctcccagaatctgaagctccacacccccctccaacccccatccccactctccttcccccccatccctgctctcccttcccccatccccgctctccctcccccatccccgctctccttcccccacccatccccgctctccttcccccccatccctgctctcccttcccccatccccgctctccctcccccatccccgctctccttcccccacccatccccgctctccttcccccccatccctgctctcccttcccccatccccgctctccttcccccatccccgctctccttaccccccatccccgctctccttaccccccatccctgctctcccttcccccatccccgctctccctcccccatccccgctctccttcccccacccatccccgctctccttcccccacccatccccactctccttcccccacccatccccactctccttcccccccatccttgctctcccttcccccatccccgctctccctcccccatccccgctctccttaccccccatccccgctctccttaccccccatccctgctctcccttcccccatccccgctctccctcccccatccccgctctccttcccccacccatccccgctctccttaccccccccatccccgctctccttcccccacccatccccactctccttaccccccatccccgctctccttcccccacccatccccgctctccttaccccccatccccgctctccttcccccacccatccccgctctccttcccccacccatccccgctctccttaccccccatccccactctccctccccccatccccgctctccttc

SEQ ID NO: 16802 - DNA, 92344 bp, Human
  misc_feature (1)...(92344): n = A,T,C or G
ttctaattagttgtcaacactcaaaaattaaaaatcccgagatttaatcatcactttatatttctgttctttctggaaaactcagactgtccccctactgagctcaaggtgctccgtaggtgtacccacaggggccctccccgccatactcagcttgcttcattcatttcctttcctgccttctgggagccaaagttcaggtacaaaactccagctgtacgtttgcagtgatttcccccaaacactgttcccctataggggaggcacctctcctaggctccgtcctcaatgctcattggctgctgctgctgtcgagaaacaagcctggggtgaagtcccgtattccagttatcagtaagtccattcctttgcaaggctacagttcgaacaggcacaagggtccagttcgggtctgctttcgagactagcagtctcctttgttaaagcaattaaaaaaatcattttctttgtcagcaacgtcattcatcgtcccgaggtctctgcttattgcggcgctgtcttcagctgcgaagactgaccctgtggcctcttggccccagtgaggtccgaggcaaggaagcgtctctctgaaacctattctgggctcttaggaagaaatgagagaaaggaaaaccactagaaatgtccaataacaccatcttttggttggaaaataaaacacgcagaaagaggggactggaacttttactgaagtatttctagagagaaggtgcttgggaacactttaggtaacttactcccctcccccagcagaaggtaaaaaaagctacttccagacgtgccggcttcaggctcgggaacttcgtttggcgcctggcaagcaccgtgctcttacctacgggcttatacgacactcctgtctccaaggcagctgggtgcggggacagtcagcccggggcggctgggtttattgattaaaaatggagggaagggccaggggtggtcacgattggagggcgagaagagccgtgcgcgcaggacccctccccaccgcccgggaccggctgagccagaggcggacccagcttccccgcggcggcttggaggggccgggcgccggtccccgtccccagggcgcgctgcgacagtcccctccccgttcccgcccgcctcccaggcccatccactccagggcctgcgcgccgcccggccggcgccccggcatccccgcgcgctgttccccgggcctcggacgggccctgcgccgccgctgccaccgcgcacggcggcccgcccggcgctcccgtcagcgccgccgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggcccggcgcggcggctgcggcgccggcgccgggggtcaaggccgagtcgcccaagaggtggtgcaggcggcgcccccggcggcgcagaccctggcggccagcggcccggccagcacggcggccagcatggtcatcgggccaactatgcaaggggcgctgcccagcccggccgccgtcccgccgcccgcccccgggacccccaccgggctgcccaaaggcgcggccggcgcagtgacccagagcctgtcccggacgcccacggccaccaccagcgggattcgggccaccctgacgcccaccgtgctggccccccgcttgccgcagccgcctcagaacccgaccaacatccagaacttccagctgcccccaggtgagtggccgcacggggcgggagggaagggcggctcccagcagcgccagctgccagttccaggaagttctccgctggtggaatgctaaggtcatctgtcccgtaggcccgtggctggagcaggccgaggggcagtctctacccaggtgcggggccagcccgggtggctgtctgcgagtgagccagagggagtcggcatagcctgcgtccctgtcgctgtccctgacgtccgcgctggctgcctgtgcctggggctggtctgtttcggagtggctcagccaggactcttagtggagtggtccttacctgctcccgccctatgcgtccctgcccgggttggtaggctcagcgcaggggctccctgggccaggcgatggggtctgcagagctgagggcagtacctggggctgtgagtggcagcagctgtcccctgctcagttctgcagttaggcgtgtggcctgtgtccccacttagcctttctgccccttggtgaccctgggctcgagcctcttcagtctccaggcgaggacgggggcgcgacgccccctccttgaggctcgggaactctggatggaaggcttgggctcctctgctgccaccaggcagggagagatgtcaggcgcatcctgcgagagtcctcccggcgcgcagccttgctgagagccacgctgtggagtagggtttcagcaccgtgtgtgtcactgtctcttccagagctgcgttggtgcctaaaggaaggagcgcctagctactctggttgctgccccctcgggagggcagtgggagggcggtggcagcagatgttctcgctccgtgcaggggtctcggggcgatactggctatgctgcggatgcctggggctccgacgccacttccgcctggcagttctcacgctcctgtctagtctgctgtctctgcgactcctcagggcccctcaagtttgacaggaaagattgcctggccagcattgctgcttttgtctggggctccccgtccctccccagccgccgtggtgggtgctgggcaggggagctcctccccggcctgtggtgacgcgtgccgtgcagttgtagcagcgcggtggcagcagtagtaggaactgcaaggagagcgtgggtccctcctgcgtcccctctctgaatggagctattggtcactttgacagggttgcagaatcttcagaagtgaaaggatttcttgtccaagtatgtgaggttcggggctggtggtcagactctggacagggcaggggtggggaaagcctgtctgggcggctgctaggctgcagtgctccagggaggaagagagctgtgaagctacttcccggggttgctgagacgccctttacgacaagcttttggggtactgaagcgtttgtaggggtgttttgccagaggcttggttttgctgttatgtgtatgttgaccttttagtaggaaacgtggctgatctttagtaacgttgtaaaaagatgtttgatggctgtgatctattatgtaaactgtcacaatgctttatttataaaaatgtttttccagaggtcccacgtgtctcagcgcaggccaggtgcctgttgcacccctttgggtaggtattggactctgtcttgtggggctggccaggtcctcttgctctgagccactgcagaggtaaagcctcatctgtctctttcttctgggaggaggtgaaggaatacgtggttggaagagggcatctctgctgtgtttatcatgagtgatcctgggactcacttccatcttctgttttaagatcagttttagggtcgggtgtgtttgatgaagagacaacttgaaaaacaactgtaggagtgttgactgtgcgtgattcctgtgtgtgaggacagaggagcagctcacacagacgtttgggtggcagtgctgagagcggtgctttcaaggagccgaatgctactatctaaaaaagtgagagatttaccccatctcttcatggcctcctgcagttgatctactgatgaggaattttgattatgttatttgtttcaataataaccaaagcaaaaaaaaaaagtatcaataaaactaccagtatcccaaaccagagtaccttcttttgaacagtacaacttaattctgtaaatcagaatggcaaattgcaaatactctggttacttcctgtaatcgattgatcagagaatattaaattattctagttggttccgttttcattgaaatatttcgtaataaaaatgtttagaacaaagatggaagtaacttataaaaataactcttgcttggttaataactcattctcattacaactcagtcttgcaaactgaggaggagccgggagtattaggggtgggcagggttctcaaagctgcatgtgggtgtcaagtggagtagcagacgggtggcaattggatggggtgtgaaagggcctgcccttcccagccttccctccgtggaggtcttgggtgggagaagggaggggacagaggtttcaccctgaagtctttaaggctaagccttaggcccgagtgtttcagccccatagtgcacaccgggtatgttgaatttggtttaggtagctgtcatgatattctttgtcaggacagtgttgtaaagacagttatgttaatgtaattgtaatttgctggtttgaggtgccagagtttagattttattcactgaggaaaaatgagaaaactcagtctttagtgagattgttgcagatgacacagttgtcccaagatcacggaaaagcactagttatgtacagcttaggatagtcataacgtcatagtcaggttgtgattacagctgaaagaagaaaaaggtgatttgacacccacattagcatgttggtaaattgttgagagatcttttcagatcggtgtaaggtaaagaagctcatttctaaaggttatcttttggcctggcaaattcacattttcttcagtgtatcttggtctattgtgctttcatgcagaatttactctccttttgctctaagatttggcccaagtgtagattcccattccaggacagaaaagcactttctcaccatgggccttgatcccttggcctagggggcgtgtgcttgctgcatgttttaggatgagtactcccaggtgaatgtgtgtctgtgggtgctgtctggagcattggttcccatctgtggggaaagggggaaaatgtccactagcccttaatcgcgctgttgggacgggttggatttggcgagtccaggcccatgctgggtggcggcatgcagacggccacccctgaggttgcaggagctgtgagttctggtggccagtggtggcagccagtgctctggcacaagggacattcctaaaagtttagattttgtgacttgagggccctgttgccgtttgacctgggaggaatatgttgttcctcggagccttggcttacccagctgtaaagtggggttgcccttttggtgaagaatgtgaattctgtcaggttgggccagataacatagctgtcaggtggcgctcactattccaaactctcccagttcccctcatttttcactgattttcacacattaatccagactggatgttttctcagtgactgaggtgtttggtgtggcagctgactggttctgtcaatggggaagttaccgaggtctgaggtgggtcaccctggggcggtggttgccaacataggggagggttgcagtggcctttggaggcctggacctgggtggagggctcactttaggctagaggccttaatctggtgtttcttttgacatactcaggtaggagtgacatttgaaaagaacaaagaaaaagaacttttggggagctgtgtaaagacagccctggacagctctgcctagcatagggcaagggcgccgctctgggtcttcccttcctccctgccccctgccccgcggctggggtcgtcaccatcgccttcgggatgaacagagtcatcttggtgacaggttgggatggacctcacctgcctttggtgtctcagagctggtgaccctcatggcttagtggcagccaggagtcggggtcctgtgacgctcttaggagcctctctcctcactgcttactgtgcccgagcactgcattcacagcagaggtctatgagtttgaacagaggatgacgtttgaagttcgttacggttgccctggttcttagggcctgtgagaagctttgtaggagagggtgtcccgcttgcttctgtggcaaatggacctgaggcaggccccgggcgcctgggaagttggccttctcccagggcagagagcagagccaccctggcttccaggactgcccccgggctccccggtgtgctgtggaagttgccccttagacatcagcacagggaggccgggaggcggcgtctggtcagagcagcacagaccgggctcagcagaacagactggtgggcgtgtccgcatcccgaaatcagagtggaatggagacagttcctgttctacctccaaagccttttctactgtataatgtgagttttcttccacttaagggataaatttgaagaaagcttttataaattgttggttgtaagtgagttgatcaaagcataattagcagctgtgtttgaggatcttgaagcagaggtgtaacagggctctggagaagcttgcctgagatttggggtaatttgcagggttcccgaagtgctttgcttttcttcttcatggtgctcagtaggaacctccaagccctcgatcatccaggaaacagttgctgtttagggtgttcacctgtggtgcccggctcaggcagcgtgatggtggcgtttacttaatcaggcctttgatagcaataaagcagttaaataaagggggcttttggctgcaggcccttctgtgccgagtgctgtgcacctgggcttcctggacgcttctgcttccaggtgggcctgcggttgctatggcattgtggtgtcagctgcaaacacgtacacagctgttctttccaattcttgcgtggaataatgaagtagaataagtgctgtcaagttatgttcgaaaatggggtgcttaatatttccatggttggaccatgaaagttttgagtgaaaacttttgatttttacatatctcaaatgaacatttgcaccaaagatgtacagctttcgaaaaacaaagagatacatgttgtccaccatgaggcccctctcccatttgagaaagtacctggtgtccgctgttggtcagtccgcggtggtcccaggctcttctccaggcctgccttctgcctggagcaggccatgctgcagtgtgcaggatgatgtagtgaagtgcccccagcttctcccaccgtgggtgtcatgttgtggagcagaagttgtcgttgggaaccgcgtgtgagggcaggagaaattgtttgttgggagccgcatgtggggacaggagaagttgtctgttggggactgtgtttggggactggagaggttggccccccgagccccattgtctgtggcctggtgtgtagacctgtgtccgtccttcctgaggtcttgctgaggttggcccccgagccccattgtctgtggcctggtgtgtagacctgtgtccgtccttcctgaggtcttgctgaggttggcccccgagccccattgtctgtggcctggtgtgtagacctgtgtccgtccttcctgaggtcttgctgaggttggccccccgagccccattgtctgtggcctggtgtgtagacctgtgtccgtccttcctgaggtcttgctgaggttggccccccgagccccattgtctgtggcctggtgtgtagacctgtgtccgtccttcctgaggtcttgctgaggttggccccccgagccccattgtctgtggcctggtgtgtagacctgtgtccgtccttcctgaggtcttgctgaggttggcccccgagccccattgtctgtggcctggtgtgtagacctgtgtccgtccttcctgaggtcttgctgaggttggccccccgagccccattgtctgtggcctggtgtgtagacctgtgtccgtccttcctgaggtcttgctgaggttggcccccgagccccattgtctgtggcctggtgtgtagacctgtgtccgtccttcctgaggtcttgctgaggttggccccccgagccccattgtctgtggcctggtgtgtagacctgtgtccgtccttcctgaggtcttgctgaggttggcccccgagccccattgtctgtggcctggtgtgtagacctgtgtccgtccttcctgaggtcttgctgaggttggccccccgagccccattgtctgtggcctggtgtgtagacctgtgtccgtccttcctgaggtcttgctgggccctttgtgtcccccactgggcatcactggaaagcgccgatgtgaggaaggcacacgtggcatcttgatctcaaagttgtgagaggagcgtagccaggtagggtggtgttggggtacatggatcttggagggaccatttccgaatagtcaggaaaccccagaaacagttttttctgtctgtcaaatttgacattaggttttagaatgagggccctgcagtaagaaggtctgtggctcccaagggaattgtttcggggttggggtcagaggtctgagtggacagtgcgtggacaaggcaggacactaggagccagggagctgaacccttctctgggcgctgggtgtggcccaagcacacctggggcagaggctttgtgggtcagctggtccactgggggctgcagacactgtgggcagaggtgctgccggtggcaaggtgggcaccttgttccatggggtcgggggacacagcctttcattttctgactttgcagtaaagtgtgtgggacaatgacctgtgaaagtttttaaaggaagttctgtgtcttctgcggaggagcgtggtctccgtggtgttcataggagccacgcacggtgctcagagcatgcccagaacgcacaggcctgccttgctttggagctttgcagaaggttacgaatgtcagtgtcagaagcatcatgacaggaacaagggtgacacgggaagcaggctcgattggcttttttatgtaactgtaagtgtaaaaaattattagttacttcaacatgatttttttgatgataaaattagtttttttttcattataggaagtttgggaagtaaactgtaaagaagaaaatacagtcacttgtaacgtcacctggcccagactgctaaaatttcggggtgtctcacttcagcctgtgtctgctgcatatctgcttctgtgtttttctgtaattacagttctcctgtgacccaagtctgtgctttgccttgtcctgtgtctggtgcactttcccttggccctcggtggtctcaggctccagcatttggtaacggcccctgtgccagggtgctgtgctgatggcgacaagtggccccctgtaggtgaatgccttcatgtctaactgtgtgtgtgtctggtgggttgagcattttcaaggctttgatacatatcaccttccaccagattacacttttaaaaccattgccagaatacgacttttgggaatggataccattctaaaggaagaaaatcgtgtctagttttaagttgcatttctttgagtgaaattagacctcgttcatgcggatgttggctatttattctcgccaactgtgcctatttgtataagcgcgttcttgtttttttcttttttttcgagacagagtctcactccatcacccaggctggagtgcagtggcgcaatctcagcttactgcaacctccgcctcccgggatcaggtgattctcatgcctcagcctcccgagcagctgggaatacaggcatgtaccaccacacccagctaattgttgtatttttagtagtgatggggtttcaccttgttggccaggttggtctcgaactcctgacctcaagtgctccgcctgcctctgcctcccagagtgctgggattacaggtgtgagccactgcgcctggcctgcatgagcacattccgagggtgtgtactgggccacgggggaaggctgatgagggtaccagggttcagctgtggggggtcccaggctgacagcccctgctttcatggtgtgtccgttgtgggggccaggcagttaacaggcaaacagatcagcaggaatgtctgattgtgattagcacccttgggtgagaggggactgctgggcagggtagtcagggaaggctttcccaggaggctgagggatgagaaaggggtcagccacatgcagctgggacctgtatccaggccaaggaaagagtagatgcaggggtcccccgtgtagattgtagggctgccctctgatagtgtgaattgatattgtagggctgcctgtacacagtgtgaattgattgtatcacagggctgcccccaagtagtgtgaattggttatattgcagggctgcctccaggcagtgtgaattgattttattgcagggctgcccccaggcagtgtgagttgattgtattgcagggctgcctgcacacagtgtgaattgattatatcacaggactgcacagtgtgaattgattgtcttgcaggactgcccgcaggcagtgtgaatcgatcgtattgcaggactgcccgcaggcagcatgaatcgatcgtcttgcaggaccgcccgcaggcagcgtgaatcgatcgtcttgcaggactgcccgcaggcagcgtgaatctattgtcttgcaggactgcccgcaggcagcgtgagtctattgtcttgcaggactgcccgcaggcagcgtgaatcgattgtattgcaggactgcccgcaggcagtgtgaattgattccaagtgcctcagtggctggaagccattgagggtttgaagctggatagggcataatttaaagttgtatgttgaggtcacttttgcgtctgagctgtggaatgtgggggtggttgtggcaggggcctggggcagatggtggggcttagggaggtgtggatgggctggagggaggggtgaagacaaaggctcttgtggaatgagattgaggtgggcaggcggggtgagagggaatgtcggtggctggtgggaggcaggagctcaggggagcagctggcacaggccagggtctgggagtcgtggtgttgctggctctgatggccatgacggtgttatgagcctgtagagtagactagaagagccgtaggaggctgccctgcaggtgccggcacctccaaggctgggccagcttgggagccagagaggagtgccgggagaggccagcattcatagggtgcatctggccagcagtgctgggagtggggtggtgagggtggacacctgggtgcaggagcctggtggaggaggttgcaggaagggtggcccagagcaaagagctgtcagctcttggggtggaaggacatggcgtggccgttgctgagagccttatgtggtggagtagcatttgttgcaaggttggcgtctctcctggcctccagcgcagcgatggcagaggtagcatggctgtgatggaggccgctttgctcttgtgtgtgcagtcctcgccttcctgccgcatgttggcgtgcacaaattcacagatctgtagatctctagagccagaaagtcctggaagagagtccccttccacagagacgctgaggctcacagaggtgaccagcttctccaaaaccccgtggccccttaatggaggctgcatgccacagggcacctgtcactccttcaggccgcctccttcatgcttgtgctgctgagagagactggaaatggttcagcttggagcaaacttacaacttaaaaccactaaagcacaggggctttcaaagagaaaatccacagaagggaatatcctgagtgcatggtgaggggctgttgcactggggtgggtctgtgtggcgcgtggcctcacccgacgatcctactgggtcctgtgggccctccagtgcttgggctccccccagctggtggctgtctgctaggtctgggccacctcatctgcctggggaggctcatctccgtcagtccctgcagtcctgcggctgcaagggcttcaagtggccaagaggcactcctggtcttaaggcccttgctcagaagtgatgcaggcctctccctagtttcagccgagaagacttggtcattgtctgtgtctgtctgcacagagtgctgggtggttcggcttgtgcctgggggcagggtgggatacgggtggacagccagcaggcctcagaccgtgcttggccttggtgggccagggggatgagtttggttggttggtcaacaaacgttcactcggcagtagctcaggtgagaccttgtggatctggcagcttgctggcggagttgcttggggagtgctgcaggtcggcgtggacgggcggaggtgaggtgcacggatgccgcttctcagcataaacgtcgctcgtggctcccttctccagagtaccttctcaaggtgggcatcttctctgttcagatgtgggtgccccagtgtttccctgccgctcctgcctgaccgggcacttaatggagctgcttagtgacggatccagagcggcagagagctgggccgggagctcgtcacagggcagtgcgagggcggtcctggtcctccggctcccgcggcctcatgggctcctggtttcaggatggtgcttgcactcagggccgccgtggctctcccttcgccccaccatcgattagacgcagagctctgagagttgggaaagcacggactgggcgtcttggaggctgtgattctggacaggtgatagggccaccctcttccactttcgggtgctctgtgggccagacgcagctctgcctgggcccgaaggctgggcttggggatggcatctcctcagtgccttggaggttgtgggcgtgccaccagagttcctgtgtgggaagggctgccacctgccttgggtcacatggttccagccctggagacctggtgttgtggggggtggcggaagggacctgatgtcatggggtatggtgtgaaggaaatggcgttttgtggggtggtgtgagggacctgatggtacgagtggcagcgtgagggacctggggtgtgggggatggcctgagggacctgggatatggggaatggcgcgagggatctggtactgtgggggtggggtggtgtgagggacctggtgttgtgggggtggcttgagggacccggggtgtggggtgtggggggcggtgtgagggacctggggtgtggggggtggcgcgaggcacctggagcgtgagcctgcagttcacacaggggggcaatgtggggacggtggtgttcaagccatgggacacttgcccatctgttgtgggggaggtgacaagatcccagcccagacacctgggcggggacattctagtgatgcaggggaggcagtgacccacagggcacacacgggctggggctggggtgtggagctggtgcgggacagggcaccctggggtttgtcgatctcagctgactggaggcggctggttccagatggcagtgctgggggtcaggttcaggaggagatggagaagtaggtcactgactgtggtgagggggtcaaaggacagtttctttgttttttcctgtttgtattttaaggagagatcttggagccatgctcaatagcggaaacaaagtgcgccccatttggattcgtgcttcgggtcggtgggagttaggctggatgaggatgggtggggcgggagggggaggttgagcctttgacatgcttcatgtcagccacttcatccaggccactgtcatttagcctgcaccccgctactgcaccccacttggagctggttggcccgggcacgtctgcggtgctcggtggccatgctgtgctgcggggatgcagggagtccacggtgcaggacgcagaaggggaaggtggccttcctgtcatctctcttccttgtggttgtggaggtgacatggccctgcaggggtttggtcgtgtgtctgcaggccctagagcctggtgggaggcggcaaccttggtttgtccaggaaggggtggcagatatccagaatggagcatgtcctgtgggtgcaggttcctcacgggtggatctgtttgtcatcactgcatccctgctacccgggacgcccctgaggtattgatggcctggccagtgatggctgcaggaggcttggcaggggcagcgttgagggccacaggccacctgccatgaggttctgaagtggtgccatggcaggggccaggcccctcagaggagggactgtggggactgagggactgtcttgatggctgtgggggtcaccgagcggatggggagggagggtggcctctgtggatcagggctcttggtggtgggaaaacaggtctgggacaggcccagccctgtgtcctatggcggtgagaggggtgggagtgaacggtggatgggactcatgctgcagggccgagatgacgaagttccctctgcacgtgcagcctggggagggcagtcccagggccctgtggggagggagcattgctgggtggctccctgcctgacaggagtatcgtgtgagaggaggcctgagagtagccaggccgggcggtgacgccctgtgattgcttcaggcacagtgggcccagaacccccggtgtcccacgtcaagagctgagcaccctgggtgtctggccagtgggcaggaaggggcctctgtgactggctggggcgcaggccggggcctcgctggaaccctcccaaggctgccggtcccacaggggacttggtcccttcttgctcctcagccccagcgcctgcggggctgccctgcaccctgccttccacttgacactgggggccatgggctgaggttcattttggacgtgatttccatggtgatttcctccctttctgaacctccttgtaacttttcgagagtgtgctgttgacttcagatgcttcccctgtgaggggtgaaaatgttttcttcccagctctgagctgctctgtgggaggggccctgcctggggtctccactgattccccagtgcccagggcagcgtgggtagtggcagaaaggggccttgctgggtgggtgcaggaggaagcagcgctgggcatgccttgttctggggggccaggtgtgggggttctgatctcttggggccaatgtgtgtgtgtttcctcggcagaggtcctttctgccgtgacttcttccttctgcctggagcctggcaggtggctctgggtgatgcctagatgcccgtcctatcagcagcaggggtgtgccctcccgggcgggcctctgctgttccggagccctgtggctctcatggagcctgcactgggtttattgaactctcttgtccttctcttctctttttattggggctttgaccatttaaattcctttactcttgttttggtgggtcttgctggggaggggtgggggagagaggagactgtgctgccagcaccccgggctgctctcagcgggtgggggcacctgtctggaatctccatgtacaagcacaagcaggcattgtggcgttttgggaagagtcgtcagaagttgcctcctatggggcagaggtgccaggaggagactcttgctgtgcccaggtccagactggcaggagaagggagcggtgagtgatgggacatggagtggtccatggggagcagagccaggccgggaccccggaggggaggatgatgagaggccgaggataggtcatgtgggggaggagcccttccttctgctgctgtgccctggtcgctgctgtgcagaaccttctggtctgcagtgtcctctgggggctctgggtgttacctgttttgactgttgtggcctcatcttcatggaaggttgtagaaaaacagtttgtcaggtgtcctccgtgagtacttacaactccagcgtgtgacagtaggcgttgggtgaagatggggtgagcgggtgaggctgactccctgccttggggacaggctgctccgtggggctgctgtgtgctccgtgacaggttgggtttctgcagcaggtctgaagcagtcactttgctccaagcatcttgagtgccgtcgtctctggcaccgtgtttagtctttgtgacgatggtgtcgtgaaacctgcctagggacgagacactgaggctcgcatttctatgaactgctcaaggccacgtgactggtggggcctggggctagaaacccgggctctggaacctctgcccgggccctgcctccctctggagtgaccctggtggcagctgtggactgctggggagttgggagttgggctggggtgcacggtggatgggcatggggcgggcagggtgcggggctggggcaggcagggatctgggccgtggtgcttctctgcaggtgtgagtatgggtgtgactcaggtagatgagacccaggacgatgtggagagcagggccttcctctgcaggcagtggggacccctgaaggctgtggagtggaagagccagaaggtctggcctgggttctagatgttggtcctgatgacacactggagacagaatcagaaagagggcggtggtcactgagcaggggacgcagaagtgggcctgtgtgttgtggctgctggatgctggctggtgccaggcactgtgtgcgcctcccatgctcaccactgccctgcagggcacatgtttgggatccacttcctggacaggtcacagacactcgcacagaagctcagcctgggaaccccgctcgcagggtctcggcacatcctgatggtggggatagtgggggcagatgtggaaggcgggcgtgggcactgctgcacctggagaaccagcagccatgatggggctggtgggtggtgccagtggaggcacagtgcagatgctgcagcttggagttgggggacggagcctggtgaccgaggtggtcatgcggggagaggactgggggaggggggatggagcccagtgaccgaggtgggcatgtggggagagggcccagggggggatggagcccggtgaccgaggtgggcatgcagggagagggccgcgggacgatggagcttggtgaccaacgtgggcatgcagggagagggctggggggaatggagcccggtgaccgaggtgggcatgtggggagagggctggggtgggggtgtacggagcttggggtgtacggagcttggtgactgaggtgggcatgcggggagagggctgcaggaggatggagcctggtgaccaaggtgggcatgtggggagaggaccagggggcatggagcccagggaccgaggtgggcacgccaggagagggccctggggggatggtgcctggtcacaaggtgggcatacagggagagggcctgtggggatggagcctggtgacggaggtgggcacgtggggagacgatcctgcttaacagaggtgtggccccacacgaggaccctggaagtgcagtgggtttgtgttgcatgagagtgggagcacctctgttaggggaagagcagggtccaccctggggacaggagggaggggctagctaggacctgctggccagctggagtcagggagattccagccaggccttgcaggtggccctgtctgtggttgtcctcactgctctgcactcgggatgcccagctgagcaaatcacttgacaactcccatcctttcctaggtgtgtccaggaggagctagtacagggctgggctgcctcttggtttttagaaaagcatttgtggtacaacagaactcccagaggcagccccctttctcatctgggacttgggcaggcacgcgccagcctgccctgtgtgggaaggtgctaggtatgtcgcagccacagggaattgactcggcattgagccccagggcttcagggattttcagaggtgactttgagacttgatttcttctacacacccttccccgtattgtgactctgggtgggggaccaggcatcttgatgagggggtggtccagtgagggtttgggtgctggggagctaggtctgggatggccctgatgtggggcggtcccggggcagggttgccggtgtcaggcagcgcccgtgtttgaacatctcggcgaggaatcccgggtgctggtgtttataaaaatagacctgcggcttccatggctgtgtcctttttggtatgattgacattggatagcgtgcgtttgtattctgccgtgttcctgtgatgggagccaggggcgactcttctcatggcgaagtctggttggtgctgaagcatgttgcatcacctgggcttgacggtgcgctctgcgctcacggcagaggcagaggctgcagcatcttccgccaccgtttccatctctttttatgctatttccagtgtgatggtgcctctagcgctgtcctgagtgtggcctgttgtgcatgtgatggggtcttcacttgcctgtggacttactcttctcagcgcccctttcttgtgcgggggtggggagggtctcgctgtagagggaagagggtagagcaggtgccctgagactgtgtgatctcttccttctaaaggagctcacgaatattcatcagctttaagagaagtccatgctctgagtgcctcgttaaccagaccttggtgtgactctctcagaaaaaaagaatgtttctagaaggtcagtgtttcaggggtgtcagtgcaggctggtggtgtggcctctcggggtaaggagggagcctggtcagctttgggattgcagtggtagctaccatagccccatgctagtaagagtgtgtcccgctcatagtgacactgaagttgtccttctgaaaagagagtaattgtcgaagaatagatgagtaaaatacagtgatggtctttatgactgtggctggagaaagatttcctaggatacaagtagcatgaactaatagggcagaaagtcgatacataggacttcaaaattaaaggaaaacttttgctggttgacagacgttgttaagacaatgaaaaggcaagccgtcgactgggagaaaatatttatatctaacaaagaactggtgtccagagtatgtaaagaactctcacgactaaataacaagacgacaaacaacggttaaaaatgggcagaaggtttgaatagacccaaaagaaggtacacaaatggctagcaggtgtacgaaaaggtgctcacatagttagactccaggacatgaaaccccagtgggatgctgcggctgataacacacccacctaaaaacagctggagttaaactgacagccatcccgtgtgtcggtgggtgtggaggtcctgggaccctcaacgctgacagttaggagaagcgtaaaaagttaagtactgattgaccgtgtgcggcagccccacccaggatatttggaaagaaccgaagtgtccatcctgccatgagtggtgacaggtgatgtgatagatccgtatggtgagatgctgctcagctccacgcaggagcggatcacgacacatgcagcaatacagtgaatctacaaaattccccagcaggtgcaagaagccgggagggaaagaccgcctatcgcacaatttcatttgtatgaaattctagaaaaagctaagctggaacagttgtggttgcctggattgagggtgacgtagtgtggcattaggacatgttttaagcgaatagaaacgttttaaatcttgattgtggtagtggttacacaactgtatacatttgcccaaacttttcaaattgcacacttaaaataggtggattttgttttatgtaaactgtatttcagtaaagccgtaccaagtccctggggccatgttccttcctgttgcctgtagcgtggtgtttcggggaaggaaaggcagttgtggctgtggttgtcatttgtgtctcatttgttggcacagaatcccaatcccaatgtctgccgtctgctgcacgggggcaccgcagagcgagggctttcagcggcctggcgggaaacagcctagttaactgcctcttaaatctgatgctggctgtggaactttgcatttctttaggagagaatcagtatttggaagtgtttgcgtgagagaaggaaaatttgttcgttatagttgtgaaaaagaggttactgctattcctgcagaggacacaaatgaggagctgtgtgtttgggacctgtctgtaccccgagcgtcagttctgtcttcccttcgtccaagcaggagcgtctgctctggattagacgagaaagagttttcatgcccgcctgctctttcgccacagatctgttgcgctctcctcagcgttcaccctttccaggagcaggtgtgtggcaatagcttatgtagccttacactcacaaacaaggcagttttctggcttttaaatagttattttctttctgagtagtacgtactcatcctagaaaatttgataaaggcaaaaaagtatggaaaagaaacgcatgctagtctgtattcctgtcaccaagggagaactgtagaaccgagaccacgggtgtgtggctcaggcagcatcgctggttcatcccacagcactcacggagtgcttgcacgtgcagggattctgcgcctgttctctgaagcttaaacccaaacaggcgcgctgttgaaagtttcaccgccatcgtctccaccaagcacctgaagcgagtcaagggtagagaggagcgggcaggcacggcaggcagggctttcccaggaagggcagggaagaacattccagaccttgtgtggccggtggggagggtgcatgggccaggaggtgcgggacggttgtccctgtgacagtcctgagcggggagcatcccgatgggattccgtttgagcggcatggctttgcgagttctcttcctgcagtgtggctagactgtctctccctacctgaggttatttacctactcacctgtgttttcatgtcggcgttgtgagttttcttttccttgtagtcactaatctgtccaggattaattttcatgtgtcactcaaggtggcctcttttctccccctgggctgagtggcttgtccattgccatgtgggactgctccctgtgcccatgggtctcctcctggccttcgctccatcctgtttggtgcctctggtgcaagacatcagcctcatcctgtatttcctgtcccaggcctgtctcttccccgaggagccttggaatggcatttagaggaaaatgactctcgagcagtttcggcagcgctgggggtgctggtcatgctggtcacatttttaacacagcacattctccccctcctgtaaattctgtgaaattgtatttttatctcttctcttgcacagaaaagcttagatcctagtaacataaacatatttacttacttggcttctgctaccctatacttaaacacagattcagaattacaacaataacatgagagtaaagtttaaggtttctttgcactctttgtctttagaatttattctttaaggatgttagatcagtactgtgttcaaaactccactgaaatgatccttttttgtgttggttatgttaccaatttgatacacaatttagttatgttttggtttgttttcaattttactttttttgtttcattttgtattttgagggtataaaacatttatgtggttcaaaatacacatactcgcatgcatacacacatatattctttttctcctattataactaatgtagcatatacgctaatttttaccttgacattttttcttaatataatctggagatcatctctggtagcattttattttaattgaaaaacttgaagttttatgtgtagtacactcaggaaattactctgaatagtgatgcttttctgcataattcaagcactaaaacttaaaaaaaataattttggaaggaaatagtttaaaaaatacatatatttttctctgccaaggcaaaaagcatataataagcacaagttagctctgcctgggaatattgggctggagacaggggaggctcagtcttaagggaaggccaggcagggtggtctttgcattggtgggaggctgaagcctgggttagctaacgggccctgcctctgtgtcttcccgtccagcctgcagtgggcttggaaatacttcctggaattatgtgtaaaccaggtacagtcgcgcgccacttagtgatggggatacattctagaaacgcatcattaggcaatgtcattgttgtgcgagcatcgtggaatatactaacacaaacctggatggcacagcctgctacactcttaggctgtgtggtgcggcccctggctcctgggctgtaaacctgcatggcttgtgacgtgtacagttgtaacacgatagtgagtttgtgtatctaaacatagaaaaggtacagtaaaactaggggataaaagatgaaaaatggtgcatctgtgtagggcactcaccatgaatggcgcttgcaggactgggtgttgctctgcgggagtctgagaggcctgggacatgactgtgctgctgtaggctctggggcactctatgcttagggtatgcttagggactatggaatttataaaaacacagttttctttcttcagtaataaccttgacttactataactttataaacttaactttttcaaactttttgactcttttgtagtaacacttagcttaaaacacaaacacattatacagctgtgcaaaaaaatactttctttgtatccttattctgtaagctctgtcacccaggctggagtgcagtgacgcaatcatggcttactgcagccttgacctcctgggctcaggagatcctcccacctcaggctcccggatagctggaactacaggcaggcgtggccaccatgccgggctaatttttgtatttttttgtaggtttcaccgtgttgcccagactggtcttggactcctgggctctagcgatctgcctgtcttagcctccagaaatgctgggtttacagacgtgtgccaccacgcccagcgagcttttttccatttttaaaattatttattactttttaaacttacttgttagaaacaagacacaagcacacgttagcctaggcctacagagtcaggatcatccacatcactgccctccacctccaagtcccgtctccctgcagtcttcaggggcagtaacacacatggagccgtcatccctatgatatcagtaccttcttctggactcttcctgaaggacctgcctgaggctgctttacagttaactgtaagttttaataagtagatgcagtatatttctgaaacagtgatgggaagtagaatgtagtgaatatgtaaaccagtaacattgttgctaattatcattgaaacaggagagttccctgacccgctctgggtacttgcaacaggggctgtggctcatttgctggaaggggagcgtgcaggggagcgtgcagacgggcaggtgcaggagcccgggtgagcccttttgggctcccgccccacagtagcacctaggggtagattacaatgaatgctcttttagcagttgccattctcagatggctaagtgttaaccagctcagcagagagtcaggcgacagcctttttccccctgccctctcggtacccgagtccttgtgcggtgtccaggaagaatcaggtcacacggacttgaaggatggcatttgtggggattttattgagtgatggaggtggccttcagtgagatggatgagctggcaaggggatggagtgagaagatgatcttcctctggagttcagccgtcccgcagccgatctcctcctggacggtgcccagccaaacccctctcgacattcagacgctccttctcttttctccttctctgctgcgccactttgctctcgtcagtggagcttggggtttatatgggcaccagataggggcgtggcaggccagattagtcttggaaaaggcaacatttgggcgcgcaaacaggaatgcctgttcccatttagggctgcaggtgtccaggcttgagggtggggcctttgctgggaaattgccctcttctacccagtatttccttgcctcctgtccgtatcattagccagtattctgtatgctacagaattgtatgtgggagggttttttttttttaggagatagggcctcactctgtcactcaggctggagtgcagtggtgccttgaactcctgggctcatgtgatcctcctgccttggcctcccctaagtagctgcaactacagccactgtgcctggctgatgtttcaattttttttttttttagagagaagggctcttgctttgttgcccaggctggtcttaaactcctggcctgaggcagtcttcccatctcacccgctcaaagtggtgagctactgcacctggtcagtgtgccatacttttcttttttcttttttttttgagatggattctcgctctgttgcccaggctggagtgcagtggcgcaatttcggctcactgcaacctctgcctcccgggttcaagcaattctcctgtctcagcctcccaagtagctgggactgcaggcgtatgctaccacgcctggctgattttttgtatttttagtagagatggggtttcaccctgttagccaggatggtcttgatgggaccagcgtcatgtatgccgtctgttattgccaggagcatcatgatgtgaggcgtggctgtacgtggaggctgacagtttgagggtaggggctctcctttaaatagaggttaacatgcataaaaattcttggaggggacataatttatatacaataaaatgtcccccttgtaagtgcacagattgaggatgtctacccccatttcgttcagccccccagagggtctgcttgtgccctctgctgtcggcccacagccctggacgggaaggtgttctctgggccgcctctcgccgtcggtgtggatctgtcctttggagcgctcaggtcgctgaaaccccagttgtgtgctccctggtgtccggcttcctactcagagtacttggaggggcatcgtgtgcaacacgtgtccacagtttgttatttttatggggaatggtttctgtttggatgtacgctatacatttgccagctgaggagtctggcatgtttccagtttttggctattacgaataaagcttctttttgaacatttgtgttcaagcctttgtgcgaacatacgtgtagacgtccttttcttttgggtaaatgttaggagtggaatcgctgagtcgtacggaaggtgtgagtttggtcttgtcagaaactgccaggctgtgttcctgagcggctctgcgaatttagtttcatccgcgggctcagtgctgctgccgtgagatcttgctggctcttggcgtggccaggcttttctgttttgcctattctagtgggcatgcagtgttagcacatactactttttaaatctccgtttatggaggcgtagttggcgcgtggcagagcgcacctttctcagcctgtaggtctgtgagttttaacgatagtcacgtcaccaccaccgtcgagtacaggatcggaatcattctgtagcctcgtgcccctgggggtgagcccctgctccagcttcctccccggcagccactgagctgctgctgtcactgtgattttgcctcttctagaattttgtataaatgagattatgtagtgggagcctcacatctggccctttcccttggcgggatacttctgcgtggtgcccaagtggtgtgtcgtgtgcgtgccagtagctggttcctttgcgttgctgagcagcatcctggtgtgcggctggaccgcaggtgatctggttaccagttgatgggtatttgggttgtttctagcttttgattattatgagcaatgcttctatgaatgtttcctataaatctttatatgaacataagtttttctttgtcttgggtagataactaggggtgggattgctgaatatggcaaatgaatattaatttctgaaggaactccaaagtggctgtcctgttttgcattgtgtctcaccagcagcgcataaaggttgacatccttgcggaaagctggtatggtcagtcttgaattttagccttttcgatgggtgccgtgccattatgttgtggctttgatttgcatttccctagtgactaatgctgagcgtctttccaccagcttatttgctcatttgcctatcttctttcgggaggtgtcttttcaaatcttttgtctgtgtgttttaaattgggttgttagttttgtcattattgatttagtaagagtttaaaatgtattttctagatgtaagtaatttatcagatagaattgttctgtaactattttcttggtctgtgtttgccttttcttttagctgcatgcgttttaaagtgcaagttttcaattttaaggaagcccaatgtatcattttaagaattcattttgtgccttcttaaataaatccagtgtatcattttaagaattcgtcctgtgccttcttaaataaatccagtgagtcattttaagaattcatcttgtgccttcttaaataaatttttgcctaacccaaggtacaggagttttctagaatgcttatggctttagctcttactcaacccaattcaagttaattttgggagagttgtaaggtagggggttgagactcgttttttctgtggttaccaatcatgccagccttatgtgttgaggagaccttcctttctctattgaacgatgctgctgcctttattgaaactcagtcggccacgtgtgaggacgtcacttctgggatgtgttctgtccactcatgtccttgtcttcccttctgcagctcagcactttccagcccatttagagggagtgttgatgggtggcaggagtcctccagtgctgctttttcgaaaacgttgagggctgttctggtcgtttgcattcatgtgtttcagaatcagttcgtcaacttctacaaaaaaagcctcttgataccttgatagctttttgtttgttttgagacggaatttttcactctttcacatcttttcctggagtgcagtggcacgatcttggctcactgcaagctccgactcccgggttcaagtgagtctcctgcctcagcctcccgagtagctgggattacaggcacgtgccaccacacccggctaatttttgtatttttagtagagatagggttttgccgtgttggccaggctggtcttgaattcctgacctcaggtgatccgcctgcctcagcctctcaaagtgctgggattacaggtgtgagccactgggcctggccaataccttgatatcttgcttgggattgtattgagtctatagatcggttttatgatcattgatatcttagcaatatcgagtgttctgattcacgaacgtgttgtacctcttcattgatttaggcctttcaggatttttctcagggttgtttcaagttctcagtgtttgtatcctgaacatactttgttaaatttattcttaagtattcatattttatgccatgtacgtggtcctttaaaaaattttgtttccaattgttgccagtatttagaaaaacaattgcttttggccgggcgcggtgggtcagtggctcggtggctcagtggctcatacctgtaatcctagcactttgggaggctgaggcgggcggatcatgaggtcaggagattgagaccatcctggctaacactgtgaaaccctgtctctactaaaaatacaaaaaattagctgggcatggtggcacacgcctgtagtcccagcactttgggaggccgaagctggtggatcacgaggtcaggagatcgacaccatcctggctaacactgtgaaaccctgtctctagtaaaaatacaaaaaattagccgggcgtagtggtgggctcctgtagtcccagccacctggaggctgaggcaggagaatggcatgaacctgggaggcggagcttgctgtgagccgagatcgcgccactgcactccagcctgggcgacagagtgagactccgtctcaaaaaaccaaaaaaaaaacaacaaaaaaattgcttttaaaaatagtgactttatagctcttccccaagcggcctgagatgatctgtgaaaatggttcattagtcacttgacccagaaatccccacaaaatcgtgcaaatccagaggttcaggtcttcttgatcactttaagaacgctcgtgaaactgcccaggccatcaagggtatgcatacgtgagaagtcaccaagtgtctgaaagacgtccctttatagaaacagtgtatgccattccgacttggcaggggtggagctggcaggtgtacctaggccaaacagtggggctggacacagggttggtgacccgaaaagagcgctgaatttttgctgcacacaattaaaaatgtggagagtcacactgaatgtgagggtgtagatgtaggctctctggtgtttgagcacccaggatgcgctgtgggacttccagggctggtggtcgggttcatccatacagggcgccccgtcacattgagacgatcctcacggtaaagacacttgttcccaagccaggtgaggaagttgcacagaggaaaactgtaccagaagaaactgaagaaacaaaaacttgtggcatgggaataaactcagcatacaataaatgcaattaaaataaaaaaaattgactttatatcctgtggatttcttaggattttcttcaaagataggcgtgatctgcagtaaagagtggttcatatctttttttctggtctgtgcaccttttatttcttgttcttgtctcattgcactggccacaacctccagtgtaatatgacaaacagaagcgttgagaagggacattttgccttgtttctgatcttgggggaggcagctgtcttctctcatgacgcacatgatgtcagctgcaggtttttcatagaggccctgtgttaggttgaggaatccccttctgtcataggccattctggctgctgtaacaaaataccatagactgggaggcttctagacaccggaaattcatttctcacagtcctgggaagtgcaagattgccatgctggtgagggcctgctgcctgctcccatgcagcttcttgtgtgtcctcagagtgtggaaggaaggggcaaggcagctgtgggacaggctctttcataagggcgctaatccggttaatgagggctgggcccccaaagtccccccgcttctgctaccatcaccttggggattgggtttcagcatatgaattgtgatggcattcagtctatgcaccttcttttcctagtttggtgagaatttttgtcgtgagtggatgtttatttttgttaaaatgcttttcttcctgtattgggatgcttgtatggtttttcttttttagtctgttaacatggtgaattacactgatttaattttgagtgttaaaccctggcgagttcctagcataacccctgttggtcacatgtattatcctttttatatacagttgcatgcagtttgctacagtttggtgtgtaggttcaggagggatactggcctgtcatttccttgcagtttgtcttgcagtactgcatgagtaatgttagttgcaacagttcacttgcctcccagcagtttctgttattttatatccttgatagcactgggtgttgtcagacttttcaattcctcgaatctgggggtgtaaaatgctctgatagtgttgtcttaattttcacttaaaaattaattaatgagccaggcgcggtggctcacgcctgtcatcccagcacttcgggaggccgaggcgggtggatcacctgaggtcaggagttcgagaccagcctggccaacatggtgaaactccatctctactaaaaatacaaaaaattagccggttgtgatggcgggtacctgtaatcccagctactcaggaggctgaggcaggagaatcgcttgaacccgtgagcgggaggttgcagtgagctgagattgcgccactgcactcgaggcagggcaacaagagcaaaactcttttttttttttaaaaaaaaaaagaaatttgattaatttcctttaattccttaatgaaaattaatttcatttaacttcttttcctttaatatagaggaaattaattttctatgtttattgtttgtgggtaaccttctgtgaaatgtctgtttgtgtctttttgccccgttttctttaaattatttcatattaattataggagttctgtgcatattctggttactgttcctttataggtcatctgtatatggccagtatcttcttccagtttatatctgatcttttcactttctttatggtgtcttctgacgaataggactccttgattttactgtagttgaatgtatctattgtctcctttttggtaagctttttcaagtcatctttaagaagtcctttctaacccgaaggtaataggaatagtcttctgtattttcttctaaaatgatagcttttgcttttaagtatgtaatcctcctggcatggggtttgtgtgtggtgtgagttagagctccattttcatttgcctcctatttggattgacagttgtcctggtgttatttatttgaatggtccttcctcacctctgtggtctccatggcccgtctgtaacatttcaggttttatattatgtggcatccgtttctagcctgtcggttgttttctcttggtttatctgtctgtcctttcatcagtagcatcctgtccttaaataatttagctccatactaattcttgatatctactagaggtaatactccattctgttgcttttgagaattgtctgtgcaactcttggcactttgatcttccttataaattttagaatcaactcttcggggcccataaaaatccttgtaggttattttaattgaagttgtatcaatctgtgggtcaattttgggagaactgaaatctatgggccgggtgcggtggctcacgcctgtaatcctagcactttgggaggcccaggcaggcggatcatgaggtcaggggatcgagaccatcctggctaacatggtgaaaccccgtctctactaaaaatacaaaaaattagctgggcatggtggcgggtgcctgtagtcccagctactcgggaggctgaggcaggagaatggcgtgaacccgggaggcggagcttgcagtgagccgagattgcgccactgtactccagcctgggtgacagagcgagactccatctcaaaaaaaaaaagaaatctatgagatagtgactatatccatgaatatggtatattactctatttacatattttgtaatatttttcaatcaagttttatgtgtctttttcatataggtcttacacatattttgttagatatgtgtagggcattccaggacattctgagttcattgctgctattttaagtattttttttaaacacattttctggctgggaatgatggctcatgcctgtcatctcagcactttgggaggctgagatgggaggattgctggaggtcaggagcttgagaccagcctgagcaacatagtgagaacccctgtctctacaaaaaattaaaaaaaaatttagccaggtgtggtggtgcatgcctgtagtcccagctactcaggaggttggggtgggaggatcgcttgagcccaggagtttgaggctacagtgagctatgattgtgccactgcacactagcctgggtgacagaatgagacccttgtctaaaaataaacaaaaaattgcgttttctaattcttctttgatagtgtgttgaatcgcagttgaattttggatattgatcttactctagcactcttcaactcttccattaaaaatttgcaattttttgagggtcgcacctagagaatttattacatgcaattaatgacaattgtatttcactgacgtcctgtgcttcattcccttgttgtcttctggtattgggcttgttggggtctcaggtgtagtgttgaggggaagttaaggaagttctttcccactcattttcttttttttttttttggagacagagtcttgctctgtcgcccaggctggagtgcagtggcgcggtcttggctcactgcaagctctgcctcacgggttcacgccattctcctgcctcagcctcccaagtagtagggactacaggcgcctgccaccatgcccagctaattttttgtatttttagtagagaaggggtttcaccgtgttagccaggatggtctcgatctcctgacctcgtgatccacccgccttagccttccaaagtgctgagatgacaggcgtgagccacctcacctggccctttttcttttttttttttttttgagacggagtctcactcttgttgcccaggctggagtgcaatagcacgatctcatctcactgcaacctctgcctcccgggttcaagcaattcttgtgcttcagcctcccgagtagctgggattatagtcatgcgccactatgcctggctaatttttgtatttttagtagagacggggtttcgccatgttagccaggctgatcttgaaccccttacctcaagtgacctgcctgacttggtctcccaaagtgctgggattactggcgtgagctaccctgcccagctcccacttcttattttctgaagttgctttctgtttgcttttcttggggcaggggatatttgttagtttgtctcaatggatgttggatcgtatcaaatgccttcctattatttaaaacccaccagggcccttgttagctcctttgtcctgccacctccctcttctgccttggtctctgattcctgccacacacgcatcttggcaggtggctccccttgttgcttcatggagagcaccagagccatccgctgggggctgaggccaccctgcctgaccccgccctgctgagagctgagggatctcatctgtggcctcactcttctcctgtgggtggccctctgccctgctcttcctaggtcactccctcaccgtatccttgctgctttctttgccctcctgcctctcaccacgtccagacagctgcctcccctctttttttccccccgcatccatcatttcccagctgcttccttcgagaagccagtctcggtgctcagatgaggccaagaagatctgctggtggcaggttcttagagggctgggcagcttcccttcctagcatagactgatgaatcggattgatcggaagctctaggagggtgtgtaccatccacatgtgtttctgatttggggccagtgcccagtgtgtgctgggtggccaccggctgctcagagcccctgctttgctgtctccctgccaatgtgttctgataagtgaggttgtctgaaagttgggttctggagaactgacgttttgctgtaagtcatttaaggtccatgtcatctgccagctgacctcagttttcttgaaattgtgcatgggattggcactatttaaaacattttgaaagtaagcagaacattgggagttgagtgctggggatgtggtttcaggtgctgagagccgaggccctggtgggccaccgggccttctggaagcccatcctctgcagacagcaggcgctgcctgtggccccgagctcctcttcttgccactggcactctcagattggtctcccttccccagcctctgtggataaagctgccttaaaacacagtgaacatgtggaagagaagcgatgcttgttgccatctggacaaacgtgtagactttaggttagagaagtcctgtgtcctggcccatcaggggacacagaaactgctgagatggtagctcagggagcaggagttcgggggtggagggaatctgagcatggtccttgtcctctcagaaaagcagagccgactgcttgcagagttgactgcccccaccgctggcctggaagcaccatccaaatggtgacttcactaactgtttttaagttagcagatcaaacgtatccaaatatgtgaagtcttaacatggagactccagaggtgctgagatactgctggcttcaggaagagtgcgagatgggaggtgcaggctcgcagaaggacagtgctgcgggggagctctgaggaaaggagggttgtttccttcttgcttgctgatggtgagaagaatctggaacttttgtttggaagtgtcctgtgcgttccgtgtctcggtgttgctgggccagctgccctcttcccgggctgttccacggggccttccctgcgagccccgtctccgggtgccaggggctgcatgccctgcaccccggcgtctccctggggttttggtgggagcctttgcttgttgattattttatttgttgacacatgtgcttactctagtaagaacttacggtgactaagaaaagtactcataacccaagaagatatgattaatgagaaagtgaggggagagggagaatagagtgaaaaacgcccaccttgggctctgttcagctgctagtggagtagggtagggggaggctgggaggtgggcacagagttggaactgagctctcagtcaaggcaaagggaatgcccaaagtgtcatttgaatgaattcagaatctgcagatgaaagagcacatgttaaaattgtgcagaagtgaaggctctctgttagtgcaggatttttagagtcttgggagttaaatatgtgcagatgaatatgctttatcctgaggtttagcaaagtgtcgagaaggcaccctgggcccagccagcatgctcactgctgtcggcggaagcgagcacagcctgattctgcacacgctgggcctcaaggtgtgcggtgcctggaggacgagggcttggacgcccagcctggagcagcctggccacgttccgaccttggacccaggctccctgaaagagggagtcagtgaagtcacatgaggcttgtgggtttcagagattttagaaacctgagaaaattagaaaccaggaatggctgagaatataagggaaggcttcacgaaggcagaagtgataccaggtgctcagtgttttcaacagaagcctttcacctaaagccgtggagaaaaacctgcctgagaccaagtgcaagtcatttcctgtttgttgcatgttgtgtctgtcaaatagactcaggcatttcaggaagctcaggtgcagttgggcaagtgaattgagtactgagaagaggtgaaggaggccatcgtattgtggaggtggtggggtacggagagcctcctgaatcaggccctgccacgtgtttatccatgaggttccacatctgtgctgtgtggcccttggtgttgctttcgtggtcacctgatacattttgtggggccagtttaaaaagtagataagacaattcaacattattggcaacttagtaaagtttttggacgaaatttgttttcaaaaaattattactctaagcatgttaattggaaaattggaggctgtactgaggtgtgtggagtagggcaagcaagacccttcccagcactgtccagcccatcctgcgagtgcgtcctctggcttcagggctaattgaaaatgtgcttcgaggcacgacaggccgcagtggggtgtgacagttaagaaaaagccgaaatgggcactgctgggcagggtaaactttattaactgttgaatgactggaaaatcattttaatgtttcagagctgttttaaattatgtgtctgtctacgcatgaaagcgaatctaaattagtattgggctttggcatgaaaaggctgtggtgtcctgactctgggtggtgacgtctgtgatgcttgtgatgctgctgtgtcgtcctatccaggacaccagaaactcagattcgttgcctgcactgaccgggcactgtggagatgcaggtgtccagtttcctggcgggctcgttggcgtccctgcctgtgattccgctccctggagtgctgcagaggcctctgctgcctcctctccttgtgcacgtggccgcacacccctatcggggctctggcccgctgcgctgctcgcctggcctcgcagcgctggcattgtgcgtctttcctccacctggccagctcctgacacccacatgggcagcttcaccgtgaccatgcccctgcggcgcactgttcttccttctggcccagccctgaggcttcccctgaccactgtgggttacctgtgcctgccattcttttttttgttttttttgagacggagtcttgccgtgtcaccaggctggagtgcagtggcgcgatctcggctcaccgcaagctccgactcccgggttcaagcgattctcttgcctcagcctcccaagtagctgggattacaggtgtgtgctcccacgcccagctaatttttgtatgtttagtagaggcggggtttcgtcatgttggccaggctggtctcgatctcctgacctcgtgatccgcctgcctcggcctcccagagtgctgggattacaggcgtgagccaccactcccagcctgcattcccattctttaccagactgtcagctcctggaggccaagagtcaggccttccttaccccgccccaccacggcagccccaagtacaggtgattggatggagtgtgcatgtatgagtgtgtgtgtgtgtgtgtgtgcgcgcgcgcgcacgtgggcactgggccctggtgctgcagagctagcagggctcccttcgaagggcttctgtgtcagagtttaccaggagtcccactgtttaccttgttactccacttgcccaccgcccccaagtggagattatcacacagagttgcatgtctagatagcaaaacagtccttgcctccgagttttatcttgcaaaatttcaaacttaaaagaatgagtacaacaaacagctatgtacaccttccctagatccattaattcctaagtttttttttttttttttgagacagagtctcgctctgtcgcccaggctagagtgcagtggcgcgatcttgggtcactgcaacctctgcctcctgggttcacaccattctcctgcctcagcctcctgagtagctgggactacaggcgcccaccaccgtgcccggctaattttttgtatttttagtggagacgggttttcactatgttagccaggatggtctcgatctcctgacctcgtgatccgcctgccttggcctcccaaagtgctgggattacaggtgtgagccactgcgcctggcccatgaattcctaagttttgagcaaagcagttttaacctgtagctgacacaggggttggtatttatgggatgcaagcctgtgcctttgttgagtatcattggaggcttaggcaggtgctttatggcactcctgaatgtgagctcactgtcgggaaggagatctgtgttggaggtcaggtggatgccagcctcactgaaggctgctcacgagctttttagaagcagctttgggttgaagtttgcagcagggctctgctcccaggctgtggcttgacagacacgcatgtgcactgtacctgttcacggaggtgtgtccatgtgctaagaatttcctaaagtgatggcgccagatacagtcgccccgcagtgttctcgggatggttccagggccccgtacgcacatacaagttccctgtggaacccaagcgagcaaaacgtcagccctctgtgtacgtgggtttcatgtcctgtcaatgccgtatcttcagtccttgcttggttgaaaaaaatctgcatgtaagtggaccctggaagtttgacccatgtttttcaaaggtcaactgtaatatcctgaagtatttttaccaaaatacctcagccatttaaagttaacttaaagagaattcaattcaaggaggtagcatttttttggggggtatgtttgagtttccagaagccctggtaggcaaaaaggccagaacccgtgtgttgggtgggtctgtccctgttggtcactctgaccggccccccttagcacctccagcatcccagagcaggtgcggctcctgggtgtccaggcctctgctcagtgctttagggaggctcagctgcaggagcagagcacgtgtgggaccctgcaccatggagaggtggctgtgagcaatcagatggcttagaagctgcttttacaacctggaaaatgcaattcagaatgatacaactcctggcctggctgactggttgcacgacctaggccgccgaggtgaggggagagcagcccacccagcagggaactgagaggggtcaaggggcaggcgggaggctgtttctcagtcactgtttctttgccccgtgcgcatggagcgatgtgggccatgcctgctgtgccctccgttgtgtgttgagggcttggtgacagtcagtgttgcataaacacctcttgaatgaatatgtgatttagatgtttgtgaggtaaagttaatgatttttttaggaatccaatgcagaaaattaattatttgccaaggttattttatcctgttctgaaaatggataaatttgacacagttccagtagtatggttttgtggttggcaggagaaacggagacaggtaaggaattagcatatacggtgggagaggatgggcctggggtaggcacagcacacctgtgcattcactaaacttttctccaatctgttcatttgtgtgaacttaagagatttaatccctgagcccagggagcttgcgttgaggggggagacagacgttagggaatgactaaatcacaaaacagtcaccgaattgcaactgtgataatgccaagggggaggagggactgtgtaggccgatgctgaaggctgggtgaaggttttccaggggcaagtcccatcagtcacagtgcccgtttagggtttgcaccttgctcttttgacgacgctgctcggctctcagggctgcgaggctggcttcttcccaaacttcattccactccaggtttctgcactgggccctgagagccacatctggccatcactacagatgcacttttgcagtgcctctgcattttgaggtgaaagacagtctttaaacttcagggtgaacttctcactcggagtttggtgtattgttgccatttcttttgtgttgatttgcacgtagctcttttgtacacaggcacgagggtaagcattcctgttgagtcgcagaggaattaacgagtgaaacaaatcatgagtagaagtctccacgggttggtgttttaactttgctctaaggtgagcaactgcgtatttgtgaaatttggccaaatgatgaggggatgctgagttggctgactgctgtgcagaccacctaaggaataaggataaatcctagaatcagagcccgggggagagtgttgggcccagctctccactcacggggcggcagcaagccgtgggtgggttggtggaggccccatttctgcctgcggagcagagctgctgatccttcaggagaggctgctctttcctgtgccgagtgtggcctgctggattcgtgtttctgcggagcctggctttccagagggtgtggagggtgcgcgcagtctgtccacctgcggctttgtggagatgggggctggagccagctcccacagagctggtactttgtggcctgctcctcaggcctgaccacggttccttctgcgtcattttgggggatcccttttccatcaaaggagctagcttggtgttatttttcagagacttgagcacgcactttcattcggaggctgggagctgagaacccctgcagctgtttcatgctccgagctactcagtgagatactctgttaaaaaggcagtgtggtggagggtgtgatcgcttggggtgccatcgacagcacactcacgtccctgtgttgctcacggggtcaggtagagtaaaactcattgaacgtggcctggtttttgtgtgtggtggtgaacagagttgttaatacgactctcgggcagctcctagtgttcttaagaggcagggctggtgggggaaggtcgtgtgctagctgtgaacttggcagttattttcactcgggaaggacgttgggaggaagaggattaaaactatgctttccgttattttttgccgggagggttgtacctttttcttgctctctaagggctctctgcgtgtgttttaagagctttactggggtgtgatccacagcaataaactgagcacatgtaaagtgactggtgagtttcgacaaatgtgcatgcacgtggagccatcaccccagggtcagcatggtgaaccctacccccagcacggcctctgcctctctctagccctccttcctgtccctcccacgccccttgtcccatctgctttctgtcactgcaggggagtctgtgtgttttagaattttatataaatgcagtcagacagcgtagtagtctgttcttacattgctataaaaaaatacccaaggctgggtgacttataaaggaaagaggttgaattgactcacagttccacatgactggggacaatcatggcagaaggcgaaggggaagcaagtaccttcttcacatggcggcaggagagacaggagggcagaggaaactgccatttatgaagccaccagatgtcgtgagaactcactcgctatcatgagaaccgcctgggggaagctgtccccatgatccagtcacttccctccctccacacgtggggattacagttggaaatgaggtttggtggggacacggagccaagccatatcacatggtgtgtactctctcttttctggcttcaactcggtgtgattatttgagagtcatctgtgctgtatcagtagttcatcccattttatttgagtgcttttccattatagatacaccagaaattgtttatgctttcatcctttggtgtactttggagttgcttccaatttatggctatcagaaataaaactgcttggaatgacccaggtacaagcctttgtaaggccacacacttgcctttcgcttgcttaaaacacctcaggtggaatggcaggtcctacatgaggagtatgtttaactttctacaaaactgcagggctgttgtcagagaggctcccaccagtggtgcccaggagctctggttgctccacatcctggagagcacctgatctttttagttttagctattttagtgagtgtgtagtggtgtcgctttaaggatttaatttatgtctccctaatgactaatgatgttggggctctctccgtgtgctcatttgcatccgtctgccacctttggcgaagggtctattcaattgcccactttttttttttttgagatgcggagtctctcagtgttgcctgggctggagtgcagtggcatgatctcggctcactgtaagctccgcctcctgggttcacgcgattttcgtgcctcagcctcccaagtagctaggactagaggtgtgcaccaccacgccctgctaattttttgtatttttagtagagatggggtttcgccatgttggccaagctggtctcgaactcctgacctcaagtgatctgtcctcctcggcctcccaaagtgctgggattacaggcatgagccaccacgcccaacctgggttattttcttactgagttttgaggattctgcatacattctggatccaagccctttattagatggatgctttctaaagagtctgtccgttctgtgccttgtcttctcattctctagcagtgtctgctgaaaagccgaagtttaacattttgatgaagtccagtttatccttttgttcttttatgcatttcgtttctgatgttgtttctaaaatttctttgcctaaccctgggtcagagaaatgttctcctgttttcttctggaagttttaggttttacatttaggtctggatccattttgagttgatgttggtacacactatggggtgtcggtccaggggtttgcctgtgtctgtccagttgttccagcatgtgagaagcccgtcctcaccactgaattgcctttgtccatccgcgtgtgggcctgcttgtggactctgcacggccgtgttgatctgtttaactttgcaccaacactgtgctgtcctggttactggagctttttttagacggggatctcactgtgtcacccaggttggagtgtagtggggtgatctcggctcactgcagtctctgtgtcccgggctcaagcagtcttcccacctcagcctcctgagtagctgggaccacaggcgtgcccacaccgtctaatttttgtatttttagtagagatgggacttcaccatgtttcccaggctggtcttgaactcctgacctcaggcgatccgcctgccttggcctcccagagtgctgggattacaggtgtgagcccggccctgagattactggagctttctttttctttctttctttttttttttttttttttttttttttgagatggagtcttgctctgttgcccaggctggagtgcagtggcatggtctcggctcactgcaacctccacctcccggcttcaagcgattctcctgcctcagcctggcgagtagctgggattacaggtgtgcgccaccacgcccagctaatttttgtatttttagtagagacagggtttcaccatgttggccaggctggtctcgaactcctgagcccaagcagtctccccgcctcggccttccgaagtgctgagctttctaatgcatcttgagatcagctcgtgtcagctctctgactttttctggtttgtttggtttgagagggagtctcattctgttacccaggctggactgcagtggtgtgctcttggctcactgcaaccttcgcctctctggttcaagcgattctcgtgcctcagcctccactacaggggtgcaccaccatgcccaactaattttttgtgtttttagtagagacagggattcaccatgttggcctggctggtctcgaactcctgggctcaaatgatctgcccgccttggcctcctgaagtgctgggatgacaggcgtgagccactgcggccagcctgacctttttttacagttgtgttggttaatctaagacttttgcatttctgtatgaatttcagaatcaccttgtcagtttctacacaggaggctgctgggactttgggatgcattgcttctgcagatcagtttgggaggagttgacatcttaactattgtgagtctcctgacccatgaacacagtgcacgtcccttcacttgctcgcatttttgttttaatcagcattttgtagttttaggggaggatgaatcaaagttcatgattttacaatagtatctgcaatgtgcggggggggggctgcaagtgctggaccaggagctgcgtcagaagtttaatttttagcaaaatattcgggttacagtggtggtagcgcctgcgccgggcagcacatgttcccctgtgctgctttgcgccgtcccttatgcctgccaaaccccgagaggtgggagagaacacttgctttagccagaacaggttagaaggaagatgaggctgtgcatctgtcacagcacagcacccgcttagagagaaagccagcctgtgtaaggagcgcacgctggattctggaggggccctttccacatctgggccatcaccacgtgtgttctgtccaccactggtcccagctggtagcatggagagggttcgaatgtcctagttacagagggaagtgggcctgcaaaccctcaggcttcagaccacccctttccactgcagggaaacaccacttttgctcatctctttggcccttttggtagcttattccttgaggaccatgctcctctctgctggggatgaggctgcctgctggtggctccgtttgtgttttctgggccttccagaggggctgcctttattctgcagccagccctgacccttcccacctctccatgcttgggtgaagagtgaggcccagggcagctgactgacagcacagctgtcctctgcgttttcctggacagaaaccatcgcaggcccacccacctcctgactgcacaggtctccacggcgcagacactttcgtgataccattataaatacagctgggaaagggagggagggattttcttagatttgtgtccccaggggtccatcctggggtgttcttgcccctctaagaccttggcgggcctggagggcccgctccgcctctgacgctgtccgccgctggccgctgtgtgcctgagtttcggagcgccctcccgggctttggacctgccctgctccccagggatgcactcactcacagagcggccactgcacacagtgcctctctgtcgccgtctgaggtgccggctgtctttttttttctttttttaaatatttaaaaatgtaaaactttaagtgagactctgtttcaaaaaaaaaagtatagaactttaatcatatgcctgttttgaagagcagagctttcagtgagaaacaaactctgctggcccacccacccccttttaactgcctctcagaggggaccactttggaacgtgtatccacatggccctgcctgtacagccacctcctgaggttgccgagtgagtgtcagctagcgaccgtctggctgcccagccgcagtccgcagagccccggcccagcccacgcagccctggccgactccgcgttgggcgcgcacggcccttggctgtgaacacgctgtttgagtcgagccaagtgctgtgctgcttctgctccctgtgcaggcagctgtgtctcagcagctagaagggctgtgggttcccaggtgcttactgccctgtggccagccccagcgccctggccctccggaccctgtgcctggccatgcctgttcctcccttctgcttcatccttgagagtccccttgtttccttggggttcagtcccatgtttcctggatcctgtcttttgttttcttcacttattcccttgtttaagtggcttctcccttcttacagaatataccttttttgagacctagtgtgtctgaaatgcctttttttgcctctgagccttggtgggtggtttggcctggcgttgagttccaggtggaaggtaatttcccggggggtttcgaaggtgctggccatctcttcccgtttctgtggagctctcagggctgctgagctctccttccccgtactgtggctgggatctgtgtttttcccctggaaacacggggaaggtctttccttcccagtggtctggcttctgtggtgaggctggtgtgcgcctccttcctcatgttcacgctggctccagcaactgctgtcctttctgtcctcctagaatttctgttgatcacctgttgtgttttctggaatgctccttcacattttctcatctgttcttccaagtttccactctctttttctatactgtattcagggggaatgcctcggtgctgtcgtctggtcatcccaggaatttttaatttgactgtcgtattggataatctttgtgattttgaagagggtttcttgcttattttgatcagttcactgctttggtgtctgggttgatgctgggccttcctcaggtggctggtggtccctggctgtttgcccatctggtggaggggctggtattgagctgcgacatgacggtgagatgggacagaagtcctaacaaagcttcccattaccagacacccagaaaggctggggaagttggataaatgttcttttaaatgaagagtttagcgttctagaagataaggaaaaccagcagggctcagacgtggagctggacagcagctgagggttgggaccttgtgtccccgtgggctggcaggggcgactgttcagcgcctggctccgtgcccctgatgcttgtgccagagagtcctgtagcctcaggaggagagctggggctgagagcccctcaggaccagaaagagcccccccaccggcagagggcacagcggtgcctgcagcctgtcctgtgcgttgggagggaggaaatgcccctctgagaatccacaggggcctgtcgtcctgggctggggctggggctggtgccatgctccggagtgacttgcatagcaggatggtcacagccctgggtttggcagaggtgaacatggacccctgtggagggatgtgtcctgacctgggctacacaggagagccacagacagagccaagccagggcgggtggtgcagggccaagaggtagccggggctgggcctcaggaggccagggcggagtccacagccccaggcccagggccggggtttgtgctgagagtgcggggcggcctgcggcacccggcaaaggcatttcccccacaggtgggggttcccagggtgcaggtgcccgtgtggttgtggcacagcttcgcatgctctacattgtggcttcaagtacagtaaaagtgttacctacaaaaggaatcaggaaaactgttgtgtggggtaagaaccctggtgtttctcctcagggagggtgggattcactcacactgtgggaatcggtggcggcatgctgagctggggacgtgggtccctggaaggctctgggggaggcactggtcaccactggtcaccactggccactggccaggctttggaggagtgcacgctgctccttccccagggaggcgtctcgtggccactgctggctctgcattgcccgcctcaagcagtgtggccttgaaccgctgggagagtggagagtttcacactgtttcagtttcaaaacctacattttcaccataatgaaaaatagaaaatagcttaaatcttcaccagaaggaaattataaacacaatttggatgaaatagtatgtagccacggacagttacgtttctgaagaatgtttactgccatgggaagtgcgcccggggagcgggcagggaacgggggagctggcagggaactcgggcgggtggcctccgtggtccttacggcttccaagtgcacggtgcacactgagtggcacctgagctgtgccagccaggagaggggcttcaggaggtttccattgttcttgtacttctctgcacttattaaactttctgtgaagaacacttctttctgtggtaaggaagatattaggacaattggaagccccagtgcggttctgttagctggaccctgacccattgtggtggttgtatgtgcacattggctggtgtggggttttggctgtgccatgaaggagtctccaggaaggtggggtggggcagagagaggggctgtgagctggggaggttgcgggggaggcggcggtggccacagtggcccggtcaggaggcagggtcccaggccccagcttcctgaccttaactgttaatgaccttcagggctatgccccatcccgtcaccacctggaattgcccatcttggttggacgaggatgctgagggtctttgggacggatgtcgtgtttcttgttgcaggtttgactgcttcctccctgactcgagggctgggtgcgtggagccggttgtgcctctgtatccgagagccctgctccctgtcatccttggctcctctctgcattcctcacaaagacctgggtggggacacggccagtgtcccacgtggctctctctggggagctctcagacagaaccctccgccctggccttggggtcccatctgtggggcggggtgggggccacacctgccacgtgtaccctgctgcaagtgcagagagaggagtagaggcaggaggggcggctgcctttcgtaggtcaggtgccgcccgtaaccacggttgattactcttaaattagttatgtcttgagacggagttgcacttctttgccttggcgtgaatagatgctgctggattatttgtccgtaaacagagctcacaggacccagaactgtgagaacctctcggaaacatggcgtggatgcagccgttggtgttctgagtgtcctcagatcatcacacagtgtctgactttgctttttggtacagtcaggctgtgatacaataaccagggaggcggacaagaaagtccccagtgacagcgcctcttatgtgctgtttgttggaagcaaacctcagttcggcttaggagacgtggccactcgcgcttggttcacagatattttcaatgcctcgagaagctacgttgtacctgcctgaagtcacatggtcacttcttgtgggacgtttgattccttctccaactttcctgaccacaagggacactgggcccgaccacagggcacattttcacagtgacccatggctgtttccctacacttctgtgatgtccagaatgccacttttattttgttagaattttaaccacattgctattttgttaatacttttttttttgaacgtattcctttaaatatatctggatacttttttttttctttttttttgaggtggactcttgctctgtcgtccaggctggagtgcagtggtgcaatctcggctcactgcaacctccgcctcccaggttcaagcgattctgcttcagcttctgaagtagctggattacaggcatgcaccaccacacctggctaattttttggatgcaatttttttaaattattattttaattttttgagacggagtctcgctctgtcgcctagactggagtgcagcggcacgatctcagctcactgcaagctctgcctcccaggttaatgccattctcctgcctcagcctcccaagtagctgggactacaggggcccgccaccatgcctggctaatttttttttttttttgtatttttagtagagatggggtttcaccgtgttagccaggatggtctctatctcctgacctcgtgatctacccgccttggcctcccaaagtgctgggattacaggcgtgagccaccgtgcctggccttggatgcaattttttaaagcacaaagctcctgataattaaagtctcttcactcactatgagaatgtcaggtttgacattgggtgtggaggcactgggacggacactgaagcctcctttgtcctgtttccgtcccattcccatgtgtgcacttaagtctgcgtccattattggcttctcagaattccttaaaaacattttttttttttgtttttaggagatggggtctcactctgtggtccaggctggagtgtgatgatgcgatggtagcccactgcagcttccagctcctggactcagatgatcctcccaccctagcctcccaagtagctggaactacaggtgtgccaccacgcctggctaattaaaaaaaaattttttttttgcaaagatggggtctcactatattgcccagtctggtctcgaaccagcctcaagtgatccctccatcttggcctcctaaagtgctggatttcaggtgtgagccaccacactcaccctggcttctcagaattcttgaggaggaggagcaaggtgtctccgaatgcagtgaatgaagtgttgggtttgaggacattgtattagcgtactctaaagggacagaactaataggagagatgaatctatgaaggggagtttattaggagaattgactctcaggatcacaaggtgaagtccctcaataggctgtgtgcacctgaggagcccggaagccagtctgagtccccagatctcaaaagtagggaagccgacagtgcagccttcagtctgtggccaaaggcctgagaacccctggcaaaccactggtgtaaggccaggagtctaaaagctgaagaacttggagtctgaagttccagggcaggaagcatccagctctggagaaagatggaggccggaggactcagccagtccagtccttccacgttcctctgcctgctttattctagccacgctggcagctgattagatggtgcccagccacattgacgctgggtctgcctcttccagtccgctgactcaaatgttaaccttctttggcaacaccctcacaaacacacccaggaacaatactttgcattcttcaatcaagttgacactccataataaccacatacatgggggtatttaccaggtgtcttgttttggggtccccaggcgccgagtgtgcttgggtgagagtggaactctccctcgttacgcgcagcagctctggcggccacatggctgatgagtgcccacctggctttgaaggctgtccttgggcactgtgggcacagactcggagacggagccttggaggcctttcctgttacttcgttcccgagctccaggcttggagattccagcaggttatttgctgcagctgggtgtttggtttttgtttgatttcagcatggtttattttgaaaggggcgttttggggggaagttttcttaatgggcataaatgtggctttttggatcaagaattttagatgttagcccaggagaggcatcaccattattcttgataccatgctgagtttcgaaagagctggagccgacagccctgagagtgccccagcgtcatagcgcaggaggaggaagccccacgctcatttgtcatcatgaccaacaggaggttttcaggccttacttcatctttttcgaggttatcatttcccattctccataaaggggaggaaggagaggctgggaaacgcagtggccgccccctgtgccccgtggcttggccagtgtgtgatgggtggtggggacggccggtggcggtgcctcattgcacgtgtgtttagtttctcagctccttggtgctgggctgtctgccgaggcttcactcgggaaagagtgcagtgtttatagccctgctcccacggctgcatccccacctctgtcatgggaagttaaatttaaaagttggacaattgtgttgctgtttctaatggaatttatgatataactggttgctgttttttgaagctaacattaatgccaaacctgaatggcaggatttgctttcctgtggtttagctcaagaaccatgacgggcaaatggttctcctgtcctaagggttgcgtcgcatctgcgcctgtgttgtggttgtcagggcagtgtgggggcagcactgccctgcctcccgagaggagggttctggtgaggagcctcgtggcccaccctccctctgttgggtctgggtgtcacaggacagcaggctgggagaccctggagtatgggccgtagacatggttgtgccctctaggcccagcccagcggacgtggccctggcacaggcaggaggtgggggcaaggagactggcatgtctgtggggtgtatgggctggttgggggcatgggggcacgtggtgtggccggtggaagccattgctacactgccttgctgtccagctcattcataaaaggaaggctcaggtgccattttttttccatggccttttaacaacctttacagtttttttgtcttgtataccatcttgactcacaagtgtgttttgagtttgggggattcgtgtgtttaagacttgatttcctttgtttccttctcacagctgtcagcttcccctgggtcaggccagggcctcctcatggctctggggtggttgcgttcctgacgccaggtctcctttgtctgcaggaatggtcctcgtccgaagtgagaatgggcagttgttaatgattcctcagcaggccttggcccagatgcaggcgcaggcccatgcccagcctcagaccaccatggcgcctcgccctgccacccccacaagtgcccctcccgtccagatctccaccgtacaggtgagtgcacgtgtgccctggagtgcgaaccccttccctgcccagcccctctccccacgcatgctggggaaacctgcaagggccaggcacagccatgggagtgaggactgggaagtgtgggcggcgtcccagtcccatccgtcccatctaggatgggcccgggacggcgctgctctcctgtcctcctctcggtggcagggctgtgcctgtctcagagacaccagctcccgcagcccactgcagggcgggccgagtggggtcaaagtgagcagtccagggttggccgctctggccccttcccttctctccctgtggcttcaccttcctgtgcctgtcccctcatctgcaaagtagagatggtgctaggactccactggcaggaccgccaccagcgccgcatggagacttttaaggcaccaagagtcctggagccgctgtgtgcgagtggggttggctgctgctgttagggggtgccagagggacacacacacacacacacatacacacacacacacacacacacacacccacacccccgcgtcagccttcagggccgaagctcccgactcctgagctgtggtagggagcacggattcacacacacacacacacacacacacacacacacacacacacacccgcgtcagccttcagggccgaagctcccgacccctgagctgtggtagggagcacggattctgacttggagggcagagtgcccaggacttgcctctcccggcgtgtgtctgtgtctggccccatgactgtcacctgcacgtgcccgcacgctgcgtgttcctgccccgtctcctgccgtgtttccctggcactgtgatgctgctgctctgaatgacctggcaggtttgtgaagactggaatgacttgatcagcatccttctcctgctacgtgagctgcgtaccctctggagttgtgcctctgtcccatagacagggacgtggacggacgtgccggaggctgccagagaccacccagatctgaagtagcacagaacggtgtcctcaagtctgcagcatctgtctgctgagtgggacactgtggaagacactcgtggcttcacttgcactgtgggcatcccattgcagtctgccatctgctctttccatgtcagtctctctccgacaaacttcatgggctcaggacttgtggcgtccctctgtcctgggcagccaccttccttcccctctctggcactgactggccatctagcctaggggcggccacctccctacccctttgcgacactgactggccgtctgcctttgcatcctttttagtgattgttaacgaggtcacaagccagcagcacgaggattgatttctagatacctgcgttcttcagagatgaccttttgtagactctgttaagaagcctaatgatatgtttattgtagtataggaaaatgtttgtcatacacttgttctttggtaagaaaactttagaattacagtggcttcattgcagatcacggataagcctgggacccacttggatatactagttacatatggaaggaataatttctgtgtacctgggggtgggaattccttttacttgcgctcgttttaggtgactctgcttatttttcaggcacctggaacacctatcattgcacggcaggtgaccccaactaccataattaagcaagtgtctcaggcccagacaacggtgcagcccagtgcaaccctgcagcgctcgcccggcgtccaggtgagagggcaggcggcggatctcttgaggctgcaggggccacgaagtgtgatttctttgatgcagagatcaggccttaggagtttttttttttttttaaactggatactacgtcaaatctggggaggaaggttctctgtgaagaaagtgctttttctttgaccaccaacatgggataagtcaggatttctttttttcttttttcttttttttagtcacacagaatttaacaccagcagcactgttcaagctttccaccatgttggaagcattaaaactatgtccttactagtacttgatcataaggcatgtctgaagcagaagcagcctgcggtgaggacagtgtgtgtgtgcacatgtggccttgtgtgtaacttgaggacggcggctgtcgctaaggtgaacgtggccgaggcgtcgctctcactgttgcaggcacatggaccgtaactttcaccgcaccctgggaagcagatgacatcgctcccttcatctcgtggtgcggcgcttacactgaggcaagggaggctctgggactcactcccggccatgccacctgcacggtgcctgccacgccacgctgccacctgccgctcacatccctcgtctgtagtgagagcatcgttctagaagggttctgtatccaccctggtggccgctggtttctagaacagcgttttcatctgcagagaggagcgtgtcccagagcaggtgctggcccctctcctagtggtgctgatgctcctgacagctcagcctttggcctgcagatcccagaagggtttgtgtgcaggccaggctgttctggaaggggtggcggaggtgtgtggaggggaaggggctggccggtcagacgcacctggtgagggaagcagctttctctgggcagtcagcaggaagcagctgggagaaaaatggttcaggggtttttcttggtcacctggtgtctgtgagcatccgtggatgcgtaggtctctatggtgttggtcgctgctggtgaagcacctgccatgagccaggcagtgggcctggacgctctgcagagagatccagagtccttgcctcagtgccacaggcccttttcccattgctcagtggtgaaatggaggctgagccccagggggtgtggactccaggggcagctccccccgcaaccccggctcttctaccctcactgggtcatgtcctggctggctgcagctgcagtgggtgaaagtgggtggaagggcggttcagtaccagggagatgtgtgctggcctttggtgcaggccccgcccttggtgttttccctgaaggagcttgctcagtcctgtgctctgattggtgcgtctggatttttggttacagtgacttttttgagaaggtagttggagcttatggttaagtttttgcattatacttagtggcagacacaatctggatatcatctgagtgaaatatgtgttcttaggagtggaagtaagtgtgaggagtcagttttgatgggaaagaagactcccaaaagatgaggtgggtcctgggtactcccagggtccagaagcagcagcttggtgtgtccttttatgttttcttcactggaggtttttatttgatgtttttcagttaaaaaaaaaatccatgcttattgttacaagtgaaaagatacacagacttagaaacagtccctccaccctgctgcctcctcacagcccatccgcacccctctggaagcggggctggttcagagttgcttcccacgtgctggcggggctgcacccaccgggagagagctcgctgctccggagccattctcaggcttacactgccccctgctttcagaagttgcaaaggagtgtttaaaaaattggagacagaaaatgttgactgctagatttatacattggaaaagtactagtttaaaatatcagtaaacatttgcattctgattattcatgtagaatggaaatgttaggaatcgagtacaggccactgagttgtctgagctaccttttggcgtctggctgttcatttgcttagcaaagcagcccctcctttctgacagtttgacactgatgacccatcctccattgctcgaatctgctctgaaaactcccctctgtgggaggcttcttgttgacactcacttttggggagtaaagaaaggtgggtttgggtgattgcagggagctggggaccctcccctatgggaggctgcggctgtggagccctgaccgccctgtagccagcctctgcacctgggaggatggagctttcaggagccgttcttctgtttgttgttttgatttctgagagatggggatctgggttgcctgttaggattatttactctggtctctatgtgactttttccatggacttctgaggactggggtctctgcagtgcctggctttgtgaacgtccgtttttgatgcaggtgcaaatcatgccttcctcacccgctcaggactgcgatcgtcagggcacagggcaggcctcccagcagcactcccgtgtccagcgggctggcaggtggccggggtccttggcttcctgggcgtcctggccaccgcagggaggcttgttttcttttgctgggcgtgaggctggtctccccctcgtcagctggtggcgtgagatgcccttaccttgtgtttttggattcttgtagcctcagctcgttctgggtggcgctgcccagacggcttcacttgggacggcgacggctgttcagacggggactcctcagcgcacggtaccaggggcgaccaccacttcctcagctgccacggtaagagccactcctttccgtgccttcaaagacggtcaggcccgtggcgcaggtcagaaaatgcagccttgagacctcaggccggcttctgtcccagaccgctcactgcttgcttcacaaagcagtgaacagtctggggcccacgtgagcacgtggggctctgctgctgtgctgtgtgaggtgggctccgagggccttagaccgcagaagtctgcaaacagcaaaagcccaaacacctgcctttgaaaaagtcactggtgcactgtcgcgttgtatgtaaaacagcagcgccacccgtttgtacacactcgtagtgtcggcctgtatcgatacacatctttattaaaacagaaaagtcactggtgaactgttgtgttcagtgtgtaaaacagcagcgccacccgtttgtacacacagtgtcggcctgtatcgatagacatctttaaacagtgggccccacttgacgcctttttggtgtttctttgctgcgtacttttcgttgctttagtgaccgcatcctatttggttccttctgtgtccgtttggattggcataggttgtccttatggtcagcaacattgtagcaggcatcttcgcagagtctcttttcacttttttaattatttgcatagctgcattcctagatgtggccttgcggggctgagggagatgctgacttcggtggccatgtgactgatgtggctggcctgccccatggcccagggttccaagaggtggtgcgttttcttgaaagaagtttagagaagaaatatatgtatcttttgtacatatgcatattttagtaaccaaaggctgtgacaaaaatctgccttttaagatttttcacttatatctttttactttaatccaggaaactatggaaaacgtgaagaaatgtaaaaatttcctatctacgttaataaaactggcttcatctggcaagcagtctacagagacagcagctaatgtgaaagagctcgtgcagaatttactggtgagaaaccttgactttacattccctttcccctaaagcctgttgcataggacagacacctgttgctgctgtgacctgtgcccgggaggcctgtgccagcagggagagctcctctggaaggctgcaggcgaaggggaggggtgcacacgtgtcgaaggcgtgtgtggcctagctaaggagactccttcctggggctgggtgttctggggccggcgcctggaggtctcccgggctttgccgttttctggtgcctgcgtcccttgtctgtggctctcttctcctctggctgccccaaccatgctgcactctggtcagggtctccagcaactcccttctggccctctccccactcctgtgtgacctcttataaaattcccaggtgtccgcagtcccggctggaacaggcattctgcaccctgagccaccagaagccccctccccatggagcagaccagctgaggcacattcgcgctccagtggcagagccgtcccccccacccccacccctcccgaaacctctgtcgcagagaacagcactctgtcccctggccggaaggtgggagggaggattcctggcagcctcccctctccttaacccacagtcccaagctccagatctccactcatggccgagctctcggctgtccaccttcctcagcctcatggctgtctcgtggctcagggctgtgctggcgtcagtgggatggcctggggatctggagtggctggtcttaccgtgccttctccttgtccgcctgaccatgtcttccggagtctcttagggttcagtccaggcaccgccttcccgccttgtcgcctgtcttcccgacctttattccacactggcctctgtttctgaaacaggatctggccctcttgctctgggctcccttttgtctgactgtagactctgggcaccctggccgcttgcaggggtgagcacagctgtcatctgctcctgaaggcgcggatgccctgactgtgtggatcctgtctgtgtggcccctggcacgctgtgacctcctgcagcaccgcacttgcagtgctggctttgataatggagttacttttaggctgatctgcctcctagcaaaatgcctgacaccgagtaggtgcctggtaagcactgagtaaagactggcattgagtaagagacttagaaaaagacgagaagtagacaggtgaccctcccaggaggagacgtggtccgcagctggctgcactgcagtgtccagggtgagcgcctgtcacacatgtacctgtgaaaggtgtagcacgcagactttcccatctcctctgtccagtgaaactcggggcggaatcagccgtaaaatacgagaccagagtgatgcgggattcagaagtgtgtgtggaatctcattcaccagaatttcaacatggattttatttttaaggatggaaaaatagaagcagaagatttcacaagcaggttataccgagaacttaattcttcacctcaaccttaccttgtgcctttcctgaaggtaatttcaaaggccccggtgcctgcgagcagtagggccagggaggggtggggcgcagatgcaccaagtgtgcagggcgaggatgctccaggcacggagggtgcacagcgcttgtgctgcctacgggggtggggccggggactcagtgcctggggacagaatgttagttttttttctgtaaagcaggagctcccctgacactgtggccttgtggttctgtcgtgcgcaaggtggtgagaagggcgtgtgcttcctgaaagtgaaggggacggggaatggggtagcgtttgcaaaactggataggaccaagggtttcaacagcgtcaggctgtctctgttgggtaatcattggtatcagcacattttaaaaatcaatacgtatatttgtacacatttatgaggtgtatgtgatgttttgttacagtcatagatagaatcaggatatttggggtctgtcaccttgagtacttatttccatgtgttgggaacattcagaatcttctcttccagtgatgttaacatattttaaaaagttttttaaaaatatgtctctttttgtttgttttcttgaacacattttggacatttgctatcaggaataatcccacttagtgggagggcaggatggggtcctggcccttgacatccagacatgctgccgtgagggccaagatccatcttacttagctcaaaagctttctgtaaaagttgatatttctgaatttttaagcaaggaaaaccgacgcatgagcagccgcctgacccctcgtgtctgtctttccacccagaggagcttacccgccttgagacagctgacccccgactccgcggccttcatccagcagagccagcagcagccgccaccgcccacctcgcaggccaccactgcgctcacggccgtggtgctgagtagctcggtccagcgcacggccgggaagacggcggccaccgtgaccagtgccctccagccccctgtgctcagcctcacgcagcccacgcaggtcggcgtcggcaagcaggggcaacccacaccgctggtatggaaggggcgcctgactggtctgcacagcccaccgtgcctctgctcccgcccgcttcttagataaattggccacggctcagaaaccttttccaagcatgcaggaagcctcctgctagaggaagcttgggtattaccttaaatagttaaaatagaaaccagaggttgaggccctgggatgttgtattttgtctcagtaaaatgaaatagttgagttggctttgaaccaccggcacgtccccgccctgccttgtctggggatgttactggtgtaaatgaatgcagcgtgcttttagaggatcttgtagatagatgttctcttggattaggagcagcggtccaagcgtaagacacgggcacctgcgtgggacaggtgggcaggagactggaggcagggtagcagctcacagcacagggtggatttaggtgagtcccgggaggcgaagccgcggctgctcatagcggttcacttatgtgcagtttggatctggctttcttggttttatagtcatgatgtttgctctgcagctagagaaaggatgtctttgccagaagaattacattttgagcacattccctttcatgggcagagggattcaccaaacgtagaggggcagttttaaaaaaatttcagaggtgttttcttcctctaaagacagcttaaacaacaaaatggtgcgggctccctcatcatgagctggtatgtgttgtgatggtgtacacatcagaaccagctgggtgaggagtagccattagggggctggctcttgtgctctgttcaagttgcatttgtttttgtcttgataatagcgaggagaacagggtgaaatggcatggagggagggtgtcccttataaaggccagggaagggctgagcgcctgtgtaaagagagggcttccttgcctgccttttgactccagagggaaagagatgtgccgtgcctcttgctttagtgtaaggacagaacttccctgttcactagtcagtggagctactttacccaaaaaggtgggttctgtttaagcaggcacagcctgtgggcaatcattttcttgccaagttttgacctctggtgcttagtcacacacaagcagcatgggtgtttttagaattaggtgctgtgtttggcagcaggatcacctctgcattctgcttccctgggctcctcctgaccacgtgtgagtctgcagagcacagccagtgggatccagggcatccaatccattgcctgcaccctgaagcctgtggaggcagaacccaggcttctccctgattcgatgacaggctccctgcaccgcagggcctggcccgggcatttgatggcaggttccctgcgccgcagggcctggcctgagcattgcctgagctgcctgaggctcttcctgtccagtgtgggtgttcctgtttcgttggagacatgtttgcattataggccgcttccccaggtccccacacatgttctgcagcatagagtttacctgccagggcacctttgcaaaatggtagcgactaaattctgaaacacctgggcccagaggtttgaggccaggccttatggacttgagcattggcttttgacaaggatgccagtgtctctaggccccagcatcctggggacagggccagagcataggccatggtcagtgctgccaggttttggatctctgccttgtgccggaggtgagagtgagaggcaggatgacagcagagctgggcagaccctgccacgaggggcccagcaggggctgggcggacagagctggccatgctgggagcagtgggtggaggcccttgagggccaagttcaggcaggacttaggaactctaaccccactccagtagaaaagccctcagccgccttacagaaaattcagaaagggagctgggtttggtagctcatgcctgtaattcagcactttgggaggtcaaagtgggaggatcgcttgagcctaggagttcaagaccaacctggccaatgtggtgaaaccccatctctacaaaaaaaaaattacaaaaattagccagacatggtgggtgcctatggtcccaggtgctcgggaagctgaggtgtaagatcacttgagcccggaaggcagaggttgcagtgaaccgagatcatgccactacactccagcctgggcgacagagcgagacttgtctcaaaaaaaaaaaaaaaaagaaaagaaaagaaaaaagaaaattcagatgagatagaaccacttgacctgtagccaccaggcaacaatgtcacctctgctaatatttggggggcagtggtctgctccatcctgggttgctgaggtcagcaggcatcagtttgccacccgccccctccaggccctgaccaatgcccaggggcagcttctaggcagcagatctgctcccgcttgccccttctgtgctcacacgggcaaccctcgcccacgtcctgccctggtctggccgagtccatggccagagcatggtcctgcagcctgctggggctgagctgcacacggggtcttcctaggacttcttactgggggcgtggggtgcaaaggaagggaagggaagaacctcctgctagggactgagtggcccctggccctcggggagcatgctcaccattctctgctggctctgcctcaggtcatccagcagcctccgaagccaggagccctgatccggcccccgcaggtgacgttgacgcagacacccatggtcgccctgcggcagcctcacaaccggatcatgctcaccacgcctcagcagatccagctgaacccactgcagccaggtgagggcctcgcgggcccctggccgctcaacaccaagggctgctcccagagccagctgccattgggcttttatttaattgggtaaaatgtacatttacataaaattggccattttaagtatctagttcagtggcactgatttcatttactgtgttgtgtaaccatcaccactgtcagtatgatttttaattttatgtattttccatggttagcttctttatctgtaatcattcctgcactttaaaaaccttgatgaaatacaggaaaataaatgctcgagaggtacagcttacactttgtactgtaatttagagttattaatatgaagtttttggaaactttcttgtagctaattaggagagtggtagctgtgcccttgagcctgtaaagcaccaaagcacatagttgatctaataaaagccttgtgtggtttccactgtgtgtttgttttgtagtccctgtggtgaaacccgccgtgttacctggaaccaaagccctttctgctgtctcggcacaagcagctgctgcacagaaaaataaactcaaggagcctgggggaggttcgtttcggtaaggaatgggcctgtgtacgttggagaagcgtggccagagcggagaagagtccagagtccgtgctgctccattcccgcccacgggtctttcccacgtggccctggcggccggggctccaaggctcctgcttcacgctcactttgacctcacgttcacacaagtgtgttttcccatacagttggctcaaagaggttttgcttcatacacatagccagaaagcgaatcaactgattatttttatatgaactaataggaaattcattttttagtataacatcgtattttgagttcattgcattcctagtatagaatgcttcactttccatgtattcaacttcagaaccctcagaaatgctgtactgctccaggcgtagtggctcacgcttacagtgccagcactacaggaggctgaagtgggagaatcgcttgagcccgggagtttgagaccagcctgcacaacatagtaaaaccttactcaacaacaacaaaaaataaaaaattagccaggcttggtggtgtgtgcctgtgggcctagctacttgggaggctgaggcaggaggatcacttctgcccaggagttcagtgttacagtgagctatggttttagcagtgtacgccagcgtcggtgacagagtgaggccctgtttctagaaaaataactgctgtgctttgcctgggcctcctggaaagcaggtggtctgagcatcacctcagtcagggaggtgcttatgggacctgagcagtgggagagtcttggagtgatctctgttgtgatcaaggggcggtggagttgtgtgtatttcaggaagtcttactgtgaattttccctttcccagacacttcatccctaaaggcatcaggcagggcatagcaggcctggggagtggctgtggcctgagccagagtcccagcccaagcagggagaggtggccagcatgcctgggcccagcgtgatgctgatacttcagtgagaagggagggcacttagggacatacacgggtgaaagaattaatcaaggctgcaggaagccttggtattttgctgtcaaggagtcagcggcctggcagaagggataaaggagagtgacccctgtgggctggctcaggattggaatgctgacgcaaacccctgggtttcagtgtgtcggcaggcatggataaccatgggtcttgccgtaagtttctagctttgttcaccgcagggtcctgggaacagtaacgccccagtaacactgagcacacctagtgttcagatgttgtcttctaaaaaccgttttccactaaaatgacaaggactcctgagagaaaaggctgattgcgggactgggataaggaaatacaagatgagcggagaccgtcctgtgtcagagagcagtggacatgggcatgacgtggacgtggatgtcagcagagcagcctccctcccatggccgggtccttcagctggagccctaagctgtgcagcccagccacagcccgtgaccaccagggatgccaagaccctgagtgagcacctggagcccataggaggactgggcatgagaactgctgtagagctcttccccgagacacaacgaccccaggagacgccaggcaggcccccggcctcacgttcaaagcccactgctggaggcggcaagtggaggctgcgtgcatgtggaattcccggcaggactcttagctcacatctcctcacgagggggccgaagtcagcctggaagaggacgtcctgcacacagctggcctgtgccttccaggtgtcaggggcagcccaggagtcaggagaggctgaggaaccttccagcttgaggagccggacaagacgtggcagctgggattgggatgcagactgtcctgcagggagaggcgctgctgggaccgggtcctacgggggagggcctggggaggggccattcatcatggcccggtctcaatggcatcctgcttctggaggggatgcccttgtctgtaggaaacacgtgcagaatgttccgggtggaggaaagtcaggttagcaactttcaggtgattcaggaaaaaattgtgcgtactcttcttccaacttctgagcctttaaaaagaatttaatgctgcctctggctttaaaaagctttgcatagatcagacccccacaagtccccgcgctgctcccggctttgctttctctggacttgagtcccctgcgcatctgtgtgtagatgttaacccggcgccaactcacagctctccttccgcagaacaatcgagctttccaggaaagcagcgaggcaccctctctgctgtggcagatgcagcaggtgcaggtgcggggaggacagaggcctggcctcctcacggccctgccttccacgtggggtttcctgcccttaccaccccagcccacctcccgatgaattccttgtacagttaaagtgatcttcccttctttcctcaagggacgatgatgacattaatgatgttgcatcgatggctggagtaaacttgtcagaagaaagtgcaagaatattagccacgaactctgaattggtgggcacgctaacgcggtcctgtaaagatgaaaccttcctcctccaagcgcctttgcagagaagaatattagaaataggtacgttggtgtttaatgactgagttcttattaaacagctgcgctgctggggcatgggagcttcaggtgagcacacctgacacctggtcatgtgttttgtctgagtttgtgatttccacatggttgctggtggtggttcttgggtaaaatatgggtaccactgccttccaccccaccagcctttctgggctccccttgggttgtataaaagcagtaactgctggatcagagattagccgtaaagaaagaactgtgcttaatgattttaaaatactgtttttcttgcctgacctttaggtaaaaaacatggtataacggaattacatccagatgtagtaagttatgtatcacatgccacgcaacaaaggctacagaatcttgtagagaaaatatcagaaacagctcagcagaagaacttttcttacaaggtaacaggctgtttgccgaggagagcgtctttatgttgttggcccccactctctgctggctgggagcctcctccccacaccgaggcagagggcggtgggtcccaagtgcctccatgttccttacgaacgtgttttggatttcttataggactagattttggaaagatttctttttgaggtagggtctcactctgttgcccaggctggagttcagtggcgcagtcttggctcactgcagcctccgcctcgtgggttcaagcgattcttgtgccttcgcctcccaagtagctgggattacaggcgcacaccactgtgcccaactaatttttgtatttttaataaaagagacagggactcgcgatgtagcccaggctggtcctaaactccttgcctcaagtgatcctcctgacttggcctccttaaatgctgggattacaggcatgagcctctatgcctggcgggtttaccttttggaaggcacctgcctctctctctgggccatgggctgaactggcagaccctgaggtgccgcagccctattctcatgaagcagctcttccaagtaaaacgtgccttcctcaccagcagtcacatatgaacactcttccaagggcacactgggtgaggtggtgcctgctgccacagccgggaggcagtgccttcagggcagcactgaaataaacacacttagcccttgctgtaaaagtagttctgtgttgcagcaaaaaaggtaaatgttactttaagaaatctgacagcatcaaagtgtataaaagggacactctcccacaagtgtgcccctgagacagccaacacgagacttcgttctgtggacgtgagcatcgatagagctctcgggcgcagcatttgcagggtgggagggatcgggtcctcgccgcattcagactggacggagggagggcgttgtgcacggatggtccagtggtgctagacaacccctttgcttgctgggctctcagatttatgacaagcagtattttaactttcttcataggatgacgacagatatgagcaggcgagtgacgtccgggcacagctcaagttttttgaacagcttgatcaaatcgaaaagcagaggaaggatgagcaggagcgggagatcctgatgagggcagcaaaggcgagtgctgggtgtctgctgctgccgtctgggcacctccgtctcagccacaacctgatgagctcactgagacagtggggttttgggtggtcagagcatgttttgggctggccttgaagcaaaggtgatgggtgctgtcagtggagctgcaaagagaagcctcattcatttggcactagcgtagatgcttgaaaagcggggcttcttaagattcccagcacctcacgctccacacagtcacacccaggtgtgaagcacatgttcctagagccccctgtgtgcgctggactggactcttcacactcacgttgtccttgttctagaacattcacagccaggcgaggcactgctcattaatagaatcagacaggagaccacagttccccagggacgggggtgggtactgtggagtgggaggagcacttgctttgatcacagccacaggctgtcccgtccctggtgtgtgggacaggacagcaaggagcctatgaggcccattctgcctgccatcatgcggtcacatcaggtcaagtcagagcctgcgattggtagatgtgtttcaaagactgtatcttacatccaaatgttactgacttttctcaagattactggcttttttcatggtgtgtgatgtaaattttcatctttggctataagcatttcacaaatttgctatgcattctttaacattacctagatgttattgtatagtaaataagataacacatttgttaaatgataaacatttagttcataacttacttttcttttctgcctctttcaaaaatagtctcggtcaagacaagaagatccagaacagttaaggctgaaacagaaggcaaaggaggtgagccctgttagtcgtgagtgctcgtgggcactttgctgtgcactgtagcgccccacgggaggggggctaaggaaaccgtggcacttctgtacgataggcatttgcgtgtctgtttaaaatgtttgccaagtttaaataaatacaacatcagaggtattttcctgtgcaaacagttggtgtcctacttttaaattcaacggtgacttccctttgcggggggcattagtctctgtgcttttgacttgcgtatattttctgagagttttaagacaaacatctgttgcattaaaaaaaatcttattttttggattatagaatatgcttactattgagaaagtcaaaacattaaagaagttatgatttagaaaactacagaaaaccctttcatatctatgtattacttttgtagtaagtaaaaaacatgcaagaaatgatgctccttgtctccttttcaaaataaaagatgcagcaacaggaactggcacaaatgagacagcgggacgccaacctcacagcactagcagcgatcgggcccaggaaaaagaggaaagtggactgtccggggccgggctcaggagcagaggtacggcagtgttgtgggatcgaggtcctgggggaaacatggggaacatcttagagccaccctcttctaggggacggacacacataggggaatttgctttcttaccatttacattttgtctcaccttttctggagtatttgttttacgtttgacattttaaatccaaatcagcttatttgtggctatcacttgagctgaaagtctttttcgtgaggaagtttgattactgtgatgaggtttaggctggatttgaaaaggatgtggggaagttataactgtcagaagaatgatctgaatagggatcttgctgattgtgcttcctgcacagtgtctgtgggataagctgctgtaggagaatggacagttcgtggaatgaaggggaagaattgctgcccgctgctgtttctccaaattccattagtttctcgtctatgtttgtggttgtatcttttagtctaataattataaacccagccttgacatgttatttttgctttcaactgtcagttgtttttttttaagtaaattacaggaagaaagaaaacggtcttttatgtttccctccttatttgccatctccggtactcttcattccttcccgtgggtctgtttccgtctgccaccatttccttttggcttgaaggagagctgttgggatttcttgtggtgcagatctactggtgatggattctctggttttgtttacttgaaaaattgtatttcaccctcattctcttttttttttttttttttgagacagtcttgctctgtcgccaggtgggagcgcagtggcgtgatgttggctcactgcaacctccgcctgccaggttcaagcagttctcctgcctcagcctcccgagtagctgggactatagacgtgtgccaccacgccctgctaatttctgtatttttaggagagacggggtttcaccatgttggccaggatggtctcgatctcttgatctcatgatctgcccacctcggcctcccaaagtgctgggattacaggcatgagccaccacgcctggccttcaccctcattttcagaggatatttttactggttacaaaattctgggctgattttttctttcttgcgaaactttcaagaccttgttccactgtcttctgatgtcctgctgtaatttttaatttttaatttttttagacgcagggtctcactgtgtcacctaggctggagtgcagtggtacgatcatggctcactgtagcctcgacatccccgggctcaggtgatcctcctgcctcagcttcccgagtagctgggactacaggtgcgtgccaccatgcctggctaattttgtagtttctttttttttcgtagagacagggtctcaccatgtagcatgggctggtcctgctataatttttaagcttgttccctgtacgtggtatgcttcatgtctctggcatgactttcaatctttgttttgagatgttctttattttttagaggtttgtctgtgttgtgttttgctgtggttctctggatattcagtttagaggtttgtctgtgttgtgttttgctgtggttctcaggatattcagcctgtttcaggttctctgaacttcacagatctgtaggtcagtgtctttcatcaaatttggaacattttggctaatacttcttcaaatttttttttttttttttttttttttttgagacggagtctcgctctgtcgcccaggccggactgcggactgcagtggcgcaatctcggctcactgcaagctccgcttcccgggttcacgccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggctcaaatttttttttccatttcaatcttactttcttctgctggggctccagttacatgtatgttagacctgttgatgctgccctgcaggtctttgagcctgtgttcctggacttcagtctgtcttctctttgttttccagactggaagatgtctactgatgtgtctacgaggtccttggcagatggatttctgccatctccagttgaagtttccattttgttaacttattttgcaattctaagatttccatctagttcttttttacagtttatatttcccctaattctttgagcttattattaaagctgttttataaggtttttgtcaagttcaacacctgggccatctcacattcagtttctctcgactgctgttttcctcggccttgcacactttcttgtctccttgcatgtctcatgcttacctgccaagagactggactctgtgatctcccttgaagagttgattcttgcaggcggttgagttactggctgaccatcttgagtttgtgtggttttgtttttcattttgtcagtaaggatctggggaaacctcaaggtgtttctcaagcccctttaacttagtgggactcaagttgcaaactctgtctttcctgtctgggtttggctttaggctttgctaaggtaggtcttactctagggtgtgatccttacgtacaaggaaaggtcttgttactcgggcaggctggactcccatgcttctggactgccctctactctgcccgacccctgacttctctgtttcgctctcagccccgtggcagctgctgtctgatgcacattggctggtcttgcaccgcttcttggtatgcaggtgcactctgggacagggtcagggtagtgacctgatgaggacagagctccccctccccaccaggactgttggaaatgtgtgggtgggatgtcccagacctccgtgctggggctcgcctgcccacatgctagcagtgacctctgagaaatggctgcctggtgtggagaggagggactccaggtgtaacagacactagagttttggcaatatggcatcccagaggttcagagaaatccctcctgggacagtacaggttaaaatgtctggtacaatgtaggaagaaaataaagatcttgtctttataaatgcgtgtgtgagatatagataaaatagggggattcttctctgggccagaaataagtaagtaagtacagattcccaaggctaacacgggctctggccactgtgtggctgggagtcttggcccgggatgggccccagcaggaacctgcactcacctgggcctaggcctgagtgcccactggctgtgaggcccgcagcccacgctgaaaatgtagttgtataccaagaaagaactgaaattctgaacaacaacaacatatatcgagaagagcacttagagttaaggacttacttttttgtgggggaggtgaaagatattgattagcctttttttttttcctggatttcttttatggttaactgaattctcaaaggcatagattttgtagcccatcatcagttcgagaactagaacgttgtaatcccagcactttgggaggccgaggcgggtggatcatgaggtcaggagttcgagaccagcctggccaagatggtgaaaccctgtctctactaaaaacacaaaatttagccgggcgtggtggtaggcacctgtatttccagctactcgggaggctgaggcaggagaatcacttgaaccctggaggcggaggttgcagtgagctgagattgtgccactgcactctagcctgggtgacagagcgagactccatctcaaaaacaaaaaacaaacaaaaaaaccaaactagaacatgccagtcacctgggagatcccccacccttttatgtgccccaccacatcacagctgcttttacctccctccaaaagtaactgctgccctgactttatggcaaagccaggaagaaacgccaggacctgccagtccccagttgtgcagcgagacactggttagccttgccgtcctttcccattaaacttgacttaaaaggaaaccagaatttaacatttttaaaaatctgtagggccctcccacccctccatcactttctttttcttacaacttgtcggttgaaggaccaggtcgtttggcctggggtgtgtcctgcgtcaggattgctggcggtgcccttgtggtgcagttctgcctgttcctccctcctctgaacttcctgcgcgttggtggctggacccagagactcctccaactctggctgcctccctgcggcaggacgctggctgctcttgtgtcccctcattgcgaggacacgggtctgggctgtgcgccccggggacggtggctggtcatgcttcatgcctagggccactagtcccttgaggttggagatggcggtgctcttagtctgtgagttccttctcacttcctctttggggtgttcttttggagactcttcctccactactgtttggccgcttggtgggtccagctcatagaggagacgcagggtaaacgcgagcatgttttcttccatatatccaggtgaagataatggatcaacaggttgtcaccctcagagggtgaccagtagttttacgttttagtgtgttgtttttattttttaccgttgtgatctcaaggacttgcacataatccatctattacagttctcattttggttgcagttcagactgtgccatctttggccaatggaagcatctccaggttggttcctgagtcacgctgggacgtggggctgatgtccttgccgtctggacgttaacatgtgtcaggctcaccttacacctttcctgtttcagaccgaaaaagtcatttctccaagaactggtttcttctagtgggaaatggcgtttgaagaccactcgctgggactagggatgtcattgctgctggggtgggttggccttttcagtggacagcactgggaaatgtgtgtaaaacatggtctcatgggcttatatgggtatttccaattcaggtagttcaaattcagaggtgtaggagttaccatgttcaaaatgacgtctttatcttcacagtaagaattctggctcttggctgccccaagggcttggggggtggggaattggaggggagggcaggagaaggagagattaaaataaaaggatcctggttatggacataggagataatagaattaaaatatctcctacctttggacatagcctgagaataagaatatgggcactcctgccgagggtggtgaaaacagccgaaagttgttcatgtgctttctcccttggccccgttttgtattttgtgctgtatttatgttgtcgaaacatttagctgttacacaccataagctctccctttcgccctctttgagttttagtgccataaataatgacatgtttaatgccgtgactcgtctttatgttgtgtctctgtagtcattttgatttttccaaatctcattctctgctagattcttttggaacgcttcatgggagcagccactcccaagttcccacctgctgatgagtttgtgccctttgtacctgaaggtctgttttttggctcacgttgtatttactgaagtgtcttaaggatgttactctggattatttcctccctaaagtgttactgtccaaatctaatgagagcctcattttacctcctgtaggccacgtgtttttcttccctgggtgtcctttttctcggaagccggctcatcccactggagtgcgtgctgggcttggttgtgctggggtggtgttctcagtactggctgtgttctttcagtgcggttcaagtctccttaggaacatctgcaataatgatcctttgtgtttgttctgttcttttgtttctttcttcagagagtcccattttccacgtgttgtatcttctttgcctgctggagcactttttacagtctcttaatttttaaaatctctctctctctttttttttgttttttggttttttagagacagggtctctctcacccatgctggagtgcagtggtgtgatcacagctcactgcagcctcgacctccagggttcaagcagtcctcccacattggcctccctaaatgctgctgagccacttgtgtccagcctaatttctctctctctttttttttaatttttattttttgagacagagtctccctctgtcacccaggctggagtgcagtggctctatctcggtgtgatctcagctcatggcaacctctgcctcctggttttcttctgcctcagcctcctgagtagctgggattacaggtgtgcaccaccacacccagctaatttttttgtatttttagtagagacagggtttcaccatgttggccaggctggtctcaaactccagacctcaagtgatttgcccgtctcagcctcccaaagtgctgggattacaggtgtgagccattgtgcctggcctaatttttctcttttttaaaaaattatcttttttgtcctttttggcttccatttctcttaaggcgtgatttgctgtttacctgctgttttgagtatgtgtttctgaggtcttctgtggtctgtagggatgctcttctgctttttatcctctttttctctcatgggagcctgtctgggatttgacctgaatgtctttctgttgctaatttcgacgtgagtttaggtttctcgaacttgtaacaggacacgtggtttgcagcgtttgctgactttgtggtgctcctctgtggttactttcccgtgatgttaagaacgggagtcctcagcgtctgtggctccggggctctgtgcacctcccaagcatctggactttgctttgccttccttgtccctgttctgctcagtactgattcactcccagcaggttctctcctgcgtgaggccctgtgctgcaggagccctggcaggtcagtgtgggcatttgcggtggccaggctgccctccctggtcctcccctgccccaggtttgactgcggctcttggagggacctgctgctcttcccaggaagtctgctggctcctgggtccaggcccgtcggggtccagttctgcagcgtccttcaggtgatggctgcttgtggttcatcttcatcagttttgttctaaagattgtccgctggcttttggttttgctgtgtcgttgctcttttatgtggaactttgggaagatccagaaactatgctacccctgtcatcgtcttccagaatacattaactttgaaaattacttattttagtttgaagtagttttcaaatctacagaaaagttgcaagaacagagtaaggagctccgtgcagactccggtgtatgagcatcacgctgtctgcttcgtccccgctacaccacatgtgtttgcgtgcactcctgtactttttcaatatgtacactttaatccttgttctgacacgatacccagcaccctaaatgctcgtgcggctgataccttaggtggctactaggcagccctcctggtcaggtgcttagcactgatgctaccacccccagcatagcacttgctgtgggctgtgtttctccacagcgtcgtggccgattcccatggccgtgttagcatttcacacgttcccacctcacacagatgccccacccttatcgcacctccacccacagcctcaatgttattaaccgcctgcctgtgtcgccacccctggggctgctcagtcgtggggatgcttcaggcaccccttctgttactgctggttgccctctgctgggaagcagagcttcgcccctcctcgttggtttattcgttcgctcatggattcgttcactcactgcagtgctgtggatgccagggtccctcattcactcactcactgcagtgctgtgggtgccgggatccctcattcactcactcactgcagtgctgtgggtgccgggatccctcattcactcactcactgcagtgctgtgggtgccgggatccctcattcactcactcactgcagtgctgtgggtgccgggatccctcattcactcactcactgcagtgctgtgggtgccgggatccctcattcactcactcactgcagtgctgtgggtgccgggatccctcattcactcactcactgcagtgctgtgggtgccgggacccctgttgtgtttggtgggctctgatcagcactctcattatttctaggcttgcttggtgggagcttcttgtggctggagtctgtatcctttgacacttccctcgtctgtggcattccttattgccacgtgcactttccctgcccactctgcagcttcccctggttcctctagtagagtctggtgttgagaggccaggatcggggcacttggtgtgctgattgctggggcccctgctcccaggccgtgccagcagccagagctcgggacccaaatgcatgtaggggagtgtgtggtgtgcgcccttccatgtcgaaggggtcctgtgtgttcgtgttgagactacggtccttgcctagcacgccagggcttccgtttagccgcccccatccttgtctattggtcccttctcagacagtgaggaacctggttcccatcattcagtgtatttgtttttttcttccgtgtaaccagcttcccaaccattttacctgctggggtcgcggcgccaggagggaggattggatgggaaaggcacattgatgaactttggatgtgagtgttaacgtgtgtggagtagcctctagggaagagtaagggagctcgtgcgtcctcactcatgagaagggccggggtgtggggctgggaggtacgtggagtatcgagaacgccggacctggaggacccaggtgaggcactgccgagtgggtgaagattggcgccggcgtctgtttggggagcagttgtttcgcagttgtttcgcttgccttttgtgaactttggggatctttgtgtgttatctgtgtaacaattcacacaaaacccagaaagtaaaagtccttcagacacctttcttcatcaaagatgatgctcagtcattcttttcttcttgtaggatacctcttaagggtaagtcttctttttttaacttttacttttgaattctatacttacaggaaagttacagaaatagtacagagagtttccatctacccctcacccagtttagcctcatgttaaacgtgggtatgatactgttcattgaagaccttatttgattttttcccttaatttaactttaaataaattaataaactattttttagagcagttttaggttcacggaaaaaggaggggacttttttagtacagagacttcccataccctcctccctgcaggtgcacagcctcccccgcttggccgggtggtgcgtttgttagaatccatgaacccacgtcaacacgtccttctcacccagcttccatagttcccatcagggtgcactcttggtgtgtacattctgtgggttttgacagctgtagaatgacgtgtttccaccagtaccgtatcatgtggagtcgttccacagccctgaattcctctgtgctctgcccgttcatccctcccctcctgtcagtccctggtccacggatcttattgtctcctagtttcgccttttccagaatatcatgtggttgaaattatgcagccttctcaaactggcttctctcatttaggaatatccacctgaggttcctccgtgttttttcatggcttgatggctcatttcttttcagcactgagcactattccagtgtgtggctgtgccacagtttattttatccactcacctactgaagcacatcgtggctgcttgcaagttttggcaattatgaagaaagctggtataaacatctgtgcgcaggatttcgtgtggacataaattttcagcccctttgggtaaataccaaggagcacgattgctggaccgtgtggtaagagcacgtttagttttgtaagaaaccgccagactgtcttccagcagccgcgccatgttgccttcccagcagccacggctgagggtcctgtttcttcacatcctcgccagcgttcggtgctgtccgtgttctgggttttggccgctctagtaggtgtgtgcatcttgttttaatttgcatctccctggtgacggaggatgcggagcagcttattgttgatattgttgagtttcaggagttcttggtatattttggataatagtccattatcagatgtgtcttttgcaaatattttctccttattcgattcttaccagtgtcctcgacgtcctttcctgccccgggacccttgcggctcctcggctccttggtctcctctgcttggtggtagctgctcagtctttcctggtctttgatggccttgacgtgctggagagctctggtccttgtctggtggacgtttccttagtttgcgtttgtctggtgtctcctcgtgatgacgtccaggctgtagaatctcagttagaatgccgcgggccggctggcgtgtcctcagagcactggattgggaggcaggtggtgtcgcctggctgttgctgctgctgctgctgactttgaagcttggttaaggtggggttggctggttactccattgtcgagttactctttttctctgtgtaattagtaggtatctcaaggagacacttggaggctgctgataccatttcttatcaggcctttggcccctgcgtgggcattcgcaaggacgctgccagtggaggctgctgtggcgtctgatgctgactttctatttctgtctttctgtttacatttattaattggaattctgtaaagagagctgccccgtctcccttatttttcccacttgttaattcattcagttacttacttatattagcatggatatttatttttttctgtaggtaacaagctgctgctacagtttatttattttgttgcttgagcagcccggctctggccatcatgagctccttcaggttagttccatgtccttgtgacacgacaagaggatttggtgactttatgacaccacagaatgttccagcacatcttctgttttccatgatttcttggaggggcattgcttcctttgactggggatggtgtttcctttgatgggggatggtgtttcctttggttgggaatggtgtttcctttgattggggatggtgtttcctttgattggggatggtgtttcctttgattggggatggtgtttcctttggttggggatggtgtttcctttgattggggatggtgtttcctttgattggggatggtgtttcctttgattggggatggtgtttcctttgatgggggatggtgtttcctttgatgggggatggtgtttcctttgatgggggatggtgtttcctttggttggggatggtgtttcctttggttggggatggtgtttcctttgattggggatggtgtttcctttgatgggggatggtgtttcctttgatgggggatggtgtttcctttgatgggggatggtgtttcctttgattggggatggtgtttcctttggttggggatggtgtttcctttgatgggggatggtgtttcctttgattggggatggtgtttcctttgatgggggatggtgtttcctttgatgggggatggtgtttcctttggttggggatggtatttcctttgattggggatggtgcttcctttggtcggggatggtggttcctttggtcggggatggtgcttcctttggtcggggatggtggttcctttggtcggggatggtgtttagaaccatactctgggcagcaggtgtgctcattgctcctggggtgtccctgcatccaggccttccaggtggactggggcatgtgcacacacacaaacactcgtctgcacctgcacctgtgctgaacacagcggccttctcacttctcctcaggcctcaggatctagtctgacgtcacaggctcattctagcttccctcgtgccttacatgggaacctggttctcatcccccacagtagatgtacttctgtgttcagttccaacatacagataaaggaccttcgggattgccaggcagtgtgagaaacaaacgtgctaactacctggagtgtagcatttctgtgcggcccttttatttaacctcacaggtcaaaatagtacatttcaaatttacatagatgagtattgttcttgtttatcctttcatttttactttttatgtttaaatttttattatttgtttttagagatggagtcttgctctgtgtcctgggctggcctgaggctcctagactccagcaatcctcctgcctcagcccccaccaggagttgggactgcaggcacacacaaccaggcctggcttcctgcccacccttcagtgtggccgtcattcacctgcagcacagctcgggtttagtccctcagtgtggccgtcactcacctgcaggacagctcgggtttagtggttactgtttgtgttcctgttggtttcctccaaatcttggttgattttttgtttgtgagaggtggagcgttgccatggtccggagagtcagaactgtacaaaaacgtatagaaagaagtgccccttggagtnnnnnnnnnnnnnnnnnnnnnnnnnnnnnnnnnnnnnnnnnnnnnnnnnnnnnnnnnnnnnnnnnnnnnnnnnnncagcaatcctcctgcctcagcccccaccaggagttgggactgcaggcacacacaaccaggcctggcttcctgcccacccttcagtgtggccgtcattcacctgcagcacagctcgggtttagtccctcagtgtggccgtcactcacctgcaggacagctcgggtttagtggttactgtttgtgttcctgttggtttcctccaaatcttggttgattttttgtttgtgagaggtggagcgttgccatggtccggagagtcagaactgtacaaaaacgtatagaaagaagtgccccttggagtggtgtcctgccacaccctccacccatcctcccaccccctgccccgtcctcctgctgcgccctccctccccccaccacatccgtcctcccccttccgccccctcccacccccgccacccctgccctcctcccaccttgctcgccctcctcctgctgcaccctccctagtcctgctgcaccttccctcctcctgccctgtccccgtccctccatttttgcatcccgtttctactcaccatgcaaacagatgagctcctgcatctttttccttccctggcagtgcagcacaggtcagtgacagtctctcgctctctgcagctgacagagttcccgggcactgccctcgtgtcactgcatcaggagcttcctctttcccagctgggtgctgatgtcccgggcactgccctcgtgtcactgcatcaggagcttcctctttcccagctgggtggcacttcatcgtgctgatgtcccgggcactgccctcgtgtcactgcatcaggagcttcctctttcccagctgggtggcacttcatcctgctgatgtcccgtagcttttcaccctctctcgtgtgcacatctgggctgtcgacacggtgacaggtgatgccatcaagagtcgccttgtacgtgtgtcttcgtgctgttggaggcctgctgttggggctgagttccgagagatgggattgctgaattgaggggttggtgcgtgtgcacttgtgttaggttttgccaagtccccctgttgcgtgtgagagaggcagctctttccccagcctcacacgtgtcccacgtgtgttgtcatagttcttgtgtttgctggtctgggtggtgcagtcagcgtctgtgggtgtgctgtgggtgcgtagggctgaggcacgtgatgagcgggtggacatccccgagccgctcctcagtgatgaggtcgctcagtcttccggctgctggcttagttttgtccacttgacctgttctgcggcaggcatgctgttccatgactgctgctagcatgtttctgtctcgtcgcatctcctgcgtttttattggtaggggctgctgtgttgtttggtgcataaatatccacgtgtcatatcttcattggcagctgtgactttttgcattagaaagtatctgtctttgtcacacgtcagaccgtcaccctgggtgtctttcttgtcccccagcctacaatccctgagatccttacttttcaccttctgaatcactttgttttccgtgtctctctgtagcatatggtttggtctcagtttatgagctgaattgaaaatctttctcttttaataggtgagttaagcccatttacctttattgataggactgacatgttttgtcttgactctatcataatattttataattatgtaaatttttatctatcttttgagacatggtttcactgtcacccaggctggagtttggtggcgtgatcatagctcactgcaactttgactttctgggcttaagaaggatcctcctgcctcagccgccccagtagcctgggactacaggcacacagcaccgcatctgactaatttttaaaatattttgtaggaatggggtctcgttatgttgcccaggctggtcttaaactcccagcctcagggaatcctcctgccttggcctcccttttcaaagcattgagattacaggtgtgagttgccgtacctggcctgaattttaaatatttgctgtgtttctttttctgtgagatgtttattctttgctcttttaattgattttttttttttttttgtatttaggaaggtttgtatctgtgtcttcctggttacttttgtacttaaactagtgacgacgccctggtctcctgtctcacaggactgttcacgctgcagtcgagcagtttgcacgggcctggcagctccactgttggccatcggcgtctgtgagccctagtggcttcttcctctgccttttggtgacaggacctccacaggggaggcacactctggtcctcagcctccctctcccgcctccgcctcactcagagcctgaggatgtctcttccctgcagtttcccgcccaatagaggaggctcttcctcccattcctgaggctgtttctgggccctgaccggaggcggcttggctggctcagaagtcttttctgttcttgccttgtgggggacgggtggggaggggggtgcaggctgggaggagccatggaggctgattccttccccttcatgggttctcttctcttcctccccggcagccctgccgtcggctctgagagcccgtagtgtatgaggttgcatctcagagtcccgccgcccactgggccctcgcagtgcattgggtttggtgtctcctctcgggtggggtgtgggtttggtgtctcctctcaggtggggtgtgggtttggtgtctcctctcgggtgggtgtgggtttggtgtctcctctcgggtgggtgtgggtttggtgtctcctctcgggtggggtgtgggtttggtgtctcctctcgggtggggtgtgggtttgttgtctcctctcgggtggatgtgggtttggtgtttcttctcaggtgggtgtgggttttggtgtctcctcttgggtggggtgtgggtttggtgtttcctcttgggtgggtgtgggttttggtgtctcctcttgggtgggtgtaggttgtgtgggttttggtgtctcttccgggtgggtatgggtttggtgtctcctctagggtgggtgtgggtttggtgtttcctcggatggggtgtgggttttggtgtctcctctctggtggggtgtgggtttggtgtttcctctcaggtaggtgtgggtttggtgtttcctctcagtgggtgtgggtttggtgtctcctctcgggtggggtgtgggtttggtgtctcctctcgggtggggtgtgagtttggtgtctcttctagggtgggtatgggtttgatgtctcctctccggtgggtgtgtgttgtgtgggtttggtgtctcctctcgggtggggtgtgggtttggtgtctcctcttgggtggggtgtgggtttgatgtctcctctcgggtggggtgtgagtttggtgtctcctctcgggtgggtgtgggtttgatgtctcctctccggtgggtgtgggttgtgtgggtttggtgtctcctatcgggtggggtgtgggtttaatgtctcctctcgggtggggtgtgagtttggtgtctcctctcgggtgggtgtgggtttgatgtctcctctccggtgggtgtgggttgtgtgggtttggtgtctcctctcgggtgggtgtgggtttggtgtctcctctcgggtggggtgtggtttgctgtcttttgtgaacgtctcctgggtcatggtgtgaatgtcccactctgcctgagggggagattcgcccagctctcatttgccctgttttctcctgacccttttcctcctttctgtgtctcgattctgtcctcttggcttcctgcctttcgtaggttccttactgcattttcaccgcctcccctccctcagactgtttgcagtttattcatttctgagataattttgtctcttccttccattactttcttaagtccagtcaactcttatttccttttggtgttgcatttgtaattttatggtttttataaaaatttgtctcctagtttttgaggttctgatttgaggtgatgattttcatatccttaagtgcacacttaagcagattttcctgtattgagagtgttgttaattttcttgttgttccagggtaggtttttctctgatgtgtgtggagcccccattttttgactcttctctgactttcccgtggctctgggtggctttaccgcctctgtccctttgccctggtggccttggggtatttgccacatctgtggtttcctggtgccgtctgctggccacatggggaagtccaggtcttgagcgggtccttgctggtgtgcaggacggaagttgtcctccagttctcccggccctttcctgcaggacccagaacttccccctttccttcttttctgcctcaccacccagtggccaaagggctcctctcaggacatgctgtgttgccttgacaaccccttcccgtcttgtgctcagtggtccctgccctgtggtctgcactgaccttcctggacacctctcaggccctgggacttggggtggcttagcctttcagcagtggcttcccacagacccctgtcccaccccgccccaccgcggccttgcaggggagagactggggggtcaggctcaggcgtgtgttgactctgcgccgacttgcagtgattttgaagtctaggcgccctcgtccagtgcagacggcgatgctggtgtaaacctgcgttccttgcttgtgctgaactgtgtttggaagagaggctgggagacatcagctcggcagccacgttgtcttcggcctcccggaagtgatgctaactttctaagctgtgtgtctgagtgtttttcgctactactgctgttcttcaaaacgtgctgccagtgacctggccttgtgtgtgtgacaccccgtaaatggttaggcacggagagggcacgtacgcgttcggggcggaggtggctggagtgtgtgcggcataggctattgttacccgccgcccggggcggctgtgggcatagcattctccacccattgctcggctggggctccgtggcggagtaaaggacggaccaaggggctcccgccccgggagcagacgcgctcctcccggacagcccccaggtgctgaccgtgtggggcctgacgtttgggtggtgcagaccctgcaccgggcggttccgcggacggcgactctgcatttggcttcgatactgagtgtctatggcacatatgcggtggagagacctcctcctttcatttgatccttttgagagccctgtgatggggcgagggctgtctgcagcgccatgcgtcagaggtggggacctgcaaagggagggctcacgtggtatgtccagggccgcggggattttgcttcgcttgcttgttttctaatcccagcacctgtacctaacaaaccccaagcccctgtgtttggagttgtttaggccgaggcccccagggctccatgttggtgccggcccttgtggagctgtctgtcgtcccaggctctgttttgcgccattgcgcctgcacatgccgcagtccctctggagtggccgtcgcgcctgcacgggccgcagtccctctggagtggccacggcgcctgcacgggccgcagtccctctggagtggccacggcgcctgcacatgccgcagtccctctggagtggccacggcgcctgcacatgccgcagtacctctggagtggccaccgcgcctgcacgggccacagtccctctggagtggccatcgcgcctgcacgggccgcagtccctctggagtggccatggcgcctgcacgggccgcagtccctctggagtggccatggcgcctgcacatgccacagtccctctagaggccgtcgcgcctgcatgggccgcagtccctctggagtggccatggcgcctgcacgggccgcagtccctctggagtggccatggcgcctgcacgggccgcagtccctctggagtggccatggcgcctgcacgggccgcagtccctctggagtggccattgcgcctgcacgggccgcagtccctctagagtggccatgggtgccttgaccctggtccccacaggcccttctttctcaggagtcccatggagctggaagcccccactaagcactcttctccaagcaggctccatgaccagtccctgcctgacccctctggctgctacgcccaccatgggcacagcccgtgaggggtttggatgaatctagggaggaaagccactgccactgccgtgtgggttgggcacagaaggccttggtccgctggcagccccagtcctgagaagagagggggaggttcctacgagatctccactccatcttcagagcagtttagcaacaaactctctgcgggagccaaaatccacatagaattctgcaagcaaagaccctatgggaaagacagggagtctggacccctcctgcctggggcgaagtgggctggggagaagcgggagtgtgccatgtagagaaaggcaattggagtatcaggtaggttagatttgcgtttttcttttaagatttaagaaaaatttgaagaaaaatttgtattgataaaactcacagaatctggagaagttatattgttcattcatagtgcaccttcagagcttggtgcagaagcagggcctggcatcagtttctcagcgtgctgggccctgggggtggcctcagccccaaggaggcaccgtctggccttggttggtctcgccccctcccttggttggtctcgcccccggccttggttggtctcgcccccggccttggttggtctcgccctcggccttggttcgtcttgcccccggccttggttggtctcgccccctcctttggttggtctcgcccccggccttggttggtctcaccccctcctttggttggtctcgcccccggccttggttggtctcgcgccctcccttggttggtgtcgcgccctcccttggttggtgtcgcgccctcccttggttggtgtcgcgccctcccttggttggtctcgccccctcccttggttggtgtcgcgccctcccttggttggtgtcgcgccctcccttggttggtgtcgcgccctcccttggttggtgtcgcgccctcccttggttggtgtcgcgccctcccttggttggtctcgcgccctcccttggttggtctcgcgccctcccttggttggtctcgcgccctcccttggttggtctcgcgccctcccttggttggtctcgtgccctcccttggttggtgctgacacttgcgttagaatatcttgatttcttaccctcggcagcctttaaattgagcacctgagatgagcgtctctccttcaccccggtcctcttttttagctgctgaactattttgaagatagaaacatcaaacacagtccggaatttatagcaggtgtcactgggtcacacagcctgtttgggtggtgcctgtgagagccctgccctcaccctgcaaactgtcactcacctcgcctgagttctcttttgggaggcctggccctcaggtgcggatcactttataatgagctagtgtggagtgcggaggcttcagtagcaaagggaccccgggcaggtctgaagaagggccctcacagcgcagggcgtctgaacggagacaggtgccctcatctgtttgaatctcacaggaataaagaaaatgcagtgggtcagagacacacttgcatgccatcacacaaggcagccatgctcccagcctgaactgaaagtggcagaacggggaaggggggaggaaggacgggatgaggggcggggccatgtcagggctgttcacagcaaggctcccactggcacacacagcagaatccgctccttccagcatcttaactttggttgagaatgtgctgtaaagatgccatcgtaatctttgtacttaaatatatgtgagcagctttcaccatcggagcagaacttagttttcatgccagctgggggaaatgacagctgttgggagttgtgtggcacgtgccccgctgggcggtgtcgtgtgtgtgtggtgcgcgccccgctgggcggtgttgtgtgtgtgtggcgcgcgccccgctgggcggtgtcgtgtgtgtggctcgtgccccgctgggcggtgtcgtgtgtgtggcgcgtgccccgctgggcggtgtcgtgtgtgtggcgcgtgccccgctgggcggtgtcgtgtgtgtggcgtgtgccccgctgggcggtgtcgtgtgtgtggcgcgtgccctgctgggcggtgtcatgcaggtgtcatcagctgaaaccgccagagctctccacaggagctggcacgcagcagctatgcttctccaagcaggaacacatctgaggcagctcgggagacacctggtcacctgtaggggctgacggaggcggcgtctgtgcagccagggcccagccagaggctcagggatcactgtgggagccactgagaaacccagccttcccagctgacccagcatgcccagtcccagccaaccccaggcctcccagtgcaggaattcagcagccaagcggggatgacacacacagacctagtgtggcttttgtgccccagctgagtccacaggcagtccagctgtggtcacatggagggtggccctggggccgctcagccatttgccttgggtgggtgccaccccctagtccatcctcagccccaggaccaggtccaagcactgtggggcattgggcagcatctgagtgtgccctgtcctgaaggtgcagcatggggcctcctgcccttgcccctgccctggcagggccctggacagcaccccagctccagctgtgggcctaccggaaggagcccgtgccaggcctggcctcctctggaatcggggtacttggctcagatacacaggctcattgcaagccccactctgagccccactaacacactgtcttctcctttttcatcaccaggggtcgggccccggctcagtggtcccaggcagctcgggtgtcggaacccccagacagttcacgcgacaaagaatcacgcgggtcaacctcagggacctcatattttgtttagaaaatgaacgtgagacaagccattcactgctgctctacaaagcattccttaagtgacacaggaggacgcctggggactttttatatatttgcagattacgcctttttgtaacgagcaaatgggatattgtttaaaaaacagccacctctttacaatggaacagttttatattcctgtttctaaatcagctcttcagtgtgaaagaaaacacgtttctgtaacagagagaacacaaaggcctgtggatactcttaaaggacaattaaatcttaactcatcttgattgagtggccttcctgccaaacaagccatatataaagactgatggaatcgttagcaaataattagctgccctctgtcaactcatagcagtttctgcattatttgtgcattttggtttagttctacctaacttactatgtaggtgtatgtctacagccgatgacctcatttcgtttattttatttttgtaatagtcagttggcaaagcaaactgattttttagactatttatcttccttcccttcccctcccaccccgctctcctctctgccccctgccctcccctcccctcccttcccctccactccgctgagaatcctggaggaatacacaattcatcgttgcacccccacctcagagtgtaatcgcatttctgcttggtagaggccgagcccagcaaaggtggctccttctgaatgtgtggtcagcatctgtacaaatgcattttatttgctatagtttgtaaagctgtaaagttaaaagagatgaaaaccttttcagcataaatatattttacttgcactgtgttttttagctaaaagtgaaaacctagattaaataaaatcaaagttgagaagaatcatcaaaagactgtttctcggtgtgaatcaagtgttgaaaaatggttggtgtattttgtcagtaattgtacataacttttggcacatgacatagaaatggctatgtaaactataattattttgctaagagactgtatgcaagccttgggccgactttacagacgtccagagcaaagccccttctttgtacctatttttttattacaaatatactaattggttctttctattttcagaggttattgtatgaaattgtctattgatagtacttttatgactgtaaatactctggctttctccgtgtgaattctcacattagactttaattcgagcgcgtgtgaactgaacgctgatcagtattttttatcaacacctgagaactgttacaccttttattttgtcttttaggaaatccctgtctttccattttttcatgtaaattttgcacagttacttgttcatatgtaaatattttactttcagaaatgaagtttttaattgctattgttttatataggattgaaagaaaattaactcctttattaaaaacaaatttatctgtatttgttttgcctatttttcctccgttttccagttttagattctactgccagattgcactccggctctgctgaggtgctggtttctgagccacctgttggaatctgtagctgagccccatcagagccgggagaaagaactttctctgtgaggacaggggccgagctactctctgcgtggagtctgggggctggcggctgcgcttaacaccttctgctgtcacaggtggagatgagctgggcacagctaggaggggcggcgggaggcccagtgctgggggagatgtacacagaaacgcacgtggcgagcccggctgaggtgcccagagggccccagccttgacgcagacctcctgtggcgagagagggcgtctccagggcagtttgtggtattggttggtcctgacaggtcacagctcctgctgggccctcagaggctcagcgccaatgtgtaccgctccctgccttcgagcaccttggagagcctttgggaacggtctctgatgcaattggagttggtctcccattgtgacgttcactccacctactgtgacggacccacagcgatatgcaggtttacgtacacgttctgctggagacactgcccctgttcccacacctgttgcactgcccc

SEQ ID NO: 16803 - DNA, 67002 bp, Human
  misc_feature (1)...(67002): n = A,T,C or G
cgtgcaccagcagacacagggtgggggcagagtgtgggctctttacccagcccctgggccacattctcttgtccactgcgctgcccgcctgcctgccagttgctcccggggcagctgtctgccgggaagcagtgagcccggtgattaaccctgctggtgctggcagctccggctgacacagcgcattctcagggccggcccccgctcccctcctggccagtgccgggggacagcggaggcctggcagcttggcctgatctggccgctaggaggcttaaagtgctctccccacccccacctctccccctgccccgccactcgcaatcccacccctccaaccacccgaccctccagggatcccaagaagccctcagggtctcaggagtctccacctccagtcccccaggctgtcagagccccaagctgtcaagggggagcccagagccagagcacactgcctggggccaagcccccacctggggacccgctactgcccagaggccactctctgcctcacacgggatctaaagcagctcagagccggactctgcgcctggactgcagattccttgatgtctccgccccctctccagccagcccctcccccacttggagcttctcctgccaaggggagccgcctcctctcccccctcccccaggtgggagaactaatagtgaagttatggaagaattgccgggccggaaagtaggaggagggagagagggtcccatcgccctcccgactccgtagagaaagggccatacaccctcttgggatttgagatttgcaggaggccagggcgccaggaaggtgtgcaaggaggtgcaccctccagggacagctgctagctcagaacccccaccagaaccggctggccagtgccccacaaacccacccagccccccgggactgtccagggaacccagcgagagatgagccccacagcccatctgggaccatggcccgcccagctggcctggctcagggatgggggtttgctgccagctcggcagctgcagccccaccccgccgccaccccctcggggcttccctggaggcagatttggccccggagcccaagggaagtaggagacccagggccgcagccacccaaaggcagacgaagacctgatctcggcctctaggtcctgtgctgtttgccaggcgtcctcgagccgccgatcgtggcaggaacgcgtgcgcggctgtgcagcgggttggaggccaggccgagagagctggtggagtccaccgggccccggagcacaggtgcttccaggcacccagcaggtgctcagcagctgtgaccagagcccccgacctccttaagagccaatttggcggctgtggggccatgagcaccgcccccgtcctctaaagggggctgcagctgcaggccagtccctcctgcccctatttccctatctgagagtatttttaagccctgctggggcaggcgggagccaggccgagttgaacctgacctggctgccccaggaagcagggggttcccacctaggctgccccgttcctctgcagatggtcattcgcgggtgcagagggcaccttcccgcagccagcaggacggacgctgttgggggaggagcgggggcagccgagtggtgcacccaagttaggggaacaaagagtgggcccctgggctgggaggagctggtgggcgctctgggggccagggcgtcgtggggagcgctagggtcccacccgggacccggagctacgacctgggctgggggcccggcggcgccgtcgtcccacggcctggcccgaggccagcaggtgccccttccgggaggcggccgggccggggtccgaagggttaaggcccgcccggccgcccctccccctcctctctccttccccccccccaccccgcctccccggacctctccccggggctcggggctcgggcgctcgggcgggccggggcggggcctgacgtccgcgggcggagcgagccctgccggccgcctggcttcagacccgccgggctcccgccgcgcgcgctgtccctggagctcggggacgcggcccggagccgggaagatggcgaagcggctctgcgcggggagcgcactgtgtgttcgcggcccccggggccccgcgccgctgctgctggtcgggctggcgctgctgggcgcggcgcgggcgcgggaggaggcgggcggcggcttcagcctgcacccgccctacttcaacctggccgagggcgcccgcatcgccgcctccgcgacctgcggagaggaggccccggcgcgcggctccccgcgccccaccgaggacctttactgcaagctggtagggggccccgtggccggcggcgaccccaaccagaccatccgggtgagcgcaggggcgggccgtggggcttcctcccggggcactcggacccggaacaccggcccgaccccagggggagcgccgtggcccggggcgagtccaggtgcggactctctggttccgcattttgggggcccaagaaggcaccccgacccggccgctccgtctcggccgggaaacttcgcgtccctccgggaaggcggaattaaagtccccggcatggacccgggggcggctgggcgccggtccagttcgactgcggtgaccggggcgggaggggggccgggcccagtccctggcggccccaagtccgggatcccggggagggcgggacttggcctccgccgcctgctgccggtggggagggggcgcagctccgccctacccgggacaggctggaacctgttggcctctggatggggtgggaggggccagccacctgaggctcccactagcccctctcggaggagtctagggactcgaggagacctccaaagtaggggagggccagctgcgaagttttgactggggctgggaacacgtggctcccaggaggggcagcatctctgcccagcaggtggtagggtccgggggcttcagtctccctgggagatgtgggttcaggccctgaagaccccctggggtgcatgtcccctccccaacaagccttaaacctgtaggcgggttctgttggtggactccatgcatggacacctcacctgaaaaccaaggctcttggggccctgtagacttaggttgggcctggggtcagccttgggtgaggagcagcaaagtcagctccaacggctcccaaccggccgctctaggcccattccccacctcagccccaccttagggagagtctaggggccctgagggcctgtgtaacctgagctgtctcctccctggtacctctgccttcccggaaggagaggctggggcaggggcgagtagctggagatttgctgggtgggggcagagggccctggagcaagacgttatggggatgaatggaggagcctgggctgggcccgccccctctgcctgccccacccccttggccctggtggagggggaaggagcctccccaggcttctgggctcaccgttctctccttaagcccagcacagtcctctgagataggaggtctcaagcccacacttcagatgggggatctgagccctggaaagctgctgacacctgcttggagccccccagccagaacagggtccagcgggggttagctgtgggaacctgggtgcctcctggctgcccccttatctggtcaactcagaggggccgggtctcaggacggagggcctgtgactgtctccttacctgctgccacacctcaccacagagggcctggctgagtgtccccagctgagattttgccgttctggcaggggaggctccaggtgccctgtgaacctcagaccacccccccacagcctgcccatgctgcgtggctgggggccacaggccccctctcagatctgtctcctctgtgggggcttattacccccgtctcgtgagtaaagggccagcctgtagtcaacgcccctctcctctgcctcagctgtgtggcttccctctgtcagcctcaagctgtctttaaaatgggcacagcgtgctggcccgcctcacctgagactgtgagcttggcccgaggagcctgggaagtggccacagtttcagtggcagctgtgggctgtggtgctccatgcctcagagccagcttggatgagaaaccagccggcctcgcccagctcatgtctagcaatagaggtgaacccttcgcttccaaagtctcgagctctgagcagtgagtgcccgctgaggctgccagatatgtagaaagatcagctggtagacgtgagctggacgggtatgaccttggatgcctccttcatctgagagccgcgggtctgctgaccgccctggccgcggattgggcgtgtgagaagtccttgccggccggtctggagtggagctgcggttggggcaaggcaggcaggcacaggaggtgcccaggcgatgaagccgcagctccatctgagggggctcactaaggctatggggcctggggctgggcagtgtgttctcaaggctgcaggccaggggctctcagggaccctctgtaggagatgcacattagctgggcatcccagatgggggtcggggtgaaccctgctgggcagctggagcaggcagagggcagggggaggttgtggccctcacagccccaggtgggcatcaggggatccctggccggcccagcctgggaaggtggggactgggcagccaggccagcatggtgactcattggaaggggaagtccttatcggcccttctgctgtttcctagctctgttctcacgggaccctccgcagcggaggtgggggagcctggttttcccaaccctgtcctctgtggctcagtgagtggccgaatggggactggaactgcctcccaataactggaccaacgctggcccaggcagggactgagcaggtgcttccctgacctcctggaagagtagaggctgacccttgacccgcaaccttccacccagcttccctctgctgctcgtgtgtctgggagggtcttgaccagcaagcagccttccctgggaggtccggctgtcccagccagagggcgccgcccacacctaccttctccaggagcccctggccccaccctgagcaggacctgtgtgcgccgtgctgtcattgagctcttgagtttgggggccaccatcaaagcttgcagtgcggcctgcgggtaggggtcgtggcgcttaactgggtgtcttcagttgctctagccccatccacgagaatgcttaggtggtgagctggggacacagcgggaataaggagggtgtggaccctgccactgcagagctctgggggaccccggggaggcccccagataattccaggtctcatacatgcagtaaaggaaatacagcagtggccacactgggggctgcagagctgcatcttgggtggtctggggcaaggtctgagatggggcaatccaaacaccagggcggggtcttgggagcctgtgggaggggtaccgggtgttgccctggtgctcagtggaggcagagggcacactctgggcgagggggttgggccctctgtaggtgctgggcctgggggtggggagaaggcatctccccagctcctgcctcctcctcctaggatgaggtctggccccccaagggaggctgggcggggtagggccgctgactttctcaaactcagattgaggcctctggggcctcaatcaaccccaagcctgggagggcgcctttgtgtggacaaacagcagatctggtttcctgggggggcgggggagcagccaggacccagctctgccccctctcctcatccctgccccggctcccagcactacccctcccctgccaggatgcaggccaggattctgctgggagcctcctctcttccccactcacccatgcaggacaggcccccagcagatggcaggcccgggacagaagcggctgccaggctgtgtgtgtgagccattactcctcacggtggccccaggcaggtgcagccttatccccactctttggatggggacattgaggctcagcagttactgtgacttggcctcttcccaggactcggaagcagcagccaggaggcccaggcccacctgccgctgtccacacgtccactctggggccggtccccacaggcctccggaacagcttaattctgtctctctggagaccctaatccagaaggctgtgggcaagatctggaggtggggcggggtctggccgcctggatcccggccctgacggtccttctgtctgcagctcccccttccgccccctggcttgctgcattttgtccaagcctctctggagcccctggcagggccagcagggaggggtagccatgctttgccttactcctgccccttcttgctccctttggctctagacacattgatccaccttgtggtttactgtgagactcttcctgcccccagggctcgttgcactggcaccccctctgcctagagcacacccccccccttaccacgtagtgctcagacgccaccccgctagagaggcccaccgagattttcccacccaaggcagatgcccctctccaccctggtcttcctcttgtccttagcgccgtgagcagctcacatgagccacatcccctgagtcggaggagcagcaggtgcttggcgcatgtttgctgagcaagtggatgaggggcgcagaggctgggcgtggaaccagctcagtgggaccaggacttgtctcggggcagcagggtgactgtggaggaggaagggggccccggcccttctcggctatctgaccctcccgttccctctgcagggccagtactgcgacatctgcacggctgccaacagcaacaaggcacaccccgcgagcaatgccatcgatggcacggagcgctggtggcagagtccaccgctgtcccgcggcctggagtacaacgaggtcaacgtcaccctggacctgggccaggtagggacccttctttgcgtgctgcagcccccatctctgtgtctgtgcccgtcgggcctaccttgggccacaggaccagaaggcgaggtctccaccgtgagcgagacctggggcctgggaggctggacacgaaggacttggtggggggagtccccacagggacaaaggcacggcagtggtcaccttttgtttgtgctttcagcgtccccatgacacagggaaagcgggtgctcatgggggtgtttccaaaggccacagagtttggttgcgggtgctgagtagacagcttggggctgggagggcggaggtgctgtgagcagtgcggtggtgccccctgcgtcaggcgccctgctgtttaaggaattcctggcaggtgcgggaggggctgcaggaatgcagaggaggctggcgcaagtggacattcctgggatacctgtgccgaggtggcggccactgagggttaggtggggtcgggtgcctgctctccagtccccagctctgggctctccttggccttggaggcccctgcacaagcaggaggctgcagctgggtgcctccaagcgaagagtgaaacccccaaggtgggcctgcctggctgccagccctgagcacccccagattgggggcgacttggcccgggtacccagccttgaggtcctggcctgtaaaatgggccagtaatcctggtgcttcttaggtcagggacagtggtggggcaggtggaggaggctgggcctgagagcagccagtgcctggagtgggggccccagggctgacccagaggcctgcatcccagccggctccgccgctgccccagtcccagtgtgtgacacatcggtcttcacccctgtctgagcctctgtccctgccattgtcccgagggtgttagagatagaggaggtctccctggagcctggctggagggccggccccaaggggcaggcacctttggcagccttggtggtctgcaggcctggcccgggctgggcaggcagtgaggggagggctcaagctccaaaagtggcctggaatttccaggggttcctgaacttgcagagccctgtggagaagggcggggagctggggaggggttgcctgtcctgggctccctgcctgcctgccaggcccctagccctgccctggcctgggtctgggtgtggctttgcctgtttaccttcatctcactgggtttccccgcatctgactcccctgtcccctggagcctgggggtccctcatctctctggcacagcagcagaggcccccaccttggctgtagcgtacgtgtgaattctcagctgctcggggcgggaagctgggcactggcgagttcttcccgcctctcctcctttgagaaactagggggctgggctgggggaggggagatggcccagtctccacggcaaccccagggtggctgcagagccagtgggcgcagtgcccgatgtgcctgggtggggcagggaagccgggactgacactcggacccacgagcctgggctccaccaccccttggctctggggctctctcggcctcggtgcacatgtatgaactgggctggaaacttcaggcctgaagccagtttgcttttagattgttctgggccagaaatcaggttccgccatgtgagcgtcttgcctctcacagcctcagtttcaccaactgtaaaatgatacggagggaagaggaaccctttccactccacctgggaagtggtccctccacccacccacccatctatccctccacccacccacccacccatctatccctccacccacccatccacccacccacccacctacctatccttctacccacccatccacccatctatccctccacccacccaccacccatctatccctccacccacccacccacccatctatccctccacccacccaccacccatctatccctccacccacccaccacccatctatccctccacccacccactcacccatccctccacccacccacctatcctatcccatccctctgcctgctgacccacccacccacccacccccaacgtatccacccacccacccctacccatccatccacccacccacccccctacctatgcagcacccaccctttattccttgtttccatccatctgtccacctgtctgctcattcctccctccacacctgcaccgtcttccttccttctcacccactttcctgaccacgtggatgtatctaccaaggcccctgtctcggcctaggccagggggctgccagccttggtcagggtgggggcagggactccctggagtggggtggggaaatgtccttcctgggcttcagggctgatcctggggcggggctggggcctccatcaggaagccaggctgagcggcgggtgggtccgggcactccccctgcagcgggctgccagcagcctttgttctgggatctggagcggatgccctgggacgggggtgggggcggctggcactgggcatcgggaaggcttcctgctcctggaaggctgaggagggcggggtgggctgcatcacggttcggatctcatacccctggtgtgcggtggggcaggggctggcgcaggggaggggagactagtccctgtggtgtccacccagaagcagctgagcctgggcccccgggagtgccagctgggctcctggcctgggtcccgctgcgcccagccgtggaggggttctctctccaagggtggggcctcaggaagaggctccagcgctggtcactggtgactcagggggcagtttccgagttccagacgtgaccttccccagggggtccttctagggggttcttgcgtatctccttgcatcctccggaagcttctggaactgagcggccacatcactggcctcaggctccttcttccgagaaccacacccaggccccaggccccaggcccagggaagggtgagcgcgttcatgactgcccaggcacatggccagcgggtcctggcttgagctcccccaccccctggctctgccgcagggtccaggcccttgccccactacaccagcacgctagcccagcgggcccaggttgtaaggagctgggcagggtgagtggggctggctctggcctgtgtcccctccctctccagtcggcccctgggtggcctgaccgtgggggcggggctctccccagcagaggagggcattgcctcccgcctccctcagatgaggagtgaggacgcacgggcccccttccggtagggaggcccctgctttgttctctgtagagcaggccacgctgcaggtgctacaggtggggtagcggctttgtcccagtccccgaggcccagagctgcagggcaaatggggaggcccaggtgggggtcaaggtgtgggggaactggggctggcagggtataagggggcagttaggcatgaggctagaagtattggttgggggcgagcagtgccaggtgagggcctgtgcccctggggatggtggagacccatgggagggcagagtggacaggtagggccggagaggggaggcagtcagctgtcccctccaagtgggggtacaaggaggcaaagctctgctgaagtcattggccactggagtgtgagtttccctaggcacttggggaaactgaggtggggttatgagagggtcagggccagtgtggagtgcccaaggtcccagtgctggggtctggaggactgtggggttggccatgctgtctgcagtctgggttcccgggctggttcctcctctgtaaatgggaggagcaccgcaggaggaggacctgccggaggcccagcgcgcccaggctgcctcacccttcaggactgcctgctctctggctggccggcttgggccctgggcaggcctactggtccagggtgccactggcttggctccctgggcctggttgggcactcagccatgtggccagtgccccaggacggtcagtgggttgtccagggaaggacaggaagtgcagctgcggccaggctctagttacagagctcggcggccgggacaggtgcacgggctgaaccagacgcagccacttgagcagggctccctggggggtacggcgggggtcctgggaggcaccactcccctcccctggcacaggatagacggcaaaaccctccctctacgtgtcctggaaggaggacacggcccaaggggctgccatgccaaggtggggatggggccgctcctctccccgcacccccgcgccatgcttgcccttggtggctgcacggccagacctggcactcagggcacagagatgccccagcacccacctagaccccccaggccctggtggtccccaaaggcttcctgttttctgtctgtttctaaacaagagccaccacattggcctctgacaacacagctcagtgaagacgaaactgtttgggtttcaggccgaggggtccccttgggataatctccacttcctgtgtccccggctgaccatctggcctgacctgggctgggctgcagggagggagcctggagcttgggctgcagtggttggggtccctgaatccaccccaggcccagctctgttgaggtgcgggcagccccctggctgggaacccatcctctccctccagctggggagctcctgtccccccgcccactcctggaagttttcctgtcctgcttaggacatctgtagttgggcatggcggcgtccaaccccagagttgggggttctggcctcagagttgttatttttcttcccagcggtgggcttgctgtggaaacccccggcttttccactccacgtccctctgggagaggtgtctgtgtggggcacgtttccggacccctgataggttgtgtggccgccgtgcttattcacccagctgggggccagtggagatgctcccggctgccgccccgcccctgctgtggggcttatctacgtttccagatggggtctcttcgaggggaggcacacagcaggagcgggcaagggctgggctggcccaggactctgggcatcgagggggctgggtgccccggtgccctgtccgagcagtgcgatcagggtgctggcccggacgcctggggctaggaggggcttttcctgccccgggaattggcacaacgcccttcttcctgcagggcgggggctgagtcacagaccgctgtgatccaggctgccggggaaggctgactggccctcacccagcacagcgggcacctggacctggccctggtctccccaacccaagatgggtcagggcagagctgggtttgggcacaggacagcaccgcctcccctcctctggaggttccagccacagcccaccccatggtgaggtgggtgcctcagcccaggaggctgctagccaacaaccccacgccatccccagggtccccgaaagccccaccagagtttctctgtagtcctcaccgtgctgcccagaccctagcacctactcagtcccctccgcagctttgccttcggagcgccagtgagtggggcagctccagtgggggcctctcagcgtctctgcggggtggctgctgccctccaggagcagctggcgtcctccctcccagggcgctcaaaccttcatgccctcatgaaaggcattttatcctgatgcccctctctgcagctcttcccactgccctgtgcccaggaaggggaagtgtccgctccagggccacacaacccctgaagcctggagccggcctgggccctgggtcctgggccccgtactcctggggctcttgcccaccccctgtgaggcagtggtcaccgggcagaggcctcctctgggaaccgtggccctcccagggcaagctgggtagtggggactggagggtgcagtggctgagaggcgggtccggctgccgtcctggagacgtgcctgccccaaaatagccgatttttaaaaataactcaggcagcttttgtttggcttttgctttaaaagacttttttttttctttctgcacagaaccatgtagcagcggaaaggtcagcactggcagctgagctgagcggggcgtggagggggaagggcggtcccgaagccaggggtctgcgctcgctccgggtcatggcgagggcggccggtgtggccctgggagccgcgaccaggtcagagacagatgggagtcctccagcgcgggcttcccttcctgtgaccatctgtgcagccaccaggccctcgaggacagctgtccagggcccctgtctgacagacagatggttgggatgggggacagacaggaggccaggatcttcctgtgcatcccaggggtggggagggcgaagtgtctgtgtccccctcatcctgctgatcagtgtcttcaagtcaatatttgtgcaagtgctctcagctgggaaaaatgtgactggcctgctgaaggggagggaggaggacagatcgggccgaggggagcgcagcctccatccaggcactcagggaacagcgggggcggctcccagggggctcagtcgggacctttagtctccttcggagcctttggtgggaggggctgtgttgccagctccccgagaacagcctgtgtccctgcccctgtccacctctagcgggtccttccctgtccaggcacaggggccactggcccccacctggggctctctggaatgcttgtggtcaggcccacagggggctgctgaggcccaggtgtggggctgggtatagggtctgtccctgaagaggctcatacccctccctgctgggcagggcatgtctccctgccccccacccacagggaggtagacgatgacctcagagcctggcagccggtgaataggcctgtgccccgcccccaccccggaaggctgcgcttggctcccacagtccccgcaacgccaagccctccgagaagggtgggatttggacctgggatgtctggagtcctggaaccttgccccctacctggagtctgggcagctggtgcccccaagggctgaagctatgaggggtctgtggtcttttcatgggggaccccacagcagtctcagtccggctcagtccagtgggatgactgtaggtcttgtgcagctctgggggaccccactctcccccttggggccctaggcttccaggcctacctggccaacagcacccagctgttcccgggcgtacctgctgtggggagaaactctccggaggagtgggcactggcgggtcagggtcccgaggaggtgtggtgggtggccctggggtgtggcatgaccctcggaggcctgctggcctttttagggcccacctgggggcccacctgtgagcagaggaggggctggtccccactgccgcccacaaagagttgggctgagtactgaggtctcccaaggtctccatcgtggaccctgtgggcccgtcaggggaggtgtgggccgggacaggcaggccacacctgtgctgtgggtccatgagttgcctctctcccccggcacccgggcctcctcgcacaggcgggggagaggttcgtgtttcctccgcctccctgccaggtccctgtggagcctctgcctgggagagccctttcccctttgtttgagaggggctggggaggggctcaccctcccttggagcctccaggcttgtgacagggcctggagacaacttccctcctttgcccccaggtagggggagcctagggctcccctcagaggctatggcgggtgggagcacttggctgcagcaggggctgagccctggcttgcatgagtgtgaaggcggggtgctgcttgggcaccgccccctcctgtgtgcctcgggaccccccctgctcctgggtgcagcctcttgccattgaggccatgggctgtttttagggaccagagaccttttcagagggggcctgtggcctgggtccatggaggagccacccccacggtgtttcactgttgggcgggtgtgtgtgcacccccaggtgcaggcatggaggcccacggtcatgtcgggtgggtgcagatatgaggctgggtagcactgactgctgggggcaggagaggctcaggcctggagtcctgagggcagggtgtcaggggatgggtagggagggagggagggagggagggaagcccaggctgatcagaggcctgaggggagtcagcaggcctggcctgtgcggagagaagggcctgggcctggggagatgtccgcagctgagggttagggggaggggctgcagtcagggaaggcttctctgaggaggtgtacaaagcgtcctgtgaagactgagccaggctctcccccagccccgaggcacagacacatgggctgtccctgggtggaggtcaggctgacacacggggagaaagtaggcagagccaaggtggggctggggcaggggcttggggtttcgggggcctgggaaggagcagctttcctctgccctgggcagggctgccctgacgtgcaccgggccacagcagtgctactgccccagtgcctgggctggtggagtctccgaggcagactcagcttcaagagggcccccagcctgcaaggctgagccccgcttgctccctgcagcccagtccctgggggctcagtgggcccctggctgtgggctggtcagcatgggagtgagcagagcctggggaggggtgcccggtgtgaggtgggggcaggggccccatcttaggagctgctgacctgtcagagggactagggggttggacctttggacctgcctggtggcagggaccactgtctggccaccaggcctggctggacgtgagggctgtggggacactggggtgtgttcctgcctccaccctggccagtccctgcctgggccgcaggtaggcctctccctagcttgctccatctgcagccacagagcttgcaggaccatgggggaaccccaaactcctgcggcagggaaggggaggaggcagcgcgttggtcccgagcccaggcggggagcccttccaggagggctggttcccgggggctcatctccatccctggggagccctctcccctgggttcgtctgccccacacaggcaaacccagaggtgccccctgtgcggcgagggtgccacatcccctgctgtggcctcacctgaggggcagaaaatgagccaggcccctgggagcatgggaatccaggcgcccctggctcccctgacgccctctcggcccacaggtcttccacgtggcctacgtcctcatcaagtttgccaactcaccccggccggacctctgggtgctggagcggtccatggacttcggccgcacctaccagccctggcagttctttgcctgtgagtctctgccgccgtggggcctggggggagaggcaggggggtccctgggcaggccctccgtgaccaggcttctgaaggtctccgaatacccagccctgccctcacacccggctgctgcggtcatgactgtcagacgaggacccgaaggctcatggggatttattggctcctgtccctggcgtcgggcacagccaagtccaggggctgtggcgccaggaatctctggtgccatctcttggctgcctctggatggcttcatgcaccggcagctcccgtggtgacaaaaggggcctggcagctcccacctcgcctcctgccagcctagccacctgcgtcaagagtactggagtcctagcccggatgctggccgtccctggccccgtgccaccctgaccagtcatgctggtgggagtgggtgctcctccccaatagggcaggcctggtcacgtgtcccccaaaattccctggcctgagaatgggggaggggcgggtcagtgatgggcagtaggcgtctgtccccaaggaagggggtgaggatggtcgtcgaggggggtcactcgcactcaaagcgtgcaagggagagcggtggggggcagtgcagtccaacgggccaggccccttcagccagtgagctgtggtctctgtcacgcggcctcttggcctgtgggagcctcagtggcaaggcccggagacgtcaaggggcccgggcaccgcggggacccaggcttttctggtgatccagcgccctcccctcccgccattccccgcagcctccaagagggactgtctggagcggttcgggccacagacgctggagcgcatcacacgggacgacgcagccatctgcaccaccgagtactcacgcatcgtgcccctggagaacggagaggtgggccggggaggggcagggcggtacgggggctggagaacggagaggtgggtaggggaggggcagtgccgagcggggctggagaagggaaaggtgggcccgggaggggcagtgctgagcaggggctagggccacactggcgtcaccgcatactgcccacagatcgtggtgtccctggtgaacggacgtccgggcgccatgaatttctcctactcgccgctgctacgtgagttcaccaaggccaccaacgtccgcctgcgcttcctgcgtaccaacacgctgctgggccatctcatggggaaggcgctgcgggaccccacggtcacccgccgggtgagctgcccatggcgcaggcgggggagggggactggccgggtggacccgggactcagggtgagtgaggcctggccgcctggtgctcacggggcctgcgggtgcagtattattacagcatcaaggatatcagcatcggaggccgctgtgtctgccacggccacgcggatgcctgcgatgccaaagaccccacggacccgttcaggtgaggccccattcaggtgaggccccgttcaggtgaggccccccccagctccctgcctgtccttgtcacccctgcctaacctgagggtgggtgacctggttccatggcccaccacaaccctgctgtctgtgtgacctgcactgaccaccaccgtgtgcctcagtttcctcatctgtgcagtgatgtggaggccagggcatgtgcagcctccccagggtgccctatcttggtttggggggccttgccctactgccagcagaggtggggctctccggacccccaggccagctggccttcccaccatagtggacacctggggccctgtggaggggagtcagcaatggggatgattgatccccgactccaagactgcatcccccggaatggacaggtgcccactacctgccgaggcagccctaattcactttgggggtgcccgcccagctcccccaacctttcaggacacaacagacaacttccctgctgccccagccctgaccttcactccagtcaagcagggaccaaggcccaggacggggatggcagggtgggggcagccaacaccccacatctgctgtgccctgtgtgcctgctttcgggggcagccgagggcactgcagagcatccacctcccgggagcccctcacaggatgggcagcagccctggtgctggcaccggcacattcctgggcctcacccagagtcctcagtaaggtagggccgggctcattctgcggagaagcaaccccagggcacgtccgtcctttcctccctcccttcgttggttctttcagccagcagctgtatgttgagcgcctaacacacgctgggccgttttcctgggaatgggaacacagggtgggaccccagcccggcctcaggagcacctgttccggggaaggcagctgggaaacacgcaaaccagtactcagcgtggtgcccggagggtgtaacaccctagggtggcagtgcaggcatggggctggacagaagccactcagagtggtgcagctgaggctgagtgtgtgacgaggctcctggacccccagcagggagctggcagggctcatctagtgcctgcaaccgagcagcccaactttcatgcgcttggatttgggacccgcccttgccttctgtggggccttactgctctgtccacgctccagtttacaggggaggtggggaggcgggtggagctcagacaggacaaaggttcactcccattctcacggccagtgccgagcagaggcgggagccctgggccccttcggatgtggctggtgggtctgaggggaggagtggcacagtcacctgagccggaggacttgggctgtttgccaggagctgtgggccctggggacccacccaggcacttgttgctgccagcacagcttcaggtgctgagctccagcagagctaacttgtcctgggaaattaagtgccaagtggggacgcagctcgtgacagcagggagtggaacccaccaggcagccaaatgggcctccaaggagaggaagggcgcgggagccggggcttgccttggcctgcagggaagacattgccatcccctgactcaccgcacctgggtgtggactgagctcagctctccctgcaggtgcaagcaggggtgactgggaatctttcatggaaccacagcctctgttaccaggacctggtcacccaccagtgtcccaaaacattagcctgcccatgttctccctgcaccctttacccgccaccccacctctcctccagggaagggggctccatgtcatcagccagcaattttctgcctctttacctccaccatcaccttactcccacccaaaccatcacccccactaccagcccactcccaccatcatcacccccaccatcaccgtcatcacccccaccatcatcgtcatcacccccaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaccatcaccatcatcacccccatcacccctcaccaccaccatccccatccccatccccatcccctgggttgctgcttcctccttcctgaaatgcaccctgtagtttttctattccatgacagtctatccggaattgtctgaaaacggctgttttgtcctccctcttgaatgatagttgagctgactgtaggattcgtggttgatagctgcatctctcagcactttggagaaatgatttgactgtctcttcacctctccaggtgcttgggagagtccattgtccttgcagttgctgatcctctgtgggtcatcttcttctccaggactttttatggtctttttgccattggtgttctgcagatttattgtgatgtgttgaggattgggatttttttcttgctcaggactcacgctttttttttttttttttttttttgagatggagtctcactctgttgcccagactggcgtgcagtggcacgatctcggctcactgcaagctccgcctcccgggttcatgccattctcccacctcagcctcctgagtagctgggactacaggcacccaccaccacgcctggctatttttttttgtatttttagtagaaacggggtttcaccatgttagccaagatggtctcgatctcctgacctcatgatccacctgcctcggcctcccaaagtgctgggattacaggtgtgagccactgcgcctggccatgtgttcattattaattcaagaccatccttggccattctttctgactgttggctccctttcctacctcttttcccctggagtccccattagatacaggagcaccttctggtttccttctcataatttctatttcctctctctttatcttctgaggtgtcttctggatagcttcctttgctcctcttccacttcactaaatctctcttccactgtgtctgtctgctgtttagcccatccattgagtctttaattttatagtttcatttttcatttctagaagttctgattggttctttttcacatctgcctgttttccatagtgttattttttttattattatgttttagatttcttttttattttattttattcttttttgagacagagtatcacactcttgcccaggctggagtgcagtggtgcaatctcggctcactgcaagctccacctcccaggttcgtgccattctcctgcctcatcctcctgagtagctgggactacaggcacctgccaccacacccggctaattttttgtatttttctttagtagagatggggtttcaccttgttagccagatggtctcgatctcctgacctcgtgatccacccgccttggcttcccaaagtgctgggattacaggcgtgagccactgcgcccggcctatgttttagatttctttatgaccatttttaacattcttccctggcttctactagattactccattttgtgaggttcttggggctctttctgctgacctgccacattgtttctctgcaaggtctttagcagggtttatctttgtgcttctggcgtgccctgggattgggatggttttgggagagcttttgctatacaccccagggtatcgccagcccggcaccacttttcctatcaatttcttgaccatgtggatttttgaaaaatggaacaccagttcaggcccttgcttataggtacttggggctggtgtgacgacagagcagcttctttgttgatcacctgtgctgacgggcagtttatttcccaattcctctcattgagggtatggccctcccagatgtttctggattctgagggaaagcagtattgattcccgaggccctgtgaggtgggccccgtggaggacaggactagagctggaccatttgaggctctgggtctaatcctcatggactggactgacttctggggtcctgctcagggaacgcacggccctgcagcctccggcagagcctgatctggggcagggactcccgctgtggtctggctaatactgagcagtaggtgcttccaacctcaggccttgtctctctccagctgtcaccctgcccacgggacgtaaggcaagattccagccctgtgacttagtgtccaccccagctggaagaaggaagcagttcttggccacttggccctagggaggtgaccaggatgcctaggagtcctgcctgctaagcgaaatctgagccttggggggtgcaaatggacccctttcccttctggctcagggaggttttgggcttacgctcgagtcctggccgaagtggaaagggcataactcagttttggagaacgcaggtctccatcctgacctgcaggcaagggggactctactgacccctgaggtgccctgtcctaggccccacccggtcagtgcacacctgctccccagtcccgcctccacaaaggccctgtgagaccctgtcctccaccgcctctttccttgtgtccattccctgagcctggggaagttgcgtcagagccacaggctcggggacgctgagtctgggcgagcgcttgctgccggacagctggagaaacagcagcggggggccgtgtccatgtggcaagccaagccatcgaggggatcacaggccccttcagggaagggactgagcacctgccacctgcctccaggatgggcctgatcccccctcctgtgtaccccacaggctgcagtgcacctgccagcacaacacctgcgggggcacctgcgaccgctgctgccccggcttcaatcagcagccgtggaagcctgcgactgccaacagtgccaacgagtgccagtgtgagtgcctcctcccacacacgtgtgtcctgcccacaccctggcccatgagagggccccggtgcccgggcccgtggagggcgtgccaacagctgcgctcccctctctctagcctgtaactgctacggccatgccaccgactgttactacgaccctgaggtggaccggcgccgcgccagccagagcctggatggcacctatcagggtgggggtgtctgtatcgactgccaggtgggctgggctagagggctgggaatgggctggccccgaggtggggcagggacctccccagactcaacggccattgcactcccagcaccacaccgccggcgtcaactgtgagcgctgcctgcccggcttctaccgctctcccaaccaccctctcgactcgccccacgtctgccgccgtgagtgggctcagctgggcgggtgtcctgggtctcagggtctgcctggaaagaggtgttcttgggcctttggggctgctttggaggggatgtcctgagcttccaggccagcccaggaaggagcctcccaggccacggggcgggtccccagccctcatgtccccccagggggcctggctgtagccctcatccccatggccctggctggggaggtagagactgccacatcttggagcccaccccttgagtcctggtagctccaggcttacccggctcctgcccctgcccaggctgcaactgcgagtccgacttcacggatggcacctgcgaggacctgacgggtcgatgctactgccggcccaacttctctggggagcggtgtgacgtgtgtgccgagggcttcacgggcttcccaagctgctaccgtgagcacctgccaggggcatccaaacagacaccactgcctgctggactccgggagccctgcagggggtggaggggttccccgggatggaccatgttatcctgcctgcatctccgattgtgctgagagaccaagggtggcagggggtgtagggtgctagggttctgagcagacctggccaacatgcgtgtctcttcccctcagcgacgccctcgtcctccaatgacaccagggagcaggtgctgccagccggccagattgtgagtaagtgtccttgaggcccccaggtccccggcctgccctggagccatgggggcggcttcacagaaagttcctggagaaagggaggattttcatttggtcactttatttttggcttatttctttttatgcaaattatgcctattcacactggaaaaccttcggaaatataggtcggcataaagccaaagaaaaaagttagcccaggcaacatggtaaaaccctgtctctacagcaaatacaaaaattagctgggtgtagtgatgtgtgcctgtagttcgagctactccggaggctgaggtggaaggattgcttgagcctggaaggccgaagctgcagtgagccatgatcacaccacagcactccagcctgggcaacagagtgagaccttgtttcaaaaaagaaaactgggcatggcacatgtatacatatgtaactaacctgcacaatgtgcacatgtaccctaaaacttaaagtataataaaaaaaaaatagaaaaaaaaaaaaaaaagaaaattggttgggcacagtggctcacgcctgtaatcccagcacttcaggaggccaaggcaggtggatcacctgaggtcaggagttcaaggccagcctggctaacatggtgaaaccccgtctctactagctgggcatggtggcgggcacctgtaatcccagctactcaggaggctgaggcaggaaaatcgcttgaacccgggaggcggagcttgctgtgagccgagattgcaccactgcacccccgcctgggcaacagagcgaaactccatctcaaaaagaaaaacaaaaacaaaaagttatccacaattcccccagctctgcacagcgcttgaatgctctctgtacacaagcacttctctttcacaagcttcgtcatgcgctctgcaccctgtcctgtgattacgtcccaaccacaatcctgtaaacacattgtcttgtggtccatttcatagggactaatgaagtatttatttaaacaacccccagtggttggaaatctaggttctttttttttttaattatgctgtgataaagcattattaagatgaggtagaaaactggcccggcacagtggctcacacctgtaatcccagcactttgggaggctgaggcaggtggattacctgaggtcaggagttagacaccagcctggccaacatggtgaaaccccatttctactaaaaatacaaaaattagccaggcgtggtggtgtgtgcctgtaatcccagctacttggggggctgaggcaggagaatcatttgaacctggttgcagtgagctgagaaccaccatcacactccagcctaggtgacagagcgagactccatctcaaaaaataaatttaaaaaaaaagagtctcccagcatacagtcacagccacagagcagcatggcacctgctgaccaaatcattgccattaccacatagcagtctatcactcttggcttgatagacaaaaaatattctcaagtcagagccatgttcccttgctttttagtgtttctggaattgggatgcgtcttttgcttgatggcatatcacagtctagttggtagggtttttccctttcatgacgggacatacaagcatggcatctttcccagtgagtggggtcttagacttagattgtatttgatatgacgtcttttttttttttttttttgagatggagtttcgctctttttacccaggctggaatgtgatggtgtgatcttggctcgctaccacttgtgcctcccaggttcaaacgattcttctgcttcagtctaccgagtagctggggttacaggcatccgccactaagcccagctaattttgtatttttagtagagacagagtttctccatgttggtcaggctggtctcgaactcccaacctcaggtaatccgcctgccttggcatcctaaagtgctgggattacaggcatgaaccaccatgcctggcacgatattgtgtcatttttagctgcactttgactactctgtaagcttgaatcttcttgacttttcgagtgctttcttttttttttttttgatggagtttcactctagttgcccaggctggagtgcaatgctgcaatctcagctcactgcaacctctgccccccgagttcaagtgattctcctgcctcagcttaccatgtagctgggattacaggcatgcgccaccatgcctggctaatttttgtatttttagtggagacggggtttctccatgttggtcaggctggtctcgaactcctgacctcaagggatctgcccgcctcagcctcccaaagttccgggattacaggcgtaagcctctgcgcccagcctgtatcacctatttcttataagttgtgtgtttttctcctgatgggtcatttgccccttattttgggggggagcttttttccgtgtcctgattttgtaaattttgaggtgaatctgcccacgttgttctaccgaatctctggctgagtcggatgtagatgctcctcccttacccaggaattctcttgtctgctggttctgtgatggtttttttatgtggaaatgtttagtttttcatcaatagtgtaaaccaggggtcaacaaactgtcggaaaaggcccagacggtaaatgtcatagactgagggccgtgtggtccctgtggggaaactcctcagctctaccgttaccagctgtagcttgcaagcagccatagaacgcgtattcatgagtggggttggcggcgttccaataaaactttatttacaaaagcaagcgaggagtccatagactagtttgctaatcgctggtgtaaactgacaatttatcttttcgctactgggccatagtaagcactcagtaattacctgtggctgtacagtattcactttcaatgtgttcattacaatgaattgtattgtctttcctaatggggacacagtgttgaacatcaatattttattttgtctaaattcacaagtgagattgttttggttttgtaaaatacttgggaaatcatccacacttttttatgctcccaatcagtttaaaaatcacagaaattatttacttgttaaaagtctggtcaaacttacaaaaccctttagtcctgatacctgtttttcttttcttttttttttgtttttttgtttttgtttgagacggagtctcgctctgtcgcccagactggagtgcagtggcacgatcttggctcactgcaagctctgccttccaggttcacgctattctcctgcctcagcctcctgagtagctgggactacaggtgcccgccaccacgcccggataatttttttgtacttttagtagagatggggtttcaccgtgttaaagcaggatggtctcgatctcctgacctcatgatccacccgtcttggcctcccaaagtgctgggattacaggtgtgagccactgagcctggtctctgatacctgtttttcaacagagatcttaaattaaggttttaatgtattctgtggctattgtattcaattttctacctcatcttttttttttgagatggagtttcactctgtcgtccaggctggagtgcagttgcacgatctcggctcacttcaacctctgcctcctgggttcaagcgattctcctgcctcagtctcccgagtagctgggattacaggcacctgccaccacgcctggccaattttttgtatttttagtagagacggggtttcaccatgttggccaggctggtcttgaactctgaccacaagtgatccacctgcctcggcctcccaaagtgctggtattacaggcatgagccaccacgcctggccagttttcttcctcatcttaagtcaggtttgattatttgtattagcaaattgtgtattttgtttggattttttaatgtattgacataaagttatgcacagtggcctgttataaagttaaaatttctgttcatttctattctcgtctatttttatttttattttctttcttcttctttttttttttttttttggttgatcagacctaacagaggttcgttgagtttattggtctgttcgaagtacaggtgcagttctcttgataagacctgctgaggtttttctttctttagttgggaggagagattttcctttctaatattcaatttctttaatccactttctttgatttatcacttttttaaaatagcttcttgagttattatttttagtctgtcttcattcccaacaaaaaggcttaaagcagtggttctcagccagtggtgactttgatgcacaggaagcattcgatgatgtctggagacatttttggttgtgacgattgatggatgtaactgatccagtgggtagaggctagggatgctgggaacctcctacaacacaggactgctcctgcacacataacaaagagttatccagcctggactgtcagtagtcctgaggctgggaaactctagtttaaagctataaattttcctcagagtatacctttggctaggtatcttgtagtttgagatgtggggtgtcctcattgctgtgttttttttaaatagtctatcatttggggttttattttctttcaacccgtcactgttcaaggtgctgaggtttccctcctgtccttttcgtggtgtgcagttctggttttgctgcatcgtggttagacttggcacactgatagtttctgccttttgtctttggaatttgagattttctttgtttctaacctagaatgtgacgacttttattttttaattttatttatttatttatttatttatttatttatttatttattttgacacagagtctcactctgtcacccaggctggcgtccagttgcacgatctcggctcactgcaaccaccacctcctaggttcaagcgattctcctgcctcagcctcccgagtagctgggactgattataggcgcccaccaccatacttgggtaatttttgtatttttagtagagatggggttttaccatgttggccaggctgatctcgaactcctgacctcagttgatccacccacctcagcctcctaaagtgctaggattacaggcatgagccactgcgcctggcagtttctgccttttgtttttggaatttgagattttctttgtttctaatccagaatgtgaccacttttagattgttccaggaacattggacaggaatgtgtgttctctatggagtaccgatttggcatgttaaagcagacttgtggccaggtgcgatggctcacgcctgtaatcccagcactttgggaggctgaggtgggcaggtcacctgaggtcgggagttcgagacgagcctgaccaacatggagaaaccccgtctctactaaaaatacaaaataagctgtgcatggtggcgcatgcctgtaatcccagctactcgggaggctgaggcgggagaatggctcgaacccgggaggtagggtttgcagtgagctgagatggcgccactgcactccagcctgggcaacaagaacgaaactccatttcaaaaaaaaaaaaaaaaaaaaaaacaaaggaggcttgttcattatgctcttcaaacccacagtacccttgctcaatttctgtccctctgagctgtcacagtctacctatgtatctccatccagtctttgtctctctctgactctggtttgccaaattctccttgccattttaatagttttagcttccctcacctccaggacacgttacctgctcctagagattcgtttctgctgcccgttgggtgacatgcctgagcttccctctgtctcgttaccgctgtgccttccgtcctcactcctctgtgtttgcgtccaccccagctccctgcacacagctctcggtttaccacctgtctgaggcgttggtttaaggtacgctctttcaagaggctatggctggagtttcctcttggtcacgctgacgtcttcggtttttatctcatgaaggagacagcccagccccacgatcgtccttgcctctgtcagttctggctggctcctgcccttgtatcatttctccttttctgctgaaacatttcctttcctgactttcacaagttagagcaagaaaacgtgctttgattttggtctgtttgtttttgctactgtttcctctctggggagggtttgcaagctctctttctgtgttctggtctgaccagtggttactcttacatttttgacaagtattgaacctttatttttctatcagtaacaaaaactgaagcgtgctcacaaccctcctttcatgcgtaagttaagacatttgatacattctttctaccttcttcccaacacctgacattgtttctaaagaaactataattttaatcccagcactttgggacgccgaggcaggcggatcacgtggtcaggagatggagaccgtcctggctaacatagtgaaaccccgtctctactaaaaatacaaaaattagccgggtgtggcagcgtgcacctgtagtcccagctgctggggaggctgaggcaggagaatggtgtgaacccgggaggcagagcttgcagtgagcccagatcgtgccactgcactctagcctgggcgacagatcaagactccgtctcaaaaaaaaaaaaaaaaaaaaaaaagaaactataatttgttttgcagcttgttttgagttttgatttgtttgtattttctctttgtgttaatgcttgcagctaactaggaatctacgtaagaaataactaatgaagcgttttgatagttggcctgactttgttgcacatcactgttttcccaaacacgcctctcccttgttggaatttttttttttttttgagacggagtctcaccctgtcgcccaggctggagtgcagtggtgcgatctcggctcattgcaacctccgcctcccaggatcaagcgattctcctgccccagcctcccaagtagctgggattacaggggtgcaccactacgcccagctaatttttgtatttttagtacagacagggcttcactatgttggtcaggctggtctcgaactcttgacctcatgatctgcccgcctcggcctcccaaagtgctgggattacaggcgtgagccactgcacccagcccttgctgggatttttattattttattttctagttagtgttgtgtaaaagtgtaagaaaatgagtttgtggagagggaaggtttgccaggaggggcgtactggggtctgcagggcatctgagactcccctgcctgtccccaccctccagattgtgactgcagcgcggcagggacccagggcaacgcctgccggaaggacccaagggtgggacgctgtctgtgcaaacccaacttccaaggcacccattgtgagctctgcgcgccagggttctacggccccggctgccagcgtgagtcccctctccccgctcaacctctacctgcgctcgaggtggacacctgaggcctggtgcctctgaccaagcatgtgggccaccctttcctgcagcctgccagtgttccagccctggagtggccgatgaccgctgtgaccctgacacaggccagtgcaggtgccgagtgggcttcgagggggccacatgtgatcgctgtgcccccggctactttcacttccctctctgccagtgtgagtggtgcctctccacgtgggcgtgggtaggggaggcccgtgggcctggcctaccgtgacacccgctccgctctgcagtgtgtggctgcagccctgcaggaaccttgcccgagggctgcgatgaggccggccgctgcctatgccagcctgagtttgccggacctcattgtgaccggtgccgccctggctaccatggtttccccaactgccaaggtgagcagagggtcagggcaggaaggggttctgccacccacatggcgccagggcctgaccccattgtccctctgcagcatgcacctgcgaccctcggggagccctggaccagctctgtggggcgggaggtttgtgccgctgccgccccggctacacaggcactgcctgccaggaatgcagccccggctttcacggcttccccagctgtgtccgtgagtgcctagggaggaagtggtggggaggcaggtgcagtctccactgcgtgcccacagctatccttgtctgcagcctgccactgctctgctgaaggctccctgcacgcagcctgtgacccccggagtgggcagtgcagctgccggccccgtgtgacggggctgcggtgtgacacgtgtgtgcccggtgcctacaacttcccctactgcgaaggtgagcaggcaggtggctgtgtgcaccaggtgccgggcctgtgtgtgggtctgtgctgttcacacgctgcctgccttcctgtgaggctgttcacgtgcatcttgctgtgtgtactgcgactgcgtccccacgctctgtgttcgcaccttgttcacatgccgtgcaggggtgtccgcgtactgcccgtgtctgcgtgctgtgcatccgcgcctgtcgtgtctcgtatgggtgcatgtgttgcgttctgtgtgtgtacgggtgtcatgtgttgcttgtgtgggtgtgtgtgtcacctaagtgtgggtgcctgtgtcacgtaagtgggtttgtgtgtcacgtgggtgcatgtgttgcgtgtcgcatgtgggcgcgtgtcgcataagtgggtgcgcgtatcgcataagtgggtgcgcgtatcgcgtgtctcaagtgtgggtgtgcgtgttcatgtcctttcacgggcgtgtgggtgtgttagtgcacgtgtagtgggtgcatcttcacgtgcgtttgtgtgcttgttcagacgtgtgtcacacactgcgtgtggaatgtacacgggtaccccacgcggtgcacgtttgcgtgcatgtccatgagcaggtgctgtgtggtgggatggcacgtccgttgctgcggagggagcagggaggtgcgtgttttcaggccgtccatgtggatgagaggcacctgtgctggtcctcagctcctgtgggaccgtgggttctggctgggcctgggacacccttggccttccgggttggtcactgggaaatgaccgaggcatggtcctctcttcacagctggctcttgccaccctgccggtctggccccagtggatcctgcccttcctgaggtgagcccaagtctgctcgtgtgtgggagatgggtgaggacccaggccaagctaaaagtcccgagtccggtgagaccagggcttcctgcctgctgctcagttgccatggcaaccccagggcctgtctgctccttaggctggtcctctgcccccactgcaggtgactcctgtgagtcacaggtgagggccctcagccctcaccaccccttgtcagggctctatggctctatggtttgtgggtgggagagcagggcgcccgctctgacctgcagtcttgtcctctcccaggcacaggttccctgtatgtgccgggctcacgtggaggggccgagctgtgaccgctgcaaacctgggttctggggactgagccccagcaaccccgagggctgtacccgtgagtgtgccctggagtattggggtacaggggttccttggggaactgtgcccacaagtatatcctggagggagtgttggggtgcagggttcctggaggggctggagccagtgagtgtgccctggagggagtggtgggatatggggttcctcggggattgtacccatgagtgtgccctgaagggaatgttggggtgcggggttcctcaggggggctgcgagtgtgccctgagggagtattgggggtatgagggttccttggggggctagagcctgtgagtgtgccctaaagggagtattggggtataggggttcctcggaggggctgcacctgtgagtgtgccctggagggagtgttggggtgtggggttcctcaggggatggcacccatgagtgtgtcctggagggagtgttggggtgtggggttcctcgggattgcacccatgagtgtgtcctggagggaatgttggggtgcaggggttcctgggggggtactggagtccatgagggtgtcctggaggaatgttggggtgcagggggttcctgcgtgggactggagtccatgagtgtgccctggagagagtgttggggtacggggtttcctcggggtgctggagcctgtgagtgtgctctggagggggtgttagtgtgtgggggttcctcggaggggctgcacccgtgagtgtgccctggagggaatgttggggtgtggagttcctcaggggattgtacccatgagggtgtcctggagggagtgttggggtacaggggttcctgggggggggctggagtctgagtgtgctctagagggagtattggggtatgggatttccttggggggctggagcctatagtgtgctctggagggagtgttggggtataggggttccttggggaactgtacctgcaagtgtatcctagagggagtgtcagggtgcaggggctcctgggggtgctggagcctgtgagtgtgccctggagggggtgttagggtgtgggggttcctcggggggctggagccaggctctcctgccccaccaagcatctgagtcctgccctgctctccccaggctgcagctgcgacctcaggggcacactgggtggagttgctgagtgccagccggtgagtctgaggaccaaggtgtgggggatttgggggcacactggtcaggaccctcccctgccccacttcacctcctcccttggcccccagggcaccggccagtgcttctgcaagccccacgtgtgcggccaggcctgcgcgtcctgcaaggatggcttctttggactggatcaggctgactattttggctgccgcagtgagtgcccactcgctcgtcccagaccacagccctgcctcccctcggtttatgctggggaacccaaggcccggagggacaagtgcagcctgggcagcatgaggcccgggtgatggatggctgccccttggtgccagcctgtgccagggtgtgggagagggggtgcagctcccacccagatgcgtggcttcctctcccctgtcctacacctgggcagacggcactaacagatcccagcgccctcaccctcgccctcgccctcgccctcgccctgagccctgagccctgagccctgactctccatcatccagagagccccaggcaggcttctcagtctggctgtgaggggcccctgaggctgggtgggggccaggcagcctctgacctcccaccttctccctgcaggctgccggtgtgacattggcggtgcactgggccagagctgtgaaccgaggacgggcgtctgccggtgccgccccaacacccagggccccacctgcagcgagtgggtaccccttccccactgggtggtggggagcggggcaggcagcttgtcctccgggcatctccgtgtccctcaccatgggcccacgtgaggcctcaccctccctggagatccggggccgctgtgcagggctaggtaggatggccaagctgcacctgaccagcccctgctgtggccaggcctgcgagggaccactacctcccggacctgcaccacctgcgcctggagctggaggaggctgccacacctgagggtcacgccgtgcgctttggcttcaaccccctcgagttcgagaacttcagctggaggggctacgcgcagatggcacctgtccaggtgggcgctgtgctccccctcccaggctcagcctagaagtggagccaggcgtggctggcagggaggggtgggcaggccccttgaaggcccaggcctcaggctggcagtggtcagggagagtgacccgacgctccatgcccacccagcccaggatcgtggccaggctgaacctgacctcccccgaccttttctggctcgtcttccgatacgtcaaccggggggccatgagtgtgagcgggcgggtctctgtgcgagaggagggcaggtcggccgcctgtgccaactgtgagtggggtccctgggccacagcccctgccccaccagcccagcccaccccaccccaccccaccccactcccaagccctgccaccttcctctggctcatgtgggtggtaggaccagcctatccccaaccctgtagggggtgcagcctggggtggccccaagggctgggctcaggagtctcacccctgcccccgcccaggcacagcacagagtcagcccgtggccttcccacccagcacggagcctgccttcatcaccgtgccccagaggggcttcggagagccctttgtgctgaaccctggcacctgggccctgcgtgtggaggccgaaggggtgctcctggtgaggcaggggccagagtgagggctgggggccgggtcagggggtggggcccaccactctcagcaccacctccaccctgcaggactacgtggttctgctgcctagcgcatactacgaggcggcgctcctgcagctgcgggtgactgaggcctgcacataccgtccctctgcccagcagtctggcgacaagtgagggccatgcgtgcggtgggaccggggtgggggcttcctggacccccactgtgcctggcttcccccactcaggctgtctctggggacctgggtggacctggggctgaccacggcctgtgtccccccagctgcctcctctacacacacctccccctggatggcttcccctcggccgccgggctggaggccctgtgtcgccaggacaacagcctgccccggccctgccccacggagcagctcagcccgtcgcacccgccactgatcacctgcacgggcagtgatgtgcgtgtcctgggaccccacggagcaatgggtgttgcaggaccttggcctgggggctgggggtcctgtggcggtggcaggttataggagcagggcgctgcctcaggcaatggagcccagcacccaggcagggcgcccctgcctcctgcctcctgcctcctgcatgtgtgacctcagtgcctgtctgtatgtaggattggctgtggcctccacatacagctcagcccccaccacttgcctggagatgtccgggccagggtgggactcggctgaagggcaggccctggggtcagggaggcgctggagtgggaggggagggaggtgggaagggcgaggggtggcgggcctcccgtcaccctgccttccctgcaggtggacgtccagcttcaagtggcagtgccacagccaggccgctatgccctagtggtggagtacgccaatgaggatgcccgccaggaggtgggcgtggctgtgcacaccccacagcgggccccccagcaggggctgctctccctgcacccctgcctgtacaggtgagtgggagccggtggggctggagtaagggcacgcccggggctgccccacctgctgaccaccctccccccacagcaccctgtgccggggcactgcccgggatacccaggaccacctggctgtcttccacctggactcggaggccagcgtgaggctcacagccgagcaggcacgcttcttcctggtaaggacccctcaggtccccaccccaaggggtcagcttctttcagaagatttgaaacatgcatgagaggggagaggacagttggggtcccaggtccccaaggcggccacactcgctcatgcccagcccagcatgtttcttctggaacccctcctgcaagcgttttgtggattcagtcccttttgacgtacccccgagctgttccatgtgctcaggaaagcacctgcagtcacagctccctggccccagggcagccacctcctggcacagacagcgttggttgcctgttctggaactttcttttctttttttttttttttgaaatggagtctcactctgtcgcccaggctggagcgcaatggcaagatcttggctcactgcaacctccacctcctgggttcaagcgattctcgtgcctcagtctcccaagtacctgagactataggcactcaccaccacgcctggctaattttcgtatttttaggagagacagggtttcaccatattggccaggctattctcaaactcctgacctcaggtgatccgccctcttgggcctcccaaaatgctgggattacagacaggagccaccatacctggcctggaactttctataaatgccacacaacatgttctgtgcagccgcgtctcccaccgttgtgtcagcggataagttgccgtgttccgagacaccaacctcacatggccgcacggaaagggagcacccatttgcggcttgtgcctgctgagtgcctgcctgggtcaggtcctgggagagctgggcctggcccggcctggtggcaccaagcagcactcgagataagagtgggggaacagtgacggatgggagggcgagggggaggaagagggctatgggaggagccgcataggcctgtgggcccaggaactggccaacacgctggtctgcggttggggtttgtgcagctggaggaggagcaatggcatcttggaaagagcagggctcggtcggacgcctgggtttgcagtttcctgggtctgagctgtgtgaccggcccccccatcgtaccgcctgcaccccccatcgtaccgcctacacccccccatcgtaccgcctgcaccccccccatcgtaccgcctgcactccccatcgtaccgcctgcacccccccatcgtaccgcctgcacccccccatcgtaccgcctgcaccccctatcctccccgcaccacgggcgttgcagcatctcgtccctctgcctgcagcacggggtcactctggtgcccattgaggagttcagcccggagttcgtggagccccgggtcagctgcatcagcagccacggcgcctttggccccaacaggtaatggcaggtaatggggctgggaggggcgcggccgagggcccggcggcagggccggctctgactcacccactgtgctctcaccagtgccgcctgtctgccctcgcgcttcccaaagccgccccagcccatcatcctcagggactgccaggtgatcccgctgccgcccggcctcccgctgacccacgcgcaggatctcactccagccacgtccccagctggaccccgacctcggccccccaccgctgtggaccctgatgcagagcccaccctgctgcgtgagccccaggtgagggccatagtctctagagggacgggggtgtcagggcaggactccgggtcccaacccagggcaggttgtccagggggcggcaggggctcatagctcagcctgctcactagggcctatccctgcaggccaccgtggtcttcaccacccatgtgcccacgctgggccgctatgccttcctgctgcacggctaccagccagcccaccccaccttccccgtggaagtcctcatcaacgccggccgcgtgtggcagggtgagtgtctggtgtggggggtggagaggctaccacacacgatgaggctggaatgccggcgccacagcgtggcctgtgctacctgctatgagcgacaggcaacatgactctgtcctgccatcagttctcaaactagctgcccttgcagcccgcagcccctacccgcccgctcccgttcccagaaaagcctgggtctcgcctctgtctcgtgcgttgggaagccccgttgtgctccatggcacgtggcgaattgagggcttgccccaggatgccgctggcagcacatgtggccctgtgtgtttgtctggttcctggctcggccaagcctggggtcccgcacatggagttgaccggtacctagaggtgtcccgcatgacatctgtaggtcatgatgcggccaacccccgtgacatgaggggccggccttgcagacctcttgggcacgtcccgtgcctgtggccgttggccagcgggcactccttggctgccccaacgctgccatcttcaaccctctgggtgtcttgggggcgctagagatgggggcctgaccctgcctttctcccccgcccaggccacgccaacgccagcttctgtccacatggctacggctgccgcaccctggtggtgtgtgagggccaggccctgctggacgtgacccacagcgagctcactgtgaccgtgcgtgtgcccgagggccggtggctctggctggtgagtcccagctgatgtcctgctcagggaccagctgtccttatacttgtcattaccactgtggtacacttgggctgggtctgtctcttctgggcctgctgaggcctggccttgtgcccagcaaagcagctcctgcctttggggacctcccgatccaccttgtgaggctccagaggggccctggaccctgcaccctgcaccctgctggtcagggtggccttcctggaggaggtggggcctccaggaaggagagggaagaggaaggcgtggccagcagacagagatgtgggagacaccaggaggtctcatgaatgctgctgcctcctcacgcccccgaaagctgctgtttggcttggagtggcctcccctgagcagccagggcccagggctgggctgggctgggctgctgctgccaggactctgagctgcctgcaggaccctggtcccagccagcctctgggggcctccccgctgcaggctctgggcccgcgggagagtgaccaggcctcaccccctaggattatgtactcgtggtccctgagaacgtctacagctttggctacctccgggaggagcccctggataaatcctatgacttcatcagccactgcgcagcccagggctaccacatcaggtgggcagggctctggcaggtcaggggtccggggtgggggtctgggccgggagctggcctcaccacgtgcccctccatgtagccccagcagctcatccctgttctgccgaaacgctgctgcttccctctccctcttctataacaacggagcccgtccatgtggctgccacgaagtaggtgctacaggccccacgtgtgagcccttcgggggccagtgtccctgccatgcccatgtcattggccgtgactgctcccgctgtgccaccggatactggggcttccccaactgcaggcgtgagtaccccagtccttgggcgcccagtggcagggagttggtgccagagcccaaggtggacgggtcgaccagaaagcagggtcaggagaatgttctagagcctggcagggcagcattgctgccccatctgcgggcctgggcccaggactccagcttgcgggccatgcagaaggtttcagggaccagcaggtggtccacagtctctgacgatgatgttgattctgagcagctgcctccatgtcaggagctgtccaaggctcagcacccggggcaggggtccctgttcttgtctcccccgcccccgtcacactgccacatcccctagggctgcattctgggcctctgagaggggcgggactgggaagaggggtcagtaaaccctgtacccgccccacagcctgtgactgcggtgcccgcctctgtgacgagctcacgggccagtgcatctgcccgccacgcaccatcccgcccgactgcctactgtgccagccccagacctttggctgccaccccctggtcggctgtgaggagtgtaactgctcagggcccggcatccaggagctcacagaccctacctgtgacacagacagcggccagtgcaagtgagagcccagagcggcgtcagcgcggcccctggtggccttaaggacagcatttcctctagccagagggtcctggcacccaccctgctcccatttgtgctccctgggtgcagcagcgccctctcctccacttctgggaggatgctgcctgggtggggggtgcctacgaggtctcactttggtgtgagtgacctggggtggagggggctcagctcccgcccctgccacaggtgcagacccaacgtgactgggcgccgctgtgatacctgctctccgggcttccatggctacccccgctgccgcccctgtgactgtcacgaggcgggcactgcgcctggcgtgtgtgaccccctcacagggcagtgctactgtaaggtgagtgagggctgggcccagatctggcctctccctccggcctcatcagctgaaagtgtccttacgggcctttcggggcagctggggcttcctagaagcttttgggagagtcatccccattggcaggtgggtaccaggaacccggggtcaggcacctggcacctgccgaccactctcactgtcctctcatccctaggagaacgtgcagggccccaaatgtgaccagtgcagccttgggaccttctcactggatgctgccaaccccaaaggttgcacccgctgcttctgctttggggccacggagcgctgccggagctcgtcctacacccgccaggaggtgcgcctgcaggactgagggcattgccttctcggggagggcttaggtgggactggatgcaagatggggccctgtgatgtgtgggcatccacccatgtgcagccacacgtgtgtgcccacagttcgtggatatggagggatgggtgctgctgagcactgaccggcaggtggtgccccacgagcggcagccagggacggagatgctccgtgcagacctgcggcacgtgcctgaggctgtgcccgaggctttccccgagctgtactggcaggccccaccctcctacctgggggaccgggtaagcagggcatcaggtctgggggaggcactttgaggatggccaggacgcctgagagggttgggagccaggagtggggtctgtccagggagggggagctccatgggggtccgtgagggtgcccaggccctgtcccggtagggaatgagcgcaagtatccaggcccagcacagggctctgtgctgggggtgcccagaccactgctgacgggctctgagcctgtggccagagtctggccaggtcacctctgtctgtcctgcctccaggtgtcatcctacggtgggaccctccgttatgaactgcactcagagacccagcggggagatgtctttgtccccatggagagcaggccggatgtggtgctgcaggtgagggagctgagatgatgtggcagggtggttgggtgggcgtggcgcagtggcaccgtggtccaggcccgtgccaaccctcacctccccatgtgccttcccagggcaaccagatgagcatcacattcctggagccggcataccccacgcctggccacgttcaccgtgggcagctgcagctggtggaggtgaggggagctggcttgggcacccaggtccctcatggacctcagctcatctgggaaggccggaaggggtcccagtgctgctgtgcccattctccgtggtggaaaagagcccaggagcagaagcggggtgggggctggggaggtccccacacccattgtcagatatcttctgcgctggtcaccctggggggtgtcatgctgtcttcccacctgctttgtgagtccctgatccctgaggggtgagcagctgctcagtagctgttggcttcctccatgcactgcctgttagcatcttttgcccatttctctttgacttgcaaatctttttccatccttttagagttctttgttattcttggtgcttaccctctgtcagacttcagagtaacaaccgtcttctcccctctcacagctcatctggtttttctttgtttttttttttttgtttgtttgttttttgagacagtcttgctctgtcgcccaggctggggtgcagtggtgcaatctcggcttactgcagcctctgcctcccaggatcaagcgattcttctgtctcagcttcccaagtagctgggactataggcacccgccaccacaccctgataattgtgtattttcagtagagatggggtttcgccgtgttggccaggctggtctcgaactcctgacttcaggtgatcctcccacctcagcctcccaaagtgctgggattacaggcatgagccaccacacccagcctgagctgtcttctgatgaacggccttatagttaatgtacttgaatttatccttttttccttggcagcaagcgtttttgcatcttgtttaagaaagtatttgtcactacttgatcagaaaggacctgcctatgttttcttctagaagcttggctgttctctttgtgtatttcaattcttaaggcatctggagctggtttgatgtgtggtgtgaggcagggatctaggtgctggctggcctcatgggagactggtttttctacctgtgtgtacctcctcctgccccatggtctttgtgcccctccatcccctacagggttggggggtctgttctaggctccctgttctgtcccattgagtgtggccccactgaggtgccatcctggacccacaggggaacttccggcatacggagactcgcaacactgtgtcccgcgaggagctcatgatggtgctggccagcctggagcagctgcagatccgtgccctcttctcacagatctcctcggctgtctccctgcgcagggtggcactggaggtggccagcccagcaggccagggggccctggccagcaatgtggagctgtgcctgtgccccgccagctaccggggggactcatgccaggtgaggttaggacagcaccagactgcgaggcggctcacctgtgcacacccttccctccagcatcctccctgtgttcccttccttgctgcctccacttcctgtcaccctactcacctctcttcctgcccctgcttttcgcaggctgctggccaactcatgggcctgcctgtcccctgctgcctgtctgcctgcccctcgtctgcctgcccctcatccgcctgcctgcccctcatccgcctgcccctccatgcacacaccctccatacccctttcccacctaccccagcccccaccactgggtcacctggacatcccccaccgaccatcctggcgtctgcctgtcattctgcccatccctcgcccactgtgtgtctgtccagctgctaatctgccctgctaatctgtctgtctgctgtaactttgctccttctgtatgaggaggtttgtggttgaatacctcctagaaggagtggaaagagcaggccctggtccacatggagtgggtggtcaccagccccaaggcctggtcattcccgagacaggacatccgtgtggctttgagagctatgtcctcaaacagcagccaggtgctggcccacctccagccggccgaggccaggagttcctgaccagcctctgacccagcggtgaccatgctccacgggttcccagtgcctcgtgcctgcaggatccctgagggtctgacttgtgagcttgcagggtggggcccctcgtcctctcaatcgctgatgccacctgcccccgtacaccctcaggaatgtgcccccggcttctatcgggacgtcaaaggtctcttcctgggccgatgtgtcccttgtcagtgccatggacactcagaccgctgcctccctggctctggcgtctgtgtggtgagtaggggctggtggggccaggggggcagcattcactgaaggcacagtcaagtgtgccagggaagaccaggggctgcacttccaggtcaactgaggtctggggaagggtgttgcccagtgggggaccatctggccttgggcacagagtctgaggcaggggtggtgggagctgcacagactcggcagtaggatgtgggtgtccaccatagctctgactgtccactctgccccaggactgccagcacaacaccgaaggggcccactgtgagcgctgccaggctggcttcgtgagcagcagggacgaccccagcaccccctgtgtcagctgcccctgccccctctcagtgccttccaacaagtaagccagcctcctcccgggacgaggccctgatggtgccaggctcccttcacccagcagcggggtgggttcccactgccctctgcagaggcctggacagctggaggtgtccgtgaggtctgggcccccgacgcctggcgtgtgttccagccggagcacagtgtgctcgcccgggcccgggcactgccaggggcctagtgactgacgctgctggtctttgcagcttcgccgagggctgtgtcctgcgaggcggccgcacccagtgcctctgcaaacctggttatgcaggtgcctcctgcgagcggtgagctggggctagggcagtggggcagggcctgagtgctgaccccaggatatgcgagggtgggcgccacgggccactgacggcccctccccaccctgctcccaggtgtgcgcccggattctttgggaacccactggtgctgggcagctcctgccagccatgcgactgcagcggcaacggtgaccccaacttgctcttcagcgactgcgaccccctgacgggcgcctgccgtggctgcctgcgccacaccactgggccccgctgcgagatctgtgcccccggcttctacggcaacgccctgctgcccggcaactgcacccgtaggcgtcgggctgggagggatgcaccctggggagggttgcgcggggaggagggaggcctgctgggcgtaccccgtaagtaggctgtgtgcctgatgctggggcccagccaggacaagtcggagccagccttctgggttcatggtcaaccctttctcccccgctatgatccggtcctcccgccccagcgatcaggccctcccgccccagcgatcaggccccttcaccatcaggcctcccccggaccatcacaccctttctccctactacaatcagaccctccccataccaggatcacatcccccctcccctacccatgatcaggcccccaccttcaccatcagaccctccccccaacccatgaccagcgccccccccacctcacgatcacatcccctctccccccacaatcagtcccccctcatggttagacaccaccaccaatgccccaccactggcagcggacaccagccgtcagagcagggcaggccatggcagggagtctgcaggtccctcgggcccaggggaggcagctggggagtggggccaggctgggacacgagtgggtagccgggtggtccgggcggcctggaggagacacagcaggaggcagtgaagtgagggcttaggagggtgcctaggggctccctgggggggtgagagggcccagggctgcagtcacggaccccttctgcagggtgcgactgtaccccatgtgggacagaggcctgcgacccccacagcgggcactgcctgtgcaaggcgggcgtgactgggcggcgctgtgaccgctgccaggtagggctgtggggtaagcagggctgggtgggtggggcctagggactagagttggggcctggggagaatctgataggtggggctgaggggcagtgtttgatgggcagagcctcagggggtggggccagatgggcaggacccctggcttccaggttggtctgggacagtcttgagggctgggcagggcagtgaccagcctgtgccacaggagggacattttggtttcgatggctgcgggggctgccgcccgtgtgcttgtggaccggccgccgagggctccgagtgccacccccagagcggacagtgccactgccgaccagggaccatgggaccccagtgccgcgagtgtgcccctggctactgggggctccctgagcagggctgcaggcgtgagtgctggccggtcacaggagggcggatggggacttctgagtggggtacgctccaaggtcccaggccagccatgctcacccaagccccccaccacaggctgccagtgccctgggggccgctgtgaccctcacacgggccgctgcaactgccccccggggctcagcggggagcgctgcgacacctgcagccagcagcatcaggtgcctgttccaggcgggcctgtgggccacagcatccactgtgaaggtgcgtcctcaacaccccacttccccacacctgatggagtaggaatccaagtcccacacagcctggtgaccccagtgttaacgtcgacctcccagagtggtcccagctgccttccatttcccgagagacccatgcctgtccaactccaaccacgctgaggagcgctgcagctccactgctggctgcacccctctactgtccctagccttcctgtgtgccctggccccaccccatctgctggcccttcctcccccactgaccccacccctccactggccccacccctccactgaccccacccctctgctggccctgcctcccccactgaccccacccctccactgaccccacccccattggccccacctcttccactggctgcacctcctccgctggccccaccccttcactgaccccacctccactggccccacccctccacaggccctgcctccactggccccctcttcctccactggcgccaccctttcactgaccctgcctccactgaccccacccctccactgaccccacccctccactgaccccacccctctgctggccctacccctctgctggccctacccctccactgaccctacccgtcctctgaacccacccgtcctctgaccccacccctccactgaccccacccccactggccccacctcttccactggctgcacctcctccactggccccacaccttcactggccccctcttcctccaccggccccaccccttcactgaccctgcctccactggccccacccctccacaggccccgcctcctccactggccccctcttcctccactggccccaccccttcactgaccctgcctccaccggccccgccccttcactggccccacctccggccccaaccccttgtgctggccctaccttctccctgggtgaccccatgcccttcactcccatctgactcctacctgaccctatgactctgccagaactctgggacctccccacaggtcctgtgtccctaagctgacctcatgacctctggctgagccctccccaccctaatgaccccagggccccagctgatcattctcccctggcctgacccaatgacactgacctgtgaccccacatcgcctgcagtgtgtgaccactgtgtggtcctgctcctggatgacctggaacgggccggcgccctcctccccgccattcacgagcaactgcgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccttcactggccccacctccggccccaaccccttgtgctggccctaccttctccctgggtgaccccatgcccttcactcccatctgactcctacctgaccctatgactctgccagaactctgggacctccccacaggtcctgtgtccctaagctgacctcatgacctctggctgagccctccccaccctaatgaccccagggccccagctgatcattctcccctggcctgacccaatgacactgacctgtgaccccacatcgcctgcagtgtgtgaccactgtgtggtcctgctcctggatgacctggaacgggccggcgccctcctccccgccattcacgagcaactgcgtggcatcaatgccagctccatggcctgggcccgtctgcacaggctgaacgcctccatcgctgacctgcaggtactgagcgtcctggccttccctccccaacccgggccagtgcaggccttcaccttccgcctcccacagagccagctccggagccccctgggcccccaccatgagacggcacagcagctggaggtgctggagcagcagagcacaagcctcgggcaggacgcacggcggctaggcggccaggcaggagccccaagaccccccagggccccgggaggctttcacctgtgttccccgcggttcgcttgtcctcattcagcagatgttacttcatgcctcgtacatgtgtcagtgcaggggacaggagctcgagagtcttaggggttgaccaagtcactgaattactatctaaactacctaatacatttgtttacagtgtataatatcactcaaatgtctttttttttttttttttttttttttgagacacagttttgctcttgttgcccaggctggagtgcaatggctcgatctcggcttaccataacctctgcctcccgggttcaagcgattctcctgcctcagcctcctgagtagctgggattacaggcacacgccaccacgcccagctaattttgtatttttagtacagatggggtttctccatgttggtcaggctggtcttgaactcctgacctcaggtgatctgcccatctcagcctcccaaagtgctgggattacagacgtgagccactgtggccggcctcaaatgtcttaatgagtaactatttcattaaattgacaggaaataacaaatggcaagttataaccaataattttaggtaactaacaagtgataaataacaagtcatcagataagagagttaaatagataaggggcccctcttccctgggaccctcggcgctcccccagaccccaggccctcccttgccaccccgaccctcgcctaccagcagcgtgggctagtgggctcttcctccacaggccgtggggacccgagaccaggcgagccaattgctggccggcaccgaggccacactgggccatgcgaagacgctgttggcggccatccgggctgtggaccgcaccctgagcggtaggggccagcccagccaggctcagggctcagagccaggagggctgcctggggtaggggtgggggtgcctggccgagcttggcctggaagaacaggcaggatctgtcttttagatgggagacgacgcctctggagtgaacagtagggcagggtcaggaggtcggcgacacagccgtgtggccagacaggtggccccgggagacgtcagacccctcgacagcctccccaggaaatgtgccggttagatgttcgcgctcacagatatcccgtagtgcacactgagacatgggactcaggagagacttggctccctgagcctgcctaacaggacctgccagcccagcctgggggtcggcagggggtgccatgtcagagagagctggccagggagcagggtgggccaggcggagaggggcaggacgagaaggctcagaagctggctgagcagactggtgtcagggtgttggaggcactgcaggaggtgagggccgggcaggtgaggcagctgtggcctttcgccaggtgctctaggggccacccaggtgcgctcaggttccgggcccctggcctgccaaggatggcagggctggggtcttgggcttggaagccagcaggcagaggtgcactagtacgggcggccccaggctctgacgaacccctgccccacagagctcatgtcccagacgggccacctggggctggccaatgcctcggctccatcaggtgagcagctgctccggacactggccgaggtggagcggctgctctgggagatgcgggcccgggacctgggggccccgcaggcagcagctgaggctgagttggctgcagcacagagatgtgagtggtgttgtccctggcaggcggggtggggagaggcagggacctgggagctccaagggggaggtcagcatggagtggcatcaggtgggcatcacggggcagatggatctggcgggcaccaagtggagaccaggggtcatgaaggggcctggcttccagagtgaccaccctcaccctggtctcggctagtgctggcccgggtgcaggagcagctgagcagcctctgggaggagaaccaggcactggccacacaaacccgcgaccggctggcccagcacgaggccggcctcatggacctgcgagaggctttgaaccgggcagtggacgccacacgggaggcccaggagctcaacagccgcaaccaggagcgcctggaggaagccctggtgaggaccccggacttgttcttcctcctgctcctcttcccgcctcctccctgcaatccctctcctctccggctcctcccctcccctcccctcgtcctcccctccctccgtcctcccctccctcgtcctccccccctcctcctcttcttccccccctcctcctcttcctcccctcccctcgtactcccctccccctcctcctcttcctcctccccctctccccttctcctctctcctccctcttctcctgtcctcttctcctgtcctctccctccccactccccatctgcccatcatccccctccccctccttgtccctccccaatcctcatccctttccccacctcctctattctctccttccccttctcctcctctcatttccccatctctcctcaccccctcccatcctttcctcctcttctccccctccctgtcccctcccccttttgcccccttccgccttcctttctcttcttccccacttttctctctacccctccatcctcctccttccctcatactcacacgttctaaccctcccctcctcccccctcctcaccccccatactccccctcttttcttctcccttccctgccctgctgtccaccccatcacatcctttattcttttcttacccctcattgtccccaactcccctgcattgccttcagcaaaggaagcaggagctgtcccgggacaatgccaccctgcaggccactctgcatgcggctagggacaccctggccagcgtcttcagattgctgcacagcctggaccaggctaaggaggtgagtgcagcccctggcccctgtcaccaccccatccacggccaactccctcccaggcccgtgggcagctttgtgtgcacacttgcgtgcagagcccgccctcagggtcgtggatcaggtggctgtgagcaggatgaggggctaagtccactcaaattccaggagctggagcgcctcgccgccagcctggacggggctcggaccccactgctgcagaggatgcagaccttctccccggcgggcagcaagctgcgtctagtggaggccgccgaggcccacgcacagcagctgggccagctggcactcaatctgtccaggtgggtggccaggagaggaggggccctgggcccaccctggggatgcagacagggccttgggagggccagctggtctgggaaggctcctaggggctgaggccgttgtcctcaaagaagccaggccttcctcagctccacggcaagctggggcccagagtgacaggagcagtacacccagcaggcgacaggcacgggcaaagacctggaggcgggacttggcgggcaggcacgggcacggctggttgtgagcgcaggaggctggagagccaggccgagggcgtctgcgcttacccactccttcgaccctcccttccgctgcagcatcatcctggacgtcaaccaggaccgcctcacccagagggccatcgaggcctccaacgcctacagccgcatcctgcaggccgtgcaggctgccgaggatgctgctggccaggccctgcagcaggcggaccacacgtgggcggtgaggcccctcacttcccctcagccccagcaggagcgcccccactgcctgcacctcccgcagccccggcctgcgtgtctgagccacggtctgccctggcatccacagacggtggtgcggcagggcctggtggaccgagcccagcagctcctggccaacagcactgcactagaagaggccatgctccaggaacagcagaggctgggccttggtgagtgctgggctccgatgggggcccttaggcctgctgggcatctgagctcccagggaccctcagcccccagccacatgcacacgtggggtttgtgggtcaccgcagcatggtttggggtgggagagctttggagatggctccccagctgcttgtgtgtcagccccggggagccctgcaggggagtccagggaggagcagcctcctgcgaggcactggctgccactgaggcaccagctgagccacagggcacagggcaagagatacgtggcctctgctctgctgacccgagggctacacgcgtgccaagctgcgcaatgagaaaggtgtgagctgctaggaccagagggctgtctcttctgagcctctattgtttcatctgtacaatggggacagctatgcctgcagtgggaccagaggccttcagggaacagaggccacgctgagactcaacacctccccacaggctaagggactccatgtctgagtgtccctgtccatctgtctgctgtgtgtcagccttggtcctcctggggtcagaagggtggaggtgggctgcaattgtatactgggggtgaagctgcctgggagctgaagctgcctcccccgcagtgtgggctgccctccagggtgccaggacccagctccgagatgtccgggccaagaaggaccagctggaggcgcacatccaggcggcgcaggccatgcttgccatggacacaggtatgcggagcctgggcccggctctcgcagccggccgaccatgaggctctgtgacagtggcgctggccacatgtggttggtgagcactcactgtgctgtggaagagacccccacagtgggcagctggggccagacacagaaagcctaccagggaggtgccagggctgcagatagcacagacagccccagccgtcgggagcctggcaagcttggaagtgctttgggtagaaatggaggtataggtgggagggctgtaggccttgggggggattggggcacaccctgcaggaagggcacccaggagggcacagtggtcagcgtggctggaaccaaggggctggcaagaccttgggcggtgaggaccagggctcccaccctgagaggcttggagcagaggacgatgtgcctcacccagtttctgagggacccctgtggctgcggactgttcccagcaagcccaggagagatggtgggggccaggtggtgggaggtgacatggggcacatgtccagggaccagctgtggcctgagaggctgggtgcctgtcctggcatggagggggcgtctggtggaggcatttaggatgggtttggattgcactgagcagcggggtgtgagggtctcacacaatccatagggggttggatgtccctgttgctggcccaacagaaagacttggggacatgaagccaggatggtccccgctggcccctgctgagcctgccctctgcccaccacagacgagacaagcaagaagatcgcacatgccaaggctgtggctgctgaagcccaggacaccgccacccgtgtgcagtcccagctgcaggccatgcaggagaatgtggagcggtggcagggccagtacgagggcctgcggggccaggacctgggccaggcagtgcttgacgcaggccactcaggtgcgcccatggccctcgcggtgcccctgatggaggcgggcacggtggggggcaaaggtctcaggtctccctctctgcagtgtccaccctggagaagacgctgccccagctgctggccaagctgagcatcctggagaaccgtggggtgcacaacgccagcctggccctgtccgccagcattggccgcgtgcgagagctcattgcccaggcccggggggctgccagtaaggtgggtgagagtcccaggggaaggtggacatcagggagggtggtggtggacgctgatggaccgtgccccgcaggtcaaggtgcccatgaagttcaacgggcgctcaggggtgcagctgcgcaccccacgggatcttgccgaccttgctgcctacactgccctcaagttctacctgcagggcccagagcctgagcctgggcagggtaccgaggatcgctttgtgatgtacatgggcagccgccaggtaccaggctggctgggtggatgcggcccgagctcaggctctgtttggaaatgagcggtgcctggtccctggtccccggtccccatcccgactgtgtgtctgtcactgccgcaggccactggggactacatgggtgtgtctctgcgtgacaagaaggtgcactgggtgtatcagctgggtgaggcgggccctgcagtcctaagcatcgatgaggacattggggagcagttcgcagctgtcagcctggacaggtgggaggcccaggagagaggccggatgcctccaactgcagggcccttgcccgttcgccatctctcccctctccgtgtgcacccaccacccttcacctctccatgcccactcgccacccctcgcctctccgtgcccactcgccacccctcgtctctgtgcccactcgccacccctcgtctctgtgcccactcgccacccgtctgtgcccactcgccacccctcgtctctgtgcccacccgccacccctcgtctgtgcccactcgccatccctcgtctctccgtgcccactcgccacccctcgtctctgtgcccactcgccacccctcgtctctgtgcccactcgccacccgtctctccatgcccactcgccacccctcgtctctccgtgcccactcgccacccctcatctctccgtgcccactcgccacccctcatctctctgtgcccactcgccacccctcatctctccgtgcccactcgccacccctcgcctctgccctcaggactctccagtttggccacatgtccgtcacagtggagagacagatgatccaggaaaccaagggtgacacggtggcccctggggcagaggggctgctcaacctgcggccagacgacttcgtcttctacgtcggggggtaccccagtaccttcacggtgagcccgcccggcctggggcagcctgggaggggctccgcagccccgagtcgcttgtgtcctggagagccgcgggttcttttggtatcttgcctcagtccgtcctgctgtagtctgaagtccccttggtccatcctggaggggaggcgcctcaggccaggtgccctgacccagccctgtgcccacagccccctcccctgcttcgcttccccggctaccggggctgcatcgagatggacacgctgaatgaggaggtggtcagcctctacaacttcgagaggaccttccagctggacacggctgtggacaggccttgtgcccggtgcgtgtggcctgccctccccgtctccacccaccccaccccaccctccgctgaccccagaatctccgacctgcagctccaagtcgaccggggacccgtggctcacggacggctcctacctggacggcaccggcttcgcccgcatcagcttcgacagtcagatcagcaccaccaagcgcttcgagcaggagctgcggctcgtgtcctacagcggggtgctcttcttcctgaagcagcaggtgcgccaggcacacccgtcctgccatccccacttgcactgaccctgccccacactaaccctgccctgtttctgcagagccagttcctgtgcttggccgtgcaagaaggcagcctcgtgctgttgtatgactttggggctggcctgaaaaaggccgtcccactgcagcccccaccgcccctgacctcggccagcaaggcggtagggccagggtggggaccagggtggcagggagaggagatggaacgatgggggcggggcaggccgcagggacacagctggccctggagcccccactggtcctgtagatccaggtgttcctgctggggggcagccgcaagcgtgtgctggtgcgtgtggagcgggccacggtgtacagcgtggagcaggacaatgatctggagctggccgacgcctactacctggggggcgtgccgcccgaccagctgcccccgaggtaagcactgtgcgcagctggggctccgaggccaggctgttggggcggtaggctgggcttggaggtggcgccctgacccgcatccccgcttccccacagcctgcgacggctcttccccaccggaggctcagtccgtggctgcgtcaaaggcatcaaggccctgggcaagtatgtggacctcaagcggctgaacacgacaggcgtgagcgccggctgcaccgccgacctgctggtgagcagccctccccgggctgggggtggcatctgtggacatgcaggggcacccgcgggcactcagggatggcctccccgcaggtggggcgcgccatgactttccatggccacggcttccttcgcctggcgctctcgaacgtggcaccgctcactggcaacgtctactccggcttcggcttccacagcgcccaggacagtgccctgctctactaccgggcgtccccggtgagacctcacacccgtgcccattccccaccccgcggtggccgtcggagcagttgggactggggtgtctggaatgagtctgggtccccaggccggccggctgacctggctgccgtccccaggatgggctatgccaggtgtccctgcagcagggccgtgtgagcctacagctcctgaggactgaagtgaaaactcaagcgggcttcgccgatggtgccccccattacgtcgccttctacagcaatgccacggggtgagcctggccgctgggccctcatcgtgaaggtctggagggacgcccgcctgcacttgcctggacctctgtctcctctgaggtgggggtgggcagggtggggaaaaaccgagcctccggcctcccgccccccagagtctggctgtatgtcgatgaccagctccagcagatgaagccccaccggggaccaccccccgagctccagccgcagcctgaggggcccccgaggctcctcctgggaggcctgcctgagtctggcaccatttacaacttcagtggctgcatcagcaacgtcttcgtgcagcggtgagcctggtgggcgctgggggacaaggtcccagctggccttccgcagctgctgaccgcctgcccgccctgcacaggctcctgggcccacagcgcgtatttgatctgcagcagaacctgggcagcgtcaatgtgagcacgggctgtgcacccgccctgcaagcccagaccccgggcctggggcctagaggactgcaggccaccgcccggaaggtgggcaccccaggggtgagcaggcagagctggggtggctggaagggtggcccctgtgtgggcggcccctgcattcaccatccacgcccccaggcctcccgccgcagccgtcagcccgcccggcatcctgcctgcatgctgcccccacacctcaggaccacccgagactcctaccagtttgggggttccctgtccagtcacctggagtttgtgggcatcctggcccgacataggaactggtaaggccaggcccggctggggtgggctgagaggggccgcgcaggctgacgccagctccgcttccaggcccagtctctccatgcacgtcctcccgcgaagctcccgaggcctcctcctcttcactgcccgtctgaggcccggcagcccctccctggcgctcttcctgagcaatggccacttcgttgcacagatggaaggcctcgggactcggctccgcgcccagagccgccagcgctcccggcctggccgctggcacaaggtgagggccgagaagaaggaaggtggtgggcagggcctggcagccctaccctgacccatctcctgcccccaggtctccgtgcgctgggagaagaaccggatcctgctggtgacggacggggcccgggcctggagccaggaggggccgcaccggcagcaccagggggcagagcacccccagccccacaccctctttgtgggcggcctcccggccagcagccacagctccaaacttccggtgagaaccatcttgccccagcccccactccccacccactgttccctttcagctgccctgggccctgatccctgcccggtctgctcctataggtgaccgtcgggttcagcggctgtgtgaagagactgaggctgcacgggaggcccctgggggcccccacacggatggcaggggtcacaccctgcatcttgggccccctggaggcgggcctgttcttcccaggcagcgggggagttatcactttaggtctgtgggtgctggcatcccaggccccagcagggcagggcagggggctccaggaggttctggggaggggccccccctttcttctccatcacaacccctccccgcagacctcccaggagctacactgcctgatgtgggcctggaactggaggtgcggcccctggcagtcaccggactgatcttccacttgggccaggcccggacgcccccctacttgcagttgcaggtgaccgagaagcaagtaagcctggcagaggtggcgtgccagggcagggtttgcctccccattctggtgacctcgggggcatagcctgaccctcccttcctaccccgccaggtcctgctgcgggcggatgacggagcaggggagttctccacgtcagtgacccgcccctcagtgctgtgtgatggccagtggcaccggctagcgggtgaggcccctcctgtggccagggcactctgccacccccacccttctgcagagcgggagccaggcgggactctgggtggggtggcttcttttggggctggagagaggctgggctgaggaccacctggcctcaggagtccccctttctcccagtgatgaaaagcgggaatgtgctccggctggaggtggacgcgcagagcaaccacaccgtgggccccttgctggcggctgcagctggtgccccagcccctctgtacctcgggggcctgcctggtgagtgcggccttgatcaagggtgggggagctgcccctcaggactaggtgctgcgtaacctaccaccctccccccacccctccaccccctgccccctcccaccctcctcccacccccctaccaccctcctatgatgtggaatgagacaggggctgggtggggcactgacgtttgggaagggcctgtgggtctctagctgcccaccaaccagccttcttccatcttccctgtgcccccagagcccatggccgtgcagccctggccccccgcctactgcggctgcatgaggaggctggcggtgaaccggtcccccgtcgccatgactcgctctgtggaggtccacggggcagtgggggccagtggctgcccagccgcctaggacacagccaaccccggcccctggtcaggcccctgcagctgcctcacaccgccccttgtgctcgcctcataggtgtctatttggactctaagctctacgggtgacagatcttgtttctgaagatggtttaagttatagcttcttaaacgaaagaataaaatactgcaaaatgtttttatatttggcccttccacccatttttaattgtgagagatttgtcaccaatcatcactggttcctccttaaaaattaaaaagtaacttctgtgtaaccgaatgaatgttgacttaaatacggagagagtctcaagacaggtctggaaccggcctggacagaggcaccaaactcttcctggggtgaccgttttccgttgttaggtcaaataactaactgtctctgggaccctacagcagctccccacgctagcacctgtccagccgaaactccctttgggcaaagaaactaagcgttggcaggtaaaagaaaagactttattaataatcagtgggtgggaggtgagggtgtgcaacgcactgcaagcgcccagttcctcggaggacggcgcgtggctcagtccaggctcatgtcctcctcttcgtccttcttgtccttcgtgtcgccctctttctgctcgggcttggcgttgttctgcatggctttggcaaacgcttccacatctagaacacgttaaagacacaaggtggtgtctaacccttgcccagaactggggatcaaagcgatgggatcaagggcagaagggctgtgacctttaccccctcagccccacttctgcagatccagggggacaggaatggaccctgcccctggctctggcctggaggtgcaggcgcagccacttaccgcccttgttggcggcctccacagcctctgcaggcagaccgaactggcacatgagggggcccagctgccccgaggccaaggctgcgctgaacatgcccagggcctgcaagaagagccaggcgagggctgagctccaacccgggctgcaccccagagccacactgctcagctgccagctctgcgggtcaggcacatgaagcactggccatggtgaaggtggggcagggcctcctcctcccccctgcccactccctgagcacacagtggaggacaccctgggcccggcctctacctgctggaactggggcgaggtcagggtattctggatctcatccgcggtctgcggcagcgactccccagatggcaagtagggaagcaggcgctcctggacatccgcgttggcgaggatgggagccattatctccggcgtcagcacactggccaggtccactggggcacaagaacacggccatcagctcgatgacagcctaagtgcccacatggaaggcatgcaagcagggactcagcccatggccccagcaccccaggcgcgcacactaggcagatgccttggaaggtgagcgtgcgagggtcagcaggccccatgccccccacccagctccaggcgacagcacacgctaccttgctggccgcctgctggcccggctggtacgttcatcgtggccaggatgctctggaggtcgctcagctggatgggctgggtcgggctggctgctgtgctggctccattcccggaactgggcgcggggctcgggctagttgctgaggcagctgctggagcagaaggggctggggtggcacgggtggaagaggtggtggatgacggggtgaccgctgccgactggctccgggagctgcgaagagagagggcaccgctggagcggacacgccccacacggcagggcctactcgcagggtccagggtgctgggccaggattccccactgcccctcccttaacaccgtggcacctgcgtggcaggagcgatgaggctcacctggaggaggagctgctccctggaggcccactgctccccagtaagctggccaggccaggtccagtcagggcccccagcccacctgcgaggggcaaggaaatgcgagctcaggatgccctctagcccaccagaaagagcctggcccctccccaggccagaggagcaggaattcccaacaccaaagccaggaagaagcggggcggtggggacccacaggcctggaggagcggcatggggcgggtggacacttgcggctgtgttctggaagcaaggtcatttctgttccatcccattacacaattcatgtgcttagattagaagattcagtccagatcccacccaaagggacaagcatttctgaagggccaagcacacgggtctgcactccatgagctgg

SEQ ID NO: 16804 - DNA, 176006 bp, Human
  misc_feature (1)...(176006): n = A,T,C or G
attgcctgaacctgggaggcggaggttgcggtgagctgagattgagccattgcactccagcctggccaataagagtgaaactccatctcaaaaaaaataataaataaaaaataaagtatggggggtatttttctacaacaaaaacattaaaaagtaccgcatgttggagaggttgtttagatactatcgtcgtttatacaaagaagtgattttagcagggcatggtggctcacgcctgtaatcccagcactttgggaggccgagatgggtggatcacttaaggacgggaattcaagaccagcctggccaaaatgatgaaacctgtctctactaaaaatacgaaaaagaattagctgggcgtggtggtgcatgcatgtaattccaactactcaggaggctgaggcacgagaatcacttgaacttgggaggcagaggttgcagtaagccaagatcatgccactgcactctagactgggcaacagagtgagactctgtctcaaaaaaaaaaaaaaaaaaaaagaagtgatttcaactaacttcaaggtagtctctctttaatgtgcttcaccatgttatagcaaacccatggaattctgtgttcatagattactcgatggtattcttttcccacactaaacattgctctgtaggaaccatgaggctcacttcagagtagctatcagagtggtaacttaccacccatgatctgcatgtggcatttgacattgttttatagaatttcaaatttgacatcataatattagcacaacagaccatagacataataacactcattggactcatgagcattaaagaagtaacaataaaacaagcaccatcctggcacagaaggggcaagctaggaggccctgcacgcttaccctgagagtggggctccccagtaagagtgcatcttccagcagccccaagcagtacaaccaaaagatagaaataggccagcttctgagatgaaatacagtctttcctagtactaattgcacagaatgttttcattcgtaaagggaacactgagtaatatactaaatgacatcctcagcacctttccagtaaacacaatccaccagtttcctgtggaatctgtcttcacgtgtccttccatggaagtaggtggcctataaagcaaagaccaatttataaaggcagtttaaaagtgagcatcacctatgtgagagaatatatttcatttttgttatttgtccatttcagtgtatctgtttctaataccattttcatttttaatcaagtaaagaagtaatctgaattagaatctatttggtgaaaaagtagggggagggtggtccagggcaaagaaaatgacccactgggaaaaatgcccaaagactaagatattgatctgttcagataaaacaagaaatgcaaaccggctgttgacaagccaaatccagcccttggctatgtttaggttgcccatgtagtgttttgtttttaattctgaatttatggtcaatatttaagagttagaaaatttgtataaaatccagactgccacttcttttgaaaagttgcatggtgtggcatggtaaggctggcatcttgcacagtgacagcagcgagctgcagatgtggggggtgtggggtggggggttggctgcctgcttcagcgcaggtgtgggctctctcaagcactccacacctgcccagctgcactcactcacccccctgcttggctcctatgagcactgacctttccagccctgagggaggccacattgtaggttactgagcagcaccccctggcacagtgggtgacaagactcccgaggcttatgccaaagtctttgcctcatggaccaggttcctgtgaaattctcatgcatttgatttcctatcttttcaataaggaagtgcttaggactattttttatttttgaaaaaagtccatcataagctttatgccaaataaaatacactactcttcttcagagctgcagctaatttactttggctcatgttccccagagaggagaaacagcactgcacatggcagctcgctccggccaagctgaagttgtgcggtatctggtacaagacggagctcaggtagaagctaaagctaaggtatgcgcaatacttgacaagtgtttgaaattgaggaaaaactgttggattttcataaaacttttaagtatatacatgcagtctttcaagaatactttaaaaatattgaaaaacctccaatgataaaagtccctacccaagtaacattgtaaaaaatcccttccctgcacatttgttcattctattatttaacaaaatgaaataggatgagatgagaacttgtgcctgaaactgtcagcacacggctagtccctaacagattggggactgaatctagacttggtccaaagttcttcacactccgtggagaagggcttatgcacaaagcttctagaacaatcacaacctagaagcataactgagcttttctggttgacttataagtcagctgtcaacagccacaaaaggaaaatgggggattttttttttttctacacaagctgtatggccacttcagaattggcctcgtatttcacctgcaggagaaacccacttatctgctgctattgggatagatagttcggtcaggctatcagaatggcagttcaggtccagaatcataaaccacttaatttcaacctacaatatgtaaatatacatttgcacaagtctgcagtctctagtttcaagtaaggggtggcagtagtagcagtatgtgagatttttccttggcacctattcgtttctgctttcaatattcctcttctcccttgcagcatctccctaactcctcatgcttcctactggttagatagcccctcttactttgacattgaccctcatcctccttattcttccaaaatggtgtcctctattctagcctcgtttctctacctttcctacttaaaccatttacctgaaccttatcacaattcagtagagaatttctatttagaggactaccacagggatctttgagcaaattaagatgatttgcgcctcccacttggggataagaccctaggggatcaggacttggtgagtacctcctgcccttgggtgaattgtagtgaggtggctctccagtttagacagatgcagcccttgccaggatgcacagcctggcaagcagagggcatcagcccctgctgacccttcagctgggagcctttgcacaggtatactgcgcaaccccacactgccttcctcacactctgcttttgtctatgggaaggcagaaccaacaaaataattcattccatgtgagtgcataataactggtgtggaggtataatatccctcccaggtatatgagttttactaggatacattctcttatctcccaaagaaggagcaattaaagttcaaatttgattctctgtggcaggtgtgggtggggtgtaatttatagacaactgcatttcatggttttcttattaatgagtcactctccacaggtatttaattagcttagagctaccatctcctcatttctgagcattgaagaaaaagacaaatgagtttttttagcattgactcaaaaagttgattgtacctcttacatcaagcagctaatattccctgaatttttcataaaggcaccattgtttcctcagctcatcagccttacatttctaccttgctgtttaggatgaccaaacaccactccacatttcagcccgactggggaaagcagacatagtacaacagctgttgcagcaaggggcatctccaaatgcagccacaacttctgggtacaccccacttcacctttccgcccgagaggggcatgaggatgtggccgcgttccttttggatcatggagcgtctttatctataacaacaaaggtatgaaagcaaatctcagaatcctgctctgtccccccaaatacatcttccttacgtttccccgcatagtaacaggtccagaagctgcacaacagcatctattcttgcgatcccacagtagtcattaatatggccagcaaagctctgtggtgggagagggtaactggtagtattttgtggggggttttttgccttaagtttcttagtatgttatcttccaatgaaaccttactgatatccagagtcagatttcttgtaaattatttggtggccttaaatggtagtttaaaaacagagccacagattagcaaaatgctcaggccaagcacacaaaccacattatcacagctcggttggtagatgcttttataatacttgcaaaactggcagtgaatttttcttggggttgtttttgtttgttcttgttcttttttgtgtcattattgtcttgtctgatttatggtttgatttatttttatctcaactctgatgccttagagtaataccctaacataaacagttgttctgcatgtgcagaatgcaaaatttggagctcattttttttgtgatactacataagccttgcaagtgtgatagcaagatgaattggcttgtggcgcatcttccaaagctagtaactggtactgcactcttttatttggatgcagataagaaagattaatgtgtaatcaatatagaagacaattacaaatagaaaactatcgggataaatgatgactacctcaaatttcatttcttgtgattctttgggctcttcagtagagttgagatgcaagttcaggaagctcatttgatgtgaaacagaataatgggtgatagggtcttgagtattcaggcatttcaccataccagctgcacattccttttagtttgctgtagtctcatgaggtcaaatgtgctgatgaccctgtaatccctgactcatgattgggacccccacaacagtgtgctgattggctggttgatacacagattcttgtaggagttggaagttctgagggagccagccactcagctattaatatccaagtgttgcatatttgtccatgtgtcattattcagttcacctacagaataggcgtcgtcattctaaaaccatgtcattattcagttcacctctggtggcaaaggtgagagaatttctcactcctcctcctgaagactagaggacacataaggattgtgtatacatggagaaacggggaaagaagaagaaaagtggctggtctggtgatgtgagattgtgagaggttcagacttgccctggattttcccaagccctccaaactgagtctgggaccctataacttattcttcccacaatatgaaactctgaaaacagccctagaataagccccagatccagctctccaacttcatcctggtgagatacctgaagacttccagaaccaatagcatgtcatggctcagtcagcagaagggagaaagattaggtatcctggtatgttatgctcacaccctgtcaataagaaggctcttgaactcttatctgtgagtcttggactttaaatgcagacttcactgctcatcatcaatagaataattaatcagttctggaaagcagtgcccttatgtcatatctttttgtttgtttgttgtttggtttgggttttgtgtgtgttttccttatgtcatttctattgttcattatttttatgttttttttttttcagaaaggatttactcctcttcatgtggcagcaaaatatggaaagcttgaagtcgccaatctcctgctacagaaaagtgcatctccagatgctgctgggaaggtaagaggtcaccagccaccctgaagcaggccacttccacgataacaaaatacacccttgctaatattcactaatagccactcaaattataactaaatatttaagtcccactaggatgaagagcacttgggaaataaaaggtaaatgctggggtccaagtactgtggaaaccggaatgtaaatatgccctatgtcgtatccaatctaatttcatttcctcaatctaagcctctggttttaagacacctttgacactggttgttgtttctgcacgtgttttcagagcgggctaacaccactgcatgtagctgcacattacgataatcagaaagtggcccttctgcttttggaccaaggagcctcacctcacgcagccgcaaaggtacctataattccacagcctaaggagactgatgggtaaggtctatcagtctctatctgcacatctacttctgcttcagcaggagcaccctcctagtttaggcaccactaaaaaatcacagaaatagaagcaccttaggacatctgtgccttcagtgatttagtctgctaatatggtagatactcaggaaatatttacttgtcagttgattgtctttggcaatccaggacctcctggaggaaggagagctggaacactctttagccagatgaaaaacataagcacagcctgaggaagtaagaaagttctgatttgtcagaattatgaaacatgtgttacatttttctggccacataattgccttcaagttgtttatttgcatttagtaaaataggttgagaggttttacatgtgtgtttttattattgctaaggaggatctttattgttagggcctttttgatcagtagacaacttagatttctgagaaaagagaaactgagtgggtatatagctatattattattttagtaatctaatttgagggacaaatcataaagaagagcttccttaaagacaggttaatagagtgctattggtttaataagcttcctattgttgagcaggtggctatgatcagagaacactgaaatgatgcaaaccatttcagtgttgttcagttatttcgctaaacactattggttggaggaccattgagtatcccttatgatccttctccttttttttttttttttttggagggagacggagactagctctgtctcccaggctggagtgcagtggcgcaatctcggctctctgcaagctccgcctccggggttcacgccattctcctgcctcagcctcccgagtagctgggactacaggcacctgccaccacacctggccaattttttgtatttttggtagagaccgggtttcaccgtagccaggatggtctcgatctcctgaccttgtgatccacccaccttggcctcccaaagtgctggaattacaggcgtgacacaccgcgcccggcctcccttatgctttttacatctttgatttgctaatccatgttggggcagctgcagtgctctcctttaaacctaatgtttagatcacatcattgtatacacagatgaatgaactggggttctagattactttagataccctaagagatcaagttttaggtactctctccatttagagagtatgttatcttcgacagatatttcttcctggaaactttcgatcattttctgccccatcctctccagaattatacccagtgaaatctaaaattcaaaatcaaactcccaaacttgcttttaatctaaatgtagctttcccctccacagtttctgaccctgacaaacattctttctattacaaaaccacaatgtgacttgataaaactttaatttaaaaaaagacagcagcattattcatgacagccaaaaggtggaaacaatgcaaatattcattgatggatgaatgcatatactcactgtgcatatacacacaaaggaatattatttagtctttaaaaggaaggaaattctgacatactctactataatacatggaggaatcttgaagacattgtgctaagtaagccagccacaaaaggacaaatgtatgattctacttatatgatgtatatagagtagtcaaatttatagagacagacagaggatggtggatgtcaagggtagagggagaagggaatggggagttaatgtttaatggatatagagtctcaattaggaagactaaaaagttctgcagatggataatagtgatggttggagaacaatgtgaatacacagtagttaatactactgacctgtacactggaaaatactttaaatgggaaattttgttatgtgtattttagcataattttaaggagaaaaatttgtaaggaatttaatggttgtacattttatttcatttcatttttacctctgtgcttttgggctacttttctttttctctttctttttctttcttttttttgagacggagtctcgctctgtcacccaggctggagtgcagtggcacgatcttggctcactgcaacctctgcctcctgggttcaagcgattctcctgcctcagcctcccaagtagctgggattacaggtgtgtgccaccacacccagctaatttttgtattttcagtagagacagggtttcactgtgttggccaggttagtctcaaactcgcaacctcaagtgatcctcctaccttggcctcccaaagtactgggattacaggggtgagctaccttgcccagcccctacttttcttatgtataaataaccccaagtccttcatagataacaagtaaataattagtaagtgaactattttttccttggatgagaataaaaattttggcacaaaaagcagtgtaaaattgaccaaagttataaagcagtaagtgcagcaaatgactccaatctctctttctactcacaaataatttttttttttttttgtnnnnnnnnnnnnnnnnnnnngtgagcctcatggttcactacacagcaatgtttagtgtgggaaaagaataccatcgagtaatctatgaacacagaattccatgggtttgctataacatggtgaagcacattaaagagagactaccttgaagttagttgaaatcacttctttttttttttttttttttttgagacagagtctcactctgttgcccaggctggagtgcagtggcatgatcttggcttactgcaacctccgcctcccaggttcaagtgattctcgtgcctcagcctcccaagtagatgggactacaggcatgtaccacctacccagctaatttttgtatttttagcagagatggggtttcttcatgttggccagctggtcttgaactcctgacctcaagtgatctgccctccttggcctcccaaaatgctgggattacaggcatgagctactgtgctaggcgcacaaataactcttaaacagggcaatagttggtacattcctagttgatttctcctttacatttgtcaaacaagacttagtattcatagttctctatctgcaaaacatcctttacaaagatttgaaaagaaaagcaatcctttaaataattctttataacattccattagcctcaggcatatttttatagtcaattaaacacaggcttttctaatgggacattgattctcatttccatacacaattgcctccataagagcctgggtaatgccatctctggcacatgtccaataatccctgtcttcagggcagtggtactggtcaggaactttttctagactttaatcttaagcaaagccagtcatataattttaggtattggctttatctgctaggaaaaaaaaaaaaaagtcctagctacaatggtttaaattgatgagcctccattttctcatggcacaaacaggaggtagacagggcagttgttgatgttgatatagggtgttgaggcaagttccctgtgactttttaaaaaatcaatttgggggtacaagtgcagttgtgttacatggatatgtcgcttagtgctgaatacagggcttttagtgaaaccatcacccaaaatgtgtacattgtacccattagagaattccttgtccctcaccccactcctaccgtcccacctttccaagtctccaatgtctattattccactctttatgtccatgtgcacacatttagctctcgctttcaggcaagaacatgcagtatttgactttctcagttattttactgaagataatggcctccagtttcatctgtgttgctgcaaaagacataattttattcttttttatagctgagtagtattccatggggtgtgtgtgtgtatttatgtgtgttggtatatatgtatacacgcacataaattgtatatattataattatatataattatatacaacttatttccagctttatatttgtcaaacaagactttatagctgagtaatagtccactcagctataaacatatagtatatacatatatatatatacacacatacacacatggtatgcaatatgtgcataccatggaatactactatatgtatgtatatatatctgtatacacacacacgcgcaccatgggatactactcagctataaaaacaaataaaataggccgggtgcggtggctcacgcctgtaatcccactactttggaagactgagacgggtggatcacgaggtcaggagatggagaccatcctggccaacatggtgaaaccccttctctactaaaaatacaaaaattagctgggcatggtggccagctactcaggaggctgaggcaggagaatcactgaaacccgggaggcagaggatgcagtgagccaagaccgcgccactgcactccagcctgggtgacagagcaagactcggtctcaaaaaaataataaaaaagaataaaatgtatatatcccacatattcacatattctttatctaatcatccattggtagacacaaaggttgattttacaggactttgctattgtgaatggtgctgcaatgaacatacgagtgcaagtatcttttttgatataatgatttatttcctttgggaaatacctaaccagcggtatctaaccagtggtaggattgctgggtcaaaggtagttctatttttagttctttgagatatctccttacaattgtccttaaaggttatattaatttacgttcctactaacagtgtataagcatttccttttctctgcatcctcaccagcatctattatttttgacttctcatagtagccatttggattggtgtgagatggtatctaattgtggttttgatttgcatttctctgatgattagtgatgacgatcattttttcatatgcttcttggccatttgtgggtcttctttcacaaaatgtctgttcgtgtcctttgccttctttttaatggatttttttttttcttgttgagttgagttcctcataaatcctggatattagttctttgtcagatgcatagttgtgaatattttctcccattctatatggtacctggttcactctgttgattatctcttttgctatgcagaagctttttagtttacttaagtcccatttgtctattttttgacttgctgcatttgattttgaggtcttagtcgtgaattttttccctagttcaatgcccaaaagagtttttcttatggtttcttctagagttcatatgatttcaggtattacatttaagtctttaatctatcttgagttaatttttgtatatggtgagagttatgggtccagtttcattctccttcatctggctatcaaattttcctagcaccatttattgaataggatgtccttttctctgtgtttgtttttgttaactttgtcaaagattagttggctggaggaatgtggcttttcttgtgagttttctgttctgttccactgatatatgcatatatttctataccagtgccatgctgttttggttactatagccttgtagtataatttaaagttaggtgatatgatgcctccaactttgttctttttgcttaggattgctttagctatttgggctcccttttggttccgtatgaattttaggattgctttttctaattctgtgaaaaatgaggttgatattttaacaggaattgcagtgaatctttggcttttccctccaaagactgttgactgggttgccaaatttactttcaagccacaggcagcaagaaagtcagcacaacaaggctttcccagaagttccaccaaaccacatctccttacaccccactggccacttctatgtgcaaaaaaaggttgagaaatagtgctaagcacactaccagagaagtttgtctgttttgttttgcttttattttttgtattttggtttgggggtttgtttgtttgtttgttttcactaagaaagaaaggagaataaatacagagtaggcaatctgccttctttactccagggaagctcaggcattcctgaattccggcagtggtgagagataaggtacagagcctcaatagggcatgattaccacatggatgtgacagcagcaacctcaatgttaactcatcatcagatcacatcctttgtcctttttcttagagcatgtgatgccttctccttaccctttcttctcctttcttctcttttttaaaattgccaatgtattgtcttactcatacatgtcctagaaatgtgatgaggtttcaggaaattggggtactgaaaagtagatgggcagctctaatctattttagtccaatctatttcctgtggcaggaccttatgctggcaagaggattggcttgagttcaggcataacctggatactaattgtagaagagatagtgagctttaagtattatttatcaggtttctcttccataaaatgtgcaacatatctattgatatggatcagtatatttgtgaaagttcttgaaaaaaattaaaatatgatttaaatgctatatattacttttgataatttcaaattgcatttgcttttattttaattttgaaatgcaaaagcacatgtggcaagcacttggtcctctacatcaagagggaaaaaaccctgtaggtcagaattattctacagttgaatcactccctgttgaatttttcttttgatagatgcatctgcctttcttagtatggcaagtgagaatcatttttacttttcacaaagtagaaacaacttagaaaatttagaaaattcattataagcctcaagataaatgtgcttattatttgaagatatttcttaagtctttctgagattaacttttcatactaaaataatacctgagtcacttttcccttgctttatactttcctttgtatctcaggtaaggagctcaagataaatccttgagcaataatagtaatttgtctgtaattggcatatattacagagctgagtctgtctctgtctgtctctctctctgtctctgtctctccctgtatctgtctctctgtctctctcagagttttaaagacaggctctccctatgttgcccagggtggtctcgagctcctgagctcaagtgatcctcctggctcagcctctaaagtagctgagactacaggcatgcaccgccatgcctgactgccacagctctcttgattaaaacatttttttaggacataggattctttttggtggcattagaagtaagtaagattttcatgtgtgagctgccttaccttgttagggggttgagaagtgactaacctgaatattatatcaatagcaaaagcaaaaagagaagatgcatgataagaagctaaattctgagtttatcttgcctttaccactcgaagtagttaggttagtgttagacacattgactaattatatttcctattttagtgctgctttgtgaattttctcttttatgctggtcacttattgtagcattgggctcagaccaaagctctgcatttggctctgcgggcatcagtctctgaagggtgtgtcccagcagagggccaaatgcttctcagggcagctggggttttcagatggcaataggtcaaaattaaaaatagggatataaaatcttcttttaccctggctcatccagtttggcagaggctagtttcagaagagtctagaagtgacatttccactttcatgggttgatataagggtttgtcaagtgaggaatgctgttggacttggacatgccagtgacttaaatgtgaggttcattgcagcaggatggctgagtactgggtgcagcagcccctcaaaaccctctgtgttgtttgtgatccttccacatggctcaaaaagattgtgactgatccattgtcaagatttggatcatacttccaaatataaattcttagattctattttctttttctaaatcttcctgtctatggaaaaaaatcattctgatttgtcattagcatattttacatactcaggtttatgtccatgtcaaagtgtaatcttacacttcttgtaagtgactgtgaaccagggcaacatcccccaaaactctttcttggggcagaagaccctgatggctcctgaggcacagctgactaacagtttatcaagggaatcttgattgtctctctctgggtatcaggggtcagccaagaaaaggatgccagaatatgctgaaagctctagtactcttgattcaaaacctgaggattcctttcttcatgtaattaatacatggcagttattgtgaggcactagagagatacaaagacaaatataacacaatatacgcccttaagaaatgtatatttagtaggaggggacagataaataaacaaaagagtgccactaaatatccccaggactttgataagagtcagtcagggttgggggtaggggttgaggcttgagggatgggaagaaataaaaaacctcatggagggtgtgacccttgagctgaattttcagctgacagatgctggctgctgggcatgttggggaaaagcattcttgtagagtaaggcaagacagagaaacatgagactatattctgtttgggggacatgcaggatgacagaccagcatgaagacaggttttgtaaaagaggaaatcaaaaggccaaatgaggagagatggtagtgtcttaacttccatgaacattaaaaatttcaacttgtaagcagtagatggcaattaaaggtatttttttaaataaaagaatgaatggctctgaacatgccctagtgataactgattgtttgttgcttcttcctcctgtcctcaatttaaataaagcaagtaattatcgagcatgttgtaacataatttcctgtaaaagggaaatttatattccttttggaaaaccaataatgctctaactctttttgattaaaatgtccatattaagccgggcgcagtgactcacgcctgtaatcccaacactttgggaggccgaggcaggtggatcacgaggtcaggagatggagaccatcctggctaacaccgtgaaaccccgtctctactaaaaatacaaaaaattagccgggcatggtggcaggcgcctgtagtcccagctactcgggaggctgaggcaggagaatggcgtgaacccgggagatggagcttgcagtgagccgagatccagccactgcactccagcctgggcgaagagtgagactctgtctcaaaaaataaaataaaataaaataaaataaaataaaataaataaaatgtccatattaaattatgttttccctacttaggaatgcaggatacatgagggcactatattcatgtaccacttggtttaccagtatttgcttacttaatcatgatttcttaagcaatcatagaaaaccactagaaagagacataaactatttgaaaatgcactgtgcacatttttatcttgttcctgggcatgtgaccaagtgatttgtgttgacagaatggttatacgccactgcacatcgctgccaaaaagaaccagatggacatagcgacaactctgctggaatatggtgctgatgccaacgcagttacccggcaaggaattgcttccgtccatctcgcagctcaggaagggcacgtggacatggtgtcgctgctcctcggtagaaatgcgaatgtgaacctgagcaataaggtaacccacttctttcttgacaaagcatgcagcacaccaaaacctcacccctcagaaaggtcactaagaattcacagaagatctgagtcaaataggatgtgtaaagtgtaatattgcaccaagttgtttaccaaagtgttacttaacagagcaaaaatttggaaacaatctgtttaaacaataagaaaaatggtcaatgcgccagttgctctggctcaggcatttaatcctagcactttgggaagacaaggcgggtagactgctcgagcccagaagatggaggctgcagtgagctctgattgcttctttatactccagcctgggtgacagagtgagaccctgtctctttaaaaaaaaaaaaaaaaaagacagaaagataatggtaaataaataattcagataattcagtcagacaatgagtatatatggaagtggctctatgtacacatagccataaaaatgaagtccaggaagtttttgtagtaacataaagttttgttataatgttaattcaaagagcaccattgttacttcaccataacatagcaaagaagaagctgcaaattgtagccctttgctttatttcacaaacatgtttggggtcctgctccttgctcatccgtttttaagttctaggttacaaagagaaatgggaaacattgctgccttcgtgagttcattttaataacaaatttagagtagctattttatggagtagataggagaagttgttggcaattttgaaggaacttgtgaagactgttccctaaactcttcaaacacccatgctgtcatctttgatatgctcattattcatgaagaaaagactagagttttgtcaagcaaagtgaaagttcagccgacaattaaccagaaacttgttaatgaagttactgcctctccctgtatgtatcaaatttaggtttgctgaattgctcattaagattgacccaaaacacaagacaggtgtttctaaatcttcagataataggaaaccacacaaaagggccctcagattctgataacctcccctgtctggcatttagcttctcttctgcctgctgggtgtgggcatagctgtgatatttctcaggcctagctcagatattggagtagggttgcaaaatagcaatagtcttatgttgacaaataacaagtaatttaaatactttcaacacgtgtgcctgtgttttgaaatcacagagagtttgaatcctaagttggattcttcctgtgtcatttaggcaagttatattacctctctgagcctcagttttgtcctttagtacatggagatagcaatactgacttcttgagttgctttgaggatacactgagaaaacattcaacacttttaagtaagaaaaaatcgtttttttaattttggagtttttacagttttggaaaaaggttactccataacaatctgaattctcaaggttattatttaacaaattctatagaccaaaagacatatacaggagaccagggatatctttttttagttttagtattgtgaaaatcttttttggtcattacagagcaaacacatttttttaattttatttttttcttgttaaacattccttttaggagtgcatgtctcagcattaatgggaatcaaaaagcaatttcataatcgtcattatagttaagatttgtttgatcttttgaattttctatagttttatataccaatttagagaccagaattgtaatggcttgcctcaaaactcaatttgtctttatgacaaagaggaccttgtgtttcccaaattgaagcacatgctggtatcagagtgtattttctcttgtgagcccataatattgtatttcatcatttcttccagaaacaatgtagtactttcacaattggtttaaattgaatatttccagtaggtttgataccaaactgcagtgtgactgactttgtttcttcaaaatcctgcagccaactggtacaatatatgcccagccttgaattcatcttagcctcatagggtgattttaggctaaaaatatttagggcaaaaattttctcagtgcttgttttagtagagtggaaattaacaaaaggaattctaaagactcaaagacatatagcaaaccagggaaacctggaaatttctggccactttcctgagtaaatgatacacaagcagagatattcctaaaggaattctaaaagatcaactggctttccattagcatgttgaacttaaggaacttctgagaacttctaatacttttaacttctaacttctcattagaaactatctaataagaaggcatttgtaaatccttgcatcctttctccgttgtcgttttcagtataaagcactaaatatgccctgatgtgaaaacagaaaagcagcaaaactttttattattcaataaggaactgtctctcagtttttgtcagtttttcctgagctgccagtgttttaagcatcaattactcactgttccctcctcccttctcctgcctacctttccctcttctcacataacactacattttatttccttgctaaaaaataactattaaaaaagatttagctttcataatttatgttgaactaaacactttattgtttttactttcttttttcttactagtaaccagcactttcccagtacttttaaggaaaaatgatcatgaaccccaagttattgttgaggtgctagtgttcgatttgattcaattttgcttttgatgttcctattttcccatataggttttgcagaccccaatgcttatattttttatacaactgaaagaatattaaacagagatgttgctattttaatttgatgttttctctgtttcaaataaatacctttttttttttttttgagacagaatttcattcttgttgcccaggctggagtgcaatgatgcaatcttggctcactgcaacctccgcctccagggtgtaagcgattcttctgcctcagcctcccgagtagctgggattacaggcatgcaccaccactcccggctaattttgtatttttagtagagacagggtttctccatgtaggtcaggctggtctcaaactcccaacctcaggggatccgtccgccttggcctcccaaagtgctgggattatagacgtgagccactgtgcccggccctaagtgctatttttaaaatgagcaatgatcaaaatgccataaaagattaacaggtaacttctgaactcaaacagggctgtggttaccttcatattgttttttaaaatcttttgaattataaccaagaatataaaaataaaatgttatttatataatttatactgttctacctaagaaaaatgtttgattttttttctctgatttaatctatgagtgagtggattaaatgctagatgctagacactggttatataaaaatcaaagatacgatacttgcctcaacaagctcacagtggtttgaggaagacaagcaagaaaacagagtttaaatgcaggattatgatatttgtaatagaagtgagcacatagtaggtttgcacataaatgtaataacttggccctttattgaaacgagaagagagaaaggccagggaagcctgaagtgactccatcagtgagtgggtaagccagctgagcagcaggcacctagacatgggagcatgaggggacaacatgtgcccacaacacattctcagtctttgctgagagctactcagtaaggtaccctcagtgtcaaaagtttcaaacttagaataggtgaccatgacactcacaaaatgttgtggctgacaatattatttcctctgaaggagaacacggaacatggttctgtgatgaggtcagtgtttgggtggtgccaattttggctctggcttatttttcttgaatttcaagtgaatgcatcagtcctccttttcacatttccccctttattcagttcaagtgagcttcctccaaaattctataaacattattaaaaagtcccagcttgactctctctgcattccataattgctctgatggaatagcaacccctgaataaataatgtttcacatctagaagactctgtgctcttcctgaaactgcctttgattacctcctttcctctgacaaataggacaggctgatattttcattgcacagatgctagagggggagaaaagacttccaggattaagatattaacttctgtgctcataatggatgaaagcaaaaaatctgaaagtactaacaccaactcactttctcttaaatattataaaaaatgctttacaatttaaagaggttttttaaaaccggagtataatcttagtaattttttttcttggtcatgagagcaaccatgtgttctgcaaattctctaatagggttagtttcaaatactgtatcagtcttgttaaatccatacatcatctaaatgacctggaaattgtcatgatcttgcattcacattacatttcacaggcgatctttcctacccagagtgacatacagaaaatattcattagaccttgggaattaatatggagaaaatattatcagcatatgtcagtgttcactttgtaaacagatatcatttaaataatttttggtaaagctagtggcattggcaatatgttaaaactcttgcataattttgtaaaaaaaaaaaaaagtctaatttttgtagatgaacactgaaatgtatgggggtaaatgttatagtgtctagatttgtgttaatattgccacaaatgaatgaaaaggaaaagagggataggtgaaacacatataggaaaactttgataattgctaagtctgtgatgagtatacaaggctcactccatttcttacactttcgagtatgcctacaatttttcatgcagcctacagatagtcatgttgccacagtgctaagacagtataacatataatttttttttttgagacaggtttcattcaaccctgtcaccaaggctggagtgcaatggcgctatctcaactcactgcaacctccacctaccgagctcaaacaattctcctgccttagcctcccaagtagctgggactacaggtgcatgccactgcacctggctaatttttgtagagatgggaccttgccatgttggccaggctggtctcaaactcatgggctcatgtgatccacctgcctcagcctcccaagcatataaatttattccataggttttttctaacatagaaattctcggcttaccatcttagaattcacaaatggtttctcaaacatggctatgtgtgtgacattccttcctgtacgatgactgtgccctttgaatcttttgcagagcggcctgaccccactccatttggctgctcaagaagatcgagtgaatgtggcagaagtcctcgtaaaccaaggggctcatgtggacgcccagacaaaggtatacggccctcccttgccacacggaaaagaatgtgtccatttggtgactgcagtaaggaagaaactataattgtatcaggagaacaaaccctttaatcatctcttttctacgtagtattttaaatgtttatttatgcaagggacactaaagtctccggttgccgtattccagggacttttgtctttaacggcctgggtacttgattctagctgcacagtaatttccccctatattaacactgttgagcctccttacaacaaatgtgtccttcggggcagagtgtgaaagcttgtacctttcttagtttttgtgatggatgttttaaatgcagacaaatagacaaatagaaaaacttgtaatttgtgacctctacgttcgttcagcatgatttatgaaacaggataaattaaggcttatttaaatattactcacttgctaaattcctaatggtctgtgcggtcatgcgtgtgttctccctctctcagacgagaaagctctcatttcaaaaagaaaaaaaaattgctaattaatcttatataatgccacaactcaaacacacacacaaaataggacttctcatgtcatcatcaaagatatagcttcacattaatcacatttctttgaaaattttctttatatgcttaattttgttatttcttcatatcagatttgtgtcatttgtgtcatctactctaacatgttttttttttggtttttttttttttttttttgagacggagtctcactctgttaccaggctggagtgcagtggcttgacctcggctcactgcaacctccacctcccacgttcaagcaattctcctgcctcagcctcccgagtagctgggactacaggcatgtgccaccatgcccaactaatttttgtatttttagtggagacggggtttcaccatgttagccaggatggtcttgatctcttcaccttgtgatccacatgcctcggcctcccaaagtgctgggattacaggcgtgagcccccgcacccagccacatatgctttctttctatatgccatgtttgacatgaaaaagaatgactactaaatattgtgaataaaatttttatatgtaatataggcaggttctgaggtatatgggcatattgaagtaactagtaatacagaaatattaccccaaattagccagataaaagggtattgacaccaaaatgagactgaatttagcttattttcttatgctgcttgaatactttcatcgggaaataattcttgactttggaaatttgcaactttatggtaaatgtcttcattccataccgctttattcacacacagagagagagagagacagacttaaacactttcttaggttctctctcctttttatagatataaaactctagaaggcaaggtctgggtcaagtttctcaacatttttctgccccagcacatccaagccatgccctaaaattcagccagggagtatggtgaggattcttaaggccaggtcggggaggagagaaacaagtactgtgctgcctccatctgttttccatttgcacacacagcccctcgatgtacgagtctcaggactccaccacagtttccttctaacccagcccaactcaggtcccagttggtagtctttttttttttttttcctccaagagggagtctcactctgtcactcaagctggaatgtaatggcttgctgcaacctccacctcccggattcaagcaatcccacctcagcctcctgagtagctgggactacaggcacatgccaccacacccagctaatttttgtatttttagcagaggcagggtatcgccatgttggccaggctgatctcaagctcctgacctcaggtgatccatctgccttggcctcccaaaatgctgggattacaggcatgagccaccgttcccggccacgtagtcatttttgtaccccgtatgatatctggcagcatgtaacctttcctgccctttacaaacggagcagagcgtctcacttcagaaagcatctctctgtcctttacaagttattttcctttcctttctcttctctgcaaaggtcacagccaccaaaaggaagtgaagccatgattgtcccataactagagcacagcagaagtgcagatagctgggttgcttgcatttgctgcttaattttgtgaataaggaatttgttgtatcccaggaatgttcacattctcactggtaaagaagacatccccaagcagcccacaggtgggatgtataccattcaactcattggcttacatgcaaaaataattaataataataaaaatatcaagacctcttctccctgatgaggagaagactagaaaatcctggtaacagcctttgcagtcctctccccccgcacccctccagtttgctgaccctttataccccaccccccttttgcatttgaagttcaccaaatgagtttaagctaaattgtgccacagggtataataatcagtgttgtttgatagagatgaagccactgcttttgcttttcagaaggataatgtccggaagcattttatttagaccacccctgaaaggcattgattcttagaggacactaattagggatcaggagttacactggatttctttaaatgtgtgtaaaagcataaaaagctttgagaacttatgtgatacttacctatttcacatttatgtgtagatttcctgctggtcaccaaattcttacctgggagatatattccttgccctcatagaattcatagtttagagagcaaaactcatagtattataataacaaagtcatcatcataataaaataaaacaatgtattacccattttctctatgccgggtactattctaagtgcttttcatttattattttgtttaattcttacaactaccctatgaggctggtaaaattagcatcctcgtcttacagatgaggaaactgaggcacagaaaaagtaattacttgcataaggtcccaaagctaattattacaaagcctgattttaaccacaggtctatatctagaaatatatatataattttagagtattcggtaataactaagatttttgacaaaggtgggtaggatagaggaagcttgttcaatatcatgggaacatgtgaagaaaaatggggattatgtcttaagatgttgctagaaaattaagatctcagagggccttaatgtaccaggctaagctgtccagctttttatcctgtttgcactgagaagccactgaaggttttaaacacaaacgtgataagatcaacaatctggtttacaaagatcctgggaagcaatgcgaagaataagttgattttaaaccttgcagcagggtcagttaggctattgtgaaatccaaatgaagaataaagaaggcctgaactaagtggcagatgagacactgagaacaagagagaaattagagagataattaaaagacatacaaacagctaagatttgaagacttttgggaggccgcggcggccagatcacgaggtcaagagatcgagaccatcctggctaacacggcgaaaccccgtctctactaaaacaatacaaagaaattagctgggcatggtggcgggtgcctgtagtcccagctactcgggaggctgaggcagaagaatggtgtgaacccaggaagcagagctcgcagtgagccgaggtcgcaccactgcactccagcctgggcgacagagcgagactccatctcaaacaaaaaaaaaaaaaaaaaagatttgaagaccatgtgtggtatggggactaaggagaagcaggaaattcaggaggaaactaaggatctgacctgtgcaactgggtgatcacaagtaccattcaatgagacagggaataaaggagagacaaagccagctggggaaagaggactatgagtttcctattgggtgtgttgaattgtagattactgggggccaatcaagtaggaaaacccaagaaatgactcacatattgatctggacacagaaaggatggctggactaaagatgcagatttcggaatcatcacagtcaaggtattagctgacactgtgaaagtagatatgatcctcaaggaaaagtgtggcgcaaaccaaagacaaaaccctcgggatccactccattttacagtggatggaggaggcaaaggagggctgtccaaaggtagaggagaaatcaggaaagaatatgatagggctgtcaaattatgaaaaactgtcaaggtgtttcagataagagaagctcaaagtccatgcatgccatgcatggctgggcacttgggatattaaaaagcagttttactagagcagtggagatggtgaaatgtagggaggatgagctggaacagtgaatgaagattatttttttttccaagaagtttagttttcaaaggatagaaacctagagaaaaggagaaatatttgaaaggagtgctttttgtttctaagatggaaacataaaaatatgtctataagctgagatgagcatgccagaggaaagaaaaatggttagcaaaattacttggttttttttgtttgtttgtttttgtttattttatttatttatttattttttgagacgaagtttcgctcttgtcactcaggctggagtgcagttgtgtgatcttggctcactgcaacctctacctcccggattcaggcgattctcctgcctcagcttcccaagtagctgggattacaggcaccgccacgcctggctaattttttgtatttttagtagagacagggttttgccatactgggcaggctgatctcgagctcctgacctcgggtgatccgccggcctcggcctccaaaagtgctgggattacagacatgagctactgtgcctggcctggttagcaaaattataaggggtatcagaagcggaataggctgagccagagttagaaatgacaatttctttttctttctggtttttttttctttcttttttttttttttttgggagacagagtctctcactctgttgcccaggctggagtacatgggcatgatcatggctcactgcagcatcagcttcccaggttcaagtgatcctgccacctcagcctcctgagtagctgggactacagacacatgccaccacgcccggctaattgttttttgtttttttttgttttttttttttttttgtatttttagcagagacagggtttttgccatgttgaccaggctggtcttgaactcctggcctcaagtgatctgcccgcctcagcctcccaaagtgctgggagtacaggcgtgagccaccacacccggcctgatcttttcctattttcagtcattaatttaccaaagatttaaaatatttattgagcactgatgatatgccaggcactgttttcagcacgaggtaataatagctaaccctatgtgtcagacactgttgaaataattgttaacagttaatccttatgacaacacaatgactttggtactgctactaaagtccattttataatgcataagccaatgtacagagaggttcaataacttatccaaattcacacagatagtaagtagcagagctgggtcccaaacccagtctgcctctgaggcccgggctcctggctgctgagcccctccttcccccgttctcatcagtcagaagtgcagtcttatcagtgaatggatgtaaacatctactacttggtaatcaagagaggaaaaaaggaaggaatgctgttaaagactcggatgcattttgcagggttttgctgagctctatccagtgttgcccaaaggaaggaaggaaaaacctaatcagcttgtaatgatgttatcagtgaggcagctatgacaaagaggtagaggctgctctgttccctgggctatggctctttatttgtttgcttatttagctactcaagaaaaaaatagggagtctttgaaaaatttgttactgctgattggaaagaattgctcatgtcccacctctctgagcgtatttatgcgaggtgctattttgtatgggaatgctgttaaccccgatgaatggaggagcccacatctgatttctctgaatgcaagttcaatcttcttggccatgcccatgtatttttgaaaaaacactttagtgtttgtgtaacagcaggaagaccagtgtcctggagcacagcgaccaagggagagaattgtgggaagactaaaagatgtatggatgggggatgaggaggataggggagactagaattagacagctcctaacactgtattataatgacttagggttttaataagaatgagatgggaaactatgaggatgaatagaacctgtgcattaacatatttaggccaggcatggtggttcacacttgtaatcccagcactttgggaggccaaggcaggaagatcacttgagcccaggagtttgagaccagcctaggcaacatagtgagacctcatccctacaaaaaatagaaaaattagccaggcgtggtggtgcatgcctgtagtcacagctacttgagatagattgagcccaggaggggaggctgcagtgagccatgatcccatcactgcaccccagcctggtgacagagcaagaccctgtctcaaataaataaataaacaaccctgtctcaactatatatacctaatcaacacatccatctcaacaactattagaaatggttgtattataacttaggcaaattgactaaaatctcaaagaattttttaatatttagatttttaaaaaatattgggtccacgtggttttgacttgtaaggggaagttctttgaacttggaaataatgttacttcaatcagttaaaccattgtactgagcactgattggacacattattttcaagcttcccttattaagcagtattctgatcatgggtgcagtatctgagttcctctgtattgaaaaggagaaccctgcaaagcaggcaaatggattctggtcaccaaaaaggaatatcttccatcgtgtattcagtagcgttagaggttgtaagtcagtttcctatatgtggttatggtgagctttccagggacagtctggtcagtgtgggtgcactgacagtgtgtttagtgagacaaagtctaccaagagtcaccgctctagggcagcacatccctggtaaggtatcttcaccttctgcagtcaactgtggtttgggcatctctttttcaaattcaaatgtattcatttgctggggtcaccataaagactctagtgccatcatataagatacagacccttgaaaatatggatcacccacccccattcctgtttagaaatattgtgataaaaggtcaatgttctccctttcagagatctggtactgcctgtgtcattatgaacaggggctctgaaattgcggggtagtatgttataatgaacacagccatctagagaaggatctggaatatccttattttaaagaaaataattatctagattgtatacacatacatacacacacatatacacacacagagaacttatagcccctcaggggtcagtggatactaatttgagaaacaaaccatttcttgtctaaatcagtgaatcagtggttttcaaactctgggactctaggtaggaaggcaaaagactaacttgatataccttgttcaagttcatacttctcagaccacctgagctctcaccagcctccctcttccttttagtgtttctgtgcttcttcctatctctatcaggcattctgataatcacctcctgccatgtgttattatttagccacttcatttttgcctagatttaaagctttcagaaagtattcaataaacaagtcaagtctccataaagtgctcttctgaccccgaataagaagccactgaatcagtttgtctatgctgtcagttgttccatctttcctttgtatcttgaaaagttctaagaacaagatgacctgataaaaaataaagcactttggggagctaacaattttatgggcagtggtattttaatttatacctaagtcttatgctgagaattatcaagggcaatttttttaatatagagaagaaaaaaacctacttttgccagctcaaaaagaaaggttaaataatgattttgcttctgtttaggatagctgttagtaaaagtgtaattatgatgcttcttttttaaaaaaataataattacagatgggatacacaccactgcatgtgggctgccactatggaaatatcaagattgttaatttcctgctccagcattctgcaaaagttaatgccaaaacaaaggtaagctccttccttttttgtttctgccagaatcatttatttttgcttcaaaggaattaagaatcatctcttccatcttccttctacagaatgggtatacgccattacatcaagcagcacagcaggggcatacgcatataataaatgtcttacttcagaacaacgcctcccccaatgaactcactgtggtaagcgctcagggccagctcaggagaagagggaggagatagatgggcctggactctggtgtcttcttacgtttttcattgtactttcatgaagaggcataaacagagcattcagtagaatgaggaaagaaggacaataaccatattgttctgagctgttcagagagagagagatgattagtgttttatatgtgaaaactacctactgcattgtcacctagtaggaagtacacatgtaagaaaaaaaaattgtgttggtttcattgattgcttacttagaacgttaaaaagcctcttggattgcatgtgtagctgcccagactttgctgtacaaacaggttaggtgggttttgtgcaaggtatgtctctaatgaaacacttatttgtgtatgacagtgggatgggtctgatgagacactcaccttacattttgtatcagcaaaaaaaatgtggaataaggcttgctaattcctcactcacattttccttttgccagaatgggaatactgcccttggcattgcccggcgcctcggctacatctcagtagtggacaccctgaagatagtgaccgaagagaccatgaccacaactgtaagtaaggaatgcagaaccttgttaccctaggagccagctttcagccagttttcttgggtttttctgagatgaatattttttcccattcataaactaagcaccatgttttaaaatacagtcacctcattgttggtagtcaggatagcaaaactcttattgctaatatgaataaaagtttaaaacactaagaatacctatttaaaagatgcatctgtagctatagagtttttacttccatatacagctaaatgtatttatttatttgtttgctttgatataacaagttcttaatgaaatgatggtgaaggcagaaattttttaacatccttccttggcagcgtaaagaaaattgaaaactctaagttggttccttaaaaatgttttaatgcacaaatggtacatggatacattatcattcctgtaaaaaaatgtttacattgttttaaaaaattccagatgggatcagaactggttttgcctgctactgtcactcatcttctgtcctattggagttttcataagaaacacaataggctgttttgttaaaatttaaagtggatctttaccaggaggccctattgcatcaactacatttttacaagctgcagcctctaggataagtcatttctttccaaccccatctggtacctttgaacagcattaacatttggtaactttggaattaaaagcaaatattacatgatatcagaggcttatttgagttattcctgactccatgactcaacacatagacctgaggttgactcttaacaaagtaaatataggactctggaacattttgaattatcagctctgtccccttttctcttcgaccaccttccaacatgaaggagaaaatggttagcatctgcaaattagtttgtatacccactgctttttgtgaaaaacatgggttgaaggtctctgtaactacctgcagtttgagttatctggcagtgttactcaatgtataattcttagtctttagaaactaaaaaacaagcctgctgattacgggagaaaaattttgtaatttgcaaaagagaaaacagttgttttaatggaatagaacaatgattgtcaagcagcacccattccgaacttcaagttatactttgtctaagagagaaatttccacatgttgctttcatacacctcttgaggattttattatattaaaatctatcattaagttctcaaaaaaagtgttcaaaccaataatgtttattacctttaattttatatcccatgtagctctatctaggataggaaaggagaagagaacaaactatttaacgatagccaagtgtcacaatgctataaagatttgaagtcattgcagtaaatatataatattaatacttctatttcaatgttaaaagacttgagacatgtaaaagttcaaaatacacatcttatttggttgaatgtaaatggctttctcacccattacaaaatttcaaaacttttcttcaaaatcaaaaaaaagctttaagagaaagtagagttaagaacaaaattaagttacaacttcaaaaaatcaactgaaagacagagaagggtctcagagctccatcaggttcccatcagaagacagaatgtgtacaggaatagtgccttttcactctcaacatcatcagctgtccttgttgatgactttctgcaaaagagagaagacactatgcatgctaattggaaaggtccagtttgcctagtgaagaaaatgaggcttccaccaaaagaagtgttcacgttgattaaaaaagagtccagagaagtctctaaaacttcgcccagcattgtggtatttggtacattatctcaagctgagacaccaccttgtcagccttgctttagcggttacatgtaaactagcttagacaggactgatgtaattcagggtggagtctatgactttaagctaataactatagctcagcctccaccacaggcatgatatttgtatagctagttactgggactccagcagccattgactctataaacagacttcagtttttcaaaacaaaaagagaatgtcttttccatgtgagtaaaatacatgatgtggcaatgctgagaaagacggtttagttaattagattacaatcaaaacagcataccaaactgaatggatagaagctgatattcaaaagatgtgaattgttatctatcaaaactgcattgtttaaaatacccaattacttcatatgtaaggagcagaacacctctagcacacagatattggttgctaatactattttctactaaaagcaaacagtgctccttggagaaatggctgaatctaaggatagcacagtaaatatataagatgagcctggaacatcttagagtgtcaaaaagtaaggaaatgctcctccctcccccaacaaaagtaaataaactaatacagaggcacaatggtagggggtatgttgaagggacatatgaattaactaaaagagttcccaatggccatagctggaacaatttgagcaaaaataaataaatataatagtcttgaagtatagtgcaaactgtaaaataactatccatgaattcatactattatacataagtaattcaataaatggaaaagaagacacaaatttctcaggcaaaagaattccaaataatgtatgaaaatacttcactctcgaagtggaacataattccccactgcttacatgtgggctgaacatagtgattcctttgcaaagaaaacagtatggaagcagggggaaatagagtaactttacaatggagaaacctgacaaatactgcttcagacatatgatcaagatcaacatcaacaatgataagtcatgttgatggtattgtacccttgatacaatgtgatgaaatggcacttttcctctgtgatcttcctccgtaaaacatacagccccagtctattaaaaaaaaaaaaaaaaaaaaaaaactatgagacaagccccagttgatggacatatctgactagtatactgcaaaactgtcaaggtcatcaaaaacaaggaaagtcaaatgcaaatcaagaccacaatgagataccctctcataccagtcagaatggcaattattacaaagtcaaaaaacaacggatgctggcaaggctgtggaaaaataggaatgcttttacactgttggtgggcatgtaaattagttcaaccatcatataagacagtgtggcaattcctcaaagacctagacccagaaatatcagttgacccagcagtcccattactgagtatatacccaaaggaatgtaagttattctgttacaaagatacatgcatgtgtatgttcattgcagcactatccacaatagcaaagatgtgaaatcaacccaaatgcccatcaatgatagactggataaagaaaatgtggtacatatacaccatggaatactgtgcagtcataaaaaaggaatgatatcatgtcctttgcagggacatggatggagctggaagctgttatcctcagcaaactaacggaggaacagaaaaccaaacaccacatgttctcacttacaagtgggagctgaacaataagaccacgtggacacagggaggggaaggacacacactggggcctgggggtggggagggagaacatcaggataaatagctcatgcatgcgaggcttaatacctaggtgatgggttcataggtgcagtaaaccaccatggcacacatttgtttacctatgtaacaaacctgcatgtcctgcacatttaacctggaacttaaattaatttttttaaaaaaacaaggaaagtctgagaaattgtcacagcccagaggaacctaaggagacacaactaaatgtcatacagtatcctcgatgggatcctgaaacattaaaaggccattaagcagaaactaaagaaaaatgaataaaatataaactttaataataatgtatcaatgttgattcattaattgtgatattttccatgctaataaaagattttaataataggccaggcgcggtggctcatgcctgtattcccagcactttgggaggctgaggcaggtggatcacctgaggttgggagttcgaggccagcctggccaacgtggtgaaaacctgtctctactaaaaatacaaaaattagctgggcgtggccatgcacgtctgtaatcccagctactggggaggctgaggcaagagaatcgcttgaacctgggaggcagaggttgcagcaagccgagattgtgccactgcactccagcctgggaaacagagcgagacttggtctcaaataataataatactatcaatgaagattttaataataaggggaacttggtgtggggtatatgggaactgtctatactatcttcacaattattctataaatctcaacctcttctaaaaataaaagtttatttttaaaactgctccattgcagtattacatgctggaaaagacatcaaataatggttgatttcaacacaataattggggataggggtagaaatcacatttaccaagtattatctctaagaaactatgaatttgtacctttttttagttttaacaacctggctttttttcagttgtctcatttaaacgtgtatcttcccttgtaccattagtgtctcatatgctgagaattaaaaaaacaaaacaaaacaaaaaaaaaactcacttttaaactaaggtcattaagattttcttaccagtgatgctaacagtgtcttttggatggatataatctaagattttcttaccagtgatgctgacagtgtcttttgggtgggtataatctaagttatcaaagagaaagtaaaagaggcagtaggcatttgctgcataatatactgttctttaaattttgggggaggctaaaatgatctgccaatgcatcaccttttaagtattttttcatacacaatattgtaaagattattgttgtaaatattattttaatattttgttttatcctatgaattaaaagtacatataagaggagaacacaaaatagacggaaagcttggcacaagtaatagagacatatttcttgcagctcatttggcttctcttcagccgagacctttcgtggaatggggcggcagattcatcagaccatgaaaaagtatagcagtggagtaggaggggcagaatcttctcttttcctttgaaaagctttattagagacctaaatcttttaagctgtggtactttgccactagaattctttcattttgtactcctgtgctttgtatatggtgacaacctttgtgacactaagggacaacaattttgatgttattttatatgtgggagattcaagatattcaacacatacattccacaagaaactgattaattcagagataaatgaaaagacccattaaaatgtacagtctgctcacactaaaatgactgcttttttgttactagactgtcacagagaagcacaaaatgaatgttccagaaacgatgaatgaagttcttgatatgtctgatgatgaaggtatgaaaatgttctttgagttcacaataattataagtgactgtgtattttgtttgtttcctgaagaaagtccattgcaaaaatgtttatcaggaatattgaaacgttttgttgtaatatcaagagtatgtatttttcatccacttatattgttcacttcaatcatgcagttcgtaaagccaatgcccctgaaatgctcagtgatggcgaatatatctcagatgttgaagaaggtatttgtaaatttttattgtgatgaaacttaactactaccaactttatctttcatttcttatctttgaaatataatatttccttgagttactaacttttcatattatcttgagattattaatttgtgtattatttaaataatgtatatctggtactactagctctcctttttaagtctctttgaatcctctttccttgaacctgtttcctaactttaaaatataaaagtgtcactaattatctggattacttgccttctctttgtttctatcgaacagaatactgatgcttttattgtttgcatctgaaatctagaaagggaaaactggttaatgtttatgattacaatattttttaaaacaagcgaagtttccttataggaaatccttttaaatgccctgagatttgcccattctgctaaactttgtagaaaaagcagcttttgatcttgaaatgataatgaaaacaacctgaaaaaaaaaacttttgaaatagaaattttcaataatgatttaatgaaagagatcaaaatattattgtagctatactttatgtgttttcagaaattggtttctgttttgcttaaaaaccaatactttgaccaggtcatgatatacagatatatcaatgaatggcatctttaaaaggtccattggaaaacaagcatttttatagtgagtaaatattgtactgatgacacattttggagtgtcactgtaataacaaaatatttaccatgggaaaattatatttaactgtttttcttgcatcatttgactctcccaaatgatgggagatcatcaaatacagtctaccctattatgacctccatttgccacctgtcatgtagtagctttcttttggttagtcttagtgttgctagtctttttttgcctttaagtaatcttccctattttaattcatatgatttctttctttgagttgcatgcatttcattgggaacctaaatagtggaaaagcttgcctagtctgaagccactttaatcttttcgttatccaatcaatgacttcccactataatgcattgtggccagggactgcacaccccagtgagctaatgtcctgctggtcatttagggacctcggaggatctggctgaatgtttgtaaatgctgttttgataaatgctaaaggcttttactcagttttctttctttttctctgaaacatctgctatacatttacctcccttctatccccaaatggataatatttgttatcgtctttaggacttttagaataatatacctactgtcatattatatttcattgccttctcatacatttcagagtaacttctgtgcagaagataaaagaaaaaatgatattcttacatagatgtttacacacacaaaacatgatgtcaaaagtatgtttgtcaaatgaaattattaggaatcatggtatgacaatcatagacctaaaaatttactgttcattaacgaaatatctaaaattatccccattgatgagaggccaagtttgaatggactaacagccttatacatatggataaccaaataatttcaaaaatggagattttgaatctcgaaatttgaatttaattgacctcgttacttaactagaaatgtgtttatctcagcttgggaatttgaaattggcaattttaaattctcattttatgcatcttttctttaaaatctttggcccttactttaatgtgtccagggctattggaatcaaatggcttttaattttgtggtattgccgaatttaatgttgaaaaggattccttaaaggtcactcagtctgagcaaacatctgctggaatctcatctgcttaggatctcctgtgcccaagcccttcaaataatgagaattctttaattcctaagctgcatagtccatttggacaattctgtctttaaaaatccttcatgttattgaacttcctgtagcatctactcattgattcaagctttggtgtatttgaccaagttgatgggaagactacattctatgtagtattttgaacaaaagctgccttttctgtgtgacaatctttcagatatttaaaaatgctttttctatttctttttagttttttttttttttcaggtatatcattgctacctccttctattgttcccctcagcaacctggtcgccctctcctgtgcatgtttcaatatgtctgtgccatctcaagttgaggtgaccagaactgaacacaatatttttagtctcgtcaaagcagagtatagcaggactattgcattctccatggaagatgttaaaagtctatttttgaagattaaggttataatacacttttaattcaagtcatattagtattactgtctgctaaggtccctaaattttgcttacaagagctctagtaagccacatttgccctattatgtatttatgttgtcctctgctgcataaattagcatttctaactactgcaaatcccaaaacaaatcattttgaaatttggattctaaaaggacccctacaacttgaatgataattttaacttctgactcatttgcctgatagtcttgccagagctttgattgtcattttagttagatttagtgttggccatttgagtaagctcctatgcagctgtggcaaatgttcatttccatgaagccataggcatgttgtgagtataactatctacaagaactagtgagagatcatcacattggtatccccagacactaaagaataacagcagcttttaaaagcaaataaaaataataagcaatataggctgccagtttgtctcaagaaagaaaatgaaaatgagtttgtaataagggaaaataaaattttaatctgattctaaaaataatctgctgtaagtagatatttaaaatttaaaataaataagataaaaaattaaaaagcaaaagtaaaataaatattaaggaagaaatgtcaagagtagtctctctcttctttttcattctcttttcctttttcttctttgctttctccttatcgtcttctctttcttttgtacactatgagaaactagtgcaagtgaaagaatgtttggattcatttctcaaaaaaataaaaattaaggaatacaagactagacaatgttatcatttaataaggtgggagaacaatggggccaagttgcaaagttgaacacaggtggaagcatcagcaaagcagagccgtagaagaagtcaagcaactttgtccaaggcagggttttaagctcacattaggcaggtgggggctaagcagagctcctcagagggtcagatgcatttgtagataccttactgctctactgtctcctgttccagaaaatacctatgcatataacattcataaaactttaatatacgtacaaaactagtatcttgattgtagtgctagtttgattcttatgttttgcaattcatattttgtaattgaaaatatgaaagagtgtgtgtatagaagaaagaagagagaaggaaggaaggaaggaagaagaaagagaaaggagagaaagaaaaagagggaaaattgagattaaggttcaagtgattgagtttggcgtctcctcccaagggattttacattggctttggttcaactctgatcttaaattgcaactgcctataaaatgtattttataaattggggcaggggggtataaaatgttattttagcttgtagaattctagtggattggagtgtagttacagatcgaaagaactatagatgggagataatgagaagtggaattaagccatgcaaagtaaaaatctaagaggcagctctatgaaatatgactctactgaacaggtttaggagacagcagctggtgaggcaaactcctgctaggaagaattttctaattctaagctactttcaaatttgatagggctgaaaaatatctctctgaatcaaatgcagacattaaatattaaaagaaaaataagaggctaagtatacatgtaaaaataatatcaagtaggtataagtttgagatataataaagcaataaaattttagcagataatagagtgacatgagggataagaagaatcatgttcagcttcgtgccaaatttggtggccagtggaagccacagtaaattaaaatccaccgatttcaaagaactgaatgggcaagttggagtcttgtaagtctattcctgccattacactgatgaggtaggaaagcccaaatacacattgaatggtctttccaatgaggtttgtggcagagctggacaagaagactggtctgacactctgtagttttagatcatttcattcccctgcccccaaagtctagtcaagtaaagcactgggagtagagaaggaacacatagatctgtaactggttgtgatcaattacttgcaaacaacactgcatagatcatctctttcattgctattccaacttgaaatgtttcttatatatagaacccaagaatgcatatttttagcttcaaaaaaaggaggtgtgttaaggaaaaggaacaaatcatgttcttggaaactatcacaaggtaataagaatattttaatttgtaataatggatacataataattgtacatatttatggggtatatgtgatattttgatacaattatacaatgtgtaatgatcaaatcagagtaattgggatatctatcacctcaagcattgatcatttctgtgtgtttggaacattctggttccacccttttaattcttttgaaatatattgttaactataaattattgttaactataaattattgttaactatagttgccctattgtgctaccagatattagatcttattccttctagctaactgtatttttgtgccaattaaccatcccctctttatccccgctctttccagcctcctgaaaccatcattctactttctatctccatgagttcaattttttttttcagttcccacatatgagtgagaacgtgctaaatttatctttctgtgcctagcttacctcacttaagataatgtctccaattccatccatgtttttgcaaaaaacacagaatttcattcttttctgtggctgaataatatttcattatgtgtatgtaccatattttctttatccattcatcagctgatggacacataggttgattccatatcttggctactgtgaatagtgctgcaataaacaagggtgtgcagatgtcactttgaaatactgattttcttttttttatttggatgtatgcccagcagtgggatttctggatcatatggtattctattcttagttttttgaggaacctccatactcttctctatagtaactgtactaatttacatttctaccccatagcatatgagggttctcctttctccattttctgttagcacatagaaatgatactgatttttatatgttgattttgtatcttgaattttactaaatttgtttatcagttctgataggtttttggagggatccttatgtttttctaaatagaagattttatcatctgcaaataaggataatttaactacttcttttctaatttggatgtcctttatttctttctcatgtctaattgctctggctagggcttctagtactatgttgaatgaaggtgatgaaagtgggtgtcctggtcttgctccagatcttagaggaaaggctttcagtttttccccattgggtatgatactagctgtgggcctgttgtttacagcttttattgtattgaggtatgttcattctatactacttttttgaccattaaagtatattgaattttattgaatgctttttcagcattaattaaatgatcatatggatttgtcctttattctttggatatgatgtatcacattgattcatttgcatatgttgaaccatccttgcatccctgggtgatgaatcccacttgatcatgttgaatgatctttctactatgttgttatatatggtttgctagtattcgaagattttttgcatttgtgttcatcagaaatattggcctctagtttccttttgtgtgtgtgtgtctttgtctggttttggtatcatggtaacactggcctcatagaatgagtttggaagtgttccctcaaatttttggaataatataagtaggattaatagtagttcttttttaaagtgcttggtagatttcagcagtaaagccatcaggtcctgggattttctttaatgggtgactttttattactacttatatcttgttattcattagtagtctattaaagttttctatttcttcatgattcaatctttgtaggctttatgtgtctaataatttatccatttctgacaggtttcccaatttattggcatatagtagttgctcataatagtctctaatgagcctttgaatttttgcactatcagttgtaatgtctccgttttcatccctgatcttatttatttgggtcttctcttttttagttagtctggttaaaagcttattgattaccttttcaaaaaccaactttttgtcttgttgatcttttgtagtatatttttagtctcaatttttcctactctgatgtttattatttattttcttctataaattttgagtttggcttacttttgcttttctaattctataagctgcctcattcagttgtttattcaaagtttccctgcttttttgatgtaggcatttattgctattaactgctcttttagtactacttttgctgtctcccgtaggttttagtgtgttgtgttcccattttcttttgtttcaagaaattttaaaaattttctttttaatttattcgttgacataatggtcgttcaggagcatattgtttaatttccatgtgtttgcatagtttccaaggtttctcttgctattgatttctagttttattccatcgtggtcagaaaagagacttgacatgattgcaatttttttttaaattttttgagacttgttttgtagtctaacatgtggtctatccttgagaatattccatgtgctaaggaaataatgtgtattttacaggtgttggatagaatgttctgtgcatgtctattagggtcatttggtctatggtagattaagtccagtgtttctttgttgattttctttctagatgatctgtccaatgctgaaaatggggtgttaatgtccccacctattgtattggggtctatctctctctttacctctaataattgctttatatatacgggtgctccagcatttggtgtgtatatatttataatttatatatccccttgctgaattaattcctttatcattatataatgaccttctttgtctctttttgcagtttttatcttgaaatctatttcatctaagtatagctattcctgttccttttttggcctctatttgcatggaatatcctttattttagcctgtatgtgtctttataggtaaagtgagtttcttatagacagcatatcgttcagtcttgtttttaaatccatttggccactctatgtcttttgattagagaatttagtccatttaaattcagcattatcattgctaggtaagaacttactatgccattttgttatttgttttctgattgttttgtttgtcctctcttcctttcttccttcttgtctttctttgtataaaagtgatttttttttattggctgggcacggtggctcatgcctataatcccaaaactttgggaagctgaagcaggtggatcacttgaggccaggagttcaagaccagcctgggcaacatggtgaaaccccatctctactaaaaatacaaaaattagctgggcatggtggcatgcatctgtagtcccagctacccaggaggctgagttgggagaattgcttgaacctggaaggcggagattgcagtgagccaagatagcaccattgctctccagcgtgggtgacagaatgagattctgtctcaaaaaaaagaaaaaaagtgctttctcttgtagtatgtttaatttcttgcttttaatattttgtatatctattataggtttttgtgcttaccataagacttgcaaataacatcttataatcaattattttaaactggtgacaatttcgttctgattgcaaagaaaagaaaaacaggcaaaaagaaaatgaaatattccacactttaacttcatcctccccactttttgacttttgttgcctctatttacatctttttatactatctatctcaaaagttgctctagttattatttttgataggtttctctttttgtcttcctacaaaggtatgagtggtttgtacaccacaattacagtgttagggtagtctgtatttgtctgtgtacttacatttaccagtgagttgtatgcatttaaatgatttcttgttgctcattaatatccttttctttcatactgaagaactccctttagcatttcttataagataggtctggtttttcatgaaatctctcagcttttgtttgtctgggaaagtatctttgcttcttttctctcactgcctttaggattctttctttatccttgatctttgagagtttgatgactatataccttaaggtagtcttatttgggttgaatctgcttgttttttggttttcttatacctggatattcatatcttactctaggtttgtaaagttccctattattatttctttgagtaaatcatctaccctgatctccctccctccttccctgccgctgcctctctctctctctctctctctctctctttttctctctctctctctgtctctccattctctttaaggccaataacttagatttgtccttttgaggttattttctagatcttgtaggtatgcatcattcctttttatttttttgttttttctgctgtgactgaattttcatagagcctgttttcaagctcattaattctttcttctgcttgatccattctgctattgagaaactgatgcatttttagtttgtcaattaagtttttcaactcctgaatttctgcttgacttttaaaaattattttaatctctgttaaatttatctgataaaattctgctctttgttatcttaaagtgcattgagctagcttgggcaacatagggagactctgtctctataaaaaataaaaataaattagctggccatggtggcatacacctgtgatcccaagtacttgcagtgtttaagtggtataaacacctgggcccagaaggtcaagactgcagtgagctgtgattgcaccactacactccagcctgggcaacagagtgagaacccctttaaaaaaaaaaaaaaaaaagccgggcacagtggctcacgcctgtagtcccagcactttgggacgctgaggcaggcagatcacctgaggtcaggagttcgagaccagcctgaccaacatggggaaaccctgtctctactaaaaatacaaaattagccaggcgtggtggcacgtgcctgtaatcccagctactcaggaggctgaggcaggagaatggcttgaacctgggaggcggaggttgcagtgagccgagatcatgccactgcactccagcctgggcaacaagagtgaaactctatctcgaaaaaaaaaaaaaagattcattgagcttccacaagacagctattttgaattccgtatctgagaggccatatatctccatcactccaggactggtcactgatgccttatttagtccatttggtgaggtaatgttttcttggatgtccttgatgcttgtagacatttgttgatacctgggcattaaagagttaggtatttattccagtcttcacagtataggcttgtttttagccatcctttttgagaggactttccaagaattcaaaagggattgagtgttgtgacctaagcctatggtcactgcagccatttcagcactagagagtgccctaagccccggaatgctgcaactcttacagactccttgatacacagctttggtagattttgggaaaataagggagaattccctgggttaccaggtaaaaagtctctcccacttccctctctttctggcaaaggaagtcagtctctgcaccaggctgcctggagttgggggagggataatgcggtcactctaatggccatgacagctggcactgcacagggtcacatgtaaagccttgtagcccagcacagtgctggggctcaccccacggctgtagtcactactgcctggctgtcgctgatgtttattccaagccaaagccactctattcagcagaacggggtttgtcccatcaggacattggattccctgctggtccagcgtgggtctagaaacactgtccagaaacaaaggcatggaatcaggaggtacaggagtttccctggtgctttattttagtgtggcttagctggtacccaagttacatgacaaagccctctgtattcttccctctcctttctccaagtgaaaagagtccctgagctgcactgcctggaattgggggatgagtgacacaggcacacccttggccaccacagctggtgtcacaactgaagtctaccacctctgtattagtcagcattctctagagggacagaactaataggatagatgtgatatataaaggggagtctattaggagaattgattcacacaatcacaaggtaaagtctcacaggccatctgcaagctgaggagccaggaaggcagtccgaatcccaaaacctcaaaagtaggaaaaccaatagtgcagccttcagtctgtggccaaaggcctgagagcccctggcaaatcactggtgtaggtccaagagtccaaaagctgaagaacttggggtcagatgtttgaggcaggaagcatccagcatgggagaaagatggaggccagaagactcagccagtctagtcctttctgtgttcttctacctgcttttattctggccttgctggcagctgattagatgtgcccatccagatggagggtgtgtctgcctttccagtccattgactcaaatgttaatctcctttggcaacaccctcacagacacacccaggaacaatactttgcatccttcaatccaatcgaattgacattcaatattaactatcacaacctccaagaccagggtagcaccagagcttgtccaaggactgcactccttgggtcctgattgctacctaaatttattctgagcctcaagccactttagtcagccaatggtgaagctggctgggactcagtttcctcttgctggggtggaggattcccctctggcccagcactgtcctaaatgctccttccgtgggcactggcagaattctgtcctgtactgtgttccactgtgacagggcagtgctgagctccaatgcaatgttgcacactcattttgctctctctttcccaggcccacagattctttctctatgctgtgctgcctggggctgggggaggggtggtgtagataatgcaagactgtctttctgagcttttcaatgcctctatccttgatattacattaaaatcgggtattgtgattgctacttaatttttttgttattatggaagtgctttcttgcattgatagttgttcagtttggggttcctgtgaggggaaaatcactggagtgttctattcagccatctttctctacctctcctcccctttacaataatgataaatatttagagaaccttcctctgtttcttttggcaaaagaactatatacaccaagatgaaaattcaagtaaaataaatataaacataatttcaaatagattttaactaaaagccagtagttttagtaaacgtatcagtgtattctcgttaggaaagaataaacagattttggttgtttcattttgttttgttttgagacagtctcactctgttgcccaggctggagtgcagtggcatgatctcggctcactgtaacttccgcctcccaggttcaagtgattctcctgcctcagcctcctgagtagttgggactacaggcgcccaccaccatgcctggctaatttttgtattttttagtagagacaggatttcaccatgttggccaggctggtctcaaacttctggcctcatgtgatccacctgccccagcctcccaaagtgttgggattacaggcgtgaggcaccaagcctggtggaataaacagattttgacttgacacaatccaaaactcaaaaaagtagggtgaattactttgggaaatgtgaaggtagatctgaagaagaccaccaggaaaagaccagttaggacctcttcttgccaaatgtctaggactctcctgctaccctaatttcctaatcattctaaataaataggactgttatgttattagcttaatagatctggaaagaggccatggagatcaggttgccctcaggtgattcaagggtttggtttcattaagtcactgttcttagcagcttcagaaattgttcttcacctgaaattttgttgttttacaagaacctcttatatcatttagccttttgcctgaagatttctctgcttacaattggcctttcaaatcgatgttacataattgcttgtatctctcagggataaagccaaaatggtaactttaaaataccagaagcaaagactaaatcttattctctgttttatcgcaagaacctagtatactgcttggtacacagagatcttcaatacatgtttgatcggttgcatcaacatgaagtcatactcaagggatagtttagcaggtttctgagatgaagcaagatgaagattgctgacaatgctaccttttcctttcattcagctcctttttactgagacagtcctaggctatgtttaagttgataaacagctttataatgactctcccaaagcatatctgcatctcaaggaatagttgatgaatttaaaagaattaccagctaaagaagaagatctgtggactgggacaagggcctttattctaaagcaaagtctgttccatcattggtatcctgtctttggaattagaattatatagtgattatcacccacactatccacttatccagctatgtacattttcatttaggttctgatatcttaagtcaccttaagatacctaaacataccccttgaaaatagtgtcttttctcacccttctccatctcaataaatggctccatcgcccaaggcaaaatctgagttttatgcaatctgtcttcccacagcacttctatccagtccatcagcaagtcatatcagtcctactttcagaatacatctcaaatctctcttctcttctccatctccattttcaccacccccatccaggccaccacatctctcacatggaatactgcaggagcctccttacagatctccagttcttctcttacccagtagactcagctttctccacagcatccacacaagcctttaaacatatacattggatcatgttattccactccttagcttaaaaccatccaaagcttatagttaggcttttaagatttattcatactgttgcatataattgaacttcattcattttcatttctatacaatattccattgtctgcctgtaccacactgagttatccactctactgttgatgagaatgtgggttgtttcaagtttgaactgttgttacaaactttcttatataagtttcctggtacacatatgcatacatttctgtaggatgtaaacctaggagtataattgctgagttgtatattatgtgaagacaacagaattcatcaaaaccagatgacaataaactatgcttgtaaaattagatactgagatttttaaggaaggaaaagaatatatagaaagcaattaccttgaggaggtaagaggggcctgtgtttggggtgggggatgtgggagtcttctgaggtgctgatgatgttctatttcttcacctggatggtgtttattttataacagtttgctaaaatgtatatttatattttatattctcatctgtgtggttgccgtattttgtaacaaaagtaaccaagccacacaaataatataaatacacccttaaagtagtacaaatacaaaactaaaacccacgcaaggctttatattgcatttagagtaatttcagtagtttgccatgattagtaagtcctgtgtgatatggtccctggctaacccctttccattctcctttcacttatgcttttttatttcatcctaatactcatctcattttattagtcattaatttcaagagtcagcagactttttctatagagagccagtggtaaatatttttgaatgtttagtccatattggtctctgtcacagctactaaactctgcctttgtagaacaaaagccaccagagataatacctaaatcaacaggcctgattgtgtgatactaataaagcttatttacagaaataggcaagaggctgggtttggcccatgggttgtagtttgccaactcatggttagttttttatattttctttcaaactagactagtcagtgccataggatcagagttgtcctggtgtctatcataggtcttagggtgtatacatctgtaccttcattcatgaatgtatctactggcttaattccacacatttacctgtgtctctgtcccccctcaggattccatgtaaattaatactctcaccatcagaaggtatttaccatgattgaatctttctatgtgctaggcattaagctagacacatttcatgcattatgtaatttaaccctcacaatgattaaattggagccattgtcattttcatttcatagatgtggaaaataagtttcagtaaggttaaggaacttgattaaggtcacacaacatcagtgctggagctgatattcaaatccttgtacttctaatatagatgttgtctggtaatttagataagagccccataatggttgagttattgttaagtttgaatacctatgctagtctgttttgcattcatatgaaggaatatctgaggctgggtaatttataatgaaaagaggtttattttggctcacagttctgcaggctgtacaagaagcatggtggctgaaacagattgtaattttgaacactttttttttcctctgcattgtatctgtccttgcccatccatctgcttctggtaagacctcaggatgctttcattcatgacagaaggtaaaggagagttaggtggcaagagaggaagcaagagagaggaaaggaggaaacttcaattatatacaacagtatgaatgaatcttaaaagcctaactaagccaggctctttttaacatcacatctcacggtaactaatagagcaagcattcactctttacagaggggatggcacaagccattcatgggggatccacctccatgacccaaacacctcccactaggccccacctccaacactggggatcacatttcaacaagagatttggaggggatagaccttcaaagtatatataatgacatatgtgaaaagcatttagcctagaacttggcatgtggtaagaactcaggaaatgttacttacttggtgctgtatctttgttacttctctcaaagtattcaacagcattattaatactatttttactcctaatttccattatgtcctaatttaataccctaatttaaagtactattagtcctaattatattaaggagtcagtctcaaggagtttaagatatttgctcacgttcacacagttacagaaactggaatttgcatttagaattttttaccttagactttctactcgagattctgtgttagtctgttttgcgctgctagaaagaaatacctgagactggataatttatatatatatatgaggtttatttggctcatggttctacaggttgtacaagcatagcaccagcatctgcttggcttctggtgaggcctcaggaagcttctattcatggcagaaggagaagggggagcaggaatgtcacatggcaagagagggagcaagagagagaggaggaggtggcagtctctttaaccaactagctgttgtgtggacaaacagagtgagtacttactcactacaacaaggagggcatccagccattcatgagggatctgcccctatgatccaaataccttccacaaggccctacctccaacactggggctcaaatttcaacatgtgatttggagggcacagacatccaaaccatgtcaggtgccatgagagaataacagattaagtgacaagaaaattaaaaagacagggagattattaaagacctcaaaaacaaactttaaaggcattttaaagaatagataggatttggacacacagaaattttgcacgggtagaaggatggggattgggaagaggtgtttcatatttagaaaacttgttggtcaaagtgtcagagacaggaaagcacaggcccccacagaagagctcagcacacaggagtggggacaagggtgcagacgccaggcaccggatgaggtcccagggcagcacacaaggaggaagagaagcggttctggaaaactctgggcacacataagaggaagaagaatgctaatggacatggaaagggagtggtgaagaatgaaggggaaaaaacctgaggagtgggtgctagaggaagcctgggaggaactttcctagaaagctccaatcaaaagagcacaagtggtataggaggccgggtatggtggctcacgcctgtaatcccagtactttgggagggtgaggcggatggatcacctgaggtcaggagtttgagaccagcctggccaacatggcgaaaccctgtctctactaaaaatacaaaaagtagccaggcgtggtggtgggtgcctgtaatcccagctactcaggaggctgaggcaggagactcacttgaacccaggaggcggaggttgcagtgagccgagatcgtaccactgcacaccagcctgggcgacagagcgagacttcgtctcaaataacaacaaaacaaaataaggggtatgggaatccttggtgacctcagcagctgccatgccatatggaatatcctggatatagacagaagataagagttctagtgtaggtagggaaggtcacagcgagtatatttttttcctccaagaagctatgatagagtgagcagctagagcagcctgtgaaatatttaacagacgccaaggaattgtgtgcttgtttaactgcaaacaacaggctgttgtggttttttttatttgccccaaacaaattgtaattttgaatattttttccccctaaatcaggtctgtcccttccatctacctgaaaagtctgacctgcttcctgtggaaggttgtcctaatgtaaccaccctgtagccctctcattagctcagagaacacaacagtgagaatgaatgagcaaggggaagacaaggtggtgcacagggagctaggagcaagaggagtgagaggagcccaggaaagatgtcccaatggggaggggtgagtcagaaccccagtgagaatgagaactgaggacaggcctcatgtgtctttgccttgtgtgtacacatctctggggtataggttggaagtacaaaacaaaccaataaatggatgtttattgccaggcacaatgataggcaatttgggtgtaagggaaagaaaaggccaaaatcgctgtttatacacgagcctggtacttctttatacctgggaacagtgattaacgtgttcctgtattgtactcatggtccttgtgtgcctaggcaatgaagaggtgagaataatgcagtctggatttggggttgaggctagacaaatagctaaggaagaatgaataggacaaatcagctgtcatgatactgccaccttgaatttagctacctagtttctctgcaagtgagaaccaacatttttgtgcctgattttccagggctagtttgtggctagcaattagttcattgtctagtcttcttcacaagtggcttagattttagataatgagaacagtataagtaatcttttacttctttctacctgcattctgtctttagacttcagtgctcctttgaccaagtcagtatggtgtttgatcttacttagaggactaaaggaatttctgtatctgagttaaggagtactaataagaaagaatatgaaggaattttagagtctgtcccaacattgtctttttctgcctcttcataggaaaaacctgaattctctttattctgttctttgtggctaaaagtgcttctttttaaaacctgtatggcactttactgcttcttaatccaggctagatatagtttctaaagtaagcatgcatgactcagtgttggaacttttccaggtggagcaatgaaaaatgtcctatgtgatcttgtttgggttaataaacaaacccatctcagaaaggaaagagaattcaggtttttctatgaagaggtagaaaaagaatcaaactggtttgtactaaaaaaaaaacagcttaagcagggtcatttgttctgtggaatgaataatggcagtttgctgttctttcagaggtgtgcaaactttgtcattcaaacctgattcttttttggccacctacaatgccaggctctcatgagcacctagaactagggaaaggaaggcagaatgctgctgatggccatcccacaggaggcacatgcatcccttaaaatgagaacacgcttctttggccttcttaatttacctagtttacccaatgcttatttaactattttctcaacttaatccataattaccacccattttcagaaggaaagccagaaagttgtattagtccattctcacactgctataaagaaatacctgaaactgggtaatttataaggaaaagaggtttaattggctcatggttctgcaggctgtacaggaagcatagcagcttctgcttctgaggaggccccaggaaacttacaatcataggggaaggcaaagggggagccagtactttacaaggccggtgcaggaggaagagagaggaaggggaggtgcccctcaccttaaaacaaccacatctcatgataactcactcactcactatcacgagaacagcaccagggggatggtgccaacccattcatgagaatccacccatgtgatccaaccacctcccaccaggccccatctccaacactggggatgacaattcaacatgagatttggtggggacacagagccaaaccatatcaaaagtatatcctagcacttattttctgttttgaaagaacgacaaccatggccagcatatgatggcaaacaaagggttaaagtgaagaccctctctcccaccccataaataatcctctccttcttcctactgagaggagaggtggagagtgaagggggcaggaagtgaatgctcactctattgtataccttgagcacgggactgtcagtttttctctgaggctccagtcctgccagaaggtacagagatgagctgggcttgcagcatcaccagtgcaaggcttgcgggtcctccagcctgacacagaagttcctgggctacatgcaggaacctcctgaagcagatggcacaattccatcctccaaacaccacctcgtgctttttatcacctctcagaatattcacaggaaaccttacttaacacgagctcttgctccaaactgaaaaatgaaaggagaaatacatgcagatctggcatctaactaacgttcccatcaactattctgtaactctgggccagaattagacttttagaatccaagtttgagggatcaggatcctaatcctaccatatttctttttcttactcctgcttccttgttcttttgagaatgaaaatatcaggagatcaagggaaaagtaatgtgagcaaatatgtcatttggattctctaggctgagaatttatcgtctaaatgttgaatgagatataaatctttgccgggcgcagtggctcatgtctgtaatcccagcactttgggaggccgaatcatctgaggtcaggagttcaacaccagcctggccaatatggtggaaccctgtctctactaaaaacacaaaaattagctgggcttggtggcgggtgcctgtaatcccaactactcgggaggctgaggcaggctaatcacttgaacccagtaggcagaggttgcagtgagccaagattatgctactgcactccagcctgggcaatagagtgagactgtgtctccaaagaaagaagaagggagcaacagacaccaaggcctacttgggggtggagggtgggagaaaggtgaggattgaaaaactgtctatcaggtactatgctctttacctggatgatgaaataatctgtacaccaaacccctgtgacatgcagttttcccatgttacaaacctgcacacgtacccctgaaactactagaagtaccacattaatagcgtgcatctccttcttcctgccttgttacttcactttttctgttccatctcttaaagaggcatgtaaggtagaatatcaaagtattgagtgttccctttgcttgcttgctggatatccactggtacacaaacacatcttcgtatctacatggcagacttatgtaagtgacaatactgtttctggtggatggaacatagagcttatatgactgatctgtggtccctatattttgttttgttttattttgttaattttattcattttttgaataggtaatagatgcacatggtacaaaattcccaaggtacaagagtttacggtgaaaagtaagtctccctcctctttgccccagtaaatatagttcccattttgaaaggcaatcactgctctttcattcattccacatttattgagcacctactatgtgccaggttctgttctgggcaatgatatgaagcaaaacagacaaagcccccttgccctcaaggagcttacattttgattacgaatttcttgtaatattcattcaatagcatcttaagttttgtatggccagcgcactgtggtagttaaaagaagggctctagagtgacagcaactgattttgaatcctattttctgtatattctaagtaatcttggagtatttattccaccactctaaactgtgttttattttgaaatggaaataacaattctgttttataagattatgagaattaaataatacatataaaacaccaaacacagtgcctaaaacatagtaaatgctcaataaatattagtgttaattataattgatctgattctactgttctgtaatgctgactagaaataaaggatttattttcccaatagttttcgtttcctctctttgctgtatgatcaaagaaaatcactttttaaaggataagcaacagtaaatttaagtcaagtttgatcattaatctcttgtgtattagactatttgctgagttctattaagaaatcaactcctagtaaatcagtagagtatagagacactgtttctctttattctttctaatctttcttaatcccatgtaatttgcagggttgtactatttggtctgtactattaactattaatttaaactttataatgggagattctgtattttacagaagaattaaacacttttgagcaaagtttctaataatacaatttggtatccttgtcttaaggaactttatgactgaagtctccagccagatgggaaaacagctttcagttcatggaaaagtgacagaagttttccttggtgatggtcttaaggtggaaagagattagaagaaaagtacatcgggtgggggaagaaaagaagagaaaataacttctaggataagaaaacacttttaaatattaggccaataactatttcctttattcgacatgaaaaaggatcattagggggcataatgaaagattgtgaggatgttgggttgggtatattacaccatgtactggaccattgacttggaatctaaaaaggaatgagggcacacctatttggcccaccacagtcctgataatcatttaatatactctctttctctcctttgttcctgtttctattttgtattgttttcctggcagacgaagttgacagatctttgaatggttgattatggtgtaggaaatctcttctttcagcctagtcatgatgtagggaggactaggaagaggagattgctgagtagttgaagtaaaatgcctctgaactgcttttattaattggttagtggtgggatcaggtagatttggggagttttgtattctttttaaatattttgtaggctctgataatttattgacagatgtagattaacaataagaacatcagtgctcaagataaaagtttcgaaatgcatcaagtcaatactaagtgaggccttctctaatggcatttgccactgtgctcctgggctttgtgtatgcacatcatttaatgcactacagagctaactctaatttattagtgatacattaggcaaccagagtgtgacctctttggtttacctttggaccttgtcatttctcatttttgttttggttacctattacaaaattacagcctccccgaaactcagtgatttaaggtcttattatctaccttggttctgtgagttaatcggggctcagctgagtcttgggatcttttatgagattgcagtcagcagctgaggtggaggaacatgaccagatgtccaagatggtgtcttcattcaaaggtctgacacctcagctaggatggcagcgacagctgagcgttggctgggcatttctctttctctctctctctctctttgactctctttttgtctctctctttccctggttctaagcagcctctccatatggctaccttgagcttctttataacatggtgctatcatcatagtcagatctcttacattgggactggcttcccccaaaccactgtttcaagagacttgaggagtctgcaaggtttctttgaacacaaactcattcattcaaaatcactttgccaaattttactgttcaaaatttcagccaacccagattcaatttaggggtactatgcaagggcatgaatagaaggaaacatagttcattggaggtaagggtgaggcgggcattttaaagatgagctaccaaaatcctctttgcctaaaaatagtcaaattcctctataacacagctcttatttcactgcaccaaataactttagaaaacataaacctacacagctcctttttagtaagtgaaaatatgtgatcttggtaacatttttaagctaaatatatctgatataaaatgcatgtcatctgttaataaattaccttggttggcttatacacacgtgttagaagctgccactagccaaaatgtgtttggattatatagtggattagagaaagttaacaaatcacacaatacaattcatctcattcctttctaatctttggtacagtagtgtgttgtactatataataatgatagaatgttttgttcattgaaaggagtgtgaatgaactttgttgttgttattgttcattcattcattccatcaacaaattttgtgattacctaacacaatgcctggcttataagtaatggagaacagggacattttactgctgtaattggattttgcctttaccagtataaatagtagcaatttaaatgctatttgagttcatgcattcagatatttgggcattggaaaaaattgtgcaacagaataatagtaatcgtgctgattaagcccttactttgtgcattatttcatttaaatctccccaggaggcttgagggtagaggcagacttattacccccagttttatagaggttggaactatgactcagagcagttaaatggtatttcaaaggtcacccagtcaatacatggtacagcttggatttgaacctagagcacctactgtggaaaacagcattaaaagaataccattgcttttatttctaaattccatgtcttttaagaaatgttctcaccattctaaaatgctaagtggataattacttaatgttataaggctattttattttcattaatctttggccaagtgtgttgacaactcccactcctaccccagacttctttttgtttcatagtgaccatttctgaagtctaagaagtacggctaaagaataatggaaacttactttcattgaaattttactgtataccagtcatttaacataatatttgaaaagagtgctaagttgccatgacatgtagatttaaaagataaacataaaaataacttatatttattatcagtcatggattccaagattatttatgagaacttccaatatacctggcccaggaagaatatggctcctaacttaggggatctcaccagccaatgggaaagactaagcagatgtgtttactggcaatacattctgatgagggacacctaatggtgagtagagggtgcgacggcttctagaaagagtcaaagattagagaagttcatcaggaaaaaacgataaagtttccatcaggagaatacaccctagtaaaggctcaaagtctaaagagtttaaggacttctagggactgaaaaaattctgtataacaggagggaaggtgggtgtggaagaatagccaagaaggaaaaatagccaagaagtcagtggaaggaacattgcatcataggccttgctgagaaattggaatgaatgacagtatttgaataacgctttgctcagttctgtagtttcgattcgaaatgcagacttaaaaagtcgatgaacattcagacatttctctttaaacaagacttccccttctattctttagagttggaaattattctctgcttgggaatagttttcaatatgttccagacattataaatgacttcccttctatttccatgtatttcccatgttgattacagccaggctgatcagagtaaagcaccaggtgtcatagcatcctaatattatatgaatcatgcatttatccattcatctatgcatgtatccagggaaaacagatttttccccctactttatcggttctacagattcagattcctgtatatttaggtaacattccaaggggatagatgtgctcttataaaagactgcttacttcagcaagacagtttctaaaccctttacttttgagcccaattctccaggtattctcgggggcggtgggggctggagggaagcaaaaaaaaaaaaaaacaaaaaaaaaaacagcaattgaaatggcctctccagtgtacccagatggaagatggggaagtcctgctagttttttccttcactgccaacataaacagggtggagcagctgagaaggaaggccactagtggagagagaaagaaacaatgtaacagcaaagtgacagacctcagtcctgcctcctatctggggcaacagaggcctctccagccaaccccagttctccctttgctttgcacttcctccagggacctctcgaaggagcaccagtgagtccctccatattaaatagttgaaagaacttgggccaaaaataaagcagaacacccatttgctttttccaacttgtctcacttctgctcccttcttcaaactcctgataaaaagcagcggcaattagtgtattgcaaagtgcctcttggagagttatgggaatcactgctgctttccttagccccagtttcacaacctcaactcaagggcaggccctccctctctctttttcccctccttccacctgacagggaccataaataactgaggctcccagtgttcccagctgagaacaaagttgaaagtttgcctggagctccatgccactccccgcctgggccactgctttgttttcttctaatgtttttcctctacctgggttggctgtttcttcattcatatttgagaagaatcacctcctaattaaatgtagcacttcgctctctccctacatgaaggctgtcttggttacccgactaggcaacgcgcattggtatcaaattaccgaaagtctacaccggagcagtcctcatatttacatacaaataactcaggggcttgcatttatgtcaccattctgtcctgctagaggcttgccagaggagtttttaatccaatcagaaggagctttaaaaggatgtctgcgaagtggtcaaaaggatcttaacctcaattaagtggggttttttaaaaagattttttggggggcctgaaattttgaaaatcttcgaactctgagtggggaaagatgtataattcctcaattgcctacgaggatatcaagatgctgagaggaattcagcggtggtgaagagagtggatacaaaccagggattggtttccttgagctgttttggaggttgattctaaatcactgcttaaggaattcctggaaacatcaggaaaacatttgatcatccaagcctagtggaaatggctttaccgcagagtaagatctttgagttgtacttggtgtgtgctgtttttgtttgagatgcagtgaatgtgcaaatagcccagccgtaaatagttacttaaaataatctcttggtactgggtagcagcagtagaaagttgatctgtttagtttttacatttgcaaaaacagtagttgacagtgtatttttagacttgattggtagtttaaaagctgagctcttgcggtttcctgagtttaaatgaatggaaaatgtaaacagtaccgaatgcaggaattggaaaatatatctgggggaatgaatcacttacctttgagaaaacacaacatgtacacttttgcaatctcttggccagtgaagcttgcgtccagaaagagggtaagagtttgcctgtgtggggaaggaacttttctgcagcctgtgctaccttttgagaaggatgggaaatgtcccagagggcaaaagacaattgaaaaacctgccttgtcactcttggaatgtggtttttccatatgatgtcatgttttgcatacgtagctggtaaaagtatttcacataattaactctttgtcttgataattaaagagcaatttatatagtcctttcaaagtgctaaagcacccatattatctctggagaaggctgtgttgctttccatgtagatttcaagcattgggacagttgggctgttgttaatttgataggtttagaagcatttcaaaattgatgtgttccaaggctctccaaccaagcaagttatagttcacataacttgctagtttcttacataagccccaaactgaaatcctgtgtgtgagaaaaccagttttttttttaaatgtctgtttccttcccacatataatttcaagaacagtaatgaagaggtggttcttattttgtaatccatgtccattcaaacaagctgccctcatcgtgggtgaggtgaggtgaggaaaactataactgacataaaacatccacctttctagtcagctgaggcttacagggaagcaaagggatacgggtaatgttttcagatttgtatttaataccaggagttgtttccgctacttaaattcactcttgaaattgtgtactaacctttacctataccttttccttctaaatgagagtttcaaaaattatccaggtgataggggaaggtgaatatgagatattgggggatttgctgataaccaaaggagtgattttctccacagctgacactttcaaaagggaagcttttgatgtgggcttactctctacatctgcaggtgaagatgcaatgaccggggacacagacaaatatcttgggccacaggaccttaaggaattgggtgatgattccctgcctgcagagggttacatgggctttagtctcggagcgcgttctgccaggtacttcgttgttgctgtctttcatagttaatttaaaacaaccatgatttgtcataaatcaaaatcatgttcatttttcacattatcccaaaatgtgttctttggatgaagatgtgaatttagcgaaatgttctcgacgcaaatacacatgctctgctattttcttttgtggtttgcggttgttaatttcatgtgattgaacatgttaattgtgtgttcttttttttttcccactttgcagtcatgctgccagcacagtagcaaaagagctcactgacaaaactgggagaaccaatctgagtcacatatttcaaaattaagttttgttccatattgaaagaaagtattatttgctaataagtgagaaatatgtgtatagattgttcactattctctgttactgaaataataattcatgattaaaagagagcatttttgaaaaaaaattatgttgtttattaaagttgtccaccaagtgtttgagtatctcttctaaaactgttccattattttgtttacaagggacatgtaagaagtataacagtgatttaccaaaagtcacagacaggaatggtgacaaattcagttcttacaactgaagtggaaaacttctgtatgggaaaaccttgactcaaacttttcttaaactagttgaaagaaacagaaccttgtgcagaatttggagacttctttgccctagtgtggattttaaagctaataattaaaccttctaagccagagccctgaggacattttcctatagtttaaggatctgttgtagaaagtttcattgtctaatagtaaatggcacttcccacaaagtaaaccctggagtttattctcagtgtagttggtgtggccagtatggatattgaattgatttttcttctagtcttttttttagtaggaatttgaaactcatatagcttggtagaacttttgccttataaatacatttataaaaggccttaaagtcttattgtagcaggtgtcattaacaggaagaggaaaaataactttaaaaaaatatgcaatcttttaggcgatcaaagatagcaacaagttaaaatggaaaatatgtagaacttttaaggttcttgagatcctgtagatcttgtttaaattgtagagatttatagcttttgaaatccaataactagcttgccttctgttcttctgataatatatgacacattttgtgatcagtcatttttatgtagaaaactgtagtagctgacctccagtgacataggaaaccagaatatcgcactgtattttttttcttaatataattccaaggctttcacacttctaattttgattgcactattatttgttgctattatatgtaactcattttttttactttgatgactcatgttatgctcagaggcaaatattttttaaaaatctataaagccaatatttttaagcacattgttagagtattatcaagtaaaatatattctgagtgtaacattttaaaaggagtacattaaatgtgtaactcattcaaccataacattttttttcttttttccctgtctgattttttgctttctatttcttgttttttttttttttttttcctaaaattactttaaaatagtcccaagataaggtaagaagacatggcacttttatagtgtttctcttccttctcctggctcatgctctcatttttattttctttagcattgtaatgtgatgtgctgtgatgtgctgcgatgtgctttctttttttctgctcaaaagctttagaaacatcagtaaaaattttctgattttaagaaaagtagaaagtatataataaatattacttacgcaaaatttaccagatacttaaggaatttctttcccttaacaagttttgtatagtgcatgaagtaattaaaggaatttcactgggtttgcagaaaaagtcctgatgtgaagggctgtttgtttgctggtttctgttttatttgagttgtgctaggtaaattagtataaatttagaattctgaggcatgtttttctaacacttcctatatttaacacttagggtgtactgatggctacaaatagttggccttagttgaaaacaatttaatgctttctagatccccatgcaaataatctttaattttcagctgaaagtacttcgaagtattaaggattccgagtgaaacttgatggatttaattgactccatatgtctaatttaaattggtctggaatgatcagaagtaggaactttagacattatgcaaaatgaagacatctttaggcctttcggttgatagctcccaattcagggctctgttctgcagttggcactcatagagaaattaaaagaaggaggagatgtttaagaagtatcaacaaagtttagatacatttaaaaatgaaattaaaatgaataggtaattattttttaaaacttttaagtgtttgtctacatagaaaactgtttcatacaccaccaatgttaacatatcatgccatggggaccataatttgaagaaatgaatgtctaatgcagagagtggccggcgactctcaaatcacaccactggagcaaaatttaacattgttattaatacttagaagctgcactaataatgtagccactagccacctatagttacttaaattaaaattagttaaattcatttgttcgttcacaccagccacatttcaagtgctcagtagccgctgttgttggatagctcagatttagcacatccccttcataggataaagttctgttggacagtgttgagttagagaattcctgctcttaggaagcttctactgtatttgagagaaggtaagagaatagaaacaggaatggcggaaagaagggcttgcaattgaaactggggaaaaaagagagtaatgggtcccatgattgggcacagagggcctgactgtgcaagtggctagagtcatgtggcttactagataagttcctctgtgcaggaattatgcttataatggtcttttagtaagttttgctgaatacattaaataatgactgcagaatgatggttgtttggggataagagaggtccatctgagattctgataaaagtgaaggctccaatcctagaagaatgtacgtacctatctgtgtagacacttagaatgaggcctctaatgtcaggaggctctgtaccttgataaaaggatacccactttctgattttctttagtatagcaggcagtggggaaaagaaattgtttcatgcaaagaatcatttatttacctcttatgtgtatcttctttgttcatttccccatcaagcacacaaaaggcaaggccaaagccaaagtctggctggttcaactggtaaagatacaagaaggcacttttagatccagatggttttttaattatataggcagtgaaagaagaagtgaaaggtgctagcttctcatgatccttgtcccctacacctaaaaggacaccagaacaaaaggggctggatgtctacaatgctagttatgggataccccattgccgaggagccaattctagacttcagctaaatggttttatattctgcagctctattccaaggagagcagaataggaagcctcatacatcattagaaagaggaagtgatgaaagctatctcatgacagcctcccaggtgagatggggaggtgagtagcagatgatctcgtggaagctcctcaccaacctccatcctctcagttcctggaagatcacagggtgttctgtgaagactcagattagcttcaattccggtctttgcctgtatgacttatgtgaatatatgcaaggtcacgagagtgacatggcagaactgttctcccaagggccctgactctattgagttttagtttagaggtcactgtgatgatggcatatcagggcatcagggtacctgcatctgagaagttcaagggccatatggaggatttgacagtggctggaaagaacagttggaggagctagaaagacaacagtagagcaaagaaagaatatttgcagaaaagaccaaataaccatgcagggaatatgaatgtttcctcaaagccaggaagatggcaaaaaggatcatgcaaagtgtattcataacactacttccttcttgatgttttctatgagtagcaacaacaaaccagagttctcagtaagtcccaaagacttataaacagacccatttaaagtagacataattcttatcagtagcgcatgtcaagtagacatagaccagaaagaggagacattctaacataagatctcatcctagaaaaatctgtcaactatctagaatcatctggttcttctcaattgtcatgtcagttcaacttcatagtgaaacatccaaagttttcatgcatttcatattctcaaaattggcctaattttaaacaaattctaatcataaggttgtctacactgaagacattttctcaaatacaagggattttacttttcactatgtcctttcaagaacaacttttgttgatatttttagccatcttgcctgttcttaaagttgcatgcattaatttttttttattcatctcatcatcatctaccactgttgaatggttaactgtaaatacaacagcctccgctccttcagttcggataggtcttacaccttgaacagaagctcctatgcacgggacagcatgatgattgaagaactccttgtgccatccaaagagcaggtatgcattcttttcaaaatagcctttgaccattaaacttacatttgtatgatttaatcaagctctctgtcttgtgacaaaaaatatatttctgcatgtttgattttacatttgtaaatcttctggtactcgccagttaaaaaaaaaataagttgtactataagcagaaatattcctgtcttctgcaggtgaggaagataggaatatcagagaggaactcagaaagtcctaggagatgtgtagttacctttctcttctctaggtcaaatctatttcagttttttaaaaggagagttgataatcattggtagctgaagttgctggtattaacctcatgaatgtttttgtttgtttttggagacagagtctctgtcacccaggctggagtgcagtggcatgatgtcagctcactgcagcctctgcctcctgggctcaagtgattctcatgcctcagcctcctaagtagctgggaccacaggcgcaccaccacacccagctaatttttgtatttttagtagagacggggtttcaccatgttggccaggctggtctagaactcctgaccttaagtgatacacctgcctcggcctcccaaagtgctgggaacaggtgtgaaccaccgcacccagcctgaatgttgtattttgctaaacaaactgtgtatctatgttggaatttgttagaattgtttttagtaagtaaagatgagactggtcattttttgttcccttagcttcaaagctgcctttgatgggtgtctgaagatgtgatagtattttgctttctaccagaatctctgctacatgcatttggtgtttgtgtaattgttttcttccaataattgtggttgaatagatagcgggttactataagaagttccagtaacacagtcttcctgcatgtgggctcaggatggtcctggaataattactacacagataatacctggctttaagtatgcacagtagtgatttaatgacagatgaaactatctggacaataaaacttttaaaggtggcttataatatttaaacaatgtaaataattggtgaaatcatgctgggctttttgacttactgcacaatgaacgtgaattggagcagatgaataaatgatagtcacatatcatagccaagttagaagttaagcaataggtagacttttgggactcccacatgtctgcagatgctgatgtctagacctacatatgtgtgttgtacttcataggaacctacaatatatattttattactttttactctctagaacattcttaataagcaggccttacagaggtgaatacagtggttattcagtgtttggtcagacaaaaaaactctattaaaaatgattataggctgggcatggtgggtcacacctgtaatcccagcactttggaaggccaagacaggcagatcacttaaggtcaggagttcatgaccagcctggccaacgtggtgaaaccccgtctctactaaaaatacaaaaattagccaggtgtcgtggtgggcatctgtaatctcagctactcgggaggctgaggcaggagaattgcttgaacctgggaggcagagtttgcagtgagccaagatcgcaccactgtactccagcctgggcaacagagcgagactctgtcaaaaaaaaaaaaaattgattataggtgcatgtattagtctgttctcacactgctaataaagacatactagagactgggtaatttataaagaaaagaggtttaattgactcacagttccacatggctggggaggcctcacaattattgtggaagagaaagagacatcttacatggtggcaggcaagaagagaatttgtgcagggtaactcccccttataaaaccatcagatcttgtgagacttattcagtatcacgagaacagcacgggaaatacctgcccctatgattcaattacctcccaccaggtccctcccacaacaggtgagaattgtgggagctacaattcaagatgagatttggatggggacacagccaaaccatttcagtgcaatagcatgtcatgggttttaaatgggtattagcactagagaaagcacttgtctcaaataatgaaactaagtcttgggtataaggtgttgccaggaattggttgaaattttctgcttggttggctgtggtcattatttcagtctgtaatcctgctcttttcatattcccaattgaaatgagatggcagtggagatattgataccacttgtaagtataaaaatgcctgttattctctacactctaaggagaccccacaaaacgtaaaatcacaggtgaaaggagactccccaggtatcaatgacactttgctaatgtagaaagcatgtgccagggaatttctgatcaaacctaattgtggcttatatttctgcatattaacttgctatgggtcaagggcccgaaattggaaccaccaccaccatcaccatgaccttaccatcatcactgtcacctccaccactgctaccaccaccactattaccaccatagttactctaccacccaccttctgcacatcaacattgaagtaaaatgcaagtgtttgtggtgctataaaatggcttctgagggttctcacaccattgcctattaaccattaccaagacctacttactcaggtagactgtgggggcagcatttactcagaactaaggatttgtgaacagaaatagaagacaaagagaagttttgagatgaaactgatgctcttgtagtcagttgttgcttccaactcaaaaatacctctgtggacatcatgaacacttctatagacccatcagaggaaaggagagcataggacatctgaaaatctttcaaaataaactttaagttgataatgtagaaacagaaagttgctgtctttaatgagcacagaatacccacataggcattccttgtggaaccagcatgtttaataagcatataacactactcagatccatgcaaatccagaataaattggcaggagatttcggagcgggaaatgaaagtcataaagacattttagggactgttgggggcatttgaaaatgtcttggagatatctgtgtatgtaggaaatcattgatcattttcttagcagtgataattttagcattgataattttcttagcttatcactgctacttattggacctactcagagaatattggggtatgcatgctgaagttttccagaattaagcaatcattaattcaactatttatttccaaatagttcagccaaaatgcatgtggataaagttaaagcaaatatagcaatgttaattgttgaatccaggtggaaggtacatgggtattttttatacagtttttcaactttttcatttgtgtgaacaatttcaaaatagtaacttggaggaaggaggaaaaatcctgaaagaggtgcattaactttttaagtctctagttttgagactaaaaaaagctaatgcatctctgtctattattatagataaataaaattatagatacagaggagaaggaaaaggctaattgctcaaagaagaagctggcagacagaagtgtctagatacactgtgcaagactcatgggaagcatttacttcagaagtgcatttaaacactttaggattaaatgacaaaattattagtttctgtttttcatttctctaattttgtatttataatgttcaaaatatagctcttccacagtaataattttgttggaaagcgtgaaagaagttttcagtatttagaattcccaaagcaatgacatataacttactgtcagatttaaaactgcactgtcattgcccagttaaatttgccctgacaagtaaaggtgaaaaatgagtaaaaatgaactctcatacacttctctttttcaatgagtagatctcactcatacaaagtacagttgcctctttattatcctgctgattaatcagtttgcatattaaccacagttaaagtgtagttgagacccagggtgattagtgcaggactgccacctcaccctctagggacctgtgctggctgaaggcacatgtggaggccagagctgggggaggggagtgggagaggtggagccatctccaccccctgttgagcctgagtacttagtcctaatccacttaattccctcctggacaatcaacagtagactgttttgttacaggttatcatgaacttcctattcttttaccttccctttacttcagaagtgcatttaaacattttctattagaattaagtgacacaaaatcattagtttttgtctttcattcctctaactctgtatttataaatttcaaaatgtagcctttccacagcaataatttcatcagaaaacatgaaagaattctgttagccaaaaattacctgaagatatgtttttgaaaatgtatatgtaaatgaaatcatgtcttggatttgtcaaaagatctttttatttaaagcaatggctcaatccagaccacttacgagcatcacttggagaactttggggtgtgtgtttgtgtgtgtgtgtgtgacagagtctcactctatcactcaggctggagtgcagtgtcgtgatctcagctcactgcaacctccacctcctgggttcaagtgattcttgtgcctcagcctccctagtagctggaattacaggcatgtgccaccatgcccagctaatttttgtattttttagtagagacggaattttgccatgttgcccaggcttgtctcgaactcctgacctcaagtgatccgcccagcttgtccttccaaagtgctgggattataggtgtgagccaccatgcccggccacctggagaacttttaaaaagacgattgctcagttcctgatttctttggcctgtgtagagactgggcatgcaattctaaatgaacccaaggttgaaagccactgattcatagtcagtattcttaactgggggtgcccaatggaattacctgtggctcttttaaaagcaagatgcctgcagaatcagaatttccatgtctgggttcttgggcatatgtatttttaagggttcccctgacaattctaaggtgtacctttagttagtaactgccgatttaaggcaactctcactggaagcttggtgtgtattggtatgtcaacatctaatgtatttgttttataagctcagatttgtatgtgtcagattgtctgagagcaacacctgtgcttggaaacattccattcctctccaaataggatttaataaataaagggatgagtctaaactgaagcctgattgtctgggatgaatgtaatagcatggtgctttcatttcttctgatgtaattattgaaagcaactgtctggtacagctaatgtacttaagacacattactgtgtgtgatccagattagacagtgctcattacataaatggaatgctattcactagataccttcagtgtcaggagatataatggtggtaacacttatggtggtggtgaaaacagctaattttgagctcctattatatgcctggaactattctaagtgatttagcagtattaagttgtttatagttcacaatatccctatgaaataatttgttaaccccattaaaaagatgaagagtccaggcacggtggctcacacctgtaatcccagcactttgggaggccaaggtgggtggatcatttgaggtcagaagttcgagaccagcctggccaacatggtgaaaccctgtctctactaaaaatacaaaaattagccgagtggtagtggtgcacgcctgtaatcccagctactcgggaggctgaggcaggagaatctcttgagcctgggaggcagaggttgcggtgagctgagattgcgccactgcactccagtctgggcaagatagtgagaccctatctcaaaaaaaaaaaagaaaaaaaatgaagaaactgaggcacagagagcatgagtaactcacccccggggacacagcttgtaagtggcagagtcactggccatctggctccagattgcctcattttatcctgaacactctacatctgcattgctcagtgcaagaaaaaggcccttgaggagtccacgtaatttatagtctctcctccaggattttatacttgctagtattcttggttgggccacagaaccaccatcgtgatgtattttttagcatgaaagattatatttagacagtgttctttgttaacgtttatttctaatcctaataaagtcttttatttattcaatgtgctttaaaaagaactgacatattcagtaacaattataaaaagtatgaagaactggccgggcgcggtggctcacatctgtaattccagcactttgggaggccaaggtgggcagatcacgaggtaaggagatcgagaccatcctggctaacacggtgaaaccccgtctgtactaaaactacaaaaaattagccgggcatggtggcacgttcctgtaatcccagctacttgggaggctgaagcaggaaaatcgcttgaaccagtaggtggaggttgcagtgagccgagatcgcaccactgcactccagcctgggagacagagcgagactctgtctccaaaaaaaaaaaaaaaagtatgaaaaactaaaaattatggcatggaaggcatcattacaggaatggaactatttgaccttcagacagataaaaggtagaaggcatgacatcagtttacaaatatttagcaggctaaccaattagtttatcttcctttaaatgacaccagaattagttgtaagactaaaaggtatgtatatactgtaggcagaaacatgtaattcagtatgattttttatagagtcattcaaagatgggagaaaagcataagtcacttatcgatgtcggttggttttgcctgcatacacccatttggctttccacatatacccatttccgtggcagtgcctggatctgatggtcgaatccctaaccccacccatttctcagctaatgttgtttagaaggggcataagtccctcctgttctgcaacagtgagacccaattctggccgttcagagcattcctatctcctggattacagcaattactttaggataaaaagtgaaatctgagcccatctagtgagactcaaatttgagactttgtctaaccttttgggaaagagaaactctactggggttcctaagctataaagatgacatacgtccaaagctgctgggagtagaatgtgaagaccaatgattcctaccatcatttgagctggattcaaccgaccttgaagttagcaccatacagattttcttgccatataaaccagcaatttaatttcagtcttcccccatccctggaaagggagtatcttaaaccagttcagtttggttttctgtcattactaatgtggttgctattggtggtaatgaaacctggtaggaacaaccacatatcaatgggaacataaaaagtctagcatcttaaagtgccattcaaccttgagattctattattttatgctttctctctagaaataagtaaatccaatattaacaaaagagaaaatgaggaactatgatttaagagaatgctataaagttggggatttcttttttcttttctttttttttttttgagacggagtctcactctgtcacccaggctggagtgcagtggcatgacctcagctcactgcaacctctacctcccggattcaagcagttttcatgcctcagcctccccagtagctaggattacaaccatgcaccaccacacctcgctaatttttttgtatttttagtagagatggagtttcaccatactggccaggttggtctcaaactcctggcctcatgtgatccacccgcctctgcctcccaaagtgctgagattacaggcgtgagccaccacacctggataaacttgggtatttctaaacaaaaactttagaaaggagccccttgccaattgatcactctaaaatgaacaccttccatttccttgtagttctgttgacttaggggcagtgcatctatgaaaagagaggaatgggacagctgtttggccctgttctctctctgagtagatttctttcttttgaagacttccttttcagaccagatttgcctacatggtttgttcctgaggggactagtggcaggccttcaatagtgactggtttagaagaattaactagactatgatgtcaacagttgcactggctgtttgaatgctgactgtggagaaaattctgtaagtgatattggaggcctcattatagccatcatgtacaggaaggctgctgtcacatcttccaccccataactcttctcatttatttcacagccaaggattctggttcctttggattggacttggtcttttttgaggctaaggatgatttcatatacatttagtcatataatgtgtaatgtacaatttgatatgttagcaagtagtgtgaaaattggagcattcttcagaagaaacttcctgctcgtattttcaagatccaagcattttcaattacctcagtaataggaagggagaagaatacctaacccaaaagactgcctatgctaacagtcagattttcctcctctacctctcaaccctattccacccacactcccacccccatctcccacacccgtcggcagattaaccttgctatttctttcacataagctaatttctaaggggggtgctcagaaacgtgcatggtggcagaaggtagccagcctcagattaaagatttgctagagatagtccccctagaagataggcatctttgactggtgacatttaatatgctgctttctctcttcaatgtgctttgccagcattattcaggtgatgcattcaacacctctcaacaattggtcagcaagattacagattttttgttttaaggcagagaagttggtattgtgacttccttaaggtagtgcagttagttttgatgtctcaagctgggtgttgacacgctcagcttccactctgaccttgattcaccttcttttgttcgagttcataaccagattgtcttgaaatcaatccaattcggaaatttaatgaacgaaatttctttatatgctattctcaaaataagtcttaagagtaataatagttgacttcaagaaaataaataccgtaagggaaaaaagacctgctttttctattatagtaggcctttaatttttattttattttactacttgtgtcaggtttccttttgtggaatccatttcttaaaagtgtttccatgtagtagtgctggatgtttaaacctactactatctatttgggtcgcggtttgccatttcactcaatatccactgcacgtcacaataattataatacttaatacactacctgccacaatattttattaaatgcatcatctcatttcgtgcttttggctacctaatggaaggggtattatgattaccactttacagacgaggagactagggctgtgaggagtgtttagcttgtccagttaaatagcttgtccacagctattaggcggtagagctgagaatggactgtaaacctgatgggtgcttaaacccattctcctgctggccactaggcaatagtgccactctaataagcaaagcatagcagatctgagtaaagcatgttagccatgggaagaatcgatgcgtagacaagtattttgcaaagcaaaaacaccactattatttctgttaatccagcaggcagctctgacttctccctgtgatgtgaaaaggatatgctatcctaaatatctacatagagggatgcaacattatagaaatataagaaataaattatcttcaattattaaaaatctagaggtaggctgggcacagtggctcattcctgtaatcccagcactttgggaggccaaggtgggtagatcagttaagccaggagttcgagacctgcctggccaacatggtgaaaccccatctctactaaaaatacaaaaaaaaataaaataaaatcagctgggcgtggtggcacatgcctgtaatcccagctactggggaggctgaggcaggagaattgcttgaacccaggaggcagaggtttcagtgagccagcacagatagcgccactgcacttgagcctaggcgacagagtgagactctgtctcaaaaaataaaataaataaatatctaggggtatgagattagcatcatctgtgtttttgtttgcatggtaatttagagttttcaagccactttcacattacttgggtcattccattctcacagtgaatcagggcaattaatattttctacctgtcaccctaatgcagaaatggagattcagtgagttttttgacttgccagtcactgggctatggagtgacagagcctgattcaaacccaagtcatcttattcttcgtgtggggaactgacacccacatgacttcctctgccttggccctgtccaagttgtggccgtagagtgaagttatccctgatagccctttactttctgtggctcctagtctgattgtatcatccaactgttactaaactaaattgtatttacaatctcccagaattgttgcactgagtgttgcatgtgacctgttattgggagatttcctggttgctgttaacattagcctgtcaaggctaccagttaatttgcaagaccaccttcacccatagatggtagagctgttagataaggaaacttgcagggttagttctggaccttaactcatgtcatctaacactggaggttgacagtcagcaacgtagagaattactaatattggagttaattggatttctcctttttttctctctctcttgcaaacactttcttgaccctgcctctttccttccctgcctggacaattatttccagacctgggcatttgggtgtgtccttgtttgtaaggccagtgtgtacttgttctcctctttgctctgatgaataggactagtgagaaactatttttggaaagtattaagctcttggagacggtgatatcatcattagtcaggctttggactccattaaataatgtgcattttcagttgaataatccttgacatcacttccaaaatgaaaagtaatgtgcttattcatattatctttgacatgggaataaaaattattaaaaattccgtgtgaatttttctttaacatagtgttctattaaagccacccagtgctaggtgttgacttcgtattgcctagtttttgaagtctttctaaacctcattttcctcatctgtcaaatggctccattactctcagggctaataggttctgacaactcaaacaaaaaatgaatgtatgggcctaggtcagtccttaccattgaactgatgcacagtaagttgtggtagtgctgttaacaaaggaatgtaaatattttgagtcaataataagacctaggcattgataagatgcattcttgaatggcctccattggtttgataaaagcatcctatgtgtattactataatgccccagtgctgggactggaatatttttatttttgctgttttccaccataaatgatcagattgtgacaaatgagctaatataagtgaaagtcttttgaaaagtatagaaggctttacacatataaggagacattatgataattccatgccaacaccagcactgcattggtgccagactttgacgtatatgttttcttttatctccatatcaaccatccccagtttgaaaatgcagaaactaagactgaaaaaagttgagtaatctgctaatgatcacaaaaccagcaggtgatgctggggcatctctgaaggagctttcaataagtaaagataaggaaaggtcaatgacaaaatatctcctttattcctgatggaggccaggcgaggactggcttagtgtctgagccacgtgggcctgctaactgaatccctgagataggcacactcccctacccaatgactgtggtgctggcccaggccaggcacactctttgcagaagtaggctttggagagaagaggagactgctcactctctgtgcccatagattgaaaactggatctgagcagaaccttcctggctacctttcccaaatctatcattcagatacatcactttaatttccagggctaaaatgaatataaaggggtagggagaggcccatagttacacaactgggttgtcttttcaaactggaaaaatcgggagtgggaaagaagtgttttcattaacaagtggcaaaggcaatttccaaatctaagtctgtgactcaacttcaaagccaagcttttccattgagcccaggcaacacccctccttgctgagaaaacttaaaagtcaggtctagttcatctttaaccatcatcatatgtggtatcctgtttatcatttttattttaaaatttttgtgaatacatagtaggcatatatatttatgggtgacatgagatatttttatacaggcatgcagtgcacaatcacatcatggcaaatggggtatctatcacctcaagcatttgtcctttgtgctacaaacaatccaattatgtacttttagttattttacaatgtacaattaaattacttttgactgtagtcactctgttgtactaccaaatactagggtcttatactttttttttttttttttgagaaagggtctggccctctcacctagactggagtgcagtagcactaccttggctcactgcaacctccacctcccagctcaagccatcctccctcctcagccttccaagtagctgggactacaggcacacaccaccacgcttggctcttttttgcaatttttatagagatggaattttgccatgttgcccaggctggtcttaaactcctgagctcaagtcatctgcccactttgacctcccaaagtgctgggattacagacatgtgccatgcaccctgcctttattcattcttcctttttttttttttttggtgcattttaaccattcccactaccctccaccccctgcactccctcactacccttcccagcctctggtaacaatttttctactttcgatctccatgaactcaattattttaatttttagctttcacaaatcagtgagaacatgagaaatttgtctttctgtgcccagcttattttagctaacataattacctccagttccatccatgttgttgcaaatgacaggctctcattcttttttatggctgaacagtactccgttgcgtgtacatactccattgtgtatgtattttctatttctattcatctgttgatggacacttaggttgcttccaaatcttggctattgtgaatagtgctgcaataaacatgggcgtgcagatgtctctttgatatacttcttttcttttgggtatatacctagcagtgggcttgctggatagcatggtagctctattttcagtttttcgaggaacctccagactgctctctgtggtggttacattcccaccaacagtgtaagagggttcccttttctccaaatcctggttagaatttgttattgcctaacttctggataaaagctattttaactaaggtgagatgatatctcattctggtttggatttaaatttctctgatgatcagtgatgttgaggactttttcacataccggtttgccatttgtatgtcttcttttgagaaatgtctattcagttcttttgcctatttttagttggattattagattttttttttccttagagagttgtttgagctcattatatattccggttattaatcccttgtcagatggagagtttgtcaatacattctcccattctgtgggttgtctcttcactttgctgattgtttcttttgctgtgcggaagcttttcaacttgatgtgatcccagttgtctatttttgccttggttgcctgtgcttgtggggtattactcaagaaatttttgcacagttcaatgtcccggagagtttccctaatgtatttttttttagtagtttcatagtttgaggtcttagatttaagtctttaattcattttgatttgatttttgtatatggcgagagataggggcctagtttcattcttttgcatatggctatctgattttcccagcatcatttattgaagagactattattcctccaatgtacgttcttagcacctttgtcaaaaatcagttcactgtagatgtatggatttatctctgggttctatattgtgttccactgatctatgtgcctgattttttcccagcaccatgccgttttggtgattatatctctgtagtataatttaaagtcagataatgtgattcttccagttttgttctttttacttaggatagctttggctgttctgagtcttttgtagttccacatacattttaggatttttttttaaatttctgtgaagaatatcattattttgatagagattgcattgaatcctttgattactttgggcagtatggacatactgttaaatatttaacaatatttaacactattgattcccccaatccatgaacatggaatctctgttaatcattttatttctttttatttatttattatttttttgagatgaagtcttgctctttcgcccaggatagagtgcaacggcacgatctcggctcactgcgacttctgtaccccgggttcaagcgattctcctgtctcagcctcccgattagatgggattacaggtgcatgccaccacacccgtctagttttctttttgaatttttaatagatatggggtttcaccatattggccaggctgatcttgaactcctgacctgaagtgatccacccacctcagcctcccaaagtgttgggattataggcatgagccaccaccgcacctggccctgttaatcattttaaatgtgtatttgttcagtaattaaatagaggcaaagtttttttgttagtactgtggtgctatgcacagtaacatgtcagaacaaacataagtgaatagttgaaattttatatttcggttttaagtagattctaatctgtaggagtaagtcttcgcagacaggtagcatggaaatgaaataccaattcagtatctatgtataaaaccgtaggttccattgaattgcttcattttatatttagatggatgcgccataggaagagtattttgtttccctgtatttaggttattaaaattgagttacgtctgctcataaacctgaggaaaccacaaaactcagaagagaaagcactaaggtacctaaaaacatgtttaagtgttactatctgggacaaatattgggacatatagctcaaaataatatatagctcattgttttgatcaagtatgagatttgttcgtgttacaacaaagcttcaatgagtggcagagttgcaagactaaagaagttaagaaaggactcagagggatgtggaatccatgtcctggcacactctggctttgataaatattacatgattgcagtgatacctttttgtgagacataattcattgtttcaataattaatggcaccagtgcatgtttctaagagtaccaaaggtaaataatttactgtaattaccaaagaggaatgatattatttatttatgagaactttttttaaaaaaatgaacctttgtgaaaaataaccttaggctccccagtgtaggaactgtagcttgccctccactccactcatgccaaaaaaattaaaggaacatcactactttgtattaagtgttttgccctactctgaaggtttgttggtttgggtctccaaaagtcagtataagttgttaaatgaggccagactgaaaccaacacctcatatttggttaatccatatagaatttgggaactttcctaaatggtttattgcttttgacgggttagaatcttggttccgtagattcttattagaagcttaattgcacacccattcactagatgtgtcctcgctcattaaatgcagataaagctgttcctcattcatgtttgcattttcctaggatgtgggtgagatagtgacttgcatgtaattgctctacaaatttatttttcaatttgacttcagggctattttttaaaaatctgtgtaattcagagtaagtttttaaatttagattttattattaccaaagttatgcaattaaataaaaagccacatcattctacaagacacacttgttaggaaaaaacataatccccatatacaccttcagtccccaagttctgctttccagagacgagtgcttggaataatttttgataactcgtatgatgtgcttggatatctctaaatactgcatgtatattgttcttgttgatttttctccatttcaggaattatttattgacttccccaaatgaaagatgaagcttttttttccacacttttcctccctatgcacacttcgtatcctcccatttccgcaaacagttgtaatttattttgcttatatctgtatttgatgcttatcttgttatgcctgtgtaaatgttactcacatatgtggcttatattatgattgctttttctttcttttttttgagacggagtcttgctctgtcacccaggctggagtgcagtggcgcaatctcggctcactgcaacctccgcctcccgggttcaggcgattctcctgcctcagcctcccaactgggattacaggtacgtgccaccacgcccagctaattttttgtatttttagtagagaaggggtttcaccatgttggccaggctggtctcaaactcctgacctcaagtgatctacctgcctcagcctcccaaagtgctgggattagtcatgagccaccgtgcctgacctgattgctttttctttccagcacaatattttattttccctggagttttttcacttgcttgatgtcctctgtgcatatcaatagtccaaccccaaaactctcccccagttgtacaaatctctcaatgtgttcacattcattaggtgatctatgtgtctcgtctacttacctcatctcgcttagagctttcttacttgtcatattccttgtaggtccactgcacacagatgtgctcttgggtcttccttcatcataaccatgaaaattccctttgttttctcttgtgttggagtccatgccctcccttttcttgggtcagtccttcactttggtggagtacatcttccattagtttcctcagagagtgcatgagaaatatgttttttaaggtgttatatatctgaaaatatctgtctagtttatacttgtttttaatttagctggttatagaattctgacttgaagtcatttcctgtcagcatgttaaaggaattgctctattgccttttaccttcacgttttgctgttaaaagtctgacacagaccctccatctgtgaccattttttctctccatgtttatagaccctgtctttgtctccgaattctgaaatgttacgatgatgtaccataatgggttctgtattcatagtgttggtcactcactgggtcattttacgctggcaacctctgtctttggctctggaaaagtttcttaaattgtttccttgatttattttcctttgttcacaattttttttctttctaggacttctttttttttagactgaggggaggatttgaacctcctgaacttatcttttgctttcttgtattttctctcctattttctagagttaaaaatttctctatactttctaaggtttttttcaatatatttgttacttctaagagttatttttccctaaatgtttcttttttttttaataagtagtctattgtttcataggtgtaaaaatatctcatctctctctagatattaatgaataattttaagttttcttctccctgaaaagcctgtttcctgcaatttgctttccttctgtttgcttgtttgttttgtttttatactggatgcttttttcagcagtctagtgacggtcagctgtctactcattaataagctcattggaagctctctgtatggtgtagaggttgttatccatgatttccactgaagtaataagccagaacatttcactgggaaattccaatgggcaggtcagaatcctcagagacttcccattttttgcctagaactctgtccccagctgtgtctgggagaccagtaaaggaagggtgcgattctgaatattcagtgtacaatccccattttcaatatggtgcctctagccttctagtctcctgcctgtagtcttctgctagggttggtggtagtgatggcaggggatcattatttgacaactgaggggattatgaaggtcaaatcactttttaaagagaattctagccaatccttctgtttttctgctgatgtgttttctcttattctctctgtcctttctgtgtctgtatttttaactatgtgactgtcatttcactgaggtttcagtaggcagcagattgtgggggatctgtgggctaataccttttatcacattggcacattcatagccattatcttttcaaatacagcttctactttattctcttcttctcttctatttctaagggtccaatttacacctatgttaaaatctctcaatgttccacatcttgtactgttttctttcttttttttaacctatccttcattttgtatatttttccatttagggctctaacttaaccctcttttatattgtgtctaagtaaagaactgacattgtatttagcactgaaccaatgcccatttgattccttcttatgtatattctagcattctatcccatttaatttattttctctatctttccctgtgtttttgtaaacatactaatcatagttattataaagcacttattagcttacctcagaatcgggatggcctgggagtctatttatagtgtctctctagcttggtttggttttatttcatttttctggttttatccacacactctgaccatgcttggcaatttttcactttatgctagacatggtgtataaaaaattgtggacacacccgatggtgatatattccttcacagaatgtttgccctccctctgctaggcaaatagaatagtaaattttaattcaattaagattttgctgaaatgaggctggtctgcagccctggtgaaagctcacactacctctggtttccccccagcacaccagcatccttatttaaaatcgttgtatgatcttcaaatctcttcccattataagttctaaacttttaagtcattttctcattactgccaaaaatctccattatgctcttcagagatatttctggttaggttttgagcttcctgttctgcacagcttcggaattcagcaaatgttcttagcaggaaactgtagcatgcttgaggccacccaaatctccaccaaaactctcctggcttttctgttcaacaacagtgacccctgtaggttaaaagtacaaatctgtttgcactggtaactgacaaaagcctgtaagttaaaaatgggcaacagaaagtcaactcaactcctgaagatgttcaccctcccagagtttggtagttcttttagttctcgatgcttcaaccgccctctgctgcattcagatacaattgctgtattttatctggcttacttggaagaagcactaggctgctactagctactccgccccacttggaaccagaagtcatcaagattgaatttttcattttttattttgagaattgggaaaaaaaattacagttgttataggattaatttgaagacatgttgaaaatgtgacatgtgcttaaaatcatagttggagttagttatgtgatatttctttgccatgtcagttacccagggagctttcttaaaagattgaaataaaacaatacatcaatagactttgttttctaacattacactcagatttcaatgtatttctatagaggagaatttaaaaattatttatgttgaatgtaagtctatctggaattagaggaatacaaatatattttatatgtgtagagaaatcagtcttgtatggtttgttgatgtaatttaatttaccattttatttttcagcatctaacattcacaagggaatttgattcagattctcttagacattacagctgggctgcagacaccttagacaatgtcaatcttgtttcaagccccattcattctgggtaagtaacctaaatgtcacttttcattatcctactacatgaacagtgcatttattacttagagttataaattcacatcaacaagcttcatatatatgaatacattcatgtatgaaatgtatattcattagtatatgtgagatgtatttgtaaatcattgtttttttctaagtaattctgtatgagttttttttttgagaaaaatttaattttgttagaaaaataatgaaattactagtacaacaaactttcctggctgttctaatcttctaggtctttaattttccttttcagaaaatttcctttgtaagttttttaaaatttgaaacataatgatttttctccgttttacttttctattcaaatgaagtttttctaggtatctgatttttctttccaatagaaaattaaatatgtaagtatgcctgttaatttaccttaactgacttttgtgcttcccttaataatagaagaatttctctcaaatatttagtagttgtttttgttttttgtttttgactgggtctggctctgtcagccaggctggagtgcagtggtgcagtcttagcttactgaaacctctacctcctgggcccaagccattctcccacctcagtttcttgagcacctgggaccacaggtgtgcaccaccatgctcggataatttttgtattttttcatagagatgaagtctcgccatgttgcctaggctgttctcaaactcctgagcttaagcaatctgcccgcctttgcctcccaaactgctgggattacaggcatgagccgccacacctagcaaatatttagtttttaaatgagcagtaagctctggtattgtcatttttttctcatatgatacaggtctttgatttgataaatgatttgtgtgattttccttttaaaagaatatataaatttgaactttcgagttggtgcctctgcatttctgaaataaaattacaattaagttgtattaaattgtaattttaaaaaatgaataaaaagaataaagatatttacttaaaaaaaaaacataccagtgtctacactggaagtgctgtggttaaaaaccacaccgagtagcctcctcatcctgcctccctggtcaatggaattcgaggcaggaggctaaaaggggacctgcttcaattactgaattaataaattagtgtatctttagatactggattcttcatctttgggtaattcaaatttgggataattgacatccatataagtagaatcaaaataattcattaaaatgatgaatatctcaaggtatttttgcctttgaaattggcatttaggccataagttaattgtgatcaaggacaagggcagattattttggaattaaataaattaacaacaattaacttttgtgaagtgcttcatatattatatgaagtatttgctgctgctcctaattaaaataaattgtaatagctaacgtttacttacttcttgtcgtgtacctggcattgtgctaaatcttttacatgtattgtctcatttatatttacttgaaccttataatgatactgtgagatacgtattactcattatcctcattttacaaataaaaaatcagactcagaggaatgcttcaggttaaaataccgttatagattttggctttgtaatactacaattctgagaaacagaacaatatcgttcaaatgggaataattgacatgaaagtgtttcataaattataaactttatggtggcttttgagttagtaacattgcatttctttaactcaattagagaaaccttgaattattataattttaaactgctaaaaatatttatataatttatattcaatgcatatgggtctaatattggaaaagcaaaagaaaaaatcagattcaagaaggaaactatataacatctgggatacattcagggagcaaagatgttgaagagttttttgaatcacgcttgatgaattgccgccatatttcaaagacctgaaaccatcactttgtattctctacaaatcaaagacaaggtactagggcttaatttagtaaactgagaagttgaagaaacatgataacaaaatcagaaatgaactttcccatacattaaaaacaatgaagtatttgagtatgcaagttatctccccttcaccttgaatgttattgaagacaagagagacaatagacatgtgcaggaaagcaaaagtaatggcagcaggtgtgggcttatttgaaaaggaaaatatagacctggtgtgcacttagaaatatttcactgatgccaggtccttgcagtttatgcagctacataaggcagatatttttctaggttgtcccacaaatgccagatgccctggtttcattttctgatggtttttatttttcctttgcttgtcattgacattttctgttgcttgcttctaattatattacattaattcttcccatttgctttctaaattattttgcagctattcttctccacttcctcagtatgattcaaggtgataactgtgtcctttatgtgaaccatcctttttgtatttttaatttatgtgaatttttgccatagttagatcgtgtcaatgtctgtagtatatcagcatttgtcatcctgctgttcctaaaactagaaacattcatgtattagttttaggatcatttgtagaatttgtgctatagtttaaatattaatgatacaaatattattatatatcacctttttaatttgttctataagttatgttgcatgactttttcacacaatatgtaagacatgagtttgtaaaacaaatcactatattttataatgttattaaataataggacccatgtcctgtttaatgaatagtcccacttttcctcagtctgttgactctatgaagttgagaacctcagaacaataaatggttgctggtgagcaccagccatgtactgtgtgctatacagaacacagagaaagagactcttccagtttgttgttaatatcatgttaactagtgttttttccattggttctgatattctttacagctgagatatttttattttaatctgataaactgtacgctaccttcagtccactcagctccaatcagctatctacctatctatccacccatcaatccattagtattagtaaccgagtctcacctacacagtttctaagcaaaatagttttattcattggttcattcagtaagcatttatcacgtccctattttgtgctagaattgtgcttggctctgcaggtcaatcagtgaacaagacagacccaatcagaattactctctatattgttgagactcagcggttgccagggcaaacattcccctctcagtggaaacattccagtgtgtgtgtatgtgtgtatgtgtgtactgacacaactgaatcttcaagcccagagtttgtcgtgaatcgttttaaatccattctgttactattattcctaatgaaaaattgatttttgtagttacaactacgaagtgcagggaatgatttgatttttgtcttataatattgccatattgccttcattattgaataaaagtagttgttaaatatacgtatgtctaagaaaatgtaggcagcccagagcaatttcaggtgagcctcatgtcttttagcattggtaacaattcatcccgacacttgtacaagtgaacaagtatctttttctttgactagggaggagtgatttttgttttctttttgtttttgagagagtcagtgttttccccttttaccttgattatcgtagtggtcccaatctcccaaaatcgatagaatgttgtaagagacataaattcattcagagtaaaatggttaaatccaaaatgagcaaaagggtatgaagacgagtccaccttactgatgagcagagttggttctaggaatctgataggctgaaaaatgatcgccagcccattgcctctgcctgtggggatcacaggccagtttgcttgaaaaggtcactctttcaaggtcaagaggtagcattcttcagaagacggtccccagctaggaagtccatgcaaggtcttaaaatctgtttgcaggatgttagcattgtttttaggggaaaaaatagtaaagatttttgatggatgggactttttttttctaaaaacactttaagaattccgacaattttctaattatcaccattttgtactgtgctagtagtaatctgtgtattttcatacgtggaaactagaatacagggatatatttgtgttcccctgtctgaccttaactcttccacacattgaactcattgatttatgtttacttataactctgtgataacgataactgtgttataactctgtgatgatgatagtgggaccatgcatatgtgatagaagacagtgattccaatatgcttctacccaaaaataacagttaatttctttatagttctatacctattaatacatgcagacagttttttccttattagctttaataaaaggccaatgacagaattatgttatttagagccattttctaaaagtctaagttccacttttttaatcattgtataaaatattcaaatgtaggttatttcagacagcttttaagcccatatttatactgaaaacatttaatctctttccatcaaaatcaccgtagcaaatctagtcatctcctgcttttattcttatattctgcttcatcatagtaaaaattagtgttggtatgattaaaaatacatttattttatgagtcgtaaatatcaagacatactgtggagtttcatcttacttgtaagagaccatatggcagcatatggcaaaaaccacttatagttaaaatgacctttgaatataaagaccacagtttttttgttttaaatgcatgagaatcctgttactagaccgattttactccagttttgaaaccttccttattccttccatttgagcctggtaaagtagttggcttttctatgggggccatgttccaccaaaaacaagttgtgtttcagtttttgcaaagtgcacaagttaaatgcatgtttgatgtgactccactgtattgacttctgatttatctttagaggaaatgatagctacattgtctgtcgctttaaataaacttaaacatttaatttccaaacttgctgtgagcacagtttatttccgtccttgaattggcctctgatcttctcccctcaggtttctggttagctttatggtggacgcgagagggggctccatgagaggaagccgtcatcacgggatgagaatcatcattcctccacgcaagtgtactgcccccactcgaatcacctgccgtttggtaaagagacataaactggccaacccaccccccatggtggaaggagagggattagccagtaggctggtagaaatgggtcctgcaggggcacaatttttagggtaagttgttttgtcaattttaaccttggccctcacaatgcatctttgattttctttacccttgttaactcaaggagataactcttaaaactgcttagttgtacctgattgagtatactttttgtaaagtgtcaaaggtcacaaagctgtgtgattctgtgaaaggctaataggctgatactttcttaactcagtttgctagtcaaggcttttactaaccgagaagcatgttctctgctcagcaagtgcacggaaccccagtggtccctgtagaagtcaaggcaccattctagggaaaaaatacagatgctggaattattttaccgcattgaatatatggctactttggggacatgtctttttaaggaaaattttttgggaaacagttcattgtgatatggtattttacaaaaaggaaaaatgaatttaattcattttctgaggtggcacttgggtacaaatcaggcaggctctgtcgtgactgacagtttgttcacaatttccccttctcgtttctctttctgctgcatggatgttattcagtaaactgcatcttcctaccaatcctccccctgtaaatgagggtgagagcttggttagccgaatcctgcagcttgggcctcaaggaacaaaatttattgggtaggacctttatagacaagatacagaatgtctacaatttttttttttccattttcaatttttttctgtcacacccatggtctgattcttgtcttaagtttatttttattttttaagttttttttaatgctttcagttgatgtgtgtcactgaaagaaaaaaaaatcatagtggcttgacttaatgtagcaccgctacctatcttgtgcttttcaggcatgtggaattcactgcaagcattctgctttcataacttcgtgcttttgtaaacctttcttttatttgaaatgtttcttctgaatatgatactttttaagacagcaaaagtctttaacccagtgtaagagaaggtatttgcaggctttgagtcaacatttgctatcaattacatgtatgtacacctgtgtgtgtgtgtgcgcgtgcgcatgtgtgtgtgtgtgtaattagatcttttaaaagtacatgagtactgtgtaattttttatgggctttgagaagaagtcatcaataagtaaactgattttgaaaagtgttgggaaaataagatatttaaataaaattaaataggcagcagatagagtattcttttaaagttataaaattgtttcgtttggttttgtttgagctgaaatgcattggtatttgttgtttgttcacttgtctgtttgattgttgtatttgccttggcagtctgcatgaagaaacctgttaatgaaaagctatgcttggctttcaccttgatcaaagacccttgttcataccttctctccaatatcattgaacatcatacataaagccacattccttaaatatttacagagacagtatctgacatattaacctgcaaagattgtatcttgttctcaaaaataaatacaatttaatgtttaattataaggtgtagttaaaaactctggtaaatatcttaatcttgaaattattaatactgctaagaacacttgattttgtttctacctattgaagaataaaggcattataaaaattattttttaatctttaatttgaatgaattatgattttgctaaaagcaaaatgaccatatttatcatccccgtttgaagcaaatgcttttctaataaatcgatattcatgtttttatttatattatttgatcattacaactactatccctttttctgctcttacttacttaagcctgtatcttctgttatcacatatacctaaacacataggttaagaaatggggttccatacaacctctgtaggagaataatgatactgtctacttaaatgtcataaaataaagctgcacaatccaactacataaactgtgtgtgattgtggtctgcttacttccattcatctcttttagtatttatcctattttaaaatttaacaaaattatttcccgtggcttgattggctatgttcaatttgcagccattcttttacattcctttgcaaaaggacactgtcaaaaattactgtgtcattatgtgacaatttcaaaccaacaagtacttttacagaaagtgtaagtattcctatgcaggttatattagagccaggaatggaagctacctactaccatttcacaaattgaaaaacacaggaattgtcttaactgtacaggccatgaaaagcatggaatctgcctgttggaggagtcgttaacatattgattgttttcttgctaaggagaaaatatagcaatcatctttcaaactaggaactttatagaatttttttttaaagaaatgactgtgtccttttaaatcattagcatttgtataatatacctattgtgtcttttaaaaatggaccaactttcttatggtctactttaataagtttccattctgattcaaaattcctatttatatgtactgaaaaatttcccccattaaatcctatgcctaacatatggtagtcctccaagaactgtttgtgaatgaatgaatgatggcatgttttcaggcttcgaaaatattctttaattagcaaatgattctgcagctttgaaatcattcccaaccttagtggcacctctgattttcaaatgaatactgttaacgaaacattttttaagtatgatactataaatatatttaatttgataccaaaataatgtggattttttttccagccctgtcatagtggaaatccctcactttgggtccatgagaggaaaagagagagaactcattgttcttcgaagtgaaaatggtgaaacttggaaggagcatcagtttgacagcaaaaatgaagatttaaccgagttacttaatggcatggatgaaggtaataatgatggctccttggttctgtaaatgtctgcaggcagaaattaaaggaatgactagattacatgaaacaggacctgaatttcacacatttgtattttaagctaggacccaagttcttcagcttttgttgctgttttctatatcataatgctgaagttccatttaatctaacaaactttattctccgtaatatagaagtataagtattttgatgattccatctttaatcacatacatcaatctttccaataccaaagaaagttttctaagtcaaaaatgagcaagaagagggtgaaataataatggaaagtatgcaaggcatgctgagcattttgaagaaaatatgttcacattttatttttggaattatttctggactctttcagctttttcaagtttctcccagataatttcagtatccttcataaatttttgatttctcttgggccataattagtctttaaaaaatgtttcagggtaattattggggtctgtgttgtttcaatgtctcattctttgacctagtaagactggtatatatctgagcatgtcactttttcatacacaacttcttcaggctgtctgaccctaagaaccagagcaatttttcttagtagacattgggaatagtctggttttgagaataggtgtttgacgcagagttttcctttaaaaatgtaaaaaaaaaaaaattagagaacaggctcaccataacgtctgatgctgagagaaaaatatcagagctaattcttcctttatactcacttcctaatcactccaaatccaggaattatttaaacaacagctttattcgagatataattcatattccataagatccactctttttcaattcactgacttttggaatgcactcagcatagtctccagtgagtttcaaggtgtgaacaaaggagcgaggtgaaccgtagggtacttgaggaatgaccttgggcaaatttattgaactctgtgagcctgtctttcttctgcaaaatggagattaccttcctaacttcctatggttattgttgagaataaataaaataattatgtgaggcacatgtgaaatacagtccttgttacatagtaagcccttgataattatgagttattatcaccattatatttgttctgtagaaaaaattgtcatgccaaaggtttggtataagacacaatcgccaccaaccatgaatttaaagatgtctttacagcaaggtagagggagaatagtaattgttgagtgtctagcattcatgaagcactgataaatgccttcatatgtgaaaaatttaaaaagaaaggatagcactgcaaatcaggtggttttaattccactttactgataagggtgctaatcaggtggttttaattccacttataaggaaactgaagttcagagatgtcaagtaacatatctaaggttattccactgagtagtaaggctggggtccaaatgtaggtctacttcttttcttttcttttcttttcttttctttctttctttgtttcttttttttttttttttttttttttttgagatggagtctcactctgtcacccaggctggagtgccgtggcacaatctcagctcactgcaacgtccgcctcctgggttcaagcaattctcctccctcagcctaaactaaggctcagagagattgagtgccaaactcaaacctacacgtgtaggtttgttatataggtaaacttgtattgcaggtgtttattatacaaattattctttcacccaggttcaaagcctagtacctactagttactttttgtgatcctctcactcctcctaccctccaccttcaagtaggccccagtgtctgttgtctttgtgtccacaagttctcatttagctcccacttataagtgagaatatgcagtatttggttttctgttcctgcattagtttgctaaggataatggcctccagctccatccatgttcctgcaaaagacaggatctcattcttttttatggctgcatagttttccaaggtgtaaagaaacaatgatgtaatcttctgtcttggattctatgtgttattttggaaaaactggatagcatttccttgccacatttttaaagaccagataaactttggttccattttagacaattcaaaggaaatgcatatacttccaggcttaaagaatcaagtactggagtccactagagcaaaaatgaggatggaattttcaaggcacagattttcttcatgtattaaacttaatagtaatgaagcaaccactacacacattttataattgaagctcagttaatcaaattgtatgccaaactcgaacccttctcgccactcttttcatatccccaaaaacacttcattcttaccagaactttcctctcttcaaaagcagaccagccaaaaaaaaaacccaaatctgtctttttaaaaagccaacttcttccttgaagggacaactgttcaaagttctagttcagagagaagcataagcacagtttaggaggtttcatgttttttatgttcttttatcctctctgttcccctcccattttgctactgaataactgttaattaacaagataaaaatagttcctgaattaaaccagtgaccaggtcactcaaggtttccttaaaaaagacaaataggccgggtgcagtgtggttcacgcctgtaatcccagcactttgggaggccgaggcaagtggatcacgaagtcaagagatggagaccatcctggccaacatggtgaaacccccgtctctactaaaaatacaaaaattagctgggcgtggtggcatgtgcttgtagtcccagctactcgggaggctgaggcaagagaatcacttgaacccgggaggcgcaggttgcagtgagccaagatcgcgccactgcactccagcctgacgacagcaagactttgtctcagaaaaaaaaaaataaattgtcttaccattatttaatataacgtattaatttcataacaattaagctttatctgtcatctgtggcaagtgacccttgataatgtctgtcttgttataaatgtttactttttcaacccccttctccatagatgaattctatgtgctactttataaccaatctacatgccacttttataaccagtcctgttgtaggttcttctctgaaaatcttaaaactcaagtatttaaaaatcatcttagcaaatattctgatttattaacacaattgtaaatatcagtttatgttcctatagtgtgttaaaatgtgtgaagcctttccatgtacgcaatcaaatttaactagtagaataactcctgggaaagagaagtttaaggagcaggataatttgccccatgtaatgtggtggttgggatcatgatttatggaagttacacagactagacttctcatcttggctccaccgcttactcgttgtgtgaccgtaatgaagcactcaatctctgagccttggtttaaatgtgtaaagtgaggatgcctaatagtgaactaataaggaatagatgagctaatatatgtaaagctcctagcttgatgcctgatatatgagaatcactcaatcagtgtttagtcatagtcacaactgccgtgtaagttgtgcaggagagcaaatggggtctgaaatcttgcccttttcacttgtcaagccatctgccctgacactggcctgtaagacataggggtactttcttctaatttgctcaaagctgctatctagttgccaacctgtgtacctacaaggttgtatacaccccaagtgggcacccttttccaaatcgtacaaagacactacatcagctagtaaaagccctggtcatcgttgattatgatgacacacactcaacatcgccaccacccggaaacagtaaatagatttagtcttccaaacctggacttctgactccacacctagttgtctctctgcactgctcctttgcctctgtatgctctcaaatgaatgatgcctgtgaaagtgctttgtgtagaacaaaagagccacatatatgtcagctggtatttaagttgtccgttactaatgaagacacctcttagtttctttgtatgacacaaaaaatatggtatgtattcaggaaaaactgtagctgcaaaataagggggaattaaaagttactccttatcaccagcaagcccagggactgaaatatcagtggttttgctaacgaagtaggtgtattagcaaaggtctattgaagaggctagaatcacagaaaggacagttggtctgggtgtgaagaacttgccatcaccactaaggtatcatgcaacaagaacaactttaactttggcagcagacatagattttgttctagtctttgtcaatttttgttttctcagccaagaaaaagatgctgcaaacagaaaacaaacattcattccccccaccaaattataacgcagcgaactgaattaactttttaagtttaatgaaaaccttcctttaattaaactcacaaagtttaattaaacatgtttaaagttacatctccaaagtcagaccccaaagagtgttttgtagtttgctgttatcttggatctggaattttctagtagaagaggtccttaatttacaaaccaaaagctccagaaatgttctagtcctgccctgtcccatacagtagccactagctccagggaacaacagagcacttgaaataaaattagtacaaatggaaatatgctgcaaatgtaaaatacaccagatacgcgaggatgagtaccctcctccaaatacatatctcattattaatttttacattggttacacattgaaatggtaatattttggatatattaatctaaataaaatgtacctataatcccagctactcaggaggctgaggtggggggattgcttgaggtcaagatttcaggagctcagcctgggcaacatagactccatctctaaaaaacaaataaaaaattaatttcacctgtttatttttattttttagtgtggctataggaaatttaaaattacatacccagtttacattatatttttactggacagtgcctctctggacagtgtgtatgctttgttttacatatctattttgttttaacacaaaaattgttgctacctaagtattacacggaaggctttgagtatatatgaattatgccattatttaaaaatcccaatcgctgtcttggaacaaaatgttgctgaagttcccccaaacaattttacaatgctaggaacatattttcttgtcattgctgaactttcaaatgagagcaaatgaagtttttaagataatacattttagattgaatagttacactattgttttattgtaaacaggaaagggaaattggtacttgctatgtaacagaaaattttttaaatttactgtctgactacataaacagtatcttagaaacagacttctcagaagttgccaattgggttcatttcaatataatttaattgtttttgccatgagaccaatagtgttaagtcattgtagaagcagttgagcactgatgtgaaatgtgtagctttatgttgtgcacagcaccatctgctggagaaatctagtaacagttttgaaaaattcccaaggagagaataaaaatagaatttaaccaaatcaggactgtggttggggtgcaaaaaaaaaaaaaaaaaaaaaaccatagcaaaatactgactttcagcctattgccataaactggcattttaaatcaattgaatgatgtccatcgtgttggaaaggaaaggaaactgtagcagaacagtcccccaaactagtagaaataaaaattctagtttagaaatgaaaattaggacaaagcaaataagcattaataaggacaggtttttaatgcatttgcatatatggatttgccagaaattacatgtctttatgaaacattagtggatcaaaataatgacataagccatcctgccccccaccccccatatcaggcacagtagagcttttagccctctgagggcagtgaagcaggtccacgaggttggacatcagcctccactacctttagtgttgatgtgaacagagagaccagtgtgccagaaactgcaggtctaagcttttggagtttagtgtgttctgtatttgctgctcatgcgaggttattgattcattgtgtttaagacactatttatgatcctggattttgaagatagaatcatattaattgatttttcccttagatgtaacagtaatggcttaaacaatggggtgaaaaaagtgacatatagggactaattgcctgaaaccatgtttttatttgcacaaatggaaaagtaaacaaatgtaagtctcttaatctgcagtcatggaagaaaaccttagaaggattattccagtgtggccagacgtcccctacttctcttcctccaggaagccctccctaatccccagactcagatcaaactggtaaatacacccacagtaccataactgcaactttgaactttgatatcttccttggtgcactgcaaaagtccaagagggcagagaccaactctgacttgttgacagccattatgcccactgcatataacaactcttgatacagagttgtcagttcatcatagtctgttgcatgaacggagaaatgaatgacttgtgtcaggcatatgccccccctgctggtgacactttttctcaatccagtgacccatacccaagagagagaaaaactttctggaagaagggaggctacaccaaatggagagaggaagtctggggcctggggaaggctctggggcaggttatggtcattctacacacagagtacaaagtaatcttaaatgtcaacactgaaggtagagttcaaaaaatggtcacatttgtccctgatttttaaagtaatatctcataagcacataatgattaaaaattaatcttctaaaaatagctttaaaaatatatgattgtcagaaattatattaatagactgctaaaactggagggaaaaacaagcaggtatatcattgtttccagacattctgcatcatcagcacttattacacgtgcaaatctaaacagcaaagaggatctctaccctgaataaagatgtgaaataatgctgacccaaatatatataaaccagatgacagaattggataagaatatgagttaaacactaaaattataaaaggtgcatggagcctttcgtactatctttgccatgccccatgaatttataattattttaaaataaatgttttttaaaacattgaaaagatctctatgatgttaacttcaaggaagaaggatcaagttatatcatttgaggatttttccctataacatcttatgtgaacttattatgaaatttgtgtattttgatggagctgaactttaattccaaagggataaatgcctgtagttttctaaactagttcagtaaatatattacaatgctatgttgttctacatattctataactagagttgaatattatagatttattttttattttcttcatttctcccaacttatttgatatttaattttcagtaattggtgattttctttaatggaatgaaatggaaatgatagcaattcatatttatattttgtagagaattatttttaaaatataacttgtgtattttcttagatctgctacagattgactctctggctgccctcaaaagctgtgtgacctcgaaaagaatatataactcttctaagttattatgtgaacagaattgtgctgggtggttttctgtcatttttttttgtcatatccatcccagaggaaactgctcatcctaatcacatagatgaggaacatatggctcagagaagttcaggaacttgcctgaggtccaggtgcactgactatagagctatatttcaaccctgggcacctgtctacagtgacttaccacagaccccataacttgctttttgaaatctaacattctaaaaatcctttactttttcacctctcaatatcaaataccccattcttagaggagctgagaaaagcctgcacctgactagaaattaaccctgatacacaaatcatcctttgggaaaccttgaggccatttgtattccttccatggactattcacactccaccctgaccaggtcacaagtagcctttgaaatctaaattgatacaggaaacagagctgtgtccccatttaacgaagtgatcgagacatttaattgtgtgcccataagagtgaggcaaaaactaatcaagatggtcatttgaaagcattaagagtaacccatttagtcagaacatgatttcagtcatgttatttatgcttcattgtattatggtctccataaccatttatatttgcaaagcattttatgattcttgttgtttgtaacaaagcctcagtcacagagaatgctgtcccaccttttacaaataaactgagttacaaggtgcttaagaaatttatcatttatctatgaggcaagaaggctatagaacattagtggctctgtaatcaggcctgctgcttagatgggtcaatgagaagtcaggtcaccttttcgaccacggcatttgcaaatctattcattactcatccgtttatcaaccaccactcgtgtgaggtagtctgcaaagacactgttaaagagtggttgaagtccatgtctgtgtgacttcatctctttccaacacccctttcctagacctaggttctaagctctaaaactgacgagctaaatccatctggacaagtcacttcacctctctgaacttcagacacctattttaccaaaatgctgtgtgggccaaatgataattgacctgacacaaaatagaccttcagtaagtgtaaagttcaatcttcctcctggccaaaactgcctatttcagaactcacttctcttttccctctaatcctctttttgtatgtgagaatttagtaacagattttaaaaagagagaggagagaggaatttcagggtcttttcatagtctatggcattatgaatcaccctgaaaggtaagaagctcttatgtttatgttctattgtttactttacagcaacttatgccatttttctccctcaattctgtagctgtggagttatttagaatatccttttaaaaaacaaaaccatataaaagtaatgaatatttatttttgccaataagcttttcttctcatattaaaccattcttattttttatagggtcctgttgtcatgtttttaacaatttgggttctgaatttttaagacaaagtacaggatgagagtctaccaagacattactttttcaaatgtgtcaaaaagtcacctgggtagagtgtgaaaacagatttttaggtttcactccaggtctgcctagtcagaagcccagcaatctgtggtactaacatgtagtacgattgtttcttacgaactggccaggttggaggacattgcattaggagctaggaactctgcagatgtgaatgtgatagtggcattgcatttgtgccgcagattattttgtcgagcttttttctgtaatgtataggatgggacaaaacaaaggattcttggtaatatattgctgcttctttgacctaattagtaaggaccgtttttaaaatctaaatacatataagttcaatcccagaaagaatattggcactgttcatttttacattatcaggctttattactatttgtctggaaatctgacttctctgatatacttttatcttattttattttatttctttctttatttttgagatggagtctcgctgtgtcacccaggctgcagtgcagtggcatgatcttggctcactgcaatctccacctcccgggttctagtgattctcctgcctcagcctcccgatagctgggattacaggcacctaccgacacacctggctaatttttgtatttttagtagagacagggtttcaccatgttggccacactggtcttgaactcctgatctcaggtgatccacccaccccagccttccaaaatgctgggattacaggcatgagccactgtacccggcctctgatatacttttaaaatatgtaatacaaaacttccagaaagaggtttatattcttatgaaagttaaactcattttgtgtaaatgttcattaagtaaacagtaatttgagttataaacacatggacataatagatttcactgtggattaaaaagtaggaagattagaaccactttttcacatgcattttttttaataaaaataaaactaggccaggcacagcggctcacgcctgtaatccaaatactttgagaggttgaggcagaggattgcttgaggccaggagttcaagaccagcctgggcaatatagcaagggccagtctctacaaaaaaagtttagaaattagcagggcgtggtgatgtacatctgtagtgtcagctactcaggaggctgaagtgggaggattgcttgagcccagaagttcaaggctggaatgagctatgatcataccactgcattccagccaaagtgacaaagtgaaacctcgtatctaataaaataaagtaatctaaaagaacaaacaataaccagtctctactagtacgtatattttatagcaagacttaaagaactgtacagttgtttgatgtgaaaagtgtctgagtctcattgattcccagctgatttctttggtagatgcttgtttagcacctgctgtgtgccgggtctcaatatcaaacatcatttaatttaatatagtttaactatggctaccttgctctttatgaaaagaacacctaatttttaaaacaactaataattttattagactcaaaagccttaggggaaggtactcatgatgccgagcaatgcggcccacagtcagggtgtgagagttagctgagtgtggagggtccttgcctccttcccccttggggcctctctccagctgtctggggatttcgttctctattttccagcactgagctaaggatattttgttttgtatttcactttccttttttaaaagcaagaaacagggaaaaaacaggtttgagttgaatgtgttaacacattaaaatgttatctagggttttatttacatataatatttattaatgctaatcctattaatggtcaggtaataagttttcagatcctaagaattctgtagtgacattactgatggctttacttcctccttttgccttttcacacttacctactatctatgtcatttattttttttttgacttatgcaatatcctagaatttcatagcctagccatcaactgcagcccttgaagaagagattatgcctttctttacaaaagaatatttaagtaatactttttgtatatttttgtatttttcttggcttttattcttagagaaaaaacttataaatatcttaagcacacaaacaggatgaaacctggttataagaaaccagagaggctgggcgtggttttcacgggtcatgcctgtaatcccagaactttgggaggctgaggcgggcacatcacttgagctcaggagttcaataccagcttggccaacattgtgaaaccccatctctactaaaaatacaaaaattagctgggcatggtagcgcatggctgtaatcccagctacttgggaggctgagacaggagaactgcttgaatccgggaggtgaaaattgtagtgagcagagattataccactgcactctatcctaagcaacagagtgagtgagaccctgtccaaaaaaaaaaaaaaaaaaaaatagaatactgtttctccatttcatcatgtagacacctggaaatctgactgttgaagaaggcagtgcatgtgattctatttaaggaatagtacatggagacactaaatgtcccccttgcctacagcagtgcctgaaattcccacattagttgtgtctttgagttggggcttatcttcaaaatactgttaaaatgtacattgaaggtcaataaccatgcaagttttaatggtgtcaaaagaattgctaaaagctttgaaaaaaaatgaacacaacacagagggtccctgagctgctgggaaattataaaatatgtcagaatttgaatgtggagggtactgatcgcttctcctcggagcttctctgtttatatagttagaaatctgagcatttccacttgcaacttgtctgctgcatctgaaatgtacatgttcactttatatttggggtggctttaatgccttatcaaaggtgacagagtagagcttaagtgtggtcagcctgcctctatcacgcaaagtggcaattcttctcaattcagtgctgtcatcgttttcgggggtgttatagctgtttctttctacttttaatcctcacaaatgtgtgcacatatacccagaactctctcacacacaaaaatagctaagaagtgtacagtacttccagttccccaaaagatgcctcagttcctctggtgggtctagactgatctcaagtaaatttcatactcacaggatacacagcttgttataagcagaattaggaaatctgccccatttgaaggatgtaatttcatgatctgtcttcttaaattgctagcaccataaggagtcctgagccattttgaaggagaacatgacatctttgtggctgaagtgaaaaaatatctgcttagctgatgatgatatgttgtatagcgatttaaacagataatcagaactttctcagttgcagcatgagttatgaacttgaggaattcactctcttaagccaaatcatggagagggaaatatatttgctttctatggaaaacgtttatctcctttcagttacattgaataggtgaaaactcccccagaatattctcctaagcaaactgtttgattctttcctatttttctgtaggaaaactttctttttaaaaattctggccgggtgcagtggctcacacctgtaatcccagcattttgggaggccaaggcagccggattgcctgaggtcaggagttcgagaccagcctggccaacatggtgaaaccccatctctactaaaaatacaaaaattagctgggcgtggtggcacacgcctgtaatcacagctacttgggaggctgagacagaagaattgcttgagcccaggaggcggaggttgcagtgagctgagatcatgcccctgcactccagcctagccaacagagtgagattctgtttcaaaacaaaacaaaacaaaacaaaattatttgttttcttttcttttcctacactaggatttcagtgtttaggtttacagagaagaagatacttgaggaggcaaaaaggagtaaaattgcagttccttttttttctaatagttacttttttaattaaagaagaaaatagttctatagtcattgttccatttgggaaatcaatgtttgataataaaagttctgttggtggctcattttttaaatctgggttgaaccctgtttctctcctagttgataatttgatcctcccatctcagagtttagtggttgatccgtaaaatgaaaaagatgtattgatccaattacctaatcattcattttgtcattctacaagtttctatttgaaataagccataatctcagcctcacgtatctgataaaggaggcagaaatgttaatagtgaagggacagggggacctgtgcagtatgtatcggaggtctgaaaagagtcctgtaggagtaatgaacaacaaaacaaccccccatcccccaaagtttgggaatttttcctttattttgttaataggtaaaacaagcatagctatatcaacccaagggtaatactccttgttccctaccctcttctcatcttccttccccaattccatttcctgttcctctgaggtaaccattgctaacagcctagaatgtttcttctacatatttcttataaaaatatacaaacgtagcctggcgcggtggctcacgcccgtaatcccagcactttgggaggctgaggtgggcagatcacgaggtcaagagatcgagaccatcctggccaacatggtgaaaccccatctctactaaaagtacgaaaattagctgggcatggtggcgcatgcctgtagtcccagctactcgggaggctgaggcaggaggggtgcttgaacccgggaggcagagcttgcagtgagtggagattgtgccactgcactccagcctagcgatagagcgagactccgtctcaaaaaaaaaaaaacaaaaatgtgcagattacattttcccctataaaggatgatcctgtgcacattgctgtgcatcttgctcaggtgtacagcaatttccgcaggttatacagggcagtcgctctttgtctggctccctcctatcctccctccagtctaccctctagtgtcacatctcaaatcatcctgttcaaacgagaaactctcctcccacccccaccctccctggtcacattctagtccctcactttgatttattttttcttcatatttgtttagtgatgtatctacccctctttatcccctattagaataaaatttccatgtgagagtgactttaatttcctttctaccctatccccagtgactagatcagtgctctacatggtggtccctcagtaaaaacttggtaaatgaatgaattggaatcattctgtttactaactgcaggaatgtctaggatatgggtaaactgttacttatgtaaccattcccttattcatagagatgcaagttctttcaagctttagtctttataagcaatgctgccgggtgctgtggctcatgcctgtaatcccaacactttgggggtccaaggttggggggatcacctgaggtcaggagtttgagaccaggctggccaacatggtgaaaccctgtctctactaaaaatacaaaaattagctgggcgtggtggcgtgtgcctgtaatcccagctattcaggaggccaaagcaggagaatcactagaactgggaaggcagaggttgcagtgagccgagatcgtgccattgcactcgtgggcgacacggcgagatctgtctcaaaaaaaaaaagatgtcagtaaatggtattgctgcgtccagggtaggtgcattttcaatttgaatagatgatgcccagttacactgttaaaaaattattgccattcacacccacttgcagtaatgaaagcacttatttcccttaatttttctctgataacaagatgtgattagtgtttaattttagctaatccaagaagtgggtgtggagggagatagtatctcattctaattggcatttccatgtaaattatccagtttgaacattgtaatatgttttattgaccatttttcagcttctgtgaattgcctgtttataatattttgctatcatctattgacttatctgccatcctattattaatacgtttggtattgagcatattaatcttttacttgtcaggtgtggctatttttccagtctactttttgcttttcaagtttactctttttgtcatggaaatctttacatttttatgtagtcaaatatattaccttttatattatgcttttaggcttctgggtttccagttttgtataggaaagtttcccctaactaaagcgaaaccatattttcctgaattttttggtaagattttaattttttttttggaaatggagtctcactctgttgcccaggatggagtgagtggcgtgatctcggctcactgcaaccttcgcctcccaggttcaagtaattctcctgtctcagcaccccaagtagctaggattacaggcgcatgccaccacacccagctaaattttgtactttttagtagagatgggatttcaccatgttggcccggctggtcttgaactcctgacctcgtaatctgcctcggcctcccaaagtgctgggattacaggtgtgagccaccacgcctggccagattttaatttttaaaaatagttgtctcctaagcaaatgtaattttttatttatatacaataagatgtgatttagctttgtttttccaaatagatttcctattatgtaaataccatcttttaaataaatcatctttctctcacttatttgaaatttaaatatattaccttgatttaaatataacttaaatacataatacatatataaaagtatatgtggatttatatatattcagtatacatatttaaacttgaatctatttcttgattctctattattgtcccccaacctatttgtctattcctatgtataattcttatatttctatatgtgtgtgtttaactgtttaattattgtacttctgagtaaatcttaatatcatataagataaattctccgtcacaaacctacttttccaaaatactcttgctaatctcaaacacttattatgccataaaaatttttaatcatttattccaatgaagcccaccagaattatgcataaaatttggctttgaaacacacatacatacacacacacacacacacacacacacacaacctggatggactggagtgagagaggtgagttggttgggaggtggtcttagcaattaggcaaactaaaacagggcctgaacacccgggtgacaggagggtgagccacgtccaaaagagaatcaactggacttggactttgaccatttgttaaggaagttgagtcataactattagagtgaaggaatgagcagattgtaaacccttcctagagttaggactatggaggaaagtacttttggaggtagacagcagggaagaagatgtatccatttgtggacaggttgagttccacgcatgagagccatcagtgggcacaaagaaattggtgatgatgatgctaaacatttggataactttaaaatatttgaaagaggtttttaaatgaagttctggaactttcaggcatacttaagttcttattcactttcttatgaggcctcacttttttttctttttcctaactcatttctacttttggcagcttgggggcaaattattgtaaattcccattcttgttcttgaaaactgggaatttatccacaggtggcaaaatgtcagttcttgaaaatgtttgttcccactctgtaaaaatattttctacaaatacttatattaatagttttataatatttttgcaaaacccaatattttatggtcactaccattttctctttatcataaaaactgtttaggctatggagtataaatgattttgactattaaaatgatgtattgcctgggcccagtggctcatgcctgtaatcccagcaccttgggaggtcgaggcgggcagatcaccggaggtcgcgagttcgagaccatcctggccaacatggagaaaccctgtctctactgagaatacaaaattagctgggcatggaggtgcatgcccgtaatcccagctacttgggaggctgaggcaggagaatcacttgaacccagaaggctgaggttgtggtgagccaagatcacgccattgcacttcagcctgggtaacaagagtgaaactccatctcaaaaaaaaagatatatcattttgacttaaggtatgttgtagatatgcttattctcatggcattttctttcatttgtcttttcagaacttgatagcccagaagagttagggaaaaagcgtatctgcaggattatcacgaaagatttcccccagtattttgcagtggtttcccggattaagcaggaaagcaaccagattggtcctgaaggtggaattctgagcagcaccacagtgccccttgttcaagcatctttcccagagggtgccctaactaaaagaattcgagtgggcctccaggtaatgttcacaaaaagttgtttccctcagtatgcgcagagagcatgtgagtgcatgttttgctctggaaagagttattctaacatcctaatgatactgctaattaggccgtttggggaatcatttacctatttcagataaaaagcatcaagtataaagttagcttactggcttgttaaataaggtacatattttagggttgttctgtttaaaagtctcagttagtttctgatgaaaaataattttttaaatcataggttattggtctcagtatgtggaacaacataccaagccatggtttatgatatgccacatcataaaaatcagttatagtgaagcctgcagactttagtgttttgatttgattgaagtaaatcataaatactgggttttatccaaaccagttggaacttgatttggtttggaaagctggctggaaatcttggatcaaaagatttttcttgtatttatttcagctagactttagttctttttttctttattgaataaggaaaatgaactaaagtaacttaatagatgttattaatattgtaattaatagtttaactgaaggttcatgttcttcttgtgaggctggactctcctgcccaatggagttaactgggttttgtttgtttgttttgagccaagcatacttaagtcctgagatgacctttaataagtagttagcactaacgagaccaccttacatttcaggggtatgaagctcccttcacctgcctcccataccaagttattttaccaaacagaaaagaaaccaagtggtagaagagaggcttagtagactagaattgaaatcttttgaaattttgaatgcattttgttattaactctgaaagcctcagtttttatgtgggtatgagttgcctttaggaggttttactgaatgtcctgcataggtttaaaatatattggactcagcatttattgtcctttaatctggactagactaagaaacttctatgccgtgagactggatcccctctctttcctgcaagccagtgctatttgtgttctactggggaaatactcagactgaccaattcctgtcatagtgtttggtttcgtttattcatgctttcctaaaatagtaagaaaggttaaaaaagacctgggtttttttttttttttttggttgtctgtttttgtttttttccttctcacttaaaaagtaaacttcatgattgggaaaaaaaaaaaaaaaagtcactttcatttaaagtcctttctctgtctctaggcccagcctgttccagatgaaattgtgaaaaagatccttggaaacaaagcaacttttagcccaattgtcactgtggaaccaagaagacggaaattccataaaccaatcacaatgaccattccggtgcccccgccctcaggagaaggtgtatccaatggatacaaaggggacactacacccaatctgcgtcttctctgtagcattacaggtttggttaagtcactgctgtacttcctattgattcacaaagattgtgtacaaagatatatttgtgtacaaagatataaaacctttgaaatatccatgccaacattataagagaaaataaaagaacaaaacattttacttgtccatcacctcatctctggtttcccaaggatcatttcttgggaagatcctggtcaagatcctggtctcatgactcatttaaaatttagtgatagcatctttcctgctattaaggttagcattagtagaagtatcattgaacctactggagcatctaggtaatttctagattcaatctaggtaatttcttggtgacctagacagaggtaatggacttagcaacatactttaaactacaaggaaattgggtggactttgggaaaaatacatgtcccacagagcactagtaataggaaattgttcagtacatggttattctcacctactgtactcgccagtgtaatccgagagtttaaacattcagggctcagaagaacacattttgtgataagcacctggaatctagagctcaattcatcctttgattatcctagtccgatttttaactgcaattccaagattattaaagatagattttgtttttgatcttcttttgttctctgaggagtaattttaatggctgatgcccctttttaccctcggtaattaattgtacagaatgccatgtacagaatgagctgtttcttaactttggtagttcttacctttttaaagagtaagaggctgggcgcggtggctcacgcctgtaatcccagcactttgggaagccaaggcggtggatcacctgaggtcaggagttcgagaccagcctggccaacatgatgaaaccccgtctctactaaaaatacaaaacttagctgggcgtggtcgcaggcacctgtaatcccagctactggggaggctgaggcaggagaatcgcttgaacccaggaggcggaggttgcagtgagccgagatcgcaccattgcactccagtcttggcaacaagagcgagactccgtctcaaaaaaaaaaaaaaaaaaaaaagagtaagagacttaattatccatctgaaacaaccaatctttgcacttacaaattgcatttataaaatatacttataaattgtggctgccccaagtttaagccattcattagtacccagacaaaaaacaaggaatttttttttaatttaatatcatcttacaaggaaatcacaataagcctggtaaaagtataaaaggagagtagagaggaaaactacctttagtacacactattaaactgaaggtgttgaagttttgccagtttgtggctatgcagaaagaagaacaggatctgatgaaaattttacaaggagcatctcccatgataaagtcaacatatctgctgttgttctctcagggggcacttcgcctgctcagtgggaagacatcacaggaacaactcctttgacgtttataaaagattgtgtctcctttacaaccaatgtttcagccaggtatggaaataaaggattccaaaaagcagtaaggaattagtttttattaccttttggaaagtaaaaattgttgtgttcaatactaaaaaaaattgttgtgagaaaaaaaatccgtagtatttgcttatcaaaattatcctcaaataacaaacagagggtttctgtgtttgatacatcgaaaaagcatctttgctgtttaaatgaacaagttaataacgttttgggttagttcctttacatattctgatttttttaattgtgagtctttttaagatttggcttttaaatagccacattttcatacttctgttttttgttttgctcagattttggcttgcagactgccatcaagttttagaaactgtggggttagccacgcaactgtacagagaattgatatgtgttccatatatggccaagtttgttgtttttgccaaaatgaatgatcccgtagaatcttccttgcgatgtttctgcatgacagatgacaaagtggacaaaactttagagcaacaagagaattttgaggaagtcgcaagaagcaaagatattgaggtaccttgttcacaaaaacaagttcatttcattacgtactccagatatgaggttttattttgtggtcttaatagcactcactataaaataccaagtgcattattgattttacttttactttaaaaaatttgatatagattaatactcaaatttttttatcttttttaatttaatttaatttaatttttttttttttgagacggagccttgctctgttgccgaggctggagtgcagtggcgcggtctcagcttactgcaacctccgcctcctgggttcaaacaattctcctgcctcagcctcccaagtagctcggattacaggcgcctgccaccatgcccagctaattttctgtattttcagtagagatggggtttcaccatgttagccaggctggtctcaaactcctgacctcgtgatccacccaccttggcctcccaaagcgctggcattacatgagtcaccacgcccggccaatactcaaattattttaagtgtctctggggctgtcttagctggttaaaacatagcactaatgaatttaagttatggtctccattttcctgtggccacttgagttacctacttttcagaatcactgtttatacacattactatgattttcctttttcaaacccagtgagcatgtaagtatctaacagtgcaaaaaaaaaaaaaaagctttcaaaatctatacgaataagtgattgatgtcaggcacattcttaaatatttttaaagttgccagaataaaaataaatgtgtaattctgttctgtatatgtccatgatatggattccaattacagttggtgagttgtaagcacacaacattatttttgttgcaaatagcaccacagaagtaactgcctaatagagacacgtgtaacatagtaacgtcagtcttttaacgttacgtgacataaaatctcaaaatattttaaactcagattaacattaaattgtttatttcttttactctaaaaggttctggaaggaaaacctatttatgttgattgttatggaaatttggccccacttaccaaaggaggacagcaacttgtttttaacttttattctttcaaagaaaatagactgccattttccatcaaggtaaatcatctttaacagagaatctgtgaattatggggaaaaaatactcttagagaataaaaataaaaggttttaatgatttatttaatttgaaataccccgtcaaatctgaactcataaggtcagattttgttctggttctaccagagtatactttcaagccagtaaagctttacaattggtaaaaaggatcattatttttcaaagagtttaataacatttatgtttaagcaaacatttgtaaaaccaaacaatttagagtaatacaatgtgttatttctggttaatgttcagtaatcaaataatggatgaaatgcaaatacagtattcaagtttcattttcatttctggtggagcccagggacgttctagagggatcaccttctctctccaagaacagaaggagagaggaaaattgttttgtcattattatttgctgttactgttgcaaaagctggagctttcagaaaaaaaaactgttagaaggaaaatgcacataactcagactgtactatgaattgtcaggattagatcatcagacacaacaatcctgcgtttaggaatcgggcatctaactcttgctgagttcagatgtgaccaccccggttgctgcataatcgtaatcatcatcttttccctttacctttcctgcctctcatagggcttgataaaacaaccatgcttaactcttatacagttaaaaatcctcagataagtctcattctataaccatcaactaccaaaattcttctagattagagacaccagccaagagccctgtggtcgtctgtcttttctgaaagaaccaaagacaacaaaaggactgcctcaaacagcggtttgcaacttaaatatcactctgccagcacataaaaaggtatcttttaatactgctttaaattgtctttccctggtcttgaagaagtgggcctttggtatgcaattaaggaatgctttgtaacatgaataaagctcttgaaactgaagttgtattagtctcctcgtgtagattgcctaagtcttgttaatgtggtgtcaaattcttatagtttgtatgatggagtcttctctgtttatcgcttttgcttctgctggtagcgcatagatttttatgcttttaaataacgtcatatgttaatttgccatggatgtacagttcttgatattttttgttggctttttttaaaatttgctttgctttctaaatcagcttgcatttgtgctccctactcagtccttttcatatcctgatattcttttccctgctgtccattataatattccttgtctctgcaatgcatcttggaaccaaaaggagacagagtcagatcaagatgatgaggtaatataaacacttctgcttttattctatcagaagtagaatagaaattgaatctgtatgacagaagttgcagagggctaaagtgtgggaaacatataaattatatttttcaggtcttaagtaggtaaaagggtatatatttttcttaaatggttcactcttcttccacacgtacttaagagtacttaaatatattcaacgaaattataattcagctgatgattcagaaactgaaggtctttaaacatttttaaatatggtagattggcatgtataaataaacgttaaaaatttttttagacaagtcaagtgcaatagtgagaaagggggaaagagtaggaccaggaagttctatctatgactgacgagaacagtcaactgagataacgcactaccttcgaacccgccaaatagacattttgtgaaagtttcatgtgcctattttactatcaactatatcctactatccagcatgttataacatttaaatcaagatcacgtttaatatgtgcaattttattgtacaaataaacttatgttgtatgtgatacaaaatatttgcttactagctattgataaatctttgatactctcactaaagaaatttatcttgaccatttttttaagaatatagttcaattaagttgtctcctaatgtttctctaagttatatgataattaggtttttgaatcccacacatcaatagtaataaatagaatcaagtagccttaggatgcagtaatagtacctctggccaggcgtggtggctcacgcctgtaatcctagcactttgggaggccgaggcggggatggggtgggggaatcacctgaggtcaggagttcgacaccagcctagccaacatggcaaaaccctgtctctactaaaaatacaaaaattagctggacgtggtgctgcatgcctgtaatcccatctactcaggaggctgaggcagaattgcttgatcccaggaggcagaggttgcagtgaggcgggatctcaccactgtactccagcctgggctacaagagcaagactccgtccctaccctcctctgcccgccccaccaaaaaaaaagtacttctaacaaaaccattcatctgttttcaatctcctcatctacactttatgcctgttaacatacagaatccccagcagtaattggaataataaactttgtgtgcctttctcccttgaatgtactcacatagagtgagtgtactttgtgatatatgtgctttcaatatgaacagttccaggaaaatttaatgctcagcatcagaagtctctgtaatgcttgtcttttacttgtacttccctgtagtctgctgtgttggtgctcttaaatttgccaaatgatgattttggttaagacatggggggtggggttacaaaatcccagtgggaaattaacatttcctaagaaggaaaataaacaagttatcaacatgccatcctacaaaatgtcttaaaactgaagatgtcacagggaagttggaaatagagttgtctttttttttttccttttcagattgagaaaacagatagacgacagagcttcgcatccttagctttacgtaagcgctacagctacttgactgagcctggaatgagtgagtttcctaacacatttactaatctacgtggattttcataagaagagacattttttctatacaaaccaaattttatcatttggaaactcaatggcaaaagaaaaattgcctgcaggaaaaccctgtcatacaacctaagtaatattttgtgcctagttgaagatgtgaggtaaaaacgcccctagctcatacttcaaaacagtttttaaagccattaactatttttaaattagaaacatgtattacttttcttttaaaaccttgatttttactttgattaactatgctaggagataaatatgaatgttgctttagatctatgctcagatgaaaaaaattactcaaatatttggaatggtagaaaaatgataaagttactttgtcatctcatttttctcagtatagataggttgtcatatcctagtcccgattctttttcttcccactttgcaagaatcacgtttccttaccttcttgaggtagcacttgtttacagagttcttctttcctccctccctccctctcacttcctctcctcctgtcctttattaaaatatcagttctaaggctggtcttcactagaccagttagacccttttcttttctcaatgatcgttttggttcattgttagctggcatgcacttattaagatacagattcattcagtcctatctgtttatatattctccctctctctctctctttctgtctgcctcctcctccctttccttccatcatccttgtaatcatcacctctggtgatctctacagccctcaagataaccccctccaccagcaggaactaagggtattgagctcagcattgtatttgactgacatattggtgccactttaaccattctcctcattttaaatgaggggaaattatacaaaaattattttttaattagtgaatcattcctagctgtttcccactgacacagtttcttaagttcaaggaggtctggaaatttgccagtaagagtcacatctttggcttttcccaccttttctgaagtcttgtttttatgggccaacagcatagcatataagatctgcggcaggacactactgcaccacttagttgagatggtcttagcgtcatcttctggagcctagctccttgactattagagaagtttcaatatttaaatacaaaatggagaatataagagaaatgaaagaaacctaccacattcaagaatgtttcctcagatctctgttctcctctagcagaaatgtcgaaatcctcccagaaacataagggctgaaattaactcatattatgctacagagcagaagaggggtgtgtgtgtgtgtgtgtgtgtgtgtgtgtgtgtgtgtgtgtgtgtgtgtgtagctaggtagctaggtggtttccagtagaattaaatacactggggaagttttctttggaatactattttgccctagagatcctcagtgggtagttggttgagaccctgtaggcaacatcgttaagctttggacaggctcaatggaccagccgctttaggtcggaggccccttcaggcaggtgagtttccatctgattctggttgctaaggcaaagtcaattgaatgtttcccacttataatagtgttactggttagatccagctaaggtgtatgcagcttgtgttcctggacttttggtagaagaggagcgaagttttctgttttatgaaagggtacataagggtggtaaacaagggaatgaataggaataggaagtgactaaaagaaaagtaagtctcaaaactggtgttatgggaactccaagtgaatgccacttttccttcaccacgctgcctttccaaccccttccccccaggaaaaagattctggattagttcggtgcctgacatccagaaattccctcttataaagggatcccaaaatatatgtcattaaagcataaaatgtgtaactgattggtaggttggttgttccttgcgaagtataaaaccatagacgtggttcaaaagatttctttgcctgatagagccagccttcagtggtaaaggatagatgctttgtcagtgtctgatagttacaaaaataaatgcttgtgagacacagactaagctcaaatcattgaatttgaaggaatctgcaaaccttccatttgcagcgtggcatttccaaaagagttcagcaatataatattgagaattatggcaagaaggggtaatgaataggcgagtttttccttagttcttccactttctttagaataatatgtaagcctaggaaaggatatgtttggaatgtttgaatttaaatgtacactagaaatgaccatcttcacccttgtgagagtagctgctaatccaaagactggactgtagcaatggcacgggcacagcatgaagaagaacataaaagctgaagcagattctcattttctctttgagtttcactattctgaaccagggctttcttggagcaaaactgtattcacctttgatgtagaacattagccgttggcaggccttgcaaatctctgaccagtttggtttgtttgagttgtagaagcagagaggaccaagtatgtgtttgtgctccccagcaagtgtgcttacttcatttgtgtgtttcttgctccattgccagaagaaatgctggtattactatatccattcttcctagtggtaggtctccctcgtgactgcttcagtgtttgtgatatccataagtcccatgaatattatgggaaggcaccagaattggtacctttgaaattgataaacatatatacacacaccccacatatcctactgtaggtacttaaatatggggtgttaaaaatatgaatgtagtttttagatgtcccccatgatagcttttgaaaattaaatgtagattaggttatgaaaaaatatctgagataaactatatgcttttatccatattgaagagttgcagacatggacgtatgtagttgcaggtgattttataacttgcagtagaaaatattttcctaaaatctcaaaaggtaccaagacttcatatctcatggaaaaagtgtactcttctttctaaatgcccttgtgaaagtatctttaaagtttatatattgtgcataatatggcatacgaattgtattacttcattggcttgtttgccatgatatattgtgcatgataaaatgttttcagttgctttgcttgcttatggtaaccatgaaccatattttctgtttttttctttgtgtgtgtatatgtacacatgcattttaaagtcatttcatattatgttttcttttcctctcatcaaaaggaatatactgcatggaaaagataaatgcaaacattccttttctttgttttttttgtttaaaattctgactcagaaaacttcttgctcttattggctttttatgggtgtaaagcataaccgaactgtgcatgggagatacagatttaaaatccagtggcttcacagtttgcacatcagttgcctgtcacttaaaagttattttggattctgcatgaaataggcttgagtggttttggaaaaaagttttagatatttaatgtatagctacatatattgaaatggttctaagtaggtgcaatctgtatcatggaaaggctaaaggagagagaggacattagaaattactaaaatgaaagttgtatggttgcacgaaacaaacatgtacctatacaggcaaaatagaatggctactgatatttcaaaaccaacacataagaaagtcaataggaagtagggaacagttttccattatggttatttttctcatcattaattctttcctcatgttttctatttttcattgtttgcctctttggttgcaatgtgctttttctttcatttcacattactctgttttttatttagttgtttttttttaacttcagattagttatgtctgtagaaatttgtttttcctcttaattgttccttttgcctcttccattctaaatcatgcaaacaattgtacttgcttttgtaatatttcaaagtttactgaccaatttttttctctggtctctctgtttctcaaccatttttgttgatttttgtgtttgatttcattttaaaatttaagaaacagttgaacggagtacaggagcaacaagatccctccccaccacttactcatacaagccattcttttctacaagaccataccagtcctggacaacagctccgattacagtgcctgggccagccaagtcaggcttcacttccttatcaagttcttcctctaatacgccatcagcttctccgttaaaatcaatatggtctgtttcgacaccttctccaatcaaatccacattaggcgcgtcaactacatcttcagttaaatccattagtgacgtggcatctccaattagatcctttcggacaatgtcttcgccgataaaaactgtggtgtcacaatctccatacaatatccaagtttcctctggtaccctggctagagctccagcagtcacggaagctacgcccttaaaagggctggcatccaattctacgttttcctctcgaacctctccagtgactacagcagggtctcttttggagaggtcatcaattactatgacaccccctgcctcccccaaatcaaacattaatatgtattcctcaagtttgccatttaagtcaattattacatcagcagcaccgctaatatcttcacctttaaagtcagtggtgtctccagttaaatcagcagttgatgtcatttcatcagccaaaattacaatggcatcttctctctcatcacctgtgaagcagatgcctggacatgcagaggtagcattagtcaatggatctatttcccctctaaaatatccatcatcctcaactttaattaatggatgcaaagccactgccacgttacaggaaaaaatttcttctgctacaaactctgtgagctctgtggtcagtgcagccactgacacagttgagaaagtgttttctaccacgactgcaatgccattttccccactcaggtcatatgtttctgcagcaccatcagcttttcagtctctaagaactccttccgcaagtgcactctatacatcccttgggtcgtcaatatctgcaactacctcatctgtaacttcatcaattataacagtgccagtatactctgtagtcaatgttttgccagaaccagcattaaagaaacttccagactctaattcatttacaaaatcagcagcagccttgctgtcacccattaaaacattgactacggagacacatcctcagcctcacttcagtcgaacttcatctccagttaagtcatctttgttccttgcaccctctgcccttaagttgtctacaccatcttctttatcttccagtcaggagatactaaaagatgtagctgaaatgaaagaggacctaatgcggatgaccgcaatactacagacagatgtgcctgaggagaagccattccaacctgaactcccaaaggaagggagaatagatgatgaagaacctttcaaaattgtagagaaagtaaaggaagacttagtgaaagttagtgaaatccttaaaaaggatgtatgtgtagataataaaggatcacccaaatcaccaaagagtgacaaaggacactctcctgaagatgactggatagaatttagttcggaagaaatccgggaagccagacaacaagctgctgcgagccagtctccatctctgccagagagagtgcaagtaaaagcaaaagccgcctccgaaaaggattataacttgaccaaagttattgattacctaacaaatgatattgggagtagttcactgacaaacttaaaatacaagtttgaggatgcaaagaaggatggtgaggagagacagaaaagagttttaaaaccagcaattgctttgcaggaacacaaactcaaaatgcctccagcctccatgaggacttccacctctgagaaagaattgtgtaaaatggctgattccttttttggaacagatactattttagagtctcctgatgacttttctcaacacgaccaagataaaagtcccttgtctgacagtggctttgaaacaagaagtgaaaagacaccttcagccccacaaagcgctgaaagcactggtcctaaaccactttttcatgaagttcccatccctcctgtcattacagaaacaagaactgaagtggttcatgttatcaggagctatgatccctcagctggggatgttccccagacccaaccagaggagcctgtgtcacctaaaccttcacctacttttatggaattggaaccaaagcccaccacctctagtattaaagaaaaggttaaagcatttcaaatgaaagccagtagtgaagaagatgaccacaatcgggttttaagcaaaggcatgcgtgttaaagaagagactcacataaccacaaccaccagaatggtttatcattctccaccaggcggtgaaggtgcatctgaaagaattgaagaaaccatgtcagtccatgacatcatgaaggcctttcagtccgggcgggatccttccaaagaactggcaggtctgtttgaacataagtcggcagtgtctccagatgttcacaagtctgctgctgaaacctcagcccagcatgcagagaaggacaaccaaatgaaacccaaactggagcgtataatagaagtccacatcgaaaaaggtaaccaagctgagcccactgaagtcattattagagaaaccaaaaagcatccagaaaaagaaatgtatgtatatcagaaagacttatcccggggagatattaacctaaaagattttctgccagaaaaacacgatgcttttccttgttcagaggaacagggtcagcaagaagaagaagaacttactgctgaagagtcattgccttcttatctggagtcttccagagtaaacactcctgtgtcccaagaagaagatagccgccctagttctgctcaactcatatctgatgactcttataaaacattgaagcttttgagtcaacactcaatagaataccatgacgatgagttgtcagaactaagaggggagtcttacaggtttgctgagaaaatgcttctgtcagaaaagctagatgtgtctcattctgatactgaggaatcggttacagaccatgcaggaccccctagctcagagttacaggggtctgataagcggtccagagaaaaaatagccactgcccccaaaaaagaaattctctccaaaatctataaagatgtttctgaaaatggtgtaggtaaagtgtctaaagatgagcattttgataaagtgacagtgttgcactattctggcaatgttagtagtccaaaacatgccatgtggatgcgctttactgaggacagattagacagaggtagagagaagttgatatatgaagatagggtggacaggactgtgaaggaggctgaagaaaaactgactgaagtgtcacagttttttcgtgacaaaactgaaaagctaaatgatgaactgcagtccccagagaaaaaggcacgccctaaaaatggcaaagaatattcttctcaaagccctaccagtagcagccctgagaaagtgctactgacagaactgctggcatccaatgatgagtgggttaaggcaagacagcatggccctgatggacaaggcttccccaaggccgaggagaaggcacccagtctgcccagcagcccagagaagatggttctctcccaacagactgaggacagcaagtccacagtggaagccaaaggaagtatttcacagagcaaagcaccagatgggccccagtctggattccagctcaaacaatctaaactcagttccattagattaaaatttgaacaaggcacacacgcaaaaagtaaggacatgtctcaagaagacagaaagtcagatggccagtccagaatcccagttaaaaaaatacaggagagcaagctacccgtctaccaagtttttgctagagaaaaacagcagaaggccatagacctcccagatgaaagtgtatctgtgcaaaaagattttatggtattaaaaaccaaagatgagcatgcccaaagcaacgaaattgttgtaaatgattctggctctgataatgtgaaaaaacagagaactgaaatgtcaagtaaagcaatgcctgactctttttctgagcagcaggctaaagacttggcatgtcatataacctcagatttagcaactaggggaccatgggacaaaaaggtctttagaacatgggagagttcgggagccactaacaataagtctcagaaagaaaaactttcgcatgtacttgttcatgatgtaagagagaatcacattggtcaccctgagagtaaaagtgttgatcaaaagaatgaatttatgtctgtgactgagagagaacgcaaattgttaacaaacggctctctctcagaaattaaagaaatgactgtaaaatctccctccaaaaaagtcttatatagggaatatgttgtgaaagaaggggaccatccaggcggattgcttgatcagccttccaggaggagcgagagctcagcagtgtcacacattcccgtcagagttgctgatgagaggagaatgctgtcttctaatattcccgatggtttttgtgaacagtcggcatttccaaaacatgaactatcacaaaaattgtcccagtcaagcatgagtaaagagacagttgagacacagcactttaattctatagaagatgaaaaagttacctattcagaaatcagcaaagtttccaaacaccagagttatgtaggtttatgcccacctctcgaggaaaccgaaacctcccccaccaaatctcctgattctttagagtttagcccaggaaaggaatctccctctagtgatgtattcgaccacagtcccattgatggattggaaaaactcgcaccactagcccagacagagggagggaaagagataaaaactttacccgtttatgtcagttttgtacaagtggggaagcaatatgaaaaggagatacaacaaggaggtgtaaaaaaaatcataagtcaggaatgtaagacagtacaagaaaccagggggaccttttatacaactagacagcaaaagcaacctccttctccccaaggtagtccagaagatgatactctagagcaagtatcctttctagacagctctgggaaaagccctttaaccccagaaacacccagttcagaggaagtgagttatgaatttacatctaagacacctgactcgctcatagcttatataccaggcaaacccagcccaattcccgaggtttctgaggagtcagaggaggaggaacaggccaagtcaacctcccttaagcagactacagtggaggaaacagcagttgagcgtgaaatgcctaatgatgtgagcaaagactctaaccaaagacccaaaaataacagagttgcctatattgaatttccccctcctccaccactggatgcggaccagattgagtcagataagaagcatcattatctcccagaaaaagaggttgacatgattgaagtcaatctgcaagatgagcatgacaagtaccagctggctgaacctgtcattagagtgcagccaccttcaccagttcctcccggggcagacgtcagtgattcaagcgatgacgaatctatttatcagccagtcccagttaaaaaatataccttcaaattaaaggaagtggacgatgaacaaaaagaaaaacccaaagcttctgctgaaaaggcttccaaccagaaagaactggaaagtaatggatctggaaaagataatgaatttggccttggccttgattcacctcagaatgaaattgcccagaatgggaacaacgaccagtccatcacagagtgttccattgccaccacagcagagttttctcatgacacggatgccacagagatcgactctctggatggctatgacctgcaagatgaagatgatggcttgacagagagtgattctaaactcccaattcaagccatggaaattaagaaagatatctggaacacagagggcattctgaagccagctgaccgctcttttagccaaagtaaacttgaagttatcgaggaggagggaaaggtgggaccagatgaggacaagccaccttctaaaagttcttcatctgaaaagactcctgataagactgatcagaagtcaggggcccagttcttcacactggaaggcagacatcctgacagatcagtgtttcctgatacttacttcagttacaaagtagatgaagaatttgccactccttttaaaacagtagctaccaaaggtctagattttgacccttggtctaataaccgaggggatgatgaagtttttgacagtaaatcacgggaagatgaaactaagccatttgggctggcggtagaagaccgctctccagcaacaacccctgatacaacgccagccagaacgccaactgatgaaagtaccccaactagtgagcctaaccccttcccatttcatgaaggaaaaatgtttgagatgactcgcagtggtgcaattgacatgagcaagagggattttgttgaagagaggctccaatttttccagattggtgagcatacttctgaagggaagtcaggggaccagggggaaggggataaaagtatggtcactgccacaccacagccacagtcaggggacaccactgtagaaaccaatctagagagaaatgtagagacacctacagtggaacctaaccccagcatcccgaccagcggagagtgtcaggaaggcacatccagtagtggctccctggagaaatcagcagcagccactaacacctctaaagttgaccccaagttgcgcacgcctataaaaatgggaatttctgcatccaccatgaccatgaagaaagaaggccctggagaaataacagataagatagaagcggtgatgaccagttgtcagggattagaaaatgaaactataacaatgatttcaaatacagccaatagccagatgggcgttaggccccatgaaaaacatgattttcaaaaagataactttaataacaacaacaatttggattcttccactatacagacagataacattatgagtaatatagttctgacagaacattctgcacccacttgtaccacagagaaagataacccagtgaaagtctcatcaggaaaaaagacaggggtactacaaggacactgtgtaagagataagcagaaagttcttggagaacagcaaaaaacaaaggaattgatagggattaggcaaaaatccaaacttcccataaaggccacttcaccaaaagataccttcccaccgaaccatatgtcaaacactaaagcaagtaaaatgaagcaggttagtcaatccgagaaaaccaaagcccttactacttcttcatgtgtagatgtaaagtccagaattccagtgaaaaacacacacagggataacataattgcagttagaaaagcatgtgccacacaaaagcaagggcagccagagaaaggcaaggccaaacagcttccatccaagttgccagtaaaggtaagatccacctgtgtcactaccaccaccaccactgccaccaccaccaccactaccaccactaccaccaccaccagctgcacagttaaagttaggaaaagtcagctcaaggaagtatgtaaacattccattgaatattttaagggaattagtggtgagaccttaaagcttgtggaccgcctctctgaagaagaaaaaaagatgcagtccgagttgtccgatgaggaagaaagtacctcaagaaacacgtcgttgtccgagacttcccggggtggccagccttcggttacaacgaagtctgctagagataagaaaacagaggcagcacctttaaaatcaaagagtgaaaaggccggcagtgagaaaaggagcagtagaaggactggtgagaatgaaggcagtcaggtctctcgagcactctgctcacatcctggagaacgagcatagtttgtaaacactttccaactcgtagaccctagtgcatgaactgttgtgattgcctgtggagtgacttaaccgtagtttctcattatgtcattgtcatctgtatgtgctgtcgtatatactcttctttctgccttttgatcaaactacacggtagacagctagggaagcatgctgaagatattggtgtcattcaagatgaacaaccttcttttttcttttttaatgtgctaatggatatgattctgtcaaagtaaaagcacagatgttgaaatcccatcatggtgttttcaccaacacgacacttctgtaactgtttaaactagctagctcgtcagcatgttcaatcccattacattgagcatccatgtagtctgacatttggcctgatgcaggtgaaaaacaagtgagccatgtgcaaagaagtgttcatgtaggtgactaggacacatttcagtgtacagtgttagcattagtctctctgtaaaatctgcgtactgctaaaagcaattttccagtatcgtatctttcttgatgattattttaattaagaaattgtaaatcgtaggtccacagagtccatgtgaacggacagatatcaggatggcaatagtagccgatcacctgggacttagttggacaggtaagtgcatacactcctgaatggaacaaattagtttcttcatttctttgtcttactcacaagcagttcaatatatatattttaaaaatagaaacaagcagctagtaaaaaacatttttatcaccaataattttatctacccagagataaatactgattgtaccttgtatactgtgtttttccaaagccttttctatgcatatgcactaagaaatagaaatttaaatttattttaccttaaatttaagcattttcttcacaatgtcacttctgtaatataggttaaccttctactgaatagcaaatttatcttgtagcacaaaagaaaacacagctaaggcctatgacttaattaatcaaaattctttcacatggtttatgtccttagggcagctttctaggcaacagttcaattaacccacgcctaggctgcacaaattttagtcattcactgtgaacttctcttcacattttgtacgatatacacataaaactctatgtttatttatctgatactcttctttaagtaaactcacttttctgcccaaatatttatttaaaagaaaaatcttatatcacttcgataatgggaaaggattatttgcattatctatgtaaacaagaaaacaatgacagtaagtttaaattttgaattaaaaatttttaaatgtgatttttaaaatatgataaacatgtaaataaatatatttaattcacaaaagttgaattctataaaattcatgcctgtaatcccagtactgtggggaggccaaggcaggtagatcacttaatgtcaggactagcctacccaacatggtgaaaccctgtctctactaaaaatacaaaaattagccaggtgtggtggtgcatgcctgtcgtcctggctacttgggaggctgagacaggagaatcgcttgaacccgggaggcagaggctgcagtgagctgagattgcaccactgcactccagtctgggtaatagcgtgagactccatctcaataaaacaaaataaaataaaagatgatgagatttcatatcaattggacaaattggacaattctgcattgtaattttgagcttaacaggacccttaaaatcctacctcacatgaatctgagaaattttaagttttataggttaagtgtattttttaatgcatggccaaataataaatattcattatcatcacatctaaattcatcctgcataccattagcaacatacattccatacagttatctctatttaatgggagaatatgaaactagataataggaagcaatttcatctaattttttttttcctttgaatgccctcagtccccgtccacccccaccaccactaccccatttcaaaccctcctctcttcatcaacctagtctctgcttgctctcaggtatactgctaatggttgggagctgagtggagttctgaaaagatagataggtggtctgaataatgttttgtaggcagttgagagttaacagtaatttattatgtatgcatatttactaatatcaactttatattttaacattggacattgtaatctgaaaatatactggagcaaatgtttgttttgcattattatatgcctagaactgttagattattttccttaagcaaatacagtcagagtaaatttttggagatgtggcttaatagccagacgaaaagccataaacctaaaattcctagtgtcagtgtctttgctctttattaagtctctagacaatggatacagttttgtcatgaaggcttattgggcagtaggagtattgtctcttaagacacagagatgaagaacttaaaataattaacttctctaactagaattactgtatgctcaatgataattattaagaatattaagcatttaagagaacaaaatttatatctgtccctcgaaaccactattaacatcttatgtgctttttttaaaacaagaacgttttataatgttatacatacaatgtaatctgcttatttgtaactgtgtcattctacaaaattaaatattttctgatcttggttttaatgcataaaaaaatatccaatagatgtaccttatgatggtggttttctaactgtggttcacaatgcttcaatgagatgtgaaatcagttcatactttgtttttgtttttaaatggaatattatataaaagaaaatgactgtgtttaagtgtattaaggctaaattctgttccggggagatctgattttatttatgtaaacaccatgatatataatgtatttctaactgtaggccatgatcacaacagttgtttgcaagccactgccttaaattaactcttatccttttgttcaacatgcagattgttttcaatgaacattcatgtatataaatcattgtatataactcatatattgtcagggtaaatttctaaatgtgaatcacttggtcaaaagataatggacttttttgagcctctgaatgcattttgcaaaattgctggaagtattttgtaagggggatagagtcttgaccaattccttttccatgggatcatttttgcccatttcttactttttgttatcatttaaggtaatacacacttgataaattgttttaatataaaaaaatacagtgggaactaagtctccttcccttctctgactcctaagtttccctcttccaaggcagccactaatagtgagatcatatgtatctttccaaagacactctgcaatttacaagattgaatatgagtatatctgagtgtatacgagtagatggacagaaagctgtctcccttttattttttactcaagtagcttcatatcatataagatgatctggcctggagtcatcatataacctcctgtgtggagtttatgaaacttgaaggcatagagggtggcatattatgtgagtaaaagataccttcatgaagattgcttagcacaaaccctatcagcatctcttgtgccatatacatgaattgtatacctctacgtatcttgtaatttgctcaaattatagagaatttggctgaattaaaacaatcatccaacatcctctttgcaaactccaaaaatcttgttttattttttgagatagggtctcgctctattgcccaggctgaagtgcagtggcacaatctcagctcactgcaccccctgcctcctgggctcaagtgatccaactcagcctcctgagtagctgggaccacaggcatgtgccaccacacctggataatttttgtgttgttgttgttgttgttgttgttgttgttgttgttgttgtgtgtatggagaccggggttttgccatgttgcccaggctggtctcaaatcctgggtgcaagcaatccacctgcctcagcctcctgaagtgctgggattataggtatgggccactgtgcccagcctaagtctaaaaatctttataagatggtctctaaaaaaaatctgattgtaagtcattacctaaggagagttaagtcacagcctgtgtatggtcactactttgctatgaagccaagtatataaaaattaattcctgaggctgtacttgagcttgactataaaattcccttttctttttgtggcaattgagcattacttttatgaaacgtgtgataaaagtagaatatgcaatcttagtaactctctttcttttctacagaactggcaagggaactgaatttttcagtggatgaaatcaatcaaatacgtgtggaaaatccaaattctttaatttctcagagcttcatgttattaaaaaaatgggttaccagagacggaaaaaatgccacaagtatgccgaaattatattattttaactttcaaaactgcataaatgtaatattttagataagccaactgttaggttcatccaagtagtgttgtaattttctgtaatctttaatatagaaaactaagtgatcatgaggtaatagcaagtcttttgaagttatacttgtttaatttagtgttaacagtctaaacttctattcttcagaagctttttggaaagcaagtagcagggaatttttcgcatctggcctgacattctctctgtgaccataaaaactgaaaacataattttagttgttaaatcatgggacacagtcatcagaaacactccgaagttaccactatggctggaggtggatgtgcagagagggaagacaggatcatattaggggagcaaatagttttattcagcttggttggctctactgttgttgggtttggttttgttggctggtgggattgggtggtagtcctatattttggcaagtgccaacccacaacaatgtggaataaattattatgggtttgcctgtgtcaacttgaccctagaaagtcattaaaatgctaagtaccaaatatgagggtgacctattttgacattctaagaggaaaggaaactttagttttattagatccccttatagccaacaggaatctagttattttaaggcccatccgcactgttccagtggaacacagctttacaaagtgatgattaagactctgacaccttccctgtagcagcgagcattctgagtcctctggatagggagattgcagagatggagtaagaaggagctaaaatgccagcagggctgcaaaagccatgcctttgtgtagatattgtgctgactgaaagaacataatttaattgggttttcaacctttttttctccttttcagctgatgccttaacttcggtcttgacaaaaattaatcgaatagatatagtgacactgctagaaggaccaatatttgattatggaaatatttcaggcaccagaagttttgcagatgagaacaatgttttccatgaccctgttgatggtaatcgaatttagtgttcatatttatttaatcatttgataaaatttgaaagtgcagtcagacaaggcagtcacttaaaagcaactaaactgtgatttgcttgacttagtttctcattttctctgccagagtctgcaaataaacactctgatatcagagcaaacttggtaaatacctctgtttatatacaatataaatatacaatataaatcatgacgtatgaacgcctaaggtatctgaaagagttggtatttctaatatttcataaaagttaaatatctagagaatgcattgcttttgtcacttttaatttttatattaaccctcctaaactagttacctcttttattcgtatataggtaaaacaaacgatgagccatttttatcaaataagcaaggtattgagtaaagtgtaagcatatagtatacaaattgtaaggtaaaatggcaatttactgtgtggcaccaggtatttaaatgtgcactgaaaaaatttaatgtatcattcaagtatgtgctttagttatttagcgttcgttgttattttaacttcatgaatatgctgccatttattctttggaaaaactgcttgatctattgtatatcaaaggcagcataatttctaattcagtcggcatacatgttactaacaacaattcctctttcacattagcttaatttatataatgatcttgtcattttttcctcattatgtaaattgtgctttcttcactgaaatattaagaaaaacataataaatatcttcctatgtttttcaaaatagtcctgtcttaggctcacaaatgaaaatttattcctacaatgaatttttgttctgtttttgagacgaagtctcgctctgtcgcctaagctggagtgcaatggcacgatctcggctcactgcaacctctgcctcctgggttcaagccattctcctgtctcagcctcctgagtagctgggattacaggcgtgcaccaccgtgcccagcaaattttttgtatttttagtaaagatgggggtttcaccacgttggccaggctggtctcgaactcttgacctcaagtgatccacccacctctgcctcccaaagtgctggaattacaggcatgagccaccccacccagcctctataatgaattttgagtagaaaatttgatgatggtgtggaggcaggaataagaactaaggatatttttctagtattccatttttaaactggcaaagttagattaacaagagtcacaaacttctaattaacttctaattctgcatatattttgtggaaaaaatcttaaaattcttagaaagttcctgcttattaaaaagtttaagtctggccaagcactgtctgtctcttaaaaaaaaaaaaagtttaagtcaacaaaagatttaaagcatacttgttatacatgtaacaaacacaatgggtaatgaagtaaaaagcggttctttttaagtttataaagaccatagaaccttggaaaaacgctccctttgaggccttgtcttatatgcaaggccatatattagtaaccacatgctttttgcactagataaatatagatcatcttatcaaattttaaattattgataagttatagtttatacattcttctaatattctttattggaaaaaatagttgttaagtaactctaataaaaaagatcaccagaacacaacagaagtagttgtgttgaaagcttcatttaatttgaacattttaaaattggaatatccttaaaatacagtcaaaaatgaaatggctttttgttgctgtatcttaatatttttaaattcctttttcaaaatttcttagggaaatttagaaacatgtatatgaagtaatttcacttaggcagattataaacctcagctaatcttagccagcttttcaacaagagtctggtttatagatgaccataactgaaaaatgttcacttacctatagcaatttgagtttacaacagcagctaagttggtatttacctgggactgatggaaaaattagacttttattttgtagaccaacaattcagaaactgtggtttgttgcttttttcctgtctctcctcttcgttgaacttttatgaaacttcctttcctcaccatgaccagaccattgttgacttttctctctgctgaggcagaaaaatgcttccatagtccatgcagcaatgtttaaaacaagggattcgttcccccctccccttttgtgtaggctggttaataaactctatgtttcatagcattgtcgtgaatattcagagtgctccctgcgaatggttttcctactatctctgttgtgtatcatttctctttatttgattcgtggttctgagtggaccctaccaccgacttcaccaagaccttcatgtaccccacaaccctttcatcttggtcatatctgtttttgtacaacaccctaaaactacatggagtcttttaaacttggtctgttttttcaatccttttcttaacatcgtttaaaatttttttcccagtgccactgctctaaaatctaacaaacaatcatttctttccaaagattaaatccgtttttctgtgctataatttcatgtgaaagaagaactaggttgctttgctcatatgtacagttcttaaaataagttgtaggtaattaatataaaagttgtaggtaattaatgataaaaattggtttcttgtggcttgctgtattcagtccaccacagtatgaacttcgcatgctaaatatagaaagataataagtatctcatgtaatgacaactaactttatattggtctttatataaacttaaatatataaactttatatatttagtctgcatactttggattagtgtgcatatttacttattgtatcataatttccaaaacagaaacaattgatatcttaattagtattctattttattggagtttgcactaggctttttatttcattgtgttacatttaattgaactaaaccgataaatttattgacattaatctgtaattcatcatacatttttcatgcctgatataattttagtcattccatgtgtttttgtttgatgtattctaattcattccagtcagtccaaatgtactgtcttccataggttatccttcccttcaagtggaactggaaacccccacagggttgcactacacaccacctacccctttccagcaagatgattattttagtgatatctctagcatagaatctccccttagaacccctagtagactgagtgatgggctagtgccttcccaggggaacatagagcattccgcagatggacctccagtcgtaactgcagaagacgcttccttagaagacagcaaactggaagactcagtgcctttaacagaaatgcctgaagcagtggatgtagatgagagccagttggagaatgtatgtctgagtgagtatcctcaataccttggaaatttggctgggtccccaaaagatgttaaaccagcagagcctagaaaactaggagtaagctctgagcagcaggagaaaggaaaatctggtcctgatgaggagatgatggaagagaaactcaaatctctatttgaggacattcaacttgaagaaggagtagagtctgaggagatgacagaagaaaaagtacaggctattcttaagcgtgttcagcaagcagaactggaaatgtcttcaattacaggttggcagaatgagacatcaagtggaaacctagagtcctgcgctcaagctcgaagagtaactggtgggttactagatcgactggatgacaggtatggctgtttcaaaaaaaggaaagtgaacacaggttacttgttaatcgtttatcttaaatacatgctttttagtggtgacttcttctaaattaccattctagttctgggataaaacctgctttaaagaccagttcattatgctaatctggaaaggaaagtgaatttaaatttaaatttaattctcaaaactgttgaaataaaatacaagaaaatttacatacatgcccaagatttatacgttgtctttactttagaatactattcttttctactttattacttgtatgattcttttcatatagccagtaattattgttcctttaaaataatgaggtgggtggatcacctgaggtcaggagttcaagaccagcctggccaacatggtgaaacctcatctttactaaaaatacaaaaatcagctgggtgtggtgtcacgcacctgtaatcccagctactcaggaggctgaggcaggagaactgcttgaacacatgagggtggaggttgcagtgagctgagatcacaccactgcactccagcctgggtgacagagtgagactctgtctcaaaaacataagaagaataatgaatgaaagtccatgttatttagaaatataaacattactgtttttttcctaactgcaaacataaatatgctcattattaaaacttaaaatgcagattaaacaaatcaatacaccccatcatctaccaataacattttggtggattttcttctacgcatgattttttaaatgtcttaatgtaaaaagtgcagagtagcaaaaagaaaagccatccattctcctaccatactaggaaaaactgattttacatatccttctatttttccacgagtcttatttttcataatttgaaagatacacagttttttacaccaaataatattgccatgatgaacatttgtctttacccaaaataatttcctggtcacatttgtctttacccaaaataatttcctggtcatgaatttggttaattcttatactggccttgctctagaaaggtgaaagtctagaatctgagacatagtttcaaatcccaccaccattaggaatgtagtttgtgatttgggatgaatctctaagctctaagaatgtcactctaattatctttaaatataagaatactactaccttccttaaacagatttatagatagaaaaagagaggatgtatcatgtctaccaaatgactgacacaaatagtaatttctcagtagcactaggcattatttttatttacatacacattagactaaaatatattttacttcagtgccagctagtgattaaattggacacaagagaacttatttcataaccatattttatatttttatgtcattaataagcttcttgctcaataaaaattcccaaagagggagtttacaaaactacttttgaaaaattgcaggcatgaatgaactttatctacagcctacaaaagagacaattgcaaagaagacaaacagtactaattttgatgtctatgttcagatatagtcacacaatttatagttacatatcagggaatagatataggaaaggtgttcatcattattaaaccgctgaaattccttgttttatataggctctgccagtgaattatatagaaaaaacactagtgaatcccctggttccatagaaggaggaaaatgccagtcactttgctcctgttatcagaatatgcagggtaggagaacgccggcaagcaatgtggactggggaatagaaaattaaaccaaagtcataaagctatatgttacaggatcttcacagtatgcttggattgtttatccttacacataaagaatagagtgtgctatggatgtcttttaaaaataagtatgttcagataatcagaatctgatttaaaggaatacacacacatatataagtatatattatacatataaagcattgtactagttattgccttctagcggtaataaacaaagatgctcaaaataatacgcaagctacaaaaaaagtgaaaaatagtctatactgaaacttgtaaaaaacttagaagtcaatttaaaagaaagcattggaaaggaaagagttttaatagttaagggaaaaacagttctctcagtaggtagaaaagggtgtgcaaccctcaaatcactagtgagattagcagaggtcaagagtagagaaaaatgagattcaagtaaaggtattagagttggaaaagtaacggcaggattcatgactgaaaacatatacaaagaattggaatttggggtacttgggggaataccacagtcttgaccacaggaatttgttttgttcttttttggagacagggcgcaattttttgtacagtagctcaatccttgctcactgcaacctctgcctcccaggctcaagcgatcctcccacctcagcctcccaagtagctgggactacaggcatgcaccactgtgcccactaatttttgtagttttttggtagagacatggttttaccacatcacccaggccgaactcaaattcctgggctcaagggatccttctgcctcagcctcccaaaatgctgggaatataggcaagaaccactgagtccggccagcagtttattttttactggtgatagagaagcgttctgaaatctcttctcctttaagattggtgggcttggaactctaggtatgtccatgagcctttcaggatcactcatcaagatgatagaattcaagtagctgtagaactgcagtttgtttatttagatgagagcatagctaggcaatttggcaactgagatatgggggatgtctagaagctgtgtagcacctcctgacaccgcacccatgagagccctttacattttatttatttattttgagacagagtctcactctgtcacccaggctgaaatacagtggcacaatctcagctcactgcaacctccacctcccgggttcaagcaatcctcctgcctcaggttcctgagtagctgggattacaggcacgtgccatcacgcctggctaattttagtatttttagtagagatggggttttgccacgttggccaggctggtctcgaactcctgacctcaggtgatctcccgcctcagcctcccaaggtgctgggattacaggcatgagccactgcgcccagctacattttaaatccagtggccacacttttcacacttttctattttatgccttcagaagtaggcaaaagacacagttcttaaaactttagagtttctgcaacctatattcagtcatagtttgccattgtgaatttgcaaattttctgttgcagccctgaccagtgtagagattccattacctcatatctcaaaggagaagctggcaaatttgaagcaaatggaagccatacagaaatcactccagaagcaaagacaaaatcttactttccagaatcccaaaatgatgtaggaaaacagagtaccaaggaaactctgaaaccaaaaatacatggatctggtcatgttgaagaaccagcatcaccactagcagcatatcagaaatctctagaagaaaccagcaagcttataatagaagagactaaaccctgtgtgcctgtcagtatgaaaaagatgagtaggacttctccagcagatggcaagccaaggcttagcctccatgaagaagaggggtccagtgggtctgagcaaaaggtacgtcatctggtcatccggtagcagtcattgaaatggaaagtatcggtgctttacttctttggattgatcttgcagcctggggcccaaggttttttacgatttctaaattataaatgtgtgaaattgtagcactaatggtggaggtaaagaaagtactgagttaaacacataggtaaaaaaaaaagttccaagtaaaatgtatgccatttcgttataccttcattcatggtgcaggaaaagggaataagtatctgtttagccatttttaggagggacaagaaccagagagacgttaagtaactagtttaagacccagtattttatctgggatttaggtttcctaactcccactccgtgttcttccttatgggaggaggataatcattctgatcctttctggctccttggcataaacagtctatagcatctgacccatctaagttctgttctgtatggtctgttgtctgaaagcgtgttttaaaaattaaagagatgaaattccaagcctaaaatgaggtgagttgacagcagttagttagaaatttaaaattagaagtataatttttataatttatataagttgatgatgattgtcttaacatgtatttctaatcactttaaaacctcactgtgatagatttgcttgttctttgtacttttgtggtacaatctaatagatttttttctttgaggtttactctatttttagatattaaaagtattttaaactgaaatgatgactcatacgtggatataagaaaataaaaagcagctctgtttcctacattttttactgctttttactctcccaatttttatgtcttttcatcaattctgcaatagacagagattaatagtagcacttgcagttttcgctgagacatatccagttcactgaagacccactttagtgttttgggaggaaaaaacaagtcttttctgaaataatgagttcaagattgatttgaggtttaggaagacttttagcaaactcaatcgctcaggagctgattctcagcttatcagtaatcacatcctttcctattcccttctgcagacaatatctgactattttcaggcttgttagaagggagagtaagaggaagtttagttctagatcatctatttttttttccctgtaagtaagttgctttgatataagatttggtggtggtaatcagttgcttaaatgatatcctaaaataatctccagctcatttaataactgccttcactaaatttttattaatggttttgttttagttttaagctcttttaagtctttttcaggccttctttaactccgtcctgacaagtgtggttttgaatactgatttctgtctttgacttgacttttagtatatttaagtggtgtgagttttggataagtttccttttaaaatgatcccacaaaatatagagagaagcaataacatagtggtatttttcctgtgaatatttattctgcaaaagcctgttaaagttctaaaggcaaatttctatacaaacacatataaacaccgctgtgtgtgtacatgtgcatatgtatgggccactggaaaatcatattggccattggcataaagacggttgaaaatttagttttaaaccttgagtggaaacttagctgagtttgtcagtaatggaaaataatttaccattagaaaacattttcaggatttcttgtaaatgagtttgtgcctctgatattggtttcgagtcctattataatgcagaaagacttcatgacctaaaaaatccataatggagttaaagcttctaggagacatgaacctgacctcacaagaaaaccaaagatgtttaggatgtatcgtttgtggctataccatagtataatagcaaccaactaggtcatctgatgtatgatctcagaaaacagccccctttttatcccctaaaaaatcaggtcaaaagtccgggtgcggctcctacacggatgactgcctgctgttataaggtaaaattctgctattttccacctgtttccatgcagcaacccatggcaaagagtactgagaaaattccatttggtttccttgttttcccctttaccaattcctagataattcactaaaaggaatcctgagcctgagattcttcctccattttcactttaaggttagcagagattccagggaaaaagtggaaactgaaacaatgaccaaatggccactttttctttatgtaaggggttggcctcacatgatttttttgtaggattatgctataatcacctctaggtttgttgtttgtgtttgctttaacatagatgctcttctacttttgaattcacccaagtgaaaacctttcctcaacttatgattccatgtacagataattcagattcagttttcccttttgcctcatccaacccattaatcctggaatgctaataattcttttctttcgtcaacacagattccttttacctctttctgacttcttgagcctttgcaaagcttccttccacaatacttaaatcattctaagtctcctaaatttactgtcctttactgaaaaatttaaaataataatagcaaacttagttcaagttcttactccttgtaaggatagtggctatgattttcttttaaaaccatattattcagtggggtggtttgttgaggtgaaatttcctgtaaagtcaaggctgatagtactgtttaacattttaaaatacttgtcaagtttactgttgatgaaaaagatggcctagtttattatctatacaactaacatttcataaagcattttatctaacacctgtacctcctatagcagttttatttttttttttaaacaaatactggaattcatttttccagcggatgttaactaaattctgtctctgggactattagatttgaggtaatgaattaacttcaaagataaagtaccagaattattttcatagttccaccattaaaatttagaaatttaaccactcagtaaatactcttccccatggcatctaagtgaaagctaaagatattttccccttcaaattatgaactatttgccccttggtagtttttccagattcccacctttattgcctaaaaattaatattttgtgcagcaactatattcttgtctgtgaaaggtattctattttatattctaatttcattatcagttctttaaaaaaagatttcaagctttcatacatttattccttcattaaattctttctcagtaccagttatgtgttaggtacaaattatgctgatattaatctcttgaatataaatatatgtgccaaaatatgctaatataaattctttacttgttgttgttgttgttgttgagacggagtcttgccctattgcccaggctggagtgcagtggcgcgatttcagctcactgcaacctctgcctcccaggttcaagcaattctcctgcctcagcctcctaaggagctattttttgtattttagtagagacagggtttcaccgtgttggtcaggctggtctcgaactcctgacctcaagtgatccacccgccttggcctcccaaagtgctgggattacaggtgtgagccaccgtgcccagctagattctttactttttaataaagttcaaaatagcttttaataaggttgtcaaatttgaccaaaatttcatagaagtccaaaatattatgcctctttctgtagatcaaatgaaatatggcccaatttacaagggtatacaccttcatggtagatgaatatagattttaaactagttttaaaaggaatatgaatgatttaattgtagtttctgctgccaaaaagtctccataattattttttaataacttataactaccttgatctttacctgtacacacacacacacacacacatgcacagagtaatttcacttagaatcctggtcaaaaattttcttccacttaaattttttttaagactctcacaaatatacatcatggttttctttagtcggcaaaaaaaaaaaaaaaaaaaagaagaaaacatcaagtaagtgtaattctttcttgatttcccttctcagaatgtcttttattttaagtgtgatggtaaaattatactaaaaatgcatttgtcaggacttgaaagacagtgagagtgattcaagctcagaggaagagcggagagtcactacccgagttattcgccggcgtttgattataaaggtatcctgtagctggatcattatgtggcattgctctactattagaaactccttccttgtggttgtagaaactccttccttgtggttgtgaaatttcagcatgcttgataatgaaatggctttgtgtaatttttttgcacccttgaaagcttgtaaaaacaacaaccaaaaagaaaagaagccatgttgcatggtattctgtataggcctatttgatatgtggcggttgtagttttatttgagaattcttggcatttgtatcctgctttccttgaagaagtgttatgtgaatgagcaaagattctgtcttggtgacacagtagttcatatcaaatgaaatgtttaattgaaaccttagaaactgtaacaaggtatgaggcacgataaagaagaaagagaatgaaagaattaaaaggcttccttctcagtctcaaattcctactgccttaagaatttttaaattaaaaccagttcttcataagcaatcagtggctgagaatttgaggttataacctggcatggatatatgtgacacaatgcaagtcaagtaaaaaaaaaaaaaaatctgaaataggtgtttgtttaactttactaacacacaagaaaaaaatcaagctgcatttttaagtataggagtcaatttaaaaaaaaaaggaaaatagaattcttccctattacggcacaattgaaaacactattaataaatattctgtctttccttcacaaaggtctgttgaagcacttaccttttgcgtagtaaggttccacagaatgcttcttgtagtctcccccttgtcttcattacttcgtcatcagatctttctaagggttagaataattgagttcagagaactagaaagccattttcaatgcgcagacttttgaatatgatccaaataacttgaggcttcttggttactgccctagagagaaagaggaagagaatatctattgaaaaccatttatcaaacttaaccaatcccaaagtgtcaagagacccaacagaaagcacagaagttggcacaggtgtccaaaatttcttaatcctggtgcttttcacttttcatgaagaaactccaccaaatctgccctaatacagtttttctaagactctggaaacattagggaagaaaataaatcgttgtctaaattttgagttatcctgcaaatcaattgtaagctcaatagggttcctttaaaaaccatgaatcacttctttgaaaattccatgtatataagcaagccaaattacttattgctgtctagcacatttgcaagtatttaacctgctatcaataaaatcctcataatcagtcacctcacacatgttctctgggttggggtgggggaatgcttgattctgtttttctgagtttttgctattctcataatcagtgtcttcaagatatgatattttaaagtgaaaggtctagaaaaagcacatagtgcttcgaacttgtcttttatgcttaacatatcacatactaatgttacatctaaatccaccacattcctttataatagctgcccatgatagaagttgactttcttctatccaggacaaaagaaaacaaatatagccatgcaaaaaaagtggaaggcggggataaagaagtttttctctgagaaaacaaaaacaataacttcaaaacctctcaaatcaataagggctatttcctttggtctcctagaattctagatatgcaccagcaagttagctattaagtaattttcttagagtaagttatctttgtttttcagcttaaaatatgattataacatattaacatatttattaagaacttaggtttaaaagacaaaaatccactataatgttgtaggtttcataaaaacaggggagtccgtattctccccaaatactttttttttgagacagagtcttgctctgtggccaggctggagtgcagtggtgtaatctcggctcactgcaacctccacctccccagttcaagcaattctcctgccccagcctcccaagtagctgagactacaggcgtgcgacaccacacccggctaatttttgtatttttaatagagatggggtttcaccatgttggccatgatggtctcgatctcttgaccttgtgatctgcccaccttggcctcccacagtgctgggattacaggcgtgagccactgcgcccagacccattacttcttgaagttaatgtaattttagagagattgagtgaagtcatcagagaataggttttataactgaggaaggcattgtataaacaataggatcattcacaaacaagctttgagagatatctttcatatgagatggaaaaaccaaaggctaaaaaatagttataatcatcattggaagctataggtataacaaaaacactttataaattatttttctgttcagatttttggggcaattgcaaagagtcacacttctgttgcttttctctttactccatatgttgctatctatctttctaatggaaaagagcttgaggactataatagtatatggtgaatatgacatgggaaccatctcttgtcaaaaacataaaatgggaatgtagtacctaaatgggtcattgagactaaaattactgtgtttccaagatctcagaactgaagattggagataaatttatttactcaaaatcacacagccagacagcagcagctctgggactagaacctaatccctagccctctagtgaagtgctttttcctcaatactatacaattggacctccatatctgggcattccacatgcacaaactcaaccaaccttgagaaaataaaacaataaacagtagaagtaagaagcaatatagtataacaattacttacatagcatttacattatattaggtattataagttatctagaggtgatttaaagtatatgggagaatatgtgtagcttatatgcaaatactgcaccattttatatctgggacttgagcatctgcagattttgctatctgcaggggtcctggaaccaatccctgtggatactaaggaacaagtgtattctcttccagaacaaatgaaaaagtattcctttttgctaggctaaatcaggtatttgaccattcagatcttttcagcagcacagaagagggcagcattgggctgtcattcctgggaaccatttgatggggctggaatgctgggaatttgacttacctcatggatgctgtccaaacctggactgaaccagcatagttaacactgtttgccatagtaagccccctagcacttagtatcccagttctgaaaactagtctggggtggttccatccctcccagagctagctctggctgggaagtatctcccagaggaagcagtatgtatgctaagcattggattgccaaaagtctgggcaaatctgtcttcttagaattccatttgtataataaatgaggtgacggcgatttttctctttactttcaaagtggatccattctttttctatgaagttttaaccttttttttacatttaatgttttcaaactcctatagaatgagtcaagtcaacaaaatctcccatttgtcatgggacttaaatgaatgtgctgataaaattctgatctctatacaatttgataatatacagtggtttcaaatgcttagaagcaatttatgttactaaccagtcgtgagtttaccttattagcttagcaaatccagtaactgcaaaggtaaaaaactgtaaaccaacacacaaccaaactattgtgaaatttcataaaattcaaataactgaatttttactatatagtacaactgtatttttatttcaatttttcaacatttttactggttttctaaataagagcttacatgtatgtttctgctaactcaggcagttcaaacgtatggtaagttctatccgttcattccatttcccagaggtaaccactcttcacaagcttcagattgtttttacatacatatacaaatatgtgtgtaaaatatgtaggtttcgtactattcatattgcttagtatttgctttttgtaaaatatatcgcatcaatcctatttttggacaattcaagttttaacgtatccatcaaagcaaattggtacatttcatattgtcactcttccattttattcaaaaattctaagagaaataaaagttataaaatgcagtgcttctagcaggagtccagagggaagtacagttaattttcattaataccgtcaccagaggtgaaaatgtaacaccacatgtgctataattttcctttataatggttggggggaagggaagggaggttgccagaaatgatgttgtcaacaagaccacggggacaattttgtttacttaaaaatactaagtgttttcaagaactttaaaaacctcattgaggccgggcgcggtggctcaggcctgtaatcccagcactttgggagcccgaggcgggtggatcacgaggtcaggagatcaaaaccatcctggctaacacggtgaaaccccgtctctcctaaaaaatacaaaaaattagccaggcatggtggcgggcgcctgtagtcccagctactcaggaggctgaggcaggagaatggcatgaacccgggaggcggagcttgcagtgagccaagatcgcgccactgcactccagctggggcaacagagcgagactccatctcaaaaaaaaaaaaaaaattgagattactttctcccattgaagagaggccttagagctctctcttaggtaacatttggtctctaatatagttgacagaattaaagatggataaattttttaaaaatgtattttatgactccctgctgtctttcctatctatttaatcaactcctatctaatctattcctcctattcattttggcttattatttataaataggttttgctttttgtaaggctattaatctaagtcaatgaatctaagtcaatgaatacatacttgtatgtattcactatgcttatacatatgcttacttcatagtcctttcagagattgtccaaacaattcaaaaattaactgacatcttttcccacaaaaagattcattcagtacctgcccaataggataccattttagggattttcctgggttctttaattgtctatcactcaaagatgtgtacatttccaaaagttagctcaaaaatatttgtcattcgtgtttaagctataaggaaaactttcattactttttattggctttttttgctgtccttatgactttacttttaaaataaaattttgggttttctccaaacatttgaaaccaccaaccatagaaaatacaaataacactgccattaaaaacgtgttgcaaattttagtgtatttacacaagacctctacatttttccagtttttctcccctctcttcactgcgctgattcaaacttgtcataagcaagattggagatgcactaaacaagatcaagcaacaccttgttttattttcattccacctataccacagtgaggaaaaacaagttaaatgtcccgcccattgtcatgaactatgcacccacaaactgtaagaacacaaagtcactttgtaataagaaaaaaaaaaaaatgagaacaaaactttgctagcaaaacaatagtgttctagtctttattctgttattttgaaccagaactgcctttctactgattgtgacatatggtcacatgacatatggcaatcatagaatgttctcaccattggctggcactgaccaaattatcagagccactatcttttccatgccagtaacacaaagagttagaatctcacttttccaggaaggcagctgtttttgtgattggccattttccctaaaacaaaacaaaaccacatctgtacactgccaagcagcattatccatttcaccttttcagtaagaagtttgactgacagatcaataggaccctggaatactagtccatccttaagatctttatccttgttctcccgaactataagtggcacaaatcttaagttaaacacaaatgaaggtaatgtattgcagatatggtcctacttctgctgagtagtttgtcgtgttatacaatcatagagctagtggagagatactatggagccatctaaatccaccaagctgtctatgacaggaaaataggcgcccaccctggagagttaagaatgtattctatttttaaaactcatagtgagacctttcagagtttcccctccaaaattagataacaaatcagaaagccagattctaactctgtattactggaatgtaaaagatagtgactctgataattttgtcaatgccagccaatggtgagcacattctatgactgccatatgttacagccaatagagatgcagcagttctggtttaaaaatgacagaataaagactaaaacactattgttttgttctcatttttttttattacgaaacaactttgtgttcttatagattgtgggtgcatagatcagaagatatcatcttaaattcccttggtattgattttatctatttttttgcctatggcaatgaagatacttcagtgtataaactatgtactatatccgacacaattattctcacttaagagctatgaaagattcagtcttcaagattctctctgtaccctcaacttttctcataatctttcaaaaaatgtgtgtattatctttagtgaatgaatttttaaataaaccagagtgataaatatcatgcccaaactaaggtactatcttagttcaagttagataaaactcaatccacaaaaatctctagagattcggtagaactaatgaagaaacagtgcttaaagtgagacgatctaatcagagctctaatccttggctaaaatttgtctcaacatatgaagcctttcggtttacagtgtgtaactgcatcctataattatgtattttcaaattcttccttctggaatctgttgctaaccatcacgcttatacatacttgaggtttaatgcttgaatgttgttgactgctaaataactgtcagtgaagtcagcctttttcccttgcactggagtagcaagtagaatttacaacttatttctctaaaattccagagcatgtgtgtggtgtttggagtagtgtggagatttctccatctagtatgttgctaatctttatgccacatcctttagggagaggaagcaaaaaacattcctggtgaatctgtcacagaagaacaatttactgatgaagaaggcaacctcatcaccagaaaagtaatcatcattcagatttcatgcttctcttggaatttagattttctgcattaaaaactctgctacttttgtgctgtagtgtcatctcctaaaacagaaaaatctctacttttcaccattacttcctacagatcactcggaaagtattaagacgaattgttatcccacaagagagaaaacgtgatgatgtggtaatggagagggattgccaaagagaatgtagaggacaaaagctttgtgcactccctagaaattgctgctaacaggctggcatctgcagtgtggcagcttgaagtgtttgctgcttttgacatcttatgcatttgatcagggtcaaagaaaaatacttttcttcctaacattctttgttacatacttttttttttaactgtcttcagagttttcacaaagataaggtcatttataggggacagaatgtgccagtttgagggagaaagaagataaaaccttcaccattcaccaccaaacctcagagcagtgcttcagccccacccagggcttggccttcagcagagtgtctgttgggacaggggcggagagcactccaaaagcacaggctttaaaagttagaatggcaaaaggctcagttcaagatctgcacatcggatccatacattttctctttccagtatgttctgcagggaaatctgaattcctccatcttcgtctgaggagggggttcccctctttgggtttataacagcccatttccaatgtgccagttaaagaatccctccagtcaacccctttctctcagagaaaacatctctggttatttttcacttgtttctcagatctctacccttttcaatttaaaaatagaaacttcaatagacaatgtttacattagaaaaagtaaactgaaaatttatcagaagtacaaatcacaaaattgaaaaggcttcatttgttttctgttaaaaattgggtaaaaactgagtatttgtgccacaaccttgctctcggggaactgtattcctgatgctcagtgaagagaggatttgtttacgcaaaatagatgccttcttggtctgacagtaagaggaagtcattggcaattccactaacttaaaaaagtccctcagatcaacagcatttccatggattagtacttaactaagaagtctgaatctcattgcaacagattgtttacaattctgctgccttatgagctgtggtgctgatttcttttagcttactataggaaatggataggctgctcgttattttgatttatcactaacttactgaattattgtcaagtacaattatgtggtattcattttgacagtgctctctagcttgcttgatgatgctaaactgtgtggttaagctaaagattgtacgtatttttggacatgaagtgacaaaatgctttaaactgtttcgcttgtcctaatccagcctccaaggatcagaatgggactgctttataactaaaactgtttcacagtgaaatcttaatatgtacactcctttcaaagcagggagaaggttttaaggtgaaaacgaagaaagaaatccggcatgtggaaaagaagagccactcgtaacagcgaacggtcagtcaaggtgaggtgtgttcatatcaacaacagtaggacttaaattcctgtgaaacttataaatttcactaaataagtgattcagattttccccttcctttccttttcactgaatttcagctttgaaaatcaaatacgaagttgttcaagttctgttgatgtttgcatatatacacacaatgaaacttgacttcggtttcacagtccattaactttctcctcacaaattaggcagcaatttaattgtaaattatgtttgcagaagcaagtataaatagtgataagagtaaaggctcactatgaaatacaatagccttatacaatctaacaggaagactatttggcaacgaatacttcttacagttatactcagagttttattgatccagactttcaccattttagcagaacggcatctgaggatatcattttggttgaaataagtgactttccaagtctaaattaaatgactgacatatctatctggtgttttatagaaacaaaaggaaaaaataggaggttaatggcactgttgtttgttttttaagttaaatgtttagtaagtgagctttgtttacatttgcctggacttttctttacagatcacgttattttccttttacattgtcctatttatttctacttagctacaattaggccatatggggtgaaaaagaaagtcctctatagtctgtaaagtaaagcaaaatcacttcctttagttcaccgccagtcttcttagccccacaggttaaagtagtaagaaagagcaaacagattctagttttcattttcatgcatctgctgttccctacttgccaggatactggtatgcagagtgctgagggaaggaactgggaagtaatctagtttcactgcctgtaattttatgtgtgagctaactaaggcccagataagttctcaattctccctccccgcaagccttatcatttgtttattcagtataacatttacttcatttctttctgtgagactttctcacatgaccatttaatggcattgagaagaccactaagaactgcagagcattctggaaagaatgtttactacacatcctcttcccagtgtttcatgcgtgctcttcaggcaatcctcacagccaaccctcttggataaggccttcatcatccccatttgatagatgaggaaacaggcccaaagtggttaaataaattgcccacgctcacataagtaaaaagtggcagaactaggatacaaacccgaacaagctgcctccagtgtccacttgtttgccagagacttaacctgggtcagaggtgacggggaaggtttctttgagaatatgatgtttgagctgaattttaaagaatgagtagcagtcagtcatccctgtaaggattctgggctgtacccgaaaagcagtgggaaaccactaagggattttaggcaagagtgtggtatgatccagtttatatgttctgcatcactcgctctaaatgcagggtagttgttaatgaattggaaggggcactggtggatgaacagaaaacctgttgagagactattgcagaagctagcttggcagtgaggatggctaaataaaaaaatttcaacacaacttggtttttattggatgagaaggatccaagatgagaaaatgaaggatgacatcaatgtagcagtagctagaatgaacccactcctatgcatgtcctactgctgaacctggtgaaagacttctccctatagcagatccacaaaatactaagcatgagtttgttatcttgaattcgtctatttatgcaattctaagtgaaaaatgaaacgaaagtagaaaagaggtcagtcatctgtagtatgcccctaaagtttagcagcttgttcaatcatattctcaggctcctagtggaaaagaaccaaaagggttacctacaccagctgagccattttctacaatgacatattcctaatacctgtgaataaatgacaccaaaaaatatgacagtgctatgcttccagggtcctttagactgtgttgatttaaaaacagcttgctcactaaatataaagaaagttttaaaattttaaataatcatcctataaagaagttgtcagactcacttgctgcaccactcaaaggagagagaacgttgggtagattcatatgaatgtgaaaataacttcagctaaagcaaacaatgtgtcagattgaaagaacagtgacttgacaagcctaattttactttccaggtagtgtttaccttccgtaagtgaacttagggaatgagtccaagaatactgcctggaattccaggagactgaatgtatgtgctccggaaaaatcaatttgcaaatatattgagagtttttatagtcatgctggctgcctctttaaaaaaaaaaaaagaaaactaagcaagtagaatgctgccaaatatgactgagtcttagatggtaacatcaaaatttgtatttcccattttagaagcagttgaattttgagctatctgaactctgcccctgcttttctttaatattgagtcatagccatcctatttttaaagagaaaagccaatgactttcaagatttgtacatagtatatagtgatttatagtttacaaagtacttttacatttttgtcttatttaatccttccaacaagccttaaggcaagtcaggcaattttgcttgtgaccttttacagatgaggatattaaggctcggacagctcaaatgatgtttctgccttcacacagtttatgactggtatagctaagacttgaagtcaagattattgattctcagcctaatgttctgttacactaagctatctctctaaaattatttacaaagaataataacaatcatcttctgtgaaatgattgctatgtggcaggcactaggtaaataattatatatataaccttaggaaatccccaaaacaatgctataaggtaaatacaactatcccccaaccccttttttaaaaaaatagggaaactgaggttcagaaaacttaaatgatttactcaaggtactacagctagggagcaaaagaataaaatttgaacttatctagaacatagatcttaactactacttatattaataaatagtatttgatcattaaagacccaaaagcaaattctgaatcaaatacaagcacaaaagcaacctgtcgtaaatttcttcttactctacacagtgaaaggactcatagttttttattcttttttcttaaacaaagcaagacttcatttctaaatctctagatttttacttcaaataccaaaaaagggggctgatttgtgaggtcatggcaagggaagatccccagataaaaggtcatttaagccatggcaaagacttgcatgacacatactgtattctaaacctcctctaggaaaatgctcaggttctcacagccatgtgtaagccaagagtggcaagagtgcccatgcttgtcaaggcagccctttacctgaggccaaaaagttaacccatttcatttatttcttcaaagaatatttggccatctgcctggcttaaagtggaaggactagatatacaatagtgaataaatgcttcatggtccctgtctttctggatctcccagtctgcaatgggaaaaagaaatgggacaaatgtttaaacactgaaaatacaaagtccaggatccaatgaaagaatgtaagaatgtacttagactttggggctagggaaggtctctctgaaatcatgacatttaagctaagacctcatcagtggcaccaattatgaaaataatggagaagaagaggaccccaagcaaagggtacaacatgtgcaagcaccctgaggtgggaaaaggcctaacatagttgaagaaatgatagatcagtgcatgatctttcatttcttcaaatatgtaagattggtgtgtgatctttcatttcttcaaatatgttaggtgagctggtggtaggtaagataggcacaagataacattaaaacacacacacacacaccatcattcagagccctgtaggccagaggaaaggatttagatttcattctaaagggaatttaaattccttatagatgctcgatgttagacttttgtcagatacatagtttgcaaatattttctcccattatgtaggttatctctttattctgttgatagtttcttttgctgtgtagaagctccttaattaggtccagtttgtcaatttttgctttttacaagcaaaaaaccacccaccccattaacaagtgggcaaagaacatgaacagacactttttgtttcttcttttatttttgagacagtctcacctgttgcccaggctggagtgcagtagcacaatatcggctcattgcaacctctgcctcctgggttcaagcaattctcatgccccaaccttctgagtaactgggattacaggcacatgctaccatgccccgctaatttttgtatttttagtagagacggggtttcaccatgttggccagggtggtctcaaactcctgacctcaagtgatccactcaccttggcctcccaaagtgcttgaattacgggcgtgagccactgtgcccagccacgcacagacacttttcaaaagaagacaggcatgtggccaacaagcatatgaataaaagttcagcatcactgttcattagagaattgcacattaaaaccacaatgagataccatgtcacaccagtcagaatggctattattaaaaactcaaaaaataacaggtgctggcaaggttgtggagaaaaggaaacatttatacactattggtgggagtgcaaattagttcaaccattatggaaagtggtgtggcaattcctcaaagagctaaaaacagaacgaccgttcaacccagcaatcccattattgggtgtataaaccaaaggaatataaattgttctatcacaaaggcacttgcacatgtatgttcactgcagcactattcacaatagcaaagaatggaatcaacctaaatgcccatcaatggtagactggataaagaaaatgtacacacacatacaccatggaatactatgcaggtataaaaaaaagagtgagagcatgtcctttgcaggaacggaacatagatagagaccattatccttagcaaactaacataggaacagaaaaccaaataccatatgttctcatttagtggaagctaaatgatgagaacacatggacacaaaaagggaaaaaacagacactgggatctacttgagggtgagaggggagaggagaggaaaaagtaactattgggtactaggcttagtacctgggtggcaaaataatgtgtaacaaacctgcacatgtacccttgaacttaataaaataattgtttgtgtgcatgtttagaggaattcgaagcctctgaaggattttaagcaaggacctaacttggtcttttttccctctttaaaaaaaacacaagagcacggactatctagagaatggatagggggacaagaataaaatgaaggtaaccagttaggaacttattgcttcagttcaactaagccataatggtggcttcagctgggaagattgacagcacttgatagattagcatggtgggtagagtggagaagaatcattgagtcaaaaatgactcctagatttctggcataagcaactggatgatagagaaagaagcagaagtggaagaggaatgagttttaagaagaatgacaggcattcaggcttggacttgggtttgaaatgctatgagacatccaagtatttatgttacatatgcaagtccgaagctctgaggaaaagttggggctgtgcatataaaaatgtgggaatcatcacaaaagaaatgggtattgaataccagtgaacagatgtgattacctagggagaaaactgaagtaagccaagaaggggctcaaaagttgagtcctcaaaagcaacatttcagagtttaaaaaaatttcctcagccagatgcagtggctcacgcctgtattcccagcactttaggaggccgaggcaggcagatcacgaagtcaggagatgtagaccatcctggctaacacggtgaaaccctgtctctagtaaaaatacaaaaagactagccaggtgtggtggcgggcacctgtagtcccaggtacttgggaggctgaggcaggagaatggcgtgaacctgggaggtggagctttcagtgagcctagatcttgccactgcactccagcctgggcgacagagcaagactccgtctcaaaaaaaaaaaaaaaaaaaaaaaaaaaaaaaaaaattgcctctgacctctctcttccgcagagctccaaccatgaccctccttagtaagcactcaataagcgtcagctattgctactagtattaaaaaaaccaagaatagaaccttgaagagctttggattacagaggctggtggactaagcagcagcagccagtgatggctagaatataacagtgggagaagtgagaacagcagtgtctgaaatcctctgcatgtgatggtggtttacacttcagaaaagtttccactatttcacatcacttgtttttcacagtagccctaggaagttagtacaacaggtatccttattcctctttactaagcaatgaacagtgacaaagagagagcaaaatctctaaggctgagtgcagttaatgacaggtctggatttcctgattctgattctcagaagtcagagctatgggctgaattgcttcactacaaattcaggaccctgccctccagaatattttaccggaattcatatagagtaaatatgtttttatattatgtattttttatttttcttaaaaatatataatattttttattttaagaaataaaattagcccagctaattttgtatttttagtagcgatggggtttctccatgttggtcaggctggtctcaaactcccgacctcaggtaatctgcctgcctcagcatcccaaagtgctgggattataggtgtgagccaccgcaccccgccttttttttcttacccttaaaaaattcctgttaacaaaagccttggcttcaagataagagctagaggcaggtggcttgatttccagttctggctccactatatattagctgtgtaaccttgagctcactatttaaaagctttgtggctctctttttggccgggcgcagtggctcacacctgtaatcccagcacttcgggaggccaaggcaggtggatcacctgaggtcagaagttagagaccagcctggccaacatggtgaaaccccacccatttctactaaaaagataaaaattagccaggcatggtggcacatgcctgtggtcccagctactcaggaggctgaggcaggagaatcgcttgaacctaggaggcagaggttgcagcaagccaagatcgtaccactgtactccagcctgggcgacagagcaagactccatctggaaagaactaaattaattaaaaaataaataagaaaatagagccacaaagcttttatttatctacaaaatggaaaaaataatagtacctcagggttattcggattaaattagctaatccactttagaacagtttagaataaatatctttacctaataaaaataataacagtaataaaattttattactgttaggtttttctttcactgctaaaacacgaatgaacagttttccagtatttttttttccagccctttgacttaagatactttttaatcacaagtgaacagaaaagaacaatcaaaaaagccctacttattggtattagtgaagaaacaaagctacctgaattgggaattactttaaaactgcactgtagtgtattttagttacataaagtaattaaaattaatgtttagaaaaaagtcttagtccatgatttctgtaactacagagaaggaaaaagagaaaagaagggaaagagagaggtgggtagggagagaaacaaagaactagagtaaagacctctttgtcctcagtgggctcaggctttccttaagccatgacacagctaagtcttaaagatgagtaagagttgaactacaaaggtggatttcattagggaaagaaatctgaactttcaaggaggtggcatttgaaacaaatttgaagggtagaagaggaattagccacagatgataatcagagaaggcaagtataggtggatacaaaatcatgagcaaagacaatgaagttggaaaacaatttgtagttgatacctggcatgtaatctagatcctcaaagtgaagtctgtggaccacagtatcagcatgcctaaaagtctgttagaaacacagaatttcaggctgggcatggtgacacgcctgtaatcccagcactttgggaggttgaggcgggcagatcacctgcggtcaggagttcaagaccaccctggccagcgtggtgaaaccccatctgtaccaaaaatgcaaaaaattagccaggcatggtggtgggcgcctttaatcccagctactcaggaagctgaggcaggggaatcactggagcccgggaggtggaggttgcagtgagccaagatcatgcctttgcattccagcatgggcgacagagcaagactctgtctcaaaaaaaaaaaaaaaaaaccaaaaaacaaaacaaaaaaaaaaacaaaaacagaatttcagacacactgacctactgaatcagaatctgtactcaaagactcctgtgtaatgcagattaaactttgagaagcactgttccagaacatttgactggctctcaaattatcgagttttaaaaaatttttgatgctggccccatcccgaaaacttctatataaactggtatgggatgtggcctggatattgttgttgttttaatcttcccaggtaagtctaatgtgcaaccaagtttgagaaccactggagattgcaaaacagcttttcagtgagggacagtgggaattaagcctaaaaaaggttcactgggctggaccagagagcttcagatgccaaactaaagataggagaccctttttaaagctaggcattagggtctaaaatccacaggtatgtccatttgcctataaaaaacaagtcagttctgtaccagagcatgctgctgacttgaagatgtgatgtatgcagtacatatttaactgtaaagtatcagctgccatgaaaatccaatgaattgctgtttccaagtttttttttttttttttttttttttgagactgagtctcgctatgttgtccaggctggagtgtgatggcccgatttcagctcactgcaacctccgcctcctgggttcaagcaattctcctgcctcagcctcctgagtagttgggattataggtgcctgccacctcacccggccaatttttgtatttttagtagaggctgggtttcaccatgttgtccaggctggtcttgaactcctgatctcaggtgatccgcccccctcccctgcccccggcttggcctcccaaagtgctgggattacagacgtgagccaccgtgcgtggccctgttttcgtatattttaaaatgtttcttaaaaatacagtgaaatggctaaaaggaatgattggttttctgatttagtttctcccacctttaggtttgaaaggcatacaaaacccaaagcaagacagattcctaagtgcaactgcatctatctcatatccattatctaaaccagaaaagggagatgagtcaaaattctatttctgaaatgtcatcttgatggcttctgccctcacaccttcccatcagatggcgctgtcatcacagtttataccaagtgtcaatatttttatagcaagtacacagtcacttagccaaggttctcatgctttttatgcaacattgtacttggtgtaaagtcttttgtccaatgaatgaccttcctgtacccagtgtggttgggaccaacaggctctgattgcataaccaagaaaagaaaaagttataagaggaactaactcccacttaaaaaaaatcacccaaaacatcctcactggaatataagtgggcataattcacagcatttttttaaatgatagaaacatatccaatatatccagaaagataacatttgcttggattgaggtgagaagagaaaggccttgctactcattacgaaattaacctgggaagttggattggtttttaggagacatggagaaaagtagtgatgatcacacatctacataaatattaaaaattatcaagccaggccaggcgcagtggctcatgtctataatcccagcactttgggaggccgaggcaggtggatcacttgaggtcaggagtacaagactagcctggccaacatggtgaaactccatctctactaaaaatacaaaaaattagccagacttggtggcacacacctataatcccagctactcgggagactgagacaggagaattgcttgaacccgggaggcggaggttgcagttagccgtgatcatgccattccattccattccagcctgggcgacagagtgagacttcgtctcaaaaaaaaaaaaaaaaaaaaaaaaagaagctgtgtatttataatagctgaagtatgatatacaaattatatatcaagcttcaaaaagtcagggggaggggtttagagaaagcagggagtgagactgtagtaacattatcataggaccatctaagaagcctggtgcctacaagattaggattaaatgataaaaacaggtgagaaaatcctgatcatcatcttctgatttgcccaccctctgcaagatgatctacccaagtgagtcactttccttctttggaacctcagcagagtcacaggggaggggtgttgaaatcacataggaggaattgatactttcatgttcttggctccaagcattagtgacctggggcatggaggtcagtagcacttttaatactaaaaaggaagccaggtcctgtaggggggcagagagaggaagtgctctaccaacatgtttccataagccaggctgtcctaggtgacccatctaaagaggaagatacttgtctgaggtaagtaaacatcttcaaggtcactggaactcctgggccccaagagaagtcgaattctaaaggttgtcctagatctgcaaatatagtctgttgtttatatgggagtgagcagggttattcttaaaattgttcttgccttactcaggatttctataggagctgtatcttgttctcaggcaggtaggcatgcaagtttgtcagcttttcacactaaacaaggaggagagacaatatatgggaagaactttgttttatggaaaaggcaaattcataccacaatagcacacaaaagtatgaaaacctctgccaaagaatgatttattttgacacagtaagactggttataaaacacagatgctttatgcaggaatcttccagcaagacaagacattctcagtggagcctccactaaaaagctcaaataaaattaattcatcccattatgactgacatggacaggaaaagcgaaagttctttgcagtggtagaagtttgtctctaattttaatttggttatggaaaagaaatttcattgtaatgaagtaatgacgcttttcttccttttgaaagattagttgaatttttggagaagtgagagacttacaaagcattcagaaatagctgagatgctctatcctgactccttatctctggccctttctgctcatggaagtcccaaacttcttacattttgatatttagggaagtctcagagattacctctctcagccacctcatttcacagataagactaaggcccaaagggctacaaatggcttccccaagcagctgaataacctgagcttcagacagaactagaagagggtcttcccaacacagtctaaaactgtcaccaaaccaaactgggtgtttgcccgtgcacaatggacagtcgaacaccaaacaccaaagcaccaggtttttgcaggagaaaggtgtattgccacttgactgacaaggagacaggaggaaccactcaaatctgtctctccaagctgggggctgggtcatgtttcagaagcatagggtaatgaggcatgatctgactggatcctgcaatggggtgacgccaaggctctatctgactggatcctgccatgagacataagcttcttaattagctccccagcctgagaacttaggttcctcctatggttgcatatttagttcatctgggcatgctcacattatgtgaccttcatcctgggggtgtccatggcaactcaaaaacaactcacaactttgttacataaaagttgagggccgggcgtggtggctcatgcctgtaatcccagcactttgggaggccaaggtgggcggctcacgaggtcaggagatcgagaccatcctgactaacatagtgaaaccccgtctctactaaaaatacaaaaaattagccaggcgtggtggtgggcacctgtagtcccagctactcgggaggctgaggcaggagaatggtgtgaacccaggaggcagagcttgcagtgagccaatttcgggccactgcactccagcctgggcaacagagcaagactccatctcaaaaaagaaaaaaagttgaaccaggtggtctggtgcaattacaaaacacagatacaataataagcaaggctctctggaggtcacctagaaaagctcactgccttctaagagctttccagtacaccttagggccttgtcctctaaggcatctagcaggtagcagcatcatgttaaaccaccccatagggaatggagggcctctattccctaagacttttctattgaatggcaagtaaggcttacactagttgtcttaaaaaaaaaaaaaaaaaaaaaaaaaaaaagaaaaagaaaaagaaagctaaactcactatctactgtctctttccacaggatcataagtttttactgccagtattgagaaattcgtggaagaaatgtcagcaggaagtaaaaattcaccgagaagtgtgtgtgtgttcgctgcttccacacattaatggcatgattttttttatgcaaaaagaaaagaaaagaaaaccacccacattttaatttagcatgagccaatttacagagcatggaaatcactttcatttccggattggcgcgtgtgcaattagcaatgcagtgtatatacaagaagccatgctgttaacagtttatctcaagtaatttggtgtcatttacaaaaggaagaaattcttgccatcagaagggacagaaggagatggaatgatcaaatcacagagaaacactaaaattactaaatctacaacagctcgccttatttttcttggacccaaactgtcagggtataaacactatttgtttcttttttaaaacatcgatagttttgctgtaaataataacactgtataaattctaacagaaaaatagaataaaatgttgataaggcactgcctcttagaacacaaacagaatattgcaaatgcatttaacaaataggggtctcaagtgacttcaccctagaagaggagggagggattctgggtgggggtgactcttcactgattcttgtatattagcaattataatgtttgtatatgcaaaactgctagcttgattttaaaaaaaaacaaatctttaaaatctgctgcaaatttaaataattcccaaaatgaggaattctgtagttctgtgaaaaatttttttcttcagaatactaatattttgatgcatgtgtatcaccttattttgattaaatcttttccaattttgcaaacactacagtatactgcaacacaaaagattttatctgtaaacacaaagcccttcatctaatatttgttgctattgccaatttttcaatgaaatgacctaaaaacaacaaaaaaaaataacctatacggtagttgctttagggggtggggggatgctatctgttagtgcttaaaagggggtaaatgcttgccgctttagaggtggatggtgctcataaaaggccccagtcgggggtatttaaaaaggactgaacagaaatccttagctagtagaatggcagcacgctgtaaaattattactgtattgtgtactggctataagatgtagacacctttcagtaagccaatcatttgtaaccattctagcagtgtcatattaggttaataaggctgctgtgttttaaagggcatttttatttgggttttggtgaaattctttaatttgttgattatattcacataaaatcagcattcattgacacatagctctaatgacatatgtatgaaaaaccatacactggatgacctagtcgattatttaagcataaaataaattgtgttaaactcttcacctatctgtgctctacagtctccttgtgttttctggcaaaaggtagttgtctaatcccttgtcatatgagtcctggccaatccaccccattggtcctctttgtgcctctgtggtcactgaagagataatctctaacattcatatgtgccctgcaagctcccagcttataaattctgtgcatttcatgggggagccaagaattaaagattaattgacaagtaagctttgcccacatctgttcaggccttcttgaaaagtgaagaattggagatactatagccagcatgtcaaaaagttgactggcacttctaggaaccatcaacatgcagttgcttttagcccacagagcttgtttttgttttgttttattaatttacatttattgtccattcttacaagttgggacatttcacataattaagttgctaacatctcttaaaaagcaagatttggcaacaatggacctcattcccagaaggtaacaacctgctagagccaagttgtccctgccctctccagccaggtgtggggtctacaggtatcactgccacagcctcatttcttatatttgtacaacctgactgtgaatttgcaacccatacactgcgtgaatctaaattctactgaggcagagaccatggctgttttaacttttattctagttaccagcttagcatatggtagtagtgatagtagtaactgtgatcatcatcactaaaactggagtgctcactacatgctattctctgttctaagcacattccatttacttacttagtcctcatatctactttatgaattaggtactgtctttctttgatggtaatgatccttttataaaattaaattagtgctaagagactttcagcaatgttatatattgcctgtccattaaagattgttgccaaatggagtgagttgtccccagtaaggattcactatcaatgcagaagaaatgcacggataatctactttgcataaagaatggggctaggttgcatctgcatggtatcccaaataaataaaatgtgccactacccttgcaccaaaattattttatgatgggtaaagttagacccttgagaggttttttttttaaaaaaaaaaaaaaaaaaaaactttcccaaaatgcctctctgtaaagccaggatcagaatataggtgtcctaacttcctatctaagagttacgaatttctgactcagtctttgagagaaggtgtttatcctgaaccagaaactcaatgatgtatacctgtttaggtattaaatagttgtgtttatatgcccaaaaatttgactttaggtatatgtgatatgctttggttccgatcaagcaggaggtcataagtttactcagaagtatccaaaatatgacattcaagatttaacttgcatatgtgtgtatatgcatatatttatacatgtatatgtagattgaatgtgacattatgtatttctaacataatatttggcctgccagcttataaatatgtatttaagcttttcattgattgacattactgtaaaaaatgaattatgattgagaagttctggatatttgctgtttttttcattttatattcttactaaattattgaatttgttaaattaaaatgtgctatcactgtattgccaaattatggcaatacactatgcagtattatttcaatactttaagaggcatctattacttcattgaacacataagcagctagcctcctttcctctgtaaataaggactttttggcatcctgatgttcctcgctgttcatttggtatcatcctggagttccatcaagactgaggattttctccatggccaataaactattgtcagcatcagctcacgtttggctgtatgacagggatatgtgagaagcccagaaataaatcacaaaaataataaggcatcttctgagtctctctgaagaagccagtgatccaaaaactaacttcatatctgagtgagtcttggtattcttgatttgcttgaagaggctgt

SEQ ID NO: 16805 - DNA, 15131 bp, Human
gtaacaatgtgtatctttgttaaaatgagagagaaatccccaaaatggcaaagataggaaaaacaaccatgcttttcaagtactgacttgcattttcagaaggttcaaattggcactagacttaggtaattgaattaatcagcatgactgataggataactatagtctgataaagaaaacaccatgaagggcagggtgcggtggctcacgcctgtaatcccagcactttgggaggccgaggtgggcggatcacctgaggtcgggagttcgagaccagcctgaccaacatggagaaaccccatctctactaaaaatacaaaattagccaggcgtggtggcgcatgcctgtaattccagctacttggaaggctgaggaggagaattgcttgaacctgggaggaggttggggtgagccgagatcgagccattgcactccagcaaggctctgtctcaaaaaaaaaaacaaaaactatgaagtaaattatggttgaaacatgtttagttcttaactgcagtatcttgcatttaaggtgtatgttcataacaagttatatttctattgtcataaagaacgttctattaaatgcttactggctcagaatcctattactttttgccagttagattatggccgtttctcttttagtctaaaataaactcagctgaaaagtaacaataaacactttatgtatacagattaacaacaaaaaatagaaggtaacctgcttggtgttagatattgtaataagccaaacaagtaacttttgtgtaaacactgaagtaagtgctttgaagaattcataaaagtttatgactctaattcatgtgagagataaaatgcatatacatcagaagattacacaatgaaagtatatggctaacgactaatgaatgatatagtaagtgttaaaagagataagatggggcagaggtcactactgattgtaaaaagtttcatgaatgaagcgagacttttatctgggtctaggaaaatgaagtcgttacaatcattacatcttagtacaagcaaggaatcaaatagtatgtctctcatgtgaacattttaagtaaataactggagaaagtacttcaacaaaataagggagcaaaataatgttggctcaaaatgaggtcgaaaagttgcagggctcggatcgtgttgctaaaggcataaatttgggagtcctcaagctgtagctaatagttaacgtccagagaaggtagtgtatattccatagcctcatgcaaaggaattccaactacgaagacgaaccagttaaggagaccgaaaagggggggcctgtatggaaaggcatagcaacgaatgtaaaatttccccaataatactctaaaactgccccacagcttttttaattttgaaaattcaaaaccattcaattcagctcgcagatttttgtgagaaataaggagatacttgcagctcagaaaaaattattaacaactatctagaaagttactgctttatcccccactgtaaactatactaccacgacccgggatccttgttcgactcctagccaaggggttcccactgcgtttctgttgggttatcccaaacctgtgataggatagtagcgccctccctgcctccggtcgaataaacactacaacgtctgacactcggtgctgaaaggaaatcgggcgcaataactgtcaccggcgccgagatgcggttccggcgcttagggcgccgctaaactcagagcccgggagtcatggctgcgggcggtgccgccccaggtaaatcagtccaggagcagggcccgggcctggcgtacactctcggaaaaatgggggccagagcaaacaagaagagcgaaagcaagagggctaggcagccagaggcggcagcaagactcaagacgccaacggcgccgtcttcctggggccccagggcctgcgccatccctgggctgccggggcaccgcctctccacgcccctcgtccggcggcggctgcgactgcttccgaggtcatgttcccaggacgggcgcgtcttcagggtggaagcctggcgcacgtccggaggtgccgaggacccaaccagcccaaactctgggggaaatgactcccctctgccctcgccccgcgctctgctaccatttccttacgtctctgcttcgctcagcgatgcaaaacgcgcgaggcgcacggcagagggccgaagccgcggtactctccgggccaggcccgcccctcggccgcgccgcgcagcacgggattccccggccgctgtccagcgctggccgcctgagccaaggctgccgcggagccagtacagtcggggccgctggctggaagggcgagcttcctaaggcggggggaagcccggcgccggggccgggtaggaaaggcgggggaggggctccggccgtctggaaggaatccacgcggcttgaggctgtgggggaagtagggtggcgagcggtccttctgcgcgcggggggcggggggggtggggtggtccattagggtcccctggcgagggggcggctttctagtgtgtgagggcgacgccctagaagctccccttcaaagttggccccacgcgctgaatgtggaaagttgactgggacccagtagtttcccatcccaaacctgctttccgagaagggcttcaaacccaaaatgtgaatcccgcctcccctctcagccagaactgtggactcgtcccggggaggggcggtgggtggggcggggctggcgggaaatttcggttttggcgcgctccctgcggcgacgctcatcgtgcgctctcctcttcccccggtggtctcctcgctcgccttctggctctgccatgccctgctctgaagagacacccgccatttcacccagtaagcgggcccggcctgcggaggtgggcggcatgcagctccgctttgcccggctctccgagcacgccacggcccccacccggggctccgcgcgcgccgcgggctacgacctgtacaggtgagcggggacctgccggcgaggaggctgggaagggccggccgtccgctgccacagctagaaacagtcaccggagagatcacaggaacacactagctataaataggatttctgcctttttcgtgtttaaaattttagctttcatctttggcataaattaaatagagatttgggcaaagactgcagaataagtaaaatagctatacggtgtctagcaaggcgttactttgcaacgtttattgtgcccttcctaaatagaagatagagaggaaggcccatggtggctttcgagtggcccgagggtgatgctgtgctcaatagaaaaaccaaggtgagagcctagatgtgagcgtgaaaatacctaagaaggatgaacgaagatgcatctgccttaaaaagttattttctatacattcatccggcccagggcggaatttgagaaggcatctgaaaacgaaaggcagagctgcctgtaatctaccacactttcatctctacagcacgttttacctgtactaaaaactttccgtatgctgttgtatttagtcctcacaacaatccttaactagataagtgttactttttacacaggcaggagtttgtgaagagctgaattgatttccccagaggcttgaagatgatataattttttatcccgaattttgggctttttttttttcatctgactactgtgcccagttcttagaaccattaaggtaggagaaaagtaatgctgagagggaaggagattttatactaaatcccaagcattgggatttattttaaagtatctcagataattcaaacatgagaactattagtctaagcacaggagaagagaaagtagtgcctgatgatagcaacagaaaaaaaaggaaaaggaaagtaggtatggacaattgtagctggaaaaactacagtctcttaattttgatgaataaaagtagagtgatatagtttgactagacctttccaaagtatattttggagcactttcttgagtcctaggggagtccttgatttaagataccttaagtagactcctaataaacacaggtgactttctgtatactgaaattgacatggaaataatggatcagcaataaattagggcttaactgtttaaagagggatttcagtgaaagaaggggtagtactgctttaccagagttaattaaggtctccaaagtaaacttccggttctgctcattgtaaaatctcttaaatttctacccaggagagggccacagtaatatcaagagtagcagcatttgctatgtggactttagaggaattctgttcctaagcaaggtccatctccaggggccgttcacggtgatcagctgtctccctcagccaggaaattcatagcctaagcttggtaaactaccaagccctgcctgacagatacaacacagttctttatctcttattttgtccacccgtttttctcctttccttctgcatattttccctaatcacacagatcattgtgagaataaaatgggttaatatatgtaaaccaattagaactgttcctggcacacagtaaaggcttaatcaatgatagctagtattattagtagtatttggccttttttctttgttctttcttcatttttttccttttcaaactatggttgtaaagcatccaccttttgaaagtttgcctttctgccctttcacgctgataagtacctcagtttccaataaacttttgttcaggggcaaacatttacaatgttgacatctcttcacaccaccaaaaatattcatggagaattattttatctaaagctgtctttttaataataaaatagccacctctaccttcttcataaacttttaagatgaattggtaattcatcatagcaaggttgattttagaaactaaagttgcattaattcattaaatacactgaaagtaattttgtatgcttggtcacaaagaaaatataaaaacaattttataaatagatttgcagttattttctttcaatattttcttagtgcctatgattacacaataccacctatggagaaagctgttgtgaaaacggacattcagatagcgctcccttctgggtgttatggaagagtgggtaagtcatttaagaaacaggtaactatttgtcaagttctcctttgtgatagattcttcatgtttcatttggggtaataagcaggcaatattgcttgggctgtgtcctaaaagaagcaccatttgtgatagcaaatgcactctttgaaaggctttatttacatctctgctttgcctctttttgacccttttatttttctccttcctcactggagcttttaggctcacactggcctagaaggctgttctcagaacatggcattttatattatgagagtaaaacttctgacctgttggtcccagaatgtgtaagcctacttaaccttttcttgtttggccatggggttagggtaagggatactcttcagtgttgtagaggcactgggaggagctaggacaaaatggagtacacgtcaacaggtttgatttttctggagcggatcagttgttaccagacagttctttgcaagagcgtaagttctttttgactaacttcagagtaaacataaaggaggcaatggagctgtgacgccctcctccagggaaaggagctagactggcactatattattagccatgagtgaggaaactgccagtacttcagcccttaaaagataacaagatgggctctcatctcatctcttgagcatcattgactccattttttagaattttttcaggggaaggggcaggagatggagtgaaataaaggttagtacagaaagaggcagcattattgacaaagtgcctgatttaaattattctaaaataaaatgctggaagttaggataattaattataggcctgatgcttgagtctgcaataataaggtgtaaccttagctttttatttttttcattttttaggattaaaaagtatactagcattgaatcattgagacttagtttttggcatttttacttaactgatattagcccatttatcttactctggttcatgtgtttcctacaggcatgtcttttggcatctgaatcatgaatagtggggtcccaagttgtaggctatggtctgctactatttggttaggtttgtttccctctcccttcctcttcctttcccttcccatctgcattgtacatgttgtggtgtcccatcttaaaaccaaagtcttcttcctcagtagtgtgttcctgctggccatacttctctttcttcccctttgaggcttaacttcttgaaagagcagcctacagttgttcccgcttgctcacctttcagctcattctagcagtccttctcccctgtctgcagcaccacaaattctgactgaagtcacatgggagtggtttaagttagttttgaattaaaaccttgtggaatttttctaaactagtctttccaactttggtaatgcagtatgatgaatatatattctttaattcaaaaccatgtgctaaagttaagatgaagatatagatattataggtgaagagaatgacatgcttaaattgcatcagttatctctgatatagcccttcccccttaaaataaccaatgtctccttttttgttttttagctccacggtcaggcttggctgcaaaacactttattgatgtaggaggtaatatatttccttttttattctgtaaatgtttgcaagtatttactttgtctttaaaaggtaatattcaaatgacagattttatttttaagaaaagaaaatgattagaggaaagcttgttataataggaggaaaagctttgtggttattttaagtaattatattttgtttaactactaacttaatttttaaaataatgattacctaattaataatgacagatttaatgatataataattaagtaattatttaagcaacaaaagttctagaaaacacaggtctatcttgtaagaattttcttcataagagagctatctgtctttagcaaaatttaagaagaaaatctttccctgaagtcaggagagaaaacacttttctctaaatttgttaagacagtcctctgtgttacctgtttcccttataataaagcctttctcatgtttgtctcaaagttaaccctacctcatgtggtacctttcatgaagaaccctcagtgtcctctgctaactactcttgatacagagctactcctcttattgtaaggaaatttctactttcctgatgtggtttccttgtttcaggtccgctccaactgggattcagaccccacttatgtggtccttacatactgaccctttatcccatcagtagtgaatctttcacttaacaagataccttggcccccacataagtaggtgtgctagatctcctcctccacccgtttttacagagctgctttatggaggcttgttaacagatcaggaaaactggcttagaaatgagcccacatggatatgtggtaaaaactggagtctctgtgtgattccagcctccttgttctttccactgcaattaattgtggagattaccctgctgcatccccctcaccaactaaacacgtccagaattagctcacttttatgtgccactgcaagggctaactaagcacttaatgaaacctggctatcctagacctgccccttagtctaacatttggtgggtgtggtgtctctccatagtgtcaccaggtggtgctgtgggacaagacaggaccccaaaagtacaccctttagggactaaaggggagctgagttttacatagcagggtggacattgacagcccactcttgggttgaggattccttgggctctgtaagttatgcccgatgttcaaaaatgcttttacaaggtcaactgtggtcattttgggacagtaacttaaggatataaataattgtatatattttcaatgaagtttcaaatgattgttcaaggaacgggagctttggaataacaactggatgtaggtcccagctctgtcattaactagttattacttaacctttctgagcctgtttcctcattttacaatggaaattagtgtgcctgcctctagaggtaggaggattaaatgataatgtgtatgaaatacctaatatagtacttggcacatattagattctgtgagatataatttctgtccttagggacttcacagattgtttttatgtggaaactttttcttttattcgactttgttactaatttttgctctgtttaaaacaactttctggaaaaaaattcatgtaaaagaatggaaagttagtttgcctagtggttggtatggtgttattcataaaatcacattgtggtgtgttcttggatgcagagaatcttaacaatctcccttaggcacaagtttatcatagttggcaacagtttttatttctgaagagagatgttgttagaaatcccaggctctaaataagggtcaaagggaaaagttgagcattcaggattctgttcagaattcacatctggtaggtgtggatagtttttcactaaaaaaggtttccaacaaatgacatgccaaactcttgacacagtaaaacttttgcctgaagtcagttaatcactctgccagttccaatgcatgatttttccagtgataacttcaagttactttctgctttctctgaggagaaatatccctgatacttatatcctgtaggcagagaaggcttttcttggaggtcgaatggcaattgggtggtaaatgaatttggaactactgaaatttttataccgtcaacattcatgcaaaaaaaaaaactattgagggcctttttttctgccatacatttgaattgacttcaaacttcttaatttcttttagtcacttaaaggtttttcacattttcgtggcccaagcataaagatcacctatctgcaggattcaagacacccaatcatttgagtagttctgataggactgctttacagatacgttagcagaggcctttcaaaaagggagtgtttttgtatgttagaagatactataaagccaacaagcaaatatttgcaacttatatgaaaaagaacaaatgagaaaaaaacatacacaaaatatagacaaggacatgcaaatgtccaacaaatgggaggaaaaaaatccagcctcactagtcatcagggaatgaaaagtaaggcaatgagatagccattttgtactcatcatattggccagaatgtaagagattgttgccatcaaatattggcaaggattttggaaatgggcattctcaaatattgctgatggaagtttgagtggctacaccttttttgcaacctatttgatgaaaataaaaagcattcatatacaaggatatacttaaagggctgcttcatttattatagcaaaatgtaaaagcagcctgtgtctgatattatgcaagagaatagttacatagaaacaatggtacaggttgggcgttgtggctcatgcctgtaatcccagcactttgggaggctgagacaggcagattgcttgagcccaggagtttgaggcttatttgagcaacatagggatactttctctctacaagaaatacaaaaattagccaggtgtggtggtgcctttgtacctggaggctgaggtgggagaatcacttgaggttgaggctatagtgagttgtgatcataccactatactcctgcctgggctataagagtgagaccctgccaaaaaaagaaagagaaggagagagagaacccatatttccatatcttgtatctaaaaagaatggctaacatttacatatattaatctcaaaggataaaaagaaaaaaataaagtagtatgtaagatatatttctgtaacattagctatctcagggagggtaagagaatattataagcttttactttatatgtatttgtattgttttagttatttaaaaatttttgaataaagtagaaacaatagttcagaagtcagtccatgtctttctctaactcattcaagatagatgaattattagcttgtacctcaaaatctcccagcatggaagttctctagcctactgtggccattttttctagcatggaacaacatgctatgttgagggatttcttcattaaatctaatttaaattgtccctgcagtcaaaattttttccatatagataatatggaaaacagctggtttcatctttatatcaaattttttcataaatattaaggtgtaaattaatggtcaactgacggtggagaaataaagcagggtttggtattggaattggtcaagttcaataatggattgtttccttcaggcccgacaggagatgaactgcctttgctgcttttctgcccagttttatactcactcttctcgtaaaagtgttgcatcaggaaccttttaagaagtgcttaaattcagattcacttgtccctagtaattcattcataaagcacaggggttcatttaaacgtatgttgtaatccattcggaaaatctaaaatgttgtttttgctgaatatttttccccgtggtggacctaagggtttgcttttttccccccattatatgagaaaattgaaaggatatgcttaggaattacccttgttcttaaaaaatggggggtgggtatgctttggggtttttttgtctgttttctcagctttcaaataatgaggagtatgggcaaatagcattactgcccattgagctgaacacaggattatttttatttccatattttttccttcatcagggcttttgtttggggtagagtattaataacaagtaagatgtgacatggagctgtcttcagttagattcacgtgagtcttatccagcctttcacaaactgaggagaaagaattaacgtgtatagcaggaaattgggggtgggaggaggaaggggagtgactgctaataaggtaggggatttttggagggagggtaatgtaaatgtgctataattgactgtgacgatagttggccaactctgatacactatgaactgtggaattgtaacacttcaaatggataaattgtatgctttgtgaattatttatcaatataaaaaaatgaaaaggcccggtgcacctgtattatctgtgcttgtgcttatggaaatattttaaattattggctcaaagataaatgctagcaagtctggtaagtataactctctgggctatgtcagggacctggctcaagtctcccctgcaaagatcttctccccctgtgttcataatcttaaacaagtattaattacacaaaaaaagttgtactcatgaagcctatgtgctacagtcttctgagaaaccatgctctaagaaaggatggtggttcagattaaaaggagaggaagattatgaactgaaaaatacagcttcatttttagtgtaaaaatggaatattctaatatttgcaagactgctgcttaacaatgtcagcgttgatttactccactgcagagctttaggctttttgacatttttatttatgactcaattgtatttcaatctgggtattagcgggaagctgataccaggaaaaacctttaaaacccaaattgtaattttctcctagtctttttggcaagtgtgccgtgggtagacagtaggttggagatggccattgctactgccagcttaaaataggaaatggtcgccatttgataaagagtgacaggttggaaaattaggacctgttttctaaatttttatttgtattttagtaatgtcatttcttggttttgaggctttacatagtaccagggcaagattcacttattcaattgtaagaatacaaatctcagagctacatgataatgattttgagataatcttacacctctagtattccaatagcaaaaattgagataatattacttttcttttctctagctggtgtcatagatgaagattatagaggaaatgttggtgttgtactgtttaattttggcaaagaaaagtttgaaggtatgttaaatatatacattcacataattttagtgaattttcagagtcatgtatgtgtaaattaatattgactcctttaattctcattgaataagacaggatatggcgaatgtgtcagtaacgtcagtaataaactattctttctttgaagtcaaaaaaggtgatcgaattgcacagctcatttgcgaacggattttttatccagaaatagaagaagttcaagtaagtattacaaaggaagatacagaataagtaatataacatcttaagtgaagaaatatatataatcttgagaatttaatatgctgtttgtaactaaatagtatatatgactaaacttattttaagcaaatttaaaatactagttttagaatttctttaaatgtttttcatgtagctattatgtagtattactttggataataagttatttaaacatactgtgaacttctaatattttattagaattttttaaagttatccagtattctaatttatggagctttttagaatttaattttctttctgtaatctcccttttgaaaagatgatatagcaagagtagaattctggctgtatttttcttaggagctggagaggaaaactgaaagaggctcttaaaaaaaactgtgaagcttactacctttctatctttcaggccttggatgacaccgaaaggggttcaggaggttttggttccactggaaagaattaaaatttatgccaagaacagaaaacaagaagtcatacctttttcttaaaaaaaaaaaaaaagtttttgcttcaagtgttttggtgttttgcacttctgtaaacttactagctttaccttctaaaagtactgcattttttacttttttttatgatcaaggaaaagatcattaaaaaaaaacacaaagaagtttttctttgtgtttggatcaaaaagaaactttgtttttccgcaattgaaggttgtatgtaaatctgctttgtggtgacctgatgtaaacagtgtcttcttaaaatcaaatgtaaatcaattacagattaaaaaaaaaagcctgtatttaactcatatgatctcccttcagcaacttattttgctttaattgctttaaatcttaagcaatattttttattcagtaaacaaattctttcacaaggtacaaaatcttgcataagctgaactaaaataaaaatgaaaaggagagattaaaggtattccttgttcttcccttctcttcactagtctaaaaacttctttttaatcttaagattctttgtgatgagggtgagaaaaagaatcctcagtttatttttccactattaatctttcttttgataaatcctctattgactgggtagaggtatgtttgtgaaagacatgtaacttggggatttgttactttaggtttgttcccttgaatttcatctcatcaggcaaattgtactagttgtagttacgagttttccctcagtgaagtagcaataggctgtaatcaagaaaatatgccatttatagagataagataaatgaaataatacttcagccaccaggtttttctgtctcacatacataagcagcatttcattgcagatatgggactgattctgtggcttaccttgattaacatcttttggaagttttgctagtgtgctttcctttctttactatgtttctcagattcctttgtatcagggttttgggtgtcacttaggttttgtccatcagattctgtgagacaccaggcatcgttttgaggatgtgggttatacacatggagtgcttctggaactatcagcccacttgaccacccagtttgtggaagcacaggcaagagtgttcttttctggtgattctccaggccatttaataccctgcaatgtaattgtccctctgtggctcacatttcattagtgagccatgaaatcaactcagtgggacatagccagcatttttgcataccaggttgggctataaaatatttctgttgtcaataaattttaaatgttttcctgctaaactaaccagaatgaattctgttttgtgcaactaaactgtgatcaataccgagtaacagttgagtaagaacaaacagtattacatggctaccgagaaatatggtcttagtttacactgttaatgtcagttacctcttacagaaagtctgctgtaacaggcacttcataaacacctggttttttactcatactgtgagagagtaggtaaaacccattgtacagaatgcagaaatgggctcagagaggtttagtaacctgtataacatttcagctatgatgatcactgtctttgttttgtgctgctatacctgagatggtaatttacagagaatggaaatttattctcagttttggaggctgggaagtccaagatggtgcctcattgctatgtcctccagagaggaggaatgtcatatcctcacatggcagaagactagaaaagagccactcccacaagcccattttataagggcactataatgcattcatgagggctcagtccttaggacttaaacacttcccgttaggcgctgcctcccaatactgttgcattcgagactaagttcccagcatgaattttgggggacacattgagaccacaccagtgacttaaaatgcaggcccttatgccttcaagtccatatgtgcagtatcttcagcctcttccaagtggtagaggtagagaatgtagagaagagagagtttaatttcttcatacccggaatgtttccatctgtgtaccatgcttaaaggaacatgctcagatatgaagctgctcgggaaattagagatttggagtatgtccatggggttaggtgaaagacccaggatgttttgtttagagaagaaatgtatcgggaatgggaggaatatgggggaagaagtggctattgaaagtccctgggatatgatagatgtccttagattaaacacttagatggggctgggcacggtggctcacgcctgtaatcccagcacttttgggaggccaaggtgggtggatcacttgaggtcaggagtttgagaccagcctggccaacatggtgaaaccccatctctactaaaaatacaaaaattagctggggatagtggcacgcgcctgtaaccccagctacttgggaggccaaggcaggagaattgcttgaacccagaaggcagggttgcagtgagccgagatcacaccactacactcca

SEQ ID NO: 16806 - DNA, 32244 bp, Human
gagaaatgttactttttcgaaagtttctactactgcctctctctctgaaggccatgggacttaactatttgtcaaagcagaaattcccaacatttcgtaaacaccactaattactttttataactgtaaagacaattattccatacttaaaaccaattcaaaataaaataaatcctcaatacttcttattccctggggtagtaattttaattagattttattgattctttattttctcctatgtgcctttatttgggaaatactgttagtctaccttactatcgagtctctttccctagcaagaaaatgtcagtcttaagagtcaggaaagcttttactttcactatcacatatgaagaatgaactaaacacctaaattggataggaaaacttaaatgagggattcaggacacttcccaaggggtcatatgaccaatttaaaagttggtatgatgtgtctaaaataacaaattaactcttttacttataataaaggtacagatgtgctgattagtcatgctaacatgtacatatgaaatatgcctaaaccaaattaaaagaaaacaaaatacagtctatggcaatcttgaaaattcagggagctcaataaatattaagaggatgctctcacaatgagagcattaaacacttggtaattaacataatttaatatgcaaaaataagaaaatatacaggatgagggatgaggagtacacataggaaatttttgtgattttcttcattttgattgtattgctttcttgtcttcaggagggaagattttgacttcaaaagtaacaaaatatttaagaagggaattcacatctttctgttctaaatgatattcttgcgctattttctcagcagttcatgtttctggataaagtttatgattattgaaaagtgtcaatgcttctacagtggaaattttgcctttgggaatgctcttaatatttatcatatcaaagtgatggcctttcggcaatctgaatttctttggctcctgacgtgtttcagcagctttcagctgcacggaagacacaggatctttggaatcaacacacacatattttagaaatgacagcagcttgtcatctttacgagcaatctctcccttaatttctggatagagactaatctgctctggcaggaggctgctggtagaggggtgcctgggagcgagagagggcttcatgttgcggatttccctttccgctcggttctcttgaaattcctgatcccgcgagtcaccgcagcccccatctccttacaacatgatgccctcaggttcacagtaatgtattttttaaaaaccagtcgttgttaccttaatttggtcccaagggctgtaaaggtcagtttacaactcgttgaacaactgagtaagatttaaggcaactcaactgatagctgcatacctaatttaggatatccatagaattgttttgtcaactacaaatataacaagcattaagtgtaaactgtgttgctgaaaagtactccaagtatcttaggaacacccaccgcaatgtgtgggctaaatgcacacgtacaatgatagcagaaataatacctgtcatataggacgggcatgtcagccttttctccgcgaaaggcttctggtcctaagctgtcccttactttcaccggaatgagatgcgtccagagtcccaagcaagggaggagactgctcctttacccaggaggctggaaactgctcgatgcgagcgcagtttccgacgcccttcggctgagacctgcagcaccggacgatgtcccagttgccagctttagttgctaaggcaccaaccacttcggaggaaacggggggtggtgcagtctcttttggagtcgtagcgaatcagctacaagtcgagataattagttccggcaggaaacagctcctctaagagggactggaaggcggaaagaagctgagagtgacgcctctgagccgcggaggattgtgggaggaggttgtctccaatttctcctccccctcccggccaagatgtctgacatggaggatgatttcatgtgcgatgatgaggaggactacgacctggtgaggcgcagggaatggaactctgagggtggtgatgtgtcttgttttcggggtccgggccggggcgcccgcggcctctccccgtagagcatgtgccgtttacagcctctctcagtgcggtgacaggactggtttacctcctccccgttcccgcaccgggcccgggccctgcttctccagcatgggggaagggagggcaaaggaggcagcgaagggggccccgggccttgccctccgagtctgagcgcctcttcggtttacacggatgcccctggtcccaggcgttcggttctctgtcttctgcctccccaccgcgctagccgcctcggtgaccatgctgcggtgtaggccctggctttgccctttcgggcccagcgttccgggcccccacttcttcacactggaactgagcgggtgcgaaatgctaggagaagtcagaaaacgggggtgtccttactgctcccaggcctgactgcgaaacgcaacttgtgagtctcctggagacatagcttaaatagtcttgccagggccagttttggtccgaggtaagtgtgtaggggagagttcagagcaaagataactgaaaaaaaggtagtcgaaccactttttcagttctttataaagaaaagctggggaggaggttttgcttgtggtgtttttggaggacgggtgaaagataattgaacccatggcttttcccttagaaatttcccagtatacaaagtttaaaacagcaacagcatagaaataaacgaatttttctgaccgaatggagatttttaaagattcaaagcttcatttattaatggatttgcaagtttgaataacgtttgctattcaaaaacatcgtgtggaaactcagaaaattatcttgatccagaattaacgtcaattttgctgtgtttctttattttgggggtgtttcatatggttcttttatggtgatgctgcattatcataaagttacgaaatagatgttttgggacgtctgactcattttaagtgccagagattgtcaaaatattaatacattgttttgaattagtctataactttttcgtatatattttcagttttttgcattttaaaataaggcacactttgcaaaagggagaaaggaaattctcgctattatttgaaagtcatagtagagatttttataatttttaaagttaaatgtagtttcgctaatagttatggtttctaccttacattttagtttgtgcaagccagttgtaggcagtgacttcagttcattaagaatatgtatctgtccatttttacttattacctgtttatttatattacaggtgttttgttatcaaaatgtttcttttatatgtgcttgtatttttttaattgattcatagtattttgtacatatttatggggggtttcgttacatgcacaggatatgtagtgatcaagtcggtatttaggatatccatcaccttgtgtttttatcatttctgtgtctagggaatatttaaagtcatctcttctagatattttgaaatataaaatacgttttaaccatagtcaccctgctccgctgtcaaacattagaacttactccttctatctaactgttggtttgtacataccattaaccaacttctcttacttccccactcctcttccccccacaacacccttcctatcattctactctctaccaccgtgaaatcaacttcttttgctcccagatctgagtgagaacatgtgatatttgtctttctgtgcctggcttatttcacttaacctaattctccagatccatgttgctgcaaactgacagaatttcattcttttttatagtcaaataatattccattatgtatatataccacattttcttcatccgtttatccattgatggacacttaggttgattccctgtctttgctgttatgaataatgctgcaatgaacatggagtgcaggtattcctttaatagaccgattttctttcctttggataaacccaggagtggattgcaagatcttatggtagttctacttctagtttttgagaaatctccataatggctatactaatttacatctccatcaaaagtgtagaagagttctgttttctccactttcttgccagcattctattattttttgtctttttgattaataaccattctaattgtggttttgatttgcatttcttggtagtgatattgacctttttttttttcatgtatgtgttggccatttgtatgtcttctttatttatttacacatgtatatatttttagagatgggattttgctgtgttactcaggctgggcccaaactcctgggcccaaccaatcatcccgcctcagcctcttaagtagctgagactactggcacgtgccaccatgcccagctgtatgtcatctcttgagaaattgcatttgtattattagtttgtgtttgtaagtgtttctgcttacctctttcctaagcaatagtctgttggatacataacttattagcactgtgattaagctgatgatcatctttgagaatgtaatgtagcaatagcagtgagaatctttttgtcccatgaagtacttgattaacttttgcaagattttttattaaacatacagtgttttaacttggtcatattttcccagccttttagggcctacgctacatgagcagtaaaatgaagttgaatatataattgctttaacttttttttttgaaacagagtctcactctgttgcccaggctggagtgcagtggcacaatctcagctcactgcaacctccgcctcccaggttcgagcgattctcctgcctcagcctccttagtagctgagattacaggcgcctgccaccacacctgactaattttttgtgtttttattagaggcggggtttcaccatgttggtcagactggtcttgaactcctgacctcaagtgatctgccctcctcagccttccaaagtgctgggattaccggtgttagtcaccacaaccagccttgttttaacttttttatttcttaaagtaagattttgcactaccacataatgaaatgaaatgttggagttttctgttgggttttttgtttttctttccctagcgttctattaaatagctcttcctcccctcatctgtctctcatcaggtgtctaattgtaaaattatttatgatcaatttactaacagttaaaacttttggtggcataaaacttatttagtaatttgtttttcatttccttaaatcatatatttaaaaaaaaaagattaatgaagcaggttaccatttcatgcttaccttttgccaaaagagtttttctttttttaaaatagttattttgtctgggattttctttttttttttttctgtttcttagtatttaaaaaatgtgcgtaattgacttgttttctcaagatttatttttataaaaaatgtattgttttttggaaaattgatcatcacctcgttttagttaaagtgttaactaagagcagtgagtattgctgaccacagtgatactcagcatatctttattggtcgtccaatgatatattttaacaccctaaatcactttgttcttccccaatctggtagaaataggtagttaggataccacctgaaaaattaagtctgtttctaaaactgtactgtttttacccaagaaagtaaataatgatttctgcccaagaagaatctaaaataaaacaaacttgttatttaaaaaaaaaaaaaaagaaacgaatataaaagaaattcaacatacatgcatgatcatgtatgttctaagatctgtttgattttcattagaggcagaagcaggcatttctaaacatagtaatctgtggtaggtgatggtgctagtaaatgacatttaatgcaatgctaattttacaggtttatagattatttgctgatccagtaacactaaataataatcatagtgccattcattaagttggtaaggccattgataagctaactgttttaattccgcagtccaatcgttctaccgtgaaacttctaataatctttttagaaagaatttaagaccaattgactttattccaaaaattagtctttagtaagtcctgttatatgtaggatattatatatttgaatataatttttttttttttttttgagacagagttgtgctctttcgcctaggctggagtgcagtggcatgatctcggctcactgcaacctccaccttctgggttcaagcaattctcctgcctcaacctcctgaatagctgggaccacaggcacccaccaccatgcccggctaatttttatattttagtagagacagggtttcaccatgttggccaggctggtctcaaactcctgacctttggtgattggccttcctcgccctcccaaagtgctgagattacagacgtgagccaccacgcctggcctatatttggatataattatttaaatgtattacaaggaaaacattgtctaaaagttagaataattccacttggttaaatatatgaccatatgaccagctgtgagcctcattatattcccctagtcaagctcatagttgggattaggggataaatgtttactagtattgttcttcttgtcttaatatatagcagttttatttattttttttaacttttaggttcaagggtacatgtgcaggttagttatatagataagttcgtattacaagggtttattatacagattatttcatcacccaggtactaagccaagtatccaatagttattttttctgctgctctccctcctcccacccttctctctcaagcaggccctagtgtctgttcccttctttgtgttaatgagttctcatcatttagttcccacttataacagagaacatgcagtatttggttttctgttcctgcattagttgggtaggaaaaatggcctccagctccacccatgttgccattattttttatggtatagcagttttaatgctctacatttttacttatttgtctatttttttgtgtgcagtggggaggtaaatgagtcttagctacaggatctcttacagactctcgtatttgtcatccttttaataaaaagatcagtagaaagatgatggtcgattgccagtgctatgtacatagtgaacatgtattcaatataaatgttaagttcaaaaaatatcaaagacggtataatccatattatcccaattttgttaggtgggaaaaatatagaaaaatgtctgcaaataaattatcaatggttttatttatttatttatttttttatttttatttattttttttttttttgagatagagtcttactctgttgcccaggctggagtgcagtggcgcgattctcatgcctcagcctcccaagtggctgggattacaggcatgcgccaccatgcccggctaattttttgtattttagtagagacagggtttctccatgttggtcaggctggtctcgaactcctggtgatccacctgcctccgcctcccaaagtgctgggattacaggcatgagccaccgtgcccagcagacagtttttttgttttgttttgttttttaattctaatttactccatagttaacaaatcagcacccattaacttgtgtgaatttttttaaatggataactttatcagtagctaaaccataaatggctacctaggatttgaatcgtgtctggtttttaaggataatgaaacaactgccatgtacctcttagtgtgccaacatatggtacagctgttagacaagactcagaaagcattgttaatggtgagtattgttttcctaaagtacatttcttaggacttctattggcggtaaatacaagagtaagtaaatgagctatggaactgatcctgttcagcagtagcgacattccagatatagtcaaaattgaccctggctgctctgtgttgtgttattttggaatgtttatccaccttttattttaactcaccaaacactcactaagcgttttgtaatatcccaggctctcagaatacacagatgaataagaaagttcctgcttctgagaagttcacaatttggactgttttaacatacaaagctctatgttagagagatgcatgtcatatggaagcatgactgagaaaaaaaatttagtttgctaagaagagtgatgctaagatgagttgatgaacacatttcccagcagtattagggcaggggagtatcttaggagaaaatcagaaagtttgttaggagggaaagtggtttagaattctagcaaaaagagcagtttatgccaaagcagagatttaaaattgtgtggcatgtttgagaaagagtagattttggttgtgtggatggatcacaaattgcttgggggaaataacaggacatgagtaggttggaactattattgaactttagggggtttttttatttttaatcccttttacaactgttcttgtaaaacaagtgcttgattatttttcataatttgcttaacctcttcatttgtttttaaagcattctttatatactaattaaaatttcactttctcttctgttaaagaacatttacacttttacaaattatctctttttcatttgacgtaactaattcagtttagcaatacttactcaatacttctagatttcctattctgagtaatggcatcatgtgttaccaagcctttgatagtcattatggataactttattttcctttatcttgtgcccatatgggcacttttattttacatccttaacattgtttaacatcttctgtgtttattccatcatttattgtgtcccctaacttttctccttattctgcttcttggagtcaggccttcacagctcctggccagacttttaagattatccaatgggctcttcattgcttccagaaacacaaatctgactatttccttgtaaaatcttttagaggctctttattggatctcatctccttgtaagacttctgttgtcctgttcctctgttcaataccagttcatctttcatcagccctttacataacatcctgtgcttcagcccaaactattcatactgtttcaagcttccttgcatttgcatgttaattgctttatttcagctgcccttcctcattgctggcgattcctattcatacttttatacctgacttgggtatctttttccttcctctaactcagaagtagttgattactcctttttgagatgccagtggacttagtatgtgtgtctgttattgcttatattatattatattatattacggttttgtttgcatatctgttccttaatagaccatgaataccttgaggggaagggttgttaatttggatttctgtgagcaataattaattgctggcatatattaaagatcatgatttttgagtataaatagtagaagcacctaaacaatagaattgttcttccaaagacttcaaaacatgagtttgaaaaattatgcctgtgtaataactgaagaataatttgcagtagtgcacagcttgtgataattgattcagtggggtgcaaatgatgggttagtgatgtcatgatggctggttcaagcctacgaacatggcgttgcagatcataacaaggaactgtctatttgtagtcaatcagtagaacatcagttgtgccgattctcatgtatttatatattttagcaataacatttgtttaagagttgaattgcagttatgcaaaaacattatacatgccatttcttaatccgtatgatatgaaaaaccaaaagaatgtagtcacaaaacgaagagggctgaatcaaatcttttctcagtcattgtgatttttttttttttttttttttttggagttgtaacatctaaagtttagaaatctctatctgaaatctatcaggtcccagaagttacaggtaactactcttattataagtattccgtgactgaatgacaagacactgtgtgacatatgacaggaaatgtcaaggatcctgtttttaacaatgttataattggttcagtaatttccagataattgaagttaatctcttccctttctaaaatactgtttctcatttgctgggaagctccaaaatactagtcctactgttgtcatgtatacctttcagcttctactttcctcttctcgaaacctgacctaattgttttttctaatttgttttgagccaagaaaccaaaaataaatggactctgaatttttactttgtgatcaatgtaaatcagaaatacttttcattttacttccaggttcaaggctgcattctgaaggtttgggttgcaaaaaaaagtaattttctggttcagcaagctattcctctatcttattcaacactgttaagtgaagtttttattttagttattgtatgataaatcatatatggtaaatctgtttatatttgttccaacttaataaaacaattagaaaagagctgatttccgaaggcatagagtaggttttatagctgtgattctttactccaagtcttccctaaagaatacccttaggctgagatctgaaatgataagcagtagttaactagatgaagagaggtagaggtagaggtggaaagagagagaaatagcacataaaagtgggagaatttggcacttgttgagttaaggccaggatggctgcagcaaagtgaatgagggagaactagataggagataaggttggacacaggagtcaagttttgctgattttgctctcgattttaagaggaataggaaccatttttgaggagaggaataagataatttacattttgtgaaaattatttcacctgcttaaccatgaggatattagaacttaaaaaggagaatgagaaggctgctaaagtttgtggagagatgaaagtagttgggtagggtagggtggtagcaggcagggggttcgggagtggatagatttgagatttattttgaaggtagagtcaataaggatttttatgttccaacaaatagttacctttcattgtttatgctgttactacgtgtactattctctttatcctctcctgttttgtctagtgggcaaacttccatttatctttcaaaacccaggtttgaagccatcactgtcacagcatcattctgtgtatggttggcttattcattctttactaatttctctttttttttagcttgatcagtttctttgtagtcaagcctagattacaagggttaagaagtaaatgaataattatgaaacttatttactacctagtttcatcttgtccctaaaagaagtgttccaagtgattttcatatgttaaacagaatggaattccaggtcttaaatctgtaagactgacagactcaggtcttcacacgaggaaggaattatcctccagagggcgcacattacaaagccactcttgattattgaaaaattcatcttgtgttaatgtatttttgagctttcaagtaacttattatacacagcatacctttcttcactcctatgcttttatgagactgtaacagaatttttcataaatatctcataaagaaatttgttacctgtatttggatttagaaataactataaaactattcttgtctttttgtgtttgtttccaggtactattcttaatttgatataaacttgccctttgtaatgacttaaagctgagaaggaaataatctatatcttatgactcataagataataatttccattataccaatccatgtgtattttgtaatcctcattattaggttgaatgtcctggaactgtgtaacactcttgtttatactgctccacaaaatagttgttttattccagttttcccttctgccttgttttttttccactaagaattgaactcatgtaatagaaagtctcataaaattatataaatccattttgttttatttattttgatttgttataaagctgattaagttaacattagtataaacagctgttgtatagtgcacataaggaaagtattcttattaacataattatatttagtgctagatgactttgccatgtgtagattaccatcctagctggttttaaaccgtgttacaataatgaaatttagacttggggaatagaaaaattagattacagaaccaaagattaataattagaacacatctacgttaggtttccctcagatttcatgactaacgaaagcttagcaactacagaattggggtcattaaccaatattaggttgcattcttcttttatgttgattctatagaaattttagctttcatctgaaagaaagtaatgattatattctgctatacacttgattttgactcctccttcctcctctcttcaacccctggttttatataacagttgaatatcagtggcattttacgtatgtattcaaggttgttttgttttgtaaaaatatgtggtttttctgtcttaacagcattcactttttacgttgctacgtgtgggtttcttttctttttttcttttaatatttctttctttccaacacaggaatactctgaagatagtaactccgagccaaatgtggatttggaaaatcagtactataattccaaagcattaaaagaagatgacccaaaagcggcattaagcagtttccaaaaggtttatattcttttccatttgattctatgtgttaatttttttaatgatatgctagaacaaataagtcccaggtgattttatctcagaaatgtgttttgaatacttaattatcctatcagttagcattaggcagcacaagcaagtgtttcaaaacggttatcctgatgttttttccaatcaagctgtctatggagcagggccattgtcctgaaaaactaggatggttctggcagaagaaccaccaacatgatggtcagtaggtattatcactgcaatcttgtttcttttaggggtaaatcatacagttgtggtttcattattatgaatagcttgatttcttgacttactgatacacttacggattatttttaccataggttggttattcaggggaaaaaatatttcagaaactatataataatcaagaagtggctctttattttgctgatgaaggaactttaagcttgcttatccttatgtaggcatcttacaacttgttttttttaaagactgaaaaatgacattgagaaatggtggtatccttggggaaatgttttttatgcatatagtataaaattaattcaatacttacacattgggcatcattagaaaataatgtgttaatattaagataaactaaaaatttcttcctctttttaggttttggaacttgaaggtgaaaaaggagaatggggatttaaagcactgaaacaaatgattaagattaacttcaagttggtaagatttgttttgaggggaattaaactaataaattttgtaggtaaaaacctcatcacgacaaagtactattatatcttcttttctaaagtacttctttggatgtgtttttatatttagtctgctctgcagttgggactatagtaatactaagtaaaaaaaacaaattcttcataggatacagaagttttctatttaagaaaacttactcttttagatgcatttacagtatttgcctttttttttttttccccgctctgtcacccaggctggagtgcaatggtgcaatcttggttcactgcaacctctgcctcctgggttcaagtgattctcctgcctcagcctcctgagtagctggaactacaggcacatgccaccatgcccagctaattttttgtgtttttagaagagacgggctttcaccatgttagccaggatggtctcgatctcctgacctcgtgatctgcctgccttggcctcccaaagtgctaggattacaggcgtgagccaccgcaccctgccagggctgcattattaatagattgacttttccacaaaggattagtgtttactttggagttttaaaattctcctgtttattataaagagtttctcttccattgactagggccaaaacgttagcattatgcttaactcttctcattgtctattaccccacaaataatccattggcaaatccacatggctttacatccagtatgactgtgcttaccatttctacctctgctactctggtccaaggcaccatgatttcttacctggattattgagatagcctcttaactggtctccttactttcatccttaccctgctacagttttccacaagtagcagagtgatccttttaaaatgtaagtcagattatgccattcttttgctccatatcttctagtggtccccatctcccttagtaaaatccaaaattcttaccatgacctacagatccctatgtaagctcatcctttgctgctgtttttatttgctccatcactggccttcttgctgttcctcaagtcatcccaagcacaatcctgtgtaaaggcttgcacctgctgtttcctctgcctcagaagctcttctctgataaccatatggattttttcttcatttgattcaggtctctgctcaatggcaccacttatcaggatggccttcccatgaccacctgatataaaatagcattcttcccatcgtcacttaaattttttctttgctctttttctttgcatatgtcaccatgtgatctattatttattgctcctcttcaccccacccctccccccaagtaaattgtaagctccatgagagcaggactttgtgttattcgttgttataatcttagaacctataatggtgactgtcatttggttggtgctcaaatattttattgaatgaactcataacttattctagagaaactggaattatgacattatactcaaaatgtcattcctcggtttctttaaactggtaaagaatacagggtagaagcggagggaaaaaggatcaggagatgataggactaggtacaaacatgaatcttagatcactaaaggagaagaacttttgagagaaagatgaagttgaagctcagatgagcagggagtgaagcagttggaaggttcaggaactatggcaaattgaagaatagctgatatgttaccactttctttttcccctgtttttgtatttcccatatgatatgtttcctccacctctccattagcttctctatcccgtctgactagtacttgtatccaggttaacttctactaatcttgtacctcttctttttgaggtactgtcactctggtatggtttatctcacctttaataggaggggcactccatggcatctcctacagaagctgttgacaaaatgtctttgttcatttcttccccaaaatacatcagaacaattcaaaacatgttaaatgttattaagtatattgtatattgcacttaaatctagttaaagaatgaaaattatctacattatatttaccctttctactcctactgctttgatactctcaaaacatttctatgttgcccagagccccatgctttctttccattttctgtttgcaagaatattaaacacaaacatttactgtattcagattaataacttagaaggctgtggaagaagcaccaagtgtttcaagggacagaaatttgtgattaaacaattatagtgccattaggggctgaatgtttaactcgtaggttctgtgatttgagataataccaagagtccctatagaaatctgctattttaacgtactagcagtggtttcgagtccatttgaacactgtgctacccttaagacttggttttgccattttaccttgagcagagtgggaaggaagggagagggttttttgcattttatgttattttgtttaccttatctaccttttgtttgctgtagcagcatctgtgaataagttatggttcacaagagtgatttcagcttctgtacctgcccctctcgttttctgattggactcagagtaggagctatgttatgtgtggtgattttatagtaaaaagttggaagggttcactatcaacttctctgggaccaatttacctactcttccttcagtctttaattagaatgtaattgttttttaaatgagctataaattattataacatgagataaattcaaagctaactttttttttttcttttgagatgaagtcttgctctgttgcccaggctggagtgcagtggcgcagtcttggttcactgcatcactgcaacctctgcctcccgggctcaagctatcctcctccctcagcctccaagtagctgggactacaggcgcatgccaccacacctgactaatttttgtgttttttgtaaagacggggtttcaccatgttgctcaggctggtctcaaactcctggacttaagcaatgctcacagcctctcaaagggctgggattacaggagtgagccaccaagcccagccaaaaactgtaactttttgcaaaactcctatttcagtgccaagatacagcttcaaagttaggatagtcgtatttctctgatttcccttttgctgcaagatatgtactgtaatgtggatttagcagctcattgacaggatgtcacctatcatttacccccacatgaaacttggaaacagaagtggttttatatatgtatatatttccatagttctatcctttttttttttttgtcccatccacctctgctgttttctttattgtaattcaattcttggttaggtttcagggattgttctcaagttttcttgttctttgtgctgtgcctcagggcagaatgtattgtcataagcaagataattgcagcattattagtttattcctcaccctaataaatacatatgttcagttagtcaaggaaagaagcatttgtatctgccaatgcttcatgtctttgataaaaaaaaaaagaaaatagaactcagtaaaaagagaggttaacagcaattgcagattatgaggattgtggatgcaggttataaggttagacttataaattgacttacaggatatacttaggaatggtaaacctctcccagaataagtctcagtactcctttattttttagacctttcttgtttcctggaacaacctcaatagtacaaatacaaggaataacaacatttactatatctacttttgaatagaaccttagatggggggtcttttcttgacttgaaacgagtattgaggcttgaaaaaattgtttaatttcacatttttatatataaccagccagttgtagggagaaaagaaacaggtaactcttattgcagagcttcctgaggaagggataaaattacagggaagaatatagctaatatcctgcatagcaggtacccaaggcatttgaaagcttggattttggccgagtgcagtggctcacacctgtaattccagcactttgggaggccaaggcgggcagatcacctgagatcgggagttcaagaccagcctgaccaacatggagaaaccctgtccctactaaaaaaaaaaaaaatacaaaattagcccggtgtggtggcacatgcctgtaatcccagctacttggagggctgaggcaggagaatcgcttgaacctgggaggcggaggttgcggtgagtcaagatcgcgccatgcactccagcctgggcaacaagagtgaaactctgtctcaaaaaaaaagaaaatacttggattttatttgtatgttttggcttatgaatattgtagtaggttttatgatttaaatatgttgtgcaatgacaatttctgaaatttggaaaatttagcagttgtacttgtttcataagctaactttatacatttggtttgagtaatctagtcatttcaaatttaaggtaattacaatgttcctgtcatacatagttcctcttttacaaaactatatcaggaactatatgaactacatttcattatgtagtagtgtattctataaccttaatcatgtgtacatattttagtacctaaatttgcatctgataattcatttttcttttctcacagacaaactttccagaaatgatgaatagatataagcagctattgacctatattcggagtgcagtcacaagaaattattctgaaaaatccattaattctattcttgattatatctctacttctaaacaggttagactcaattttcccctcttgggacgatcagtgtgtttattatttatagtaagggctttgttctttatagatggaaaggcctagagcttctatttaagtagttgtgctagttattagtatgctttaaaaatgataagtactattttcctggttatattactgattatataatagtaaaaggtaataactccagcttgatctctttaaataatgccttcagatgctaaaatctgtaaacaacttttcaggcttatgttagactcctatacagttgctaccacaggtccttctaataaactacattaacactttagctagccattctgaggtgttaaatacactgaatcacaggttatttgtgtggatttggttatattaaaatctttgagaagtgcctgtgctcttatcagttagtgtttggcattactcaacaggtgctcagtaaatgcttctgcaaaggatgggtggataatgaaagaagagctactgatgaaagaaactaaagaaggtattgggagtgatagtgctttcattatgagtctagattttggttattaagaaaaccaatgattattttatatatatttttgctaagataatttttaattggatcatttgtccttatccttgtaagcagtatagtcctcagttttagtttttcgtcctcttactctgtgatacttgagtacaagatatagtctctatgtcatttagtatttcttagaatatttgatactttttgtactcgtaatcaaagaatgttcagatcagaatcagcctcatttaatgtcttttctactagatgtcatttttttcaggcagtttgtactctttacatttaaattttatgtaatgccaatagaggaaggtaaacttacatgttttgttagaatattaacacttaatgacactaattctagagttaagctatatatcatggagctttcctaaagtgggaaaatgttttccaactcttaaaaacaagtgtcatcaaaacatattttgtatactgtttataaatattatgccagtaattggagcagggagagggaatcgagtgattttgaaacttcaggactgcatgctctgtgtgtggttatatgtaaggtttttgtcttttgaaagtaacaacagatattgggtgggtggtactctgttctattcaatatgccatcagcagtcatgcataaatagagagtgttttctgaaaatgtgaaattttcctgctcttacagtcctcttcttgatcctgttaagcagagaattagatattcaaacaaaggcaaagccagaagcggggggaagagggtgggcaggggaacttaacaagatgtaaaacaaataatgatttccgtgaaaaaatgccacacagattggtgatttggtggtgattagacatagctaaaattatactagacttttctctccacccacctccatggtttaccagtgacttaaaagctatgcagttgagttacttagtcatatttatagaagaattttgagggaaggagcttattctttgtttcttcaccagcatgcttagtgtttgccacattgtaggctccaaataagagttgagtgaataagatatacactgttagtaataatacaactagttctatgtacatttcatttactgctgttaatatgaaatgagtggctgatgtgagtggagtggtatttacagctaattgagcacaaccagttacagattactttgttccttctccactcccactgcttcacttgaatagctttttaaaaagtaaaataaaatacagaatgtattattagattgggaaggacaaacgtgtactattacagcatgagaacttacagcactatgtttatatggggaaatattttctgggttctataaaacaacgcatcatggtacttgtaaatttggtctgtattttgcttcagtttgttaattttttggactgtagaagacagtaagatacagatagtgtatcttatgtgtattaaagttcaaagatgcacttttagtttgttcaaattaactttattaacaggtacaaatttgctgtttacaattatagaattctgattttttatgtcagatggatttactgcaggaattctatgaaacaacactggaagctttgaaagatgctaagaatgatagactgtggtttaagacaaacacaaaggtaaccgttataatacttacacttttcttttgaaaagtgggtgggtgtttttaataaagtctcctaaagatgcacatcttctgttgaaatcttgattttaataaatttgctttcttgcagcttggaaaattatatttagaacgagaggaatatggaaagcttcaaaaaattttacgccagttacatcagtcgtgccaggtagctttcccttatttttttctgaatatttcttcataataaaaaaaaagtataagcaataattatattcaaaatattgtttagggatgttttagtttaagcattatctgaaaaataaaatttagaaaataagttataaaattatctttttttttttgagagagagggtatggctctgtcacccaggctggagagtgcagtggtgcgatcttggctcactgcaacctttacctcctgggctgaagcagtcttcccacctcagcctcctaagtagctgggactacaagtgcacaccaccatgcccagctaattttttgtatttttttgtagaggtggggttttgccatgttgcccaggctagtcttgaactcctgagctcaggcgatcaccgcctcggccacccaaagtgctgggattacaggtgtgagccaccatgcctggcccctcaatctttattctttgtctaatgaggtaccagtatcaataaacaaacaggcctattgtaatacttactattatattgatatgtagttatataccctgtgaaaacagagccaggatattacaaacgtgtaataaagatatttttatattccaatttatatgaatcctagcagcactgtccaacagaacttcaagtgatactgggaatgttctatatctgttatcaaatatggtagcaccagctatgtgtagctatcaagcatttgaagtatggctattgtgacagaggtactgagttctttattttctgtaattaattactttaaatttgaaaagccatatggtcaggacagaatggctctataactttttaaccaggctttcattttatattcccttttttgtcttaaccaaatacatcatttaatactagtttaaattgaatgtggaaatactgctttaaatatttttaaactcttccaatgccacgtactactttttttcaacccctccccacgcttgccaccatgtagtattattttaatgatatatgtgtcatttctgtgaatgggagaaacgattaagaaactgttctaaatgaatcacctgcagatattcaatagttttgttttgtaaagcagattagtcacttaggaattatttcttatctacacattgttaagatgctttagtctgatgcataaccaactggaggttcagttccctatgaaatggaaatgctggaacagccatctctgaatggtggagggtctttcagtatgtatataaggaatttgagaaaaccctttgaagaagttttgctttaagaacataaaaatgctatcaggatggtaaatagcattatattacttagtactttgatggaagtatgttcagggaaagatgcaggatactctagatgtataaattgttttgtatattgtatgttttactctggttatgattcattagtgaataattaaacagaattttaagtttgaagacccaataaattttggcttagtgtatgtcagtgtgagatatttatgaatatcttcctgttgatcatattgctatttttcatggcccacatttcatgggctgttggtcaactttaaagtcatgctcaaatgtcagcacttttttgtgattcctgtgacgtcctccaggaaggttagtccctatttcattctcctaggcacttggtttatgcttcacctagtcattgtcacttacattgtaatttatctactgacagattaatcttctactagagtgtgaactttttgagaccgggaaccttggcttttttaactttgtatttccccatgacagacccagtgcctggcatgtggaagggacttaggaagggctttttaattgaataagtggttctaaagcagttgtgaagattttgggaagacaataataaatctcctagataaaaacataaacattaaaacatttcatacgtacagcagtcctcccaacccttatccacagattgctttcttcaatttcagtttcctgtggtcagcttatttcctgtggtctgaaaataagatattttgagagagagagatcacattcacataacttttattacagtatattgttatgtgttctattttatgatcagttattgttaatgtctcactgtacctgatttataaattaaacttaatcataggtatgtctgtatagtaagttttcacttaacgttgttaataggttcttagaaactgtgatttaatgttgttttgttcaacactacattgatgaggggaaaaaatgatttcattgtacattgttttgcttaaggtcatggtttccaagaacctatcgacagtgttaaacgaggacttactatataggaaaaaacatactactatacatagtttcaggcatccactggacgtcttggaatatattccctgtggataaggaaggactactataaaaaaaacctttggctactttttccttatctcataactaaaaagtagaaaggatgtattagtttctttttggccattacaagtggtattcttagtactgtagctcccaattaaaatttgtgttgtgttttcacatggaaatagtattataaatgtaagatttccaggctaatgcaaataagaattactgtctgaattctatcttgtctaaagttaaatatttgctttcctagactgatgatggagaagatgatctgaaaaaaggtacacagttattagaaatatatgctttggaaattcaaatgtacacagcacagaaaaataacaaaaaacttaaagcactctatgaacagtcacttcacatcaagtctgccatccctcatccactgattatgggagttatcagaggcaagtttggtttggagagggtgggcagtggcatggggagatatcaaagtgtttaattaaactcttgctttttagaacttcagtgtataccttggggccagtagtattcaagttacagaatttaaaaactgaaaggcactgaaatagttttcatttggcatttatgaggtggtcagttttgttattacagaactgaaaatgtcctattttctcatgtcttattcttcacagaatgtggtggtaaaatgcacttgagggaaggtgaatttgaaaaggcacacactgatttttttgaagccttcaagaattatgatgaatctggaagtccaagacgaaccacttgcttaaaatatttggtcttagcaaatatgcttatgaaatcgggaataaatccatttgactcacaggaggtacgtgtgttttaattgttaatttctcttatcagctatctggaaataaatgttatttctttttttaaaatgttgtttctttgtacatatatttaatttttttctttactgtgtttaggccaagccgtacaaaaatgatccagaaattttagcaatgacgaatttagtaaggtaagattttgtatttcagttaaggtaaatttccttaaagcagttcataaaggaaagagtgagaaaacttttcagaactcagttaatattcaacatttgcccttttgtattttcttagaaaagtttgtagaatttttatcttctgaggttatttattacgctattttctgtagccacaagattttataaagtatctacttagttttcctattatccatgtgtgtgtgtctgtctgtctgcgcacgcacgaatgcacctgtgtctttcagtggaaaactgattgtggatgtcttaaaacattatttcacaatgatactgcctatacctctcttaatccagaatgaaattacgaactagtccaagatgagtcaagaattttcagtaagacaagacagcataagcatatttttttactcatatattttctcaatgacaagatgaaagtatttttaaaaatgtttacaatggataggctgggcgtggtggctcacgcctgtcatcccagcactttgggaggccaaggcgggtggatcacaagatcaggagatcaagaccatcctggctaacacggtgaaaccccgtctctactaaaaatacaaaaaattagccgggcgtggtggcgggcgcctgtagtctcagctactcgggaggctgaggcaggagaatggcatgaacccgggaggcagaggtggcagtgagctgagattgcgccacagaactccagcctgggcgatagagcaagactccgtctcaaaaaaaaaaaaaaaaaatgtttacaatggataattttctgaggtggagtgtggggtgacagaagggtcgtactggtaagaaacccaagatttattgaatgattctgtggaggaagatgtaatgatggttaaccactgaagaacctaccatagtcaattaatattcgacaaaattatggaagataagaccaaacaaaaaacctagaagaaaaggcccatttttgcaaaaggaattagtgagtaagagaaactttcctccaggcatagaataaatggaacccagggtttttgtgggttttattcattaaaaaagtataagaaatttactaaatttcttcaagtcttttattttaagttgtacagctgagttttaccacagctggaaaaatgtagttagggacatgaagcagggcttttttttttttttttttttttgcagatatatgtaaataatttaggtgaccagaagttctatttatagtactttttcatttaacagaaaacactattagactgtacattatgggtcacctacatataaattgtgtatacttggagaagatagcttatttcatgatattaaagttcctgtgtaaaatgtcctcatttaactttttttaaagaaaccttaattttggctgtaaaaaaaaaagcgtttttttttagggggactaagaacagtttggaattaaaaaccttaagttaccacattaaatcagtttctttattgtttactttattttaatttatttgttgaattaggttgcttttcattattaaaggaaacgtcatctttatttcagatagtttatttcattcacatttggtcacattaactaagaaccaaagttgtttataatgttaaattgctaagcagcagtttacacttttaaaactctaagaaatattgaggaaaagctttaccctagacattgatattttgtataaattaaattggctaagtacattaaaattggttaaaggactgatttgtcagacctttatctgacctatatcagaatatataatgacatttataaatttattatatccaactactccagcaaagccactgtattagaactcaaaacttattttaatggtaaattttgacccacatgatgtgatgcatggtgtcccacaattttgtataagatgttttttttgaaaccccacttaagaaatggaagaatgtcttacggttaaaatatgtatgtacacaaatataaaacaaatgtttgtgcaagtgttttcaatgcttgaatatgtcctcctatagtatattacagcagtgtatttggggtaggtaagaaagtaatgcttcctaattttgtcttcctagtcagttgccaggagactagaggaaaataattcctgtcaaagcacttgaatcacgtgcccctaatatgaggttacattgggacccaacagatggaagcactagcagagggcgtgcagtatagctgatgataatgtcttacgtataaagcagacaatggtgccatatccacaaggttggattcttccttctcagcacctttagcaattcccatagagctttacagaattatttcaagaggagatactagatacctcagagaattatgaatataaatcagtctttggccttctgcaacaggggattgagaaatgttccttttgaaaattttcacagttgctggtagctttctagaagataaaaattaagaagctgcattttctgaataacctacacagaggatatgctttctcatttgaaagacgaggctacaccccttcatgtagtgtacatgaagcctggttcctttcattatgaacaattaggaattaaatgcacaatttcatttgaaaacatcaaacattaaatagttgttaaatgttttattgccaacttttaagagaagtaagatattgaggtgattttaattaactttgtataaatatagtatataaccccaaaagaagatttatttaatctttcttttaaaaaaccaaaagcatgaaaaggaaatttatgttttttttggcagaaggttatgtgtgcttgtttaactgtgatttccatgacagaaagtataatattatttagatttttgcatatgaaagttgagaagcagggtctttggattatctgatttaatacataacttcttcatgtttgacataatttacactttgtttttctattagtgcctatcagaataatgacatcactgaatttgaaaagattctaaaaacaaatcacagcaacatcatggatgatcctttcataagagaacacattgaaggtatgttctttctgccaactggattctattactttctttgccactgtcaaagaaatgccacttaatgaagctgcatggcattaagctgttttctttctgtctattgcaaagtatagatatgtttctaaatgctgtcattggatgggatattccttaaaattatgaagctcttttaaagaaattgaccaatttcatattactatagtcaagtttatatataatgtccattttgtttaaggtaactgtccctttttaaaaaaatctaatatagatgctgttgcatgtttattattgatgcttaggttcaaagttaatttttaaggtttatttttgacaaataacaaaagttatgaaaatatcctgctatagataatgctaagatatatgtactatgaaagataaggcaacactgtgaaggtttcataccagtaagtgaatgaggtttttagcaagttatattgaattaccaaagactacaatcatctctttgctcttggacttcttttatagctccgattttcccacctattatggagctatttgaaggtttttaaatgaccatttggaactaaatttcagatgcatcagaagtaatgttctgttccccatctttctttctcttttaatcaacagacattttaaaagttcttacatgaacctggaatgatactgcagtttatagatatagaaaaacgtagaatctttgtacatgaatttcaacctggttttaaaaaattttaagaactattgtacagacaaaactggaggaaattgtaaaagcattatataaaatatagtactctaggttttgagagagtctaaaacaaggaacttggctggctggtataaatcagagcttctttaaagatattaactgttgaggaaatgataagtagtgtaatattgagaaggcaaaataatattttagtagagtctcaatgtcaacaaaatcaaggaggtgggaacaagaaattatgggataggcagcagctgatcatactgtccatccattgacccaggtattttaaaatctaaacactttatatcattgccaagcaggaagatgtattttgagaagataattaggagtacataatgatccataaagatatcatacaaactgttaaataaaatgttattttaattttttgtctttcagagcttttgcgaaacatcagaacacaagtgcttataaaattaattaagccttacacaagaatacatattccttttatttctaaggtacttatattcatagattttaatgatgtttataatttatagttataaatgcagtataccagtcttgcatttaagagtcactctaacttggtaacattttattataataatacattttttaaattaaacataacttaagggctttacttttaatcattttttttttttttaagagacagggtcttgctgtatagcccaggctggagtacagtggctattcacaggcacagtgtggcacactgtagtcttgaactcctgacctcaggcagtcctcctacctcagcctcctgagtagctgggactgggctttacttttaatgtgaatttttctgttttcttggcataaattgagttaacagaaaagagccttaacattgtaacaaagaaattaggaatcactaaatttctttttaaggattctttcaccctcagagaaaattgtaggggaaagtagtggctaaaatatgtaattgatgaagggttaacttcaaccacaataaaattgttgcaggaatgtgcttcagaagttaaaaatttaagtctttatcatacctgtgttctcggatatattttgaagtgataatgaaatatgtttaaaaatcttctcttcactaattttcctttaagtgatagaaatgaattaaaattagaatgattgtgtaaaattatgaagtctttaaaatgttaattggtatataacaagtcttttgtcttaggagttaaacatagatgtagctgatgtggagagcttgctggtgcagtgcatattggataagtaagtactttactattttttatcacaaaatatttggtaccgtaagttttgaataatagtgacaaaggtaacaattggattcttgattattcataaaaagcacccttgggtatggttttctattagaagagatatatatgtatgtgtgatggtttttgatgaatgagcgtattaaacacatctcagaaaaagttctaaatgatttttcagaaggatttcttattatatacagccaaagaattatttaatgaatagtatttatgtatgtttttaagtatagggtatgtggtacataacatttttgaaattgtatcttacttgaaaacagtacattgtttaaagcttcacaggtgatacttgcctttgattaatcggataaatctatgccttatgggtctttcagtgaaactgatgaaaagtatctgaaatctggtttctatctagagtttgaataacacagtgaagttaaaactaacactgaactcatttaatgtaggcagctgctttttttttggcatttgttgatactgtattttatgaaacattaatccagaaactgtgcttgatgaaagtcttttgtagacacatcttatttatttctttctagcactattcatggccgaattgatcaagtcaaccaactccttgaactggatcatcagaagaggggtggtgcacgatatactgcactagataaatggaccaaccaactaaattctctcaaccaggctgtagtcagtaaactggcttaacagagaacaagcttttacagacgtccttaaggcaacagtgcagagatgtaatccttaaaagaactgggaatggcaaaactactgtcggttgatgtgtcctgaaaattattggagttatggcagaagtgcttttttgatcaactggtttgtgttttgctgctgcatttatcccaagaaaaacagctttaatctccagaagaaaaccaaaataccatgggatttatgctgtattgacatcttgccctaaacgtacaacatcatagtaatttgtcatgggcaacatgaccagagagaagatttttgtcatgattttaaatacactgacacgctactgttggttaaatttaaacatgttttacctgcagaaattctctcacaaataacctgcaataacttgaaatgcatacccttttgaacacttccttttctcatgtataaattaaaatgtttgctgcattttgcaaaatgtcaattctctaaaaatgtgtccgtatatttctgtacctgcagtgtagtaaaggtttagacgaaaccccataattatagtggcatactgtcacttaggtttcaagcagcaaaataaacagtgcagctcagaaattgtagtttggttcttgatgtgtttttattacatttggagttgttttgttttttagtaccttcgaaatttcaaattattttatcttcagttaatgattttaaaaagcctgggggcaaataagttggttatttgctttcaagtttttaaaagtagtctttattgatagagtaaggagaactactttctaacaaaacacgtgcatagttatgacagtgatgctttaaaggaataaaattctttttttttaaagagtgatattccttttcaaaagaatactaactctcagaatgttcactttaaacgaatatgccagaacatagacagctaaatgaatgttactctgcatagtgatcatgctggaaggttatttcctaatgccagcaatctaccattgcccaaaacctgctgagtttactcttttagaattgcattcaaagttaatttgtcacacacactaaactttatgattatacattgttttaaaaaatatagtattaggaagcttgattatttttagttaccattacttggcaccaaatgaaagtttccaaaacttccacctaactttgaggtaatgcagaaagtatataactggctttgaaggcaatcccaaaagagttttaaaggttttttgagcagtggcagtatacttaggagaatgaactgtggccttccaaggtaactaccttaaaggaactcagctcatttgaatgtattgagttttggatgtatttgtttcattttttaaaaagttcacattattttatagtgtcgaaaggaagaactaggattaacataatttctttggtttttctattgcttgttattattatgtaaaaactgggtggcagttcagaaggaagattgtggttacagaagagtgacaaccaagaattttttgatcattaaatcagattttataaacagtggaaggagcatggacttaaaacaaggcatgcttattcggttttgtcaaaattttacgaaaatatgtgatatatatttatactaaaaatatataatccttagatttagaaaagcaatcagttaatgtctttagcagactaaagcagtattaaacacaggtacaagttggaaattgtagaaaacggaaagaaaacaaaagacaaaatgtctatggtagggaataaaagtttaagatattataaaattatgtgtattttctcttttacataaatcatttgtgaaaagtgtgctaaactttttttacaagagtgatattaattaggatttatttttcaatataatttggagaccctttgttatccaaataaaaatgatgagtttttgtgcctgtattcaaatatgtatgcatgtgataacccttgaaagctaaagcccttcttaacttttgagttgatggaattagaattcaaagatttgaatgaaatgatttaacctttatcctccaattcttacagtgcccagttctcctgtgctatctttgctttgtacaatagtgcatcttccactttctagagagaaagcatgcacttgttatttggaaaactgggctaaatatataacagtatccaaagttataccataataatttattgtaattgtgtattacatagctttgtttacccagatataggtgcgttcttttttttctgttagtcatctgtgacttttgttctggaatacaggtttttaaatatatcttaacagtctgactaacttaaaataatttattcttcccttaaaacatttttctgtgtttttgtgcatcaaatattgtagagttgaaatcttagagattgcttatcgaaatataaatttaggggaagttaaaaatcgattggcaaatttgtagcatttattcactgattaaatcttttccacttttgtgaaaaccataccagtggtttacatcatattgtaatgtgttcatctcattcttctttttatccctaaacctagctaaaagttactgcaaagaaatctttggctgccacaagtagatgctctctactacaagag

SEQ ID NO: 16807 - DNA, 87752 bp, Human
ctgtttccttgtcctcccagctcgccttccccttctccttattttgcatcctggggttccagggatcaaggtccctcccgggccgcctcccaccgtacgcacttctgagcctcaatggcacccggtcccgggtcccgggtctagaccggctcatcgcacagagtagcagagccgggctcatcgaggaggcaggaggggctcgccagcgtggcacgggcgcccggcgggaacctccacccgccccgcggccgcgcgtccccgcctcgaattcagccccgccccggtgcgccgggctggaggggcgctgacgctcagcggtgtcccatcggtgaccttggacggtccctccacctctccggcctcagtttcccttggctgcagcggccgcggggcgctaggtgggagccgctgagcgctcccggggccccgcccaccgcgagcagccaatcgggcgccgccctccggggggtgtgtcccggggccgaggcccggggcccggagggcgcgcggggcgggcggggcttccgggtcgggcctcgggacactggctcgcgcggaccggggcagggggcgggccgaggggcggtgcgtgtcgcgggggcgcggctggcacggacgcgcggaggcggcgccgggcatgggccgtggacgcggcggccccgcggcgggggcagcgggcggcgggggcggaggcggccgctagcgccctgcccggcgccgcctccttcggcgttcgccccacggaccggcaggcggcggaccgcggcccaggtgcccgggggcgggcgggcgggcgggcgggaacgcgcgcgggggtccgcggtccgggcttcccaggtcccgggacccggagggcggcggacgggggaggggcaggggctgggcggcgcatgcgcggggcccggggtctcggggtctccgggtcccggggacccgggggcccggggtgcgcggctggggacctgagggcgaggagcgaggacacacaccgaggactcttgcgagggatctcggggcccagctcggcctccctcctagcgctgggggcctgcccggaacccgagtccgcggctgtccctggggtttggcgctgcgcggaggtcgggtctggggaccgcagcgactctgggtcttcgggttgtcccctcggagggagggcccacgggcggggacatcgggacttgccctttcctcggcgcagcggagctggggcgtcgccgactcagaaggtgctttccgagacctccagggatctccgaggcgaggaaacccgggccccggacagaccgaccctgggtgggtgcgcccggcttctgccgtcggacggagacgcgcgtgtttgttcctccagctgcgaccacctttgaggaacggttcccactttgtgccccaacgcggcggggcgaccccggacaggctgcgctgggccgggtggcttctctgcggaagccgcgccacgtcgctcccggtcggggccgctgagggtcgggcgcccaggtctttccggagtcccgggctgcgcggcccgcgtggtgcgggtgaagctggaggggcgcggggtggtgccagtggaagtcaggagggtcggccctgccccctcacgcaccccaaccgggcacaactgcacgcctgtgcttttctgaagtcttttttaaaagttaaaagagaggaagtgtgctccaagtgtcaggattctttccaagaaaaacccacagttgtccaatggcctgggcttcgtgggacctccggggctgcacgcccacgtcagcctcagccgacccctgccaggaaaccagggaggcccctcctctcccagcctccttgggataagggtgccttggggaactgggtcagggcaaggacacgggattttcctgggaaggaccctgcgacacccgtgtcgttgcggggcagggtcagcatgactttcctcttccaaggtgaagagttggggggcatccagagaacaaccgtaatcacttcctccttcaccttcttactgccaggctgaagctcagggccctgtctgctctgtggactcaacagtttgtggcaagacaagctcagaactgagaagctgtcaccacaggtaaatagaaggtttaatttactgtttccagatggaaatatttaagtgttttcagtgtttacttctgttgcactacagaccagcaatctgggggttattactttgtgatgcaaggttagatacgttttcagactgaaagtaaaatacatgtgcatggattcattttttttttttttttttttttttgagacggagtctcgctctgccgcccaggctggagtgcagtggcctaatctcagatcacagcaacctctgccactggggttcaagcgattctcttgcctcagcctcccgagtagctgggattacaggcgcctgccaccatgcccagctaatttttgtagttttagtagaggcggggtttcaccatcttggccaggctgatcttgaactcctgacctcatgatccacctgttcctcccaaagtgctgggattacagacgtgagccaccgtgcctggcctaggattcactttgaagttctgagttattgtgtgacttttgctaggaacttcattgcttcgtggcaggcatgttttgtataatttaaaacttgatgacattaactttgagaaacgtgagtgcttactagacccttgggatgtccacactgactggtaccgagtagtgtactgtctctgagctgttttcattttgatttgaatattaagcagatggcttcttgagatagacccgtgccagaacatgccagggataggctgaagaaacgggccagatgatacaaatttgtgtggtcaccatccatgagagaccagggacactggggctgatgatgacctctgcaactctgaagcaaaagtaaactaattggcaagttgggtgcggtggctcactcctgtaatcccagcactttggaagctggggtgggcagatcgcttgaggccaggagttcgagaccagcctggccaacatggtgaaaccttgtctctacaaaaaaatagaaatattgcctgggcatggtggcggacatctgtaatcccagctactcaagaaactgaggcaggagaatcgcttgagcctgggaggtgaaggttttagtgaactgagattgtgccactgcactgcagcctgggcgccagggcgagactccgtctcaaaaataaataaataaaataaaattaattaactaattgacattagaaaaaaatgttttttctttcttttcccacatcctttttttttttttttttttttttgtgacagagttttgctcttgtcacccaggctggagtgcagtggcatgatcttggctcaccgcaacgtccacctcacggattcgaacaatactcctgcctcagcctcccgagtagctgggattacaggcactcaccaccacacccggctaatttttgtatttttagtagaggtgggtttcaccatgttggctgggctggtctcaaactcctgacctcaggtgaaccgcctgccttggcctcccaaagggctgaggttacaggtgcgagccaccgcgccgggcccttttccgacatcttaaacgtaaagtaggagacgtgtcataatcatcgaatactgcagtggttttcattagctcctgtttgtcaaacttatgaacagagttttaaaaattgtgtatcagccgggtgcggtggctcacacctgtaatctttgggaggctgaggtgggcagatgacaagatcaggagtttgagaccagcctggccaatatggtgaaaccctgtctctactaaaaatacaaaaattagctgggcatggtggcgggtgcctatggtcccagctactcaggaggctgaagcaggagaatctcttgaacccgggaggtggaggttgcagtgagctgagatggcaccacagcaccccagcctgggtgacagagcaagactccgtttccaaaaaaaaaaaattgtatatgagagagacagaactagacagagaagaaggagaaaatgtgtcttctttatacactattttgtaacttgctttatcgagtaggttatgaaaaatcttcctatgtgaaaaacatttctgcatcatttgaaatgtctatataatatcccattgtgtttagatacaataatatttagccaatctctttatgtgtatatatttaatacagtcattctataaatattgactgagtagctgctgtgggctactgtccgcagtgctgaacaagacaagcatgaatccatgaaactgattttcataccagaatataaaaaagaaacttaaagataatcctcatcatggtaaaagatgaagaacctatttttgccgggacatcttactctttagtaattggtggccagtgttctttttcttgcatgctgttttggagagtctgttttttaaataaatatttaagtagcctgggcgcagtggctcacgcctatggtttcagcactttgtgaggccgaaggggatggattgcttgagcccaggggttcaagaccagcctgggcaacctggcgaaaccctgcatctactaaaaatacaaaaattagccaggtatagtggcgtgtgcctgtggccccatctacttgggaggctgaggtgggaggatcccttgagcctgagaagtggaggttgcagtgactgagatggcaccactacactccagcctgggtgacagagtgagacctggtctcaaaaaataaataaatatttatgtaatcatctttaagcagtgtttttaattttatttatttatttatttatttttgagacagggtctcactgtgtcacctaggctagagcacagctgcatgatcacggcctattgcagcctcgacctccctgggctcaggtgatcctcccacctcagcctcccaagcagctaggaccacaggcacacgccaccaggcctgactcatttttgtattttttgcagagacggggtcttgctatgttgttcagacctgtctcaaactcctgggctcaagccatcctcctgcctcggcctcccatagtgctgggactaagccatgaaccactgcacccggcataagtggtctttctttaaaaaaaaaaaaaaaaaaaaaaaaaaaaaaaaaaaaaaaccacattaattaaaatatgtatttgcttattataaatatatttgaaacatgccaatttttcttctctttttttgctctattggtttctgtgtgtggatggatatatttttaatggcaaataggatgagtgtctttacttccaagtagtcagtgtttttctttaatgtttgtactaattttgtcacattgcagttagaggttgtggcctgtctaatttctgcttttttggaacttgagagtctctgtttttatttgtttttggtagcctggcatagagtccatttttcttttcttttctttttttgagacggagtttagctcttgttgcccagactggcgtgcagtggcgcaatctcagctcactgcaacctccgcctcctgggttcaagcgattctcctgcctcagtctccccagtagctgggattacaggtgcccaccaccacacctggctattttttgtatttttagtagagacggggttttgccatgttggccaggctggtctcgaactcctgatctcaggtgatccacccgcctcggcctcccaaagtgctgggattacaggtgtgagccactgcgcccagctgtagatactttttaaaaaggtatagtttctgattatggggtagaaatgtgctatgtctgtcatttcagccttatgaattgcccagaataagctagatcacctttaaggccatgtggttagggaaacttgggcacagaatttacattttcaacttggtgataagatgggtttaaggtaagaatcaaataggagaaagccttagctgttccagcggcccatgtttaaaagaatgtgcttctttttccaagtatttctgccgcttgcatgcactgagcttctttggaaaggagcaccatgcaggcatattttccagacaggaccggatttgctcgttactcagaggtgtgtgcattctttgcttttaggatatttaattagcatcttttaatagtgatattacggtgtcttaaaagtttatgcatttgaaaagaaaagaacttactccttgccaggtctcaacctatcatggttatctttgcagctgagctgcgttggttttgaggctcacatatggtaaaagtggttggaaatctggaaatattgctgtgtatctgcaaagcagcttgatatagtggaaaaggtattaggtcattaatcatgagatttggattctagccccttagctgctgcctgccaggcctggagacctttgttctcttctttaaactgctgctttctcatcagaaaatgaagttcctctccataccacctctctgaagggctgtgaagctcgaagtggcagcttaaaaaactgcccatctcaggaggtgtcttaagaaggaggacataccgctggctcctgcctttctcacttagccaggtctgatacctgtgttgttttcactgtggccattttaggatttttcaaaggctttcagaaagcaacatgctaccgtaccccttatacaccaaaactggttttcattttggaatataaaagtgagatttctccaccagtacaataaagttgttacaagtggttcctatgtgtttgtttttgtttttgagacagagtctcactctgtcacccaggctgcagtgcagtggcacaatcttggctcactgcaacctccgcctcccgggttcaagcaattctcccacctcagcctcctaagtagctgggactacaggcacccgccaccacgcccagctaatttttgtatttttagtagagatggagtttcaccatgttggccaggctggttttgaacttctgacctcaggtgatccacctgcttcagcctcccaaagtcttaggattacaggcgtgagccaccacacccggcctcctgtgtgttttgaaggtgattgtgacctcaggttttggcagggctataccttgtgtttgctcttactccaactccatggcatacctggaccaggcctcttcatcttgaagagggatctgctgaaatgcaggcccagtgaatctccccatgcctggacacagttccgtcaagccaggacccggtgctgcctgcacccctgtttctgttagtctgactgtcctcgctgagtctaactccttgagggcagagaggatgtcttatttatttctgccccgctagccgtgtaaactgagtaggtacttgtaaatgttcattgaataagtacctgattaatagaatttaattcaagaagaatgtattgatgggcctgtgtggtcaccacagtactgagatgtaggtgggagctggctgaagggggaggcacctaaacaggagtgcagacagcggcacctacggatgatggcccgctccatcccaccgcagcgaaattgtcccagacctctgcagcttcccccacacctagactgagagagagctcttcttccttctgtagggagcaggtgtttcctccagatgtccaatatgtacctcccattacagcggtgttaggaaggtgagggctgccgctgaaagggtccccttcataatcatcactagatttggggtatattatggattaaatagaatttttataagatgacctgaggatctatttaaataaaatcctctttctttctgcaagatcatggatttaaattcaacacaactgacttcatagggaaggggtatggtgaaagggaagtgaggtgggcagcactgatatttaacaaggtgagggtccttctcctgctctgactgtcacattaaaatattcccaggagaaattggagaaaactcagatgaaatatcgtctgtgttccaggaggcaggactcatcggaatgcttttattttgctccattttaagagatttgcagataaagaggagtgaagatttctattcagatttacttgctttatacttttaacttatagaccacaagccaactttcgaaagagcatcattttgaatagtaagagttaggaaggcaaatacagaaggactaatggcttccaagattatgagcttcataggaatggtttgagatgaggctatagtaaagcagaatattgaagttcccccaccccctttcatttttcatttttcatttttaagagtgagcgaggccaggcgtggaggctcacacctgtaatcccagcactttgggaggccgaggtgggcagatcacaaggtcaggagtttgagaccagcctggccatcatggtgaaaccctgtctctactaaatgtacaaaaattagccaggcttggtatcaggtgcctgtaatcccagctactcaggaggctgaggcaggaaaattgcttgaacccaggagtcggaggttgcagtgagctgagatcgcaccactgcacatctcagaaaaaaaaagagtgaggccccaagtttttttgcatttgtttgtaactgaatacgtctgaagttatgtgataaccacgccaaggtgacaaattgccaagtttcagtaaaagagacccagttatttagaggttgacacgtggatatgtccctttctaagaagttcgtggtcagctttacatgagtatttaaatgcgtgtttataattcagcaatatggcttgtaaaatacagattgccaatcaagtgacatgcaaatcttgatgatctgaaacaagttttcttctgttatctatggaagaaatggtaatagggatatttaagtgggatgaattttttgaagcattttcaggcagttttccacatggaacaaaataacattgagtgggctgctaacatgaggaacatattgccctctgcctaggattatgagtaaatttgataaattctagactgcagtctcattttagctcattttatgaggcagcttgacaactgggatagtgtctcttttttttgtcgggggtgttgaggctggagtctcgctctgctgcccaggctggagtgcactggcgtgatctcggctcactgcaacctctgcctccggggttccagtggttctcctacctcagcctcctgagaagctgggattgtaggcatgtgccaccacgcccggctaatttttgtattttttagtggagacgggctttcaccatgttggccaggctgggtctcaaactcctgacctgaagtgatctgcccgcctcagccaccctaagtactgggattacaggcatgagccaccacacctggcttctgtttttctatctgtgcattggggatgaaattaacacaaatgatgtttaaagaaaaaaatgctcagagaagttagaaatgtgctttaaattggaatcatctcttagtatgtaaaagttttttgtaatagaaacaagcagggcagtatttgacctgttgacagtgtccttggactttacaatttgtgaagcagcgtattttgcttgagttgtacgattgtcgtttttttccctccactttgacaactgttacagaacctgtcaccagatacaggcaagggaggttgggcttcccatctctgcacggcttccctgtgattcacaagcaagcaatcagaagtgcacaaaagtttagaacgcgattttcattctcttctttccttagaaaaactcgctttgttagccttttccagaaaggaaggcactcaattgttgtaatactcaaatcataaaaagaagcctagtctagtctattcagcaaggtgttctgaaagagggaattttttaagttcaattatgcgaagatcttgaaggtgggactcaaaggagagggctatcctgggaagaaggctttggaaaatgagaggcatgaaggggagagggtatttaaatgtgtttgaagccaaggatccttgagagaaaaagctggcactaacagcgttcaaagaacttgcgtgacaagtgatgactaatgacactgagggtgggttgtgggtgcctagtgaattcctccgaagccaagagagaggtttccagacccagggaagaaggtgtgtacacccagaagtagtgtagggacagagattccgatcacaagctgtgactggaagacgccgaccaccactgcagcagcctgaaaaccacagtcttgaaccgccagcgaagggctgggaagtgcggatccagggctggtgcactgaacccagaggagcaggctcccattcccagctaagggtggcagctggcggggatctttccagcagaaagctgtaagtggaagctttcaattcagagcagtagcaatgccttcaaagtcccaggcttcacgtgggaacagagaatgtgaagagtatttagcaggatgccaatataagaaatctatattggtgttcgtttgtttgtttttgagatggagtctcgctctgtcacccaggccggagtgcagtggtgcgatctcagctcactgcaatctctgcctcctgggttcaagcgattctcctgcctcagcctcctacatagctggtactacaggcacgcgccaccatgcctggctaaatttttgtatttttagtagagatggggtttcaccacgttggccaggctggtctcaaactcccggcctcatgatccgccctctgcagcctcccaaagtgctgggattacaggcgtgagccaccgcacctggcccaatattgtttgtttatttatttcttgacaggatctcactctgtcaccaggctggagtgcagtggtgtgatctcagctcactgcaacctccacctctctggctcaagcaatcctccctcctcagcctcctgagcagctgggactacaggtgcacaccaccacacccaactagattttgtgttttttgtagagatggggtttagccatgttcagctagtctcaaactcctgggctcaagtgatctgtccgccttggcctcccaaagtgttgggattacaggtgtgattcatgatgtccagcccagtatttttctttcactctggaaaccaaaaattattggctttttttcctgttgcattccctttacttagatgaatctagcaaggttggctgttagtgtctaggtcagaagtctaagtgaaagtgaatatttaaccacactcaagcacagctgatgatctttaatactaatagaggtataagacttaaaagaaacaagaacccagagggaaaatatggccatggactcagagaaaaccacggcagcttccatggactcataaaaagagctcaaaacctaggaagtggatggagactctttttggaatgaatgaattcaaatgtgggctttcttagtagattaaatcattttctagaaggaatttcggaaggatgtgtgcccaattatggtatcaggtctgttgtagactcttcaaggaggaagcctctgaaagacaagaaggaacaattaaaaattagaattcaggtgagtggatcacgaggtcaagagatcgagaccagcctggccaacatggtgaaaccccgtctctactaaaaatacaaaatttagctgggcatggtatggctgtagtcccagctactcgggaggctgaggcaggagaatcacttgaacccgggaggcggaggctgcagtgaaccaagattgtgccactgcactccagcctggcaacagcgagactccatctcaaaaataataagtaaataaataaataaataaaaattagaactcagaaaaggaattaatttcttctgagagagaaaaagatgagattctagcctaaggtgtaacacatccatccaccaggtatcatttttatacacgtgaagttaaatcaccaaaggaccaggtgagcagatgtggactttccgactgtgtgtgtgcgacttcctcagagccctcagtggcgttcccttttccgcgctagcgtttggtccctgcgcttttctggatgcccccaccccctctggctccacgaggccccctgtacgtcaccatcacctttgtgagcttgaaacctgtcacccacccgccttccagatgtcacctgggccctcccggaggccctcgccctcagtgtgtctgattctgagctgtcctgcgttttcccctcccctcaccctggcgacccttttcggtctcagttgccagcctcctgctagggctgggtgggggacatcaaaggcaggacaaggtgtagggtcctcacccaccacttagcagctctcagatgcagacagatttttcagctggcctgtggctcagtttccctcagctacaagaggggtgcatgctagggtttctctggattgctgcacctggcaggtagtgtgagcttggtaggtgcttccttgcttatcattgcctctcccatcttaatgttgtcccatccatccaatgtttatgggatgagaggttgataggagggcatggccctgacattccagggactgaccgacacgctgtctacacaaaccccttctggttcttctcgtgcactgggcgtgccggagacacactcccttaccctcataccccgccgcacccctgtgacctctacctttgagacctcagcttaaactcactcttagggaaggctccctgaaccacctgctggggttgtatgctgatgcaggtacttgtaacacctggtgcttttcctttcgtgcactcaggcagtgtttattcaagtgatggcttggtgacagtggctctccctgagaccccgtgaggccagagtccttggctcatcactcatggttgaacccggagcctcttgctggtaggtgcttcaggactggctctgggagcctgtggctcctgccgggtacccaccggttgagatacctcaagttttaaatgccacctccttcctgaagccttccttgctgctcccccaaactagaggcaggagttttgtccttcagataacctatggcatttgagtcactctgatttgatgaattctgccttcacttgagcagctattaggggcatatgtcagtcattcattcctcagttcatgtatttattcagcaaatatttactgagcacgtactgcgtgccaggcactgtcctgctgtggaaaacagcaggcatgattccctgccactaccaaccactgcatcgcataactggcagactcccagcttcaaggagaggcacggagggaaactgagagcagcctgcagaggggaaagagcggggacagagggtcacggaggtcgcaggggcgtgtgtgcagcacctgccagtgaacggaatgtgcggctccagatgtcgttgtctttaaacttcggaatttcctttcactaaagaaccaagtccagggggaggaaagagtgaatacaaattatccaagaaactcaagagctcattttagttctcctgattatgatcttaaaggcattaagcgctcaagttaaactccttgtgacccacataggttagcagaatttaaatcctaggtgattattaactctaatcatacatctaatgacctatattgaagatacactgcctgcttagttgtggcttcagcctttgctccgtcactgatagttctagcctgaaaagcaaatgagccctcatgctcacgatttcaccacagtcacataagcgggaagagcaggctcctggctgtggcgagcttgactccatttggtttgatagaaatgagaggtagatgattccctagacaaatgcaggcctttctcgaagcccctttcccaggacgacgtgacatgagtggtctgtgccttccagggcagccacgtcatgctttgcccagccagggcggtggggagggagacagccacatcctgcccggggctcctgggccccgctgcatcaagtgaaagcagggctggctccctgatgtccttggagaagtcgcccacactgctttcccccatgggagtgacaaggatgtgtcccgccagccttccacgacggaccccccactctctattaattcccaagaaaccaggccatggaggtgggtttgagggtttgtattggtgttttttaaagtcaggttgaccgagtgcggtggctcacgcttgtaatcccagcactttgggaggctgaggcgggcggatcacatgaggtcaggagttcaagaccagcctggccaacatggtgaaaccttgtctctactaaaactacaaaaaaaattacctgggcgtggtggtgggcgcctgtaatcccagctactcaggaggctgaggcaggagaaacccttgaactagggaggctgcagtgagccgagatcgcgccactccagcctgggtgacaagagtgagattctgcctcaaaataaataaagtcgggtttattaagatataatttacatacagtaattttttttttttttgagacagagtttcactcttgttgcccaggctggagtgcaatggcacgatctcagctcactgcaacctccgcttccagggttcaagccattctactgcctcagcctcctgagtagctgagattacaggtgtccaccaccatgccttgctaatttttgtatttttagtagagacaggttttcgctatgttggccaagctggtcttgaactcctgacctcaggtgatccgccagcctcggcctcccaaagtgctgggattacaggcatgagccactgcacccggccagtacatgctttcttgatttgtctgtttcccacctgtctcccctccctagaatggcagctccatgacgacagaggtgtttctctgttttctccatggctgcaccctcagctgctagaaggtggcccagcataggaggtatttaatgaagccttcctctccacttaaatctacacccttgtgcttattaaaaggtgacagttttctgtttgaaaattttattagtgttttaatgagaaagttattatttgggtaatgcctgaatatgaggaaaacattaagggtagaaatgtaattgttttcctatttcattcagtctatggattttattgaagattacagaattacttctttgtagctatggaagtaaaaaaataataagacgagtagctatttcaaaacgtagggctgataaatttgggatggtttgagaacgttaagttggggaactccatttctttttttacatttttatttattttcatttgtttatttatttatttgagacagagtttcgctctgttgcccaggctagagtgcaatgccatgatctcggctcactgcaacctctgcctccggggtataagtgattctcccatatcagcctcccgaggagctgggactacaggcgcctgccaccacacctggctaatttttgtatttttagtagagatgggatttggccatgtcagccaggctggcctcaaactcctgaccgcaggtgatccgcctgcccttggcctcccaaagtgctgggattacaggtgtgagccaccgcgcccagccagggaactgcatttctgacagtggctcagtagtttggaagttaactggcaaaggtggacagaatctttaaacatatgtggaggaattggagagtttacaagatagtgaagaactgccaggccatggtctggagaagatggaaacttgatgtttggggccattgtgtccctggggtgttggccaatttatgaaagaagcagttaagagcctgagtggcacttttgaggggctagaagggaagaccctggtaaacatcccaaactttggattgggacccaaaaaagctccatcccaggagtacaggtgacctggaaacggatcagcgtaatcgaggactgaagtccagttctagctacgcccagtccttgagactggattaaggtgatctcagattgcaaggacctcaaatgcctggcagaagcaagtgaatatccttctggaggaacagagcctcatcctaggcctctaattatttttaaggacaatttttcaaatgcaggctttcctccctttgcacagttcccttatgcataaatttcagtcagtggccagctgcagtggctcatgcatgtaatcccagcgctttgggaggccaaggcgggtgaattgcttgagtctgggagttggagaccggcctgggcaacatagaaccccatctctatttttaaaaataaaatattaattatcactgcttagttaaattatagtggtctcccaacaatacagatcagatcccagctcccatggtatatacactgtgagtgctgtataaagtacaagctctgccgccagttctccagcctacaaatcacagtatagataacagatgtgcatgatgatcactggccaattgcgtcacttctctcaaagtcagtctgtgattggtccctgagcatctgtcggtcagtttcatgcacagactgcaaagcatatggttttgtctactctttgtctctcagtgataaacccacatggcattttgtaaaagtggatacatcaggccaggtgtggtggctcatgcctgtaatcccagcactttgggaggctgaggcaggtggatcatttggggtcaggagtttgagaccagcctggccaacatggtgaaaccccatctctactaaaaatacaaaaattagctggatgtggtggcaggcgcctgtaatcccagttactggggaggctgaggcaggagaattgcttgaacccaggaggcagagcttgcagtgagccgagatcatgccactgcactctagcctgggtgacagagcaagactaccatctcaaaaaaaaaaaaacaaaaaacagtaatcaagcatgaaaattatgaaatgctcagagataaaatgcgcgaggcctgtacactgtaatctacaaaacactgctgagagaaattttaaaagacctaaataaatggcaagttataacatgctcttgaatcagaagactcagtatcttaggatggcgacttttcccaaaatgatctacagattcaaagcaatcggaatcagacctcagcatgcctacttgtagaatttgataacctgattctaaagtttatatggaaatgcaaggaacccagagttgctaaaataactttgaaaaagaacaacacagttgaaggacttagactacatgatttcaagaattattataaagctacagtaatcaagacagtatggtattgatatgaaaatagaccattagatgaatggaacagaatagcaagtccagaaatagatccacacatatatggtcaattgattttcagcaaagtgccaagtcatttaagtggggaaaagataatcttttcaacaaatgataccggaacaactggatagccatatgcaaaagaacctcaaccttcagctcacagcactacaaactcataattattatcattatattatactattatgtaataatagtatatatcatgttacatattatattatgtaatatatattatatgatactgttatgtcatataattattattgaaatgggtcatagatctaattgtaagagttaaaaccatccaggtacagtggctcatgcctgtcatcttgcactttgagaggccaaggcgggtggatcacttggccccaggagttacaagaccatcctgggcaacatagcgaaacaccgtctctacaaaaaaatgaaaaaattagttgagcatgatgacactcacctgtagtcccagctgcacagtagtctgaggtgggaggatcacctgagcccagagaggtcaaggttgcagtgagccatgattgcaccactgcactccagactgggtgacagagagaccgtgtgttaaaaaaagagttaaaactataaaaccttcagaagaaaacatatgagaaaattctagtgatttggggtttggcaaagattccttgaacatgatttaaaaagcattaactaggccaggtatgctggcttacacctgtcattccaatgctttgggggaccgaggtgagaggatagcttgaggccaggagtccgagagcagcctgggcaacataacaagagtgggtctttaccaaaaaaaaaaaataaaaagcctgtgccaggcacagtggcacatgtctgtagtcctagctactcacgaagctgaggcaggaggatcacttgagcccaggagttgaagcttgcagtgaattatgaccatgccactgcactccagcctgggccacagagtaagactaagactcagtctcttaaagaagaaagcgaccgggcgcagtggctcacgcctgtaatcccagcactttgggaggctgaagcaggtggatcacaagggcaggagatgaagaccatcctggctaacacggtgaaaccccatctctactaaaaatacaaaaaattagccggacgtggtggtaggcgcctgtagtcctagctactcgggaggctgaggcaggagaatggcgtgaacctgggaggcggagcttgcagtgagccaagatcgtaccactgcactccagcctggacaacagagcgagactccatctcaaaaaaaaaaaaaaaaaaaaaaaaaaagaagaaagcataaactataaaagaaaaaattaataaattagtcatcctcaaaattagaaacttttactcatcagaaaacacttaataaaatgaaaagtcaagccatagacttagagaaaatatttacaaaacatatatctgacaaaggacttggatatggattatataaagaactattgtaattcaataagatgtcaaacaacccaattaaaaatgggtgaaagatgaactaactcttcaacaatgggcatgtcatttgaatggatggtaagcaagcacatgaaaagatgttcatgtgcctttccctcattagtcactagggaaatgcaagttcatagacatctctcttggtagaaagatatcactacacacccacaagagtggctgtaattaagcagtctgaccaagtatgcgtaagaatgtggaataagaactctcatacactgctgatgggaatgtaaaatgatagccactttggaaaacattttggcaaataataccacttacattattatcgaaaatattgtatacctgaaagaactcaaagtgaaaaagctatatactgtctgcttccaaggctacacattatgggaaaggcaaaactatgaagacagtaaaaagatgcgccagtggttgccaggggctcatggggagggaaagaggaatgaataggtggaacacagggcatgtttagggcagtgaaactattctgtatggtaccgtaacgatgaatacatgttattaggcatttgtcaatacccataaaatgtacaacacaaagagtgaaaatgaaaactgtgggcttcagttagcaataatatgtcaacattggctcatcagtggcaacaaatgtacctcaccaatgcaagatgtttgtttgttgtttgtttgttttgtgacggagggggtgcagtggcgcaatctcggctcactgcaagctccgcctcccgggttcacgccaatctcctgcttcagcctccggagtagctgggactacaggcgcccgccaccacgcccggctaattttttgtatttttagtagagacggggtttcaccatgctagccaggatggtcttgatctcctgctgtcgtgatctgcccgcctcggcctcccaaagtgctgggattacaggcatgagccatcacgcccggccaccaatgcaagatgttaataacagggaaactgtggtgggagtgaggtggtatatgagacctctctgtactttccactcaatttttctgtaagcccaaaacttctctaaataagaaagtttattaattaaaagttacttttatagtgtatctatatctaggaataaatctgaaaaagatatataagatctctactcagaaaactgattatgttattaagagagcttaaatatagcccaaataaatagatggatatactatgttcatggaagggacagctcagtattaggaaggtgtcagtcatcttaagaaaagcctcatgtgtcacacaagggatactgacatctgacaccaagcacatgtaggcatcctgactacgtttacttgaatgatgtggactttacagagctgactatagacagttcaaatggcctgaaaactgttcaatgcactccctcccaggctgtcatgggatgcacttcaggaactttactttttaacaagaaaattcagttttcctcttaaacagctggcttctgttccattagcattcttgtcactttaagttgcattcatctttgttttttttttttagaaaaacatttgttctgcaaccagtcttgtcctttaaatacttgtactgtatacaggctctttttcataggtccattacttaaaatgatgtaagtgtgtttttggtggcaggggggtgggagttgtttgttttgttttgttgagacacggtcttactctgtcacccaggctggagtgcagtggtgtgatcttggctcactcctggcctcaagtgatccacccacctcagcctcctaagtagctgggaccacaggtgtgtaccaccacacccagctaattttttttttttttttttttttttttgtagggacggggttttgtcatatcacccaggctggtctcaaactcctggactcaagggatcagcctgtctcagcctcccaaagtgctgggattacaggtgtgagccactgcaccggtcctgatttgagtttttgtaagacagggaacaatgttcagaatttagcaccaatgtcagactcattctgtaaatttttattgaacgtctgcctggtgtaggagaggaagatgacagacaagaattcttcctccaagagttacaggtcagttgagcagaaaaggcatacatcaatacccacaatgagagttgtcgtgattcagaggagggacaaagtccttcccctggagggatcctgagcactttggagaggaaaggcatctgtactgccccccaaatgtgtagaatgggatgcattcctggcagaaagaagtaggataaagtacagaggccagggctgggtgcagtggttcacgcctgtaatcccagcactttgggaggccgagacagcagatcacctgaggtcaggagttcgagaccagcctggtcaacatggcaaaaccctctctctactaaaaatacaaaaattagccaggcacaatggcaggtacctgtaatcccagctacttgggaggctgaggcaggagaattgcttgagcccaggaggcagagatcgcagtgagccaagactgcgccactgcactccagcctgggcaacagagcaagactctgtctcataaaaaaagaaaaaaaaaaagtacagagtccaggaagcctggggtggggctggcagatgccgagtcatctattttggccagagttcaaggcttgctaggggacatgaagagaagattcgtgcattctagttcaaactccaccagatatttgagctccttctctgtaccaggcattgttctaagatacgtaagtgaacaaaacccatgacaccctcgtctatgagagctgatcctctggcagggacagacaggtcatgagtggagtgatggagcagctggcctggtgacttagccgccttcaggtacagtaggaggagcaagcccaggacaggtgagtgggtcaagggtgccagaaggggtgagggcaccaggaagctggtccagtttggcttccctgaggtggtgaccaggacctagcatctgaggaagggctggaagcaggtgagagcaggtggagcagacatcaggatgggagcatcctgacagggagggcagcagggtgggctcatgagaggaacagccaggaagtgtgactcgagcagtgtcctggagaggaggaggaggagaaagaggtcaggaggtcccaggggagaggcaggaccagtctcgtggaggtcggggccgttgtgaggactctggtttgtgttgtgtgtgaaaggccatgggatggggaccagcgagggcttcttaggggactggatatgctctgatctagctgctaaaaagcccccttgggcagcttgcagggcccgggcagaagctataggtggttctgaggtttgcagaggggcctgaaggggtggggcccggccaagcaaggtggctaagtgggaaaggctccaccgcgttgggtgtaggaagaccttgaccttagctccagcccagccactgagcagccgtgtcgccttgggtgatacctgtccctggtcggtttccctacctgtgaatctgggtacttggaagccatgctcgagaagagcccatccccaggaggtgatcagggttctcctccaggtgaggaacctggcagccgtgtgtgagaaccttagaaaagggagagggaagaggctgtggcaggaagtgaggagggagttagtgataccctgggcaggatgccatgagctgggatggaaaccacaggatgaatgcaagtaattaaaaaaaaaaaaaaaaaaaacagcattgggccgggcagtggctcacgcctgtaatcccagcattttgggaggccgaggtaggtggatcacctgaagtcaggagttggagaccagcctagccaacatggtgaaactgaaaatgcaaaaattagccaggcatggtggcgtgtgactatagttccagctactcaggaggctgagacaggagaatcacttgaacctgggaggtggatgttgctgtgagctgagatcgtgccactgcattgcagcctcggtgagagagcaaggccccatctcaaaaaagaaaaaaacagactttccgaccaaacgatcgacaaaccagactgtccaaacagccataagccgtaactttgtgcggaggtaaaagaccgaggtcacatcgggacctgttggattcaaggcatgttgacagctgtttccaggcttcagatagagcctccagctggcagggtggccacagggcttgttgagtaggaagcctcgttgctttgacaggttacttggccccatgagggacaatcccatagtcagttacccagaaacgtgactgtctccttgaaatcctcagcatggggtcttatgaataaacccttactagatttcctgttctgtcttatttttatgcagagctttactttatagcagaaaattccatttttacccttaaatggcttgcttctgctcccttagtgttcttgtcactttaagttgcattcatctttgtccctttagaaaaggatttgtcctgcaaccagctcttgcagaaggtacttggtttattgttaaccgatgtttgctaaatgtttgaattatgttgagttgcttaaagtcatgctatcgggtagatgttgtggctgttcttttcactctcttatttggggatttacaaaacagttatgtttttagttttcttttatttgttgtgttgaataagaatgtagctctgggaacctctagttccaaataagaaagccttggacacatttccagttggcaagctggcaaaatgaagggcgtacaagttgttagagaggctgggagcctatttaagcacccagcttcaggatgggacatgggatatacctcgagttagaggttcttattaactgtggattcttctatgcagatatctgtcacaatataagttactataagtcagtactaaggcagctgctacattctgtttgccaaggggaagaagaaagcttggaaatggtattccttaaaaatgtcagtatcataaaagacaaagaaaagctgcggaaatgtttcagattaaaagagagaagacaataaaatgtaatacctgactctgaacagcatccagtactgaaggaggaaaaatgctatcaaggacattattgggtcaattaacaaaatttgaatacgaatcatagattgaactgtatctgttaaattaacagaagcgaagtgttctgtggtgtgtaggagcacactgccattcttagcaaacgtgtagtttagtatttaggagaaagggccatgaggcatgcaactcaccctcaaatacacacacacatacacatatatacatacatacctataaagaaagaaattatgggctaggtgcagtggctcatgcctgtaatcccagcactttgggaggccgaggtgggtggattgtgaggtcaggagatcgagaccctctctactaaaatacaaagaattagctgggcgtggtggtgcacgtctgtagtcccagctactcgggaggctgaggcaggagaattgcttgaacccaggaggcagaggttacagtgagccgagattgcaccactgcactgcagcctggcaacagagcaagactctgtcttgaaagaaggaagaaagagagagagagagagagagagagagagggagaaagaaagagagagagagagagaaagggaaggagagagagaagaagaaagaaggaaggaaggaagaaaggaaggaaattatgataaagcagatggttaagttggtaactaccagtgaatatgggtaaagttaggatgttctttactctgttttgggggtgcaacttttctataagtgaaagtacttccaaataaaaagttaaaaggcaagcaaataaataaaagagacagtttctatgttatatatcctagctatgtttaccatgtctggattctgaaagctgcagagcagaaaacctgaagaacagatcacctgttcttaaaataccactgttggccagacatagtaactcactcctgtaatcccagcactttgggaagccgaggtgggaggatcacctgagctcaggagtttgagaacagcctgggaaacatagtgagaccctgtctctacaaaaatttaaaaaattatccaggcatcatggttcgtgcctgtagtcctagctactcaggaggctgaggtaggaggattgcttgagcctgggagttcgaggctgcagtgaaccatgatcacactaaagcactctagcctgggcaacagagcaagaccctgtatcaaaaaaacaatcaaacaaaaaatcactcctaattttcctcccttttagtacttttaaaaattaacttaaaacattttttggataattgtagttttttttacttttttttttttgagacagagtctcattctgtcacccaggctggagtgtactggtgcaatctcaggtgactgcaacctctgtctcctggattcaagtgattctcctgcctcagcctcctgagtagctgggttcataggcgtgcaccacacctggctcgtttttatatttttagtagagatggggtttcaccttgttggccaggctggtctcagattcctgacttcaagtgatctgcccgccttggcctcacgtgcagttttaggaaataatacagagatccccagcactctttccagttttccccaagggtaacatcttgcaaagtgagaggacgatatcacagtcaggatactgacattgataccatcaagatacataatgtttccatcaccaatcagtggtcatggtgccttttatagccaaacccacttctctcctaccttcccatcccttttttaattttgccagtcattaatctgttgcccatttctgtcattttatgaatgtcacataggccgggcgcggtggctcacgcctgtaatcccagcactttgggaggccgaggcaggcggatcacgaggtcaggagatcgagaccatcctggctaacatggtgaaaccccatctctactaaaaaatacaaaaaattagccaagcgtggtggcgggcgcctgtagtcccagctactcgggaggctgaggcaggagaatggtgtggacccgggagacggagcttgtagtgagctgaaatcacaccactgcactccagactgggtgacaaagcgagactccatcttaaaaaaaaaaaaaaaagaatgtcacataatgaatcatatggcatataaccgtttgagactcagggtaattctcatgagactcatccagcttgttggtgcatcaacagtttattcctttttattgctgagtaatttccatggtatggaggaaccatggtttaactattcacccattggaggacatctaggttgtttccagcttggagttattatgaataaagctgctgtgaacatttgtgtacaggtttcttggttttctggtttgttttaaacagttctagccaggcacggtggctcacacctgtaatcctaacacttggaaggctgaggtaggaggactgcttgatcctaggaggcagaggttgcaaggagccgaaattgtgccactgtactccagcctgggcaacatagcaagaccctgtcattcataggtaggtggatggatggatggacggacggacagatagataggtagaaatgtaaattacagggctacgctcagtggctcatgcctgtaatctcagcactttgggaggcgaaggcgggcggatcaccagaggtcagcagtttgagaccagcctggccaacatggcaaaaccccatctctactaaaaatacaaaaattagccaagcatgctggcatgtgcctgcaatcccagctactttggaggctgaggcaggagaatcacttgaacccaggaggcggaggttacaatgagccaagatcatgccactgcactccagcctgggccacagagtgagactccgtatcagtactttctttttattgtttttctgttattatagtttaagttcattgttattagattatatactctgtatggcttcaattcttttaaatttgttgaggtttgtttaatggtcaaagacatggtctgtctaggtgaatgttccatgggcttttagggaaaaaagtatattctagtgttgttgaatggtgtcttagtccattcaagctgctataacaaaataccgtaaactgggtgatttataaacaacagaaatttttctctcacagttctggaggctgggaagttcaagatcaaagtgccagcagattcagtgtcatgtgaggacgtgcttcctgcttcatagataagaggtacatacacgtttaggagcatcgtgtcttcctggtggatgaattctgttatcattaggtgatcctttgagcacttttaaaaagaatctgttggccgggcgcagtggctcacgcctgtaatcccaggactttggggggccaaggcgggcagatcacgaggttaggagattgagaccatcctggctaacacagtgaaaccctgtctctactacaaatacaaaaaaattagccgggcatggtggcaggcgcctgtagtcccagctactcaggaggctgaggcaggagaatggcgtgaacacaggaggcagagcttgcagtgagccaagatcacgccactgcactccagcctgggcaacaaagtgagaccctgtctcaaaaaataaaataaaataaaataaaaataatctgtttaatagcctactagtgttcttcctttactattttattgagcattaattaatcccaacattatgtctatgtcaggactgatgacaatatttggtataaaaatttgatagtctcagaggctgaggcaggagaatgcttgaatccaggaggcagaggttgcagtgagctgagaccgtgccactgcactccagcctgggcaacagaacaagactccatctcaaaaaaaaaaaaaaaaaaatcgatagtatcatatcctccaggattcaaagtgaacttcaaacagtcttatgtagtctaaattttggaatgcatcccagtattgagttgcagcagggatttgagtttttgtgaagagagagaggtatatcagaatcttgggcataaactaaggagccatgtcagaacctcaggtgtatgccaatgagatagatcagaacctcaggcatgtacccgatgagacagatcagaacctcaggcgtgtacccggtgagacaggtcagaacctcaagcgtgtacctgttgagacaggtcagaacctcaggcgtgtagccagtgagacaggtcagaacctcaggtgtgtacccagtgagacagatgagaacctcaggtgtgtaaccagtgagatatatcagaatcttgggtatttacccaaagaggtatagcagagtctcaggtatatactcaagaaggcatatcttgaggctttaagtatctagctaaggatttatatcaggatctcaggtttatacccagggaggtatagcagaatttggggtatagatctaaggaggtctatcagtctagagcatatagccaaggaactatatcagaacctcaggcacctacccaaagaggcattttaggactcgtaaggagggggtagatttcaaaagtgtagtctaacagtttatctactttgaaatttaaaacaatattaaaggaaaacatgaaatatttctatctgtcagaaggtgacatgagttttaaacaattaagaaatatactggctgtggccttgtaaccaaattattatgcctatagaaattacagactccattttccaggatagaataacagggactgacttaccttctcatctgagataacaaaacctccatacaaatacatgaaacaatgttcttcaagatgctggacatcaggcagtgaagggcactgatggttgtaagacaaggtgagaggtgtggcttgagagagtttccaggttgcagtgcagggagaggggaaactgaggcagatcttggcagacttcctcagttgacaaaatagagctgagagtccagggagaccatggtgtatagattatccaaagcaaagtatgagaggtgcaagccatatacagagggactccagagatctaccaaagtacttcttggtgcatccatatgagcaaaactacttgaggccaggaaaagaaccatctgagaggattagaaggaacagtgcccagtacttgtgccagccaggaatggtgcctgatactcacgcagggccaggaacagtgcagggatgtgagtgtttgttaggagagggaggtatatcagaatcttgggcataaagacaagaaaccatatcagaacatcaggtgtgtaccaatgagatagatcagaatctcgggtgtatacacagtgagatagatcagaatctcagatgtgtacacagtgaagcagatcagaatctcagatgtatacacagtgagatagattggaatctcaggtatgtacccagtgagtccaagagcatggtgctggcatccggtgagggccttcctgctggatcgtgacatgaagcaaggcaaagagcctgtcagctcagggctctcttcctcttcttataaagtcaccagtcctatcatgggggccccaccctgatgatcttataatcctaattacctcccaaaggctaccttcaaatgctatcaacatatgaatttggaaactaagtttccagcacatgaaatttgggggatacattcaaagtatagcaaatattacatcataaccagtaggattcatcccaggaaatgccaaatggcttgataatcaaaaattaatgtaactcatcgtattaacaggatgaaaaagaaaaaccatgtgatcatcttagtagatgcagaaaagcagttgattaaatcccacattcatttctaacttaaaaaaacaactggattttgacagaggtgcaaaggcaatttggtagagaaaggacagtcttttcaataaatggtgctggtgcaatggttatccatatgcccaaaatgaactttgacccatgcctcatgccatacacaaaaattaactcaaaatagatcagagatctgaaggtaaaatttaaaactataaaacttctagaagaaaacacaggagaaaaatctttgtgaccttggtctaggcaaagatttcatagatatgacaccgagaacacaatctatgaaagaaaaaaatcaataaattgaacttcatcaaaatgaaacttttactgttcaaaagacagttttaggagaatgaaaacacaagttacacattgggaagaaatattcgaaaagcatttgcctgataaaggtattgtagctggaagacagaaaaaattctcaaaactcacctagaagaaaataacccagttttaaaaatgggcaagagatctgaacaaacacattgtcaaagaagatagatgaatagcaagtaagcatgtgaaaaattctcaatgttatcagtcatcagagcaatgcagatgaaacctacagtccccatgctaatgttctacaacttacacagtggtggtatgataccactacatgcccatttgaatggccaaaattagaaaggttgaccataccaaacattagccatgatgtgcaggaactagaactctcatctttgctgacaggaaggtaaaatgatacaaacacattgaaaaacaggttggcagttgcttttttttttttttgagatggagtcttgctctcccaggctggagtacagtggcgcgatctcagctcactgcaacctctgcctcccaatgaattagaaaaataataataaaggtaacaatagcagtaataataatagaaataatgatagtttctttaataaaaatgctgtttaggcccagactgaaaggctttaagtaaccactcccccactgaagttagagttaagaaagaatattaattttccttgtgtgaaacattaatcttatctagcctccatgtattttgtaagttctgtaaattcctgttttccctgcacagctgcaagttcacaaggcagataagcttaagctgcaaaacatgtttttcttaagatgtaaggcatgtcacaagaatatcacaagatgataacggcctttattctcacttctgtatgcctgcttcctgcctcacatatttcctgcctcaagatgcgtaaaaggtacttgccttctttgtttggtgctctgactttctggatgcaagtccactgagccagtgtacaccttaaataaatcctcctgaaccccatcaatcgctccagttctctgatttcccactacattttctgggggctcgtccgggattggagatggcagattttctgtctcccttgcctgtggaactggagcccgggtcgagggagacctgggacctttggtgccaatgggaggactttagcccggaaaggagattggctctcctgcatcccggtgtccttcctagacagcacaacggaacctataaaggggttgcaggacggttccagcaggggctggggatggtgagagtagctcactgattcagatgacagggttttgccatgttgcccagacccagaggggctggggacagtgagagtagctcactgattcagatgaaacttacaccttagccgatgcaggacacgagagtggctcactaagttggtcaggaaagaaactgaaaatgggaagagtggcttcctgccttgactaaggatcgggaactgggagcggggaggtgtgtgaaagagatggttccgggagggccgtgatgtggggagacacagatctcttagcacggactgtgtgctctgaggcgagtgtgtgattgaccagaaccagggcatcacatacagctgacaggagctgccccacagctgcagcaggctgtggcaggaataaggtactctcctagctaagcagcacctgaaacttccgtaataggacccagtctggtcagtctggaacgaaagtgagagtgagtgtgcatcacaaagggcgggatgggaggaaaagcatcgaaacccactcctctggggtgcatgttaaagaattttaagaaaggttttgctggagattatggaattaagttgtcccccccaaagattgagggttctgtgtgaagtggaatggccttcttttaatgtcgggtggccagccgagggtacaataaatagggaaatgattggtcatatatttagggtagtgactggggttggaggacaccctgggcatccagatcagttcccatacatcaattcctggatgatcacagtctagacatgccccaaatggttacagccttgtctggcaacttactgtaagactctagtgacctgagccgaacctaaggcagttagagggcccccttcaccagacacctcaggtggaaagaaaaagccacaggaaaattaggaaagacctgttctacttcactgggatcaagtgattctcctgcctcagcctcctgagtagctgggagtacgggtgtgcaccaccacgcctggctaatttttttaaattttatttttagtagagacggggttttgccacattggccaggctggtcttgaactcctgacctcagacagtctgcctgccttggcctcccaaagtgctgggattacaggtgtgaaccaccatgcccagccagcagtttcttataaagttaaaccaatgcctaccatgagatctggcaatcccactcctaagtatttggccaagaaaaaagaaagcatatattccatacagagtctagtcctgaatgtctatagctgctttatttataatagctcagacttggaaaccattcagatgccattaataggtgaatatattctcaaactgtggttatccatacaatggagtattactttgcaatcaaaaggaatggcctatgaatacccataacaacatggatgaatgctgaaataattgtgctgagtaaaagaagacaggaaaaataagtataatacatactgcttgattctatttgtataaaactagaaagtacaaactaatctgtaatgacaggaagcagaccagtgacagtgggcatggaggggcaagagggagagattagatgggcacaggagagctttgaggatgatgggtctgcgtactgtctcggctatgatagtggtttcacaggttgatacatacggcaaaaaataccaaatttgtacactttaaatatgtacagattattgtatgccagttacatgtccataaagctttcttttgttgttttgtttttattttattttttgagacagagtctcgctccatcgtccaggctggagtgcaatggcaccgtctcagagcactgtaacctccgcctcccgggttcaagcgattctcatgcctcagcctcccaagtagctgagactacaggcatacgccaccatgcccagctaatttttctatttttagtaaagacagggtttcgccatgattgccaggctggtcttgaactcctgacctcaggtgatccacccacctcggcctcccaaagtgttgggattataggcatgagccacagcaccgggcccataaagctgtcttttaaatgaaaaaaagttgtcttgaaataagcattagaactgtggctttggctctgaaatcctcatctgaggacccacactcgggtgccccaatgtggcggtgcttacagaaatgactccatctgctaaatgagtaaatgggtaattctccactgaacacacactcgtttagcagcataagcagcaagagttcaggtaatcctcacattgcaatttgtcattagtttaaacttccagtctttgttttaaaaacacattagaataatactacattttccctcatctctaaacttgactgaagactccaagagagagtaatattcatcaagaggatcatctactcaacacagataaactgggaaagaaaaataacttgtgagtaattcagaatctggattatcaggtcaggctcaatggctcacgccagtagtcccagcactttgcggggcccaggagggcagatcacttgagttcaggagtttgagaccagcctgggcaacatggcgaaaccctgtctatacaaaaaatagaaaaattagccaggcatggtggcatgtgcctgtagtcccagttacccgggaggctgaggtgggaggatcacttgagcctgggaggtcgatattgcagtgagctgtaattgcaccatgcactccagcctgggtgaaagaaggaaactctgtgtccaaaacaaaacaaaacaaaacaaaaaaagctaaattatcaaatgtctagatcgttgatggttggaagtaaagttgagaaatgttcacactgggagatgacacacagtaaaccacacagagggttctaacgtggttgttagaagcagaaactagaggcttgctgcctgaggtcaaaccccggtcccggtggttctgtgccccagcgcatgttgtggtagcctctctgtacttcagtttcctcatctgtaaagtaaacataatgataatgcctgcctcatggggttgctgttaccaggaagtgagttaatgcacattaggttcttatttatgacagtgcctggcataggataagggctcaaaaagtgttagctggaactactatcattatcaacatctctaatttattgcagggttggatctgaaaaatggctgatgatgatttgatgatgacttcatttttataaaacaataatattgcagtgcaaattaaacacaagcaacctgcaacacgccactgcaagttggatgtctagaaaaggtgccatgagttaccttctaaaacatcataagaaaccatgttcaccaataattaccataataggagagaagtaccaagtaccatggggagacagagtccagaatctcagagagagacacagttaccttttagttacactaatggggaaaacaggagctttgctacccttgcacctgatggagggcttctctgaatatagggctatggggtcagaagccagtttcctcccatatttagaaggtttccaactgttatctttcacttcccatgttgctgttggaaaatccaaaagtattctatttggccaggcacagtggctcacacctgtaatcccagcaatttgggaggccgagattacctgaggtcggaagttcaagaccagcctggccaatatggcaaaacctcttctctacaaaaaatacaaaaattagccaggcgtggtggcgcacgcctgtagtaccagctattcgggaggctgaggcacgagaattgctttaacctgggaggtggaggttgcagtgagctgagattgtgtcactgcactccagcctacgcgacagagcaagactccgtctcaaaaaacaaaaaaagtattctgttggatcgtttgtgtgcgacgtgtttttccctctcagaaagctcgtagggtcttctctttgtctccagcatggtctggaatttcccagtgagtgaccatctgtgtgtgtgtattcatccattccatggagtccctgctgggcccttgcaatctggaaattcatgcccatcatttctgagaagttatcctgaacgtactggttggtggtttcctgtgctccatgttcttgcttcctgctcttcggagctcctgttatttggttgagttttgtctcctggactggtcctctcttacttctcttgcttctcccatgttccatctgttttcactctactttctgtgagatcaggccctttatcttccaacccttctattaggtttgcaattgagtttgtaattccctagaaaagttcttattctctgaatatcccttttgatagcatactcttcctttttcatgagtgcagtgtttctgcatggctctcatcagaacatgctagtgtctcccatttctcataactttctagagtgaggaccatttgaacttggagtgccctcattttaaaactctgtggttgaccttgttcccctcttttgctgctgcttttcaccagactttgaagaagcagaagtacattcagaacttgtctgctctggcaaaagacaatactgttggcttaatctaaaaattgaagaagaaagctcaaggagagaagtttaaaaatataccacctctggctgggcgcggtggctcacatctgtaattccagcactttgggaggctgaggcaggtggatcacctgaggtcaggagttcaagaccagcctggccaacatggtgaaaccccgtctctactaaaaatacaaaaattagccaggtatggtggcagccgcctgtaattccagctactcgggaggctgaggcaggagaatcacttgaacccaggaggcagaggttgtggtgagccaagatcacgccactacactacagcctgggtgacaaagtgagactccgtctccaaaaaaaaaaaaaaaaaaaaaatatatatatatatatatatatatatatatatatatatatatatatatacacacacactaaccttcagcatataggactattgcagaagggattatctttctacttggttggttcctcttggtcttgagcaaattttgacttccctgagttggcccctaaaagttaaagggaaagggccttttctctttcctttaaaaccaatatggcatatttgctgagaacttagataccacaggattggcagtgtagacttacattcatagaccggatgccatcagccaaccttgagtaatttgcagcacactgcatcattttatttaagtaatgcgaagtccttgacatgtctcagacattgtcttggttacttgtaaggtctcacataaatctaattttcctctttctctgccctttctggttcagctcagtttattcaagggtgtatttgtgcaacacacttgaataaggtgtggtcccgcctttgtagatgttatagtttgggaagaccagccgggcagagagaagagcatgattcaaggatgaaggcgtgggctgggggccgagggagcaaggattcccagtaacgagggaggaaggagcagcaccatgtgcccattactctatagacatctcgaaccacctggccatgtagctgtcattaacctaaatttacagttattgaaactgaggttcagccaggcgtagtggctcacgcctgaacacaggaggcggaggttgcagtgagccgagatcacgccactgcactccaggctaggtgagagagcgagactctgtctcaaaaaaaataaataaataaaagaaaagaacaaaactgaggttcaaagaaatgtacagtgctcccccccttatccaaagaggatacactccaagcccccacagtggatacctgaagcctcagatagtatcaagccctatatatgctatgttttttccctgtatatgcatacctatgataaagtttataaattaggcacagtaggagactaacaacaatgataataaaatggaacaattataacatacactgtaacaaaagggtctcttcctctctctctcagaatatcttattgtactgtactgggggtaactaaaaccaaggaaagtgaaaccatggataagggatatctactgtataaggtggagttttcaaggtcatagcactgccttcccctgaggttggccttgcagcctctctaggcactgctgctgctgctaagaacccctgtgaggtgaacactgtaagcatcatcattgcttctcagaagaggagacctggcttacagaggtcaagcctcaggtaccttaaacaccattttaaaactgaactcatggccaggtgcattggctcatgcctgtaatcccttctctccatgctcaaaacctgccctccttgtctttatattccaaatttcgtgggtgccacctcctctgcccagtgacttaagccagagcatacattcatcctagactctgtcccaggtccctggtccaggcagctgccagttgtcaggatcagctctttatctcgcagtcctcctgcctcttgtgtcattacccagggctgtcaccatcttttcttgggacagttacaacagccccgtaaggagttgtgctgcttctagtcttgttccctttgaatctggattccttcttgccatcaagacaatcctgatacaaatctgatcacgtcacacttcccttcaatagtcttccatggctccttattgttttaggatgaaatccaaactcctaaacatggggattaacaatgtgccatgattggcactgctggcctctcctacctctgcagactcacctcttgccacttctcccttgaggtagatcaaaaatggtcacaagttctttgaggctcttcccatcaagaggtagagtttatttccccacctcttggatctggcttgccttgtgacttgctttgacccacagaacgtaacagaaaggacactgcctaacttacaaatgaggtctaccttaagaggctttgcagattccacattcaacctcttggaatgctgccaccatctgagaagcctgaggtggcctctgtgaggatgaaagacttcatggtgagaaatacctagcgaacagcctggcaccagctaccaggcatgtgactgaggccatccagccatagctgagccacaaaatgaccacagctatgtgaattatcccaggtcagaccagtagaagagccacctggctgagctcagcccaatttgctgacccatagaattgtgaacaaataaaatggttgtagttataagccattaagtttcagagtttgttacacggtaacatgtaactgatacaactcttggagccagttgttcagccattctcaaccacttattcaatgatgttttgggccatatatgcagatatgctgttcccttttccttgaaatggcccttaccctcctttctgttgggttttcctatggaatatccagtcagcctttaggattcatcttgggtgtcccttcctgtatgtaggctccctggccctccaggattcccccagtaacagccctcatcacgctgcctttgcaaccatttgtttatttgtacctctcacctgctagttgggcaagttactcacttctctcaacctctgcatttttcttctttataaatgggaccaataatacctaccctgccctggcgtggatagattaaagaaaaaaaatacatgcagctgccattgagggcctggcccacgtgtgatgttcaataatattatttctccttgttttccttcccgtgccagtgccacacccccctgtcccagtgcactggggctgtggatcccttcaaagctgagattgcctgtctgtggtctccagcgttaagcacagtcattagctcaggtgcgtactcatgtgttccacgagttcaagcctcagccctgtaaagtttgcctgccgtgtatctgatatatttctgctaaaacccattaggcctttcttgctctgaaatgtcatcgttagttgtgtgtcacttcagttttgtaactggccaggccactgcgcccaggctgcttcctcgtcatctggctgctaaatgcttcaaccttacctgccttgctatgcgtcccatcctgtatcaggtcagagctcttgagtggtgaatacaaatttcatttcagttgacttttgattcttgtggcaggcctctcggcctactctaatttgattgcaacggacacaaaatgtgtccaaacttgcagcttttcttctcttattttgatatcaccatccacaaaggtaagatattttaaagcaataactacaaactttctgaaaattatgaagaagtgctgggttttaaatggaagtcatatagtgtgaactttgtgtaaagtccgtagggagttttcttggaaatggctgggaacattctttttgcacctttgaagataaaggtaggtggaggagctcacagctcttgtgccatgttgggcttgtcactcttgtttatgtgccaaattcttttgattacaaaattttaagtttaatgctttaggtattgttgggcaagatctagatgtatctagttaaatgtaggtgatatgcaaactatttatgatgtatttgatttaaattcattaagatagagtgtctttaccaccattatagtctggtccttttccttctgttttaaatgtgtttccattggcattttctaaactgactttgttagcgtgttaatcatttggcactggtaatgattaatcttttctttctttctattttttttcttttttttttttgagacagagtcttgctctgtcaccaggctggagtgcagtggcgcagtctcagctcactgcaacctccgcctcccaggttcaagtgattctcctgcctcagcctcccaagtagctagggactacaggcacgtgccaccacgcccagctaatttttgtatttttaatagagatggggtttcaccatgttggccaggatggtctcagcctcttgacctcgtgatccgcccacctcggcctcccaaagtgctgggattacaggcatgagcgactgcgcccagccgtgttcatctatttctgtgaaccgatgctaggtgaaggtacagagggctttctagcttctgggtttgtttattctgaaatgttattttaaatcttagcccaacaaattgagcgaaaagacttctagatgttaaatatgatattcaaaaaatataaagacaaggtgataaattagaattggtgggaaagagaaaaatctgtcttctgatggtcacctgccccagcaacactactcgtttgagaagacttccatcctttaccctcaaagtgttccatgaggttggatcagacatcatttagcaaagaaagatgtaaatagatttctgtagggtggcattattaagcatattaagtggttacaatacagtaaattagagggagtagtacagaagcataagcagtcaaaaaagtgaaagtctaacgttcgtaattattgttctggaggcttttgtatcacatataagttccaggctgggtatgatggctcacaccagtaatcccaacacttagaggccaagccgcgtggatcgcttgagcccaggagttcgagaccaggctgggcaacatagtgaaacctatctctacaaaaatacaaaaattagctgggggtggtggcagcgcctgtagtccaaaccacttgggagcctgaggtgagaggatcacctgggcccgggagatcaaggctgcggtgagccatgatcttgccattgcactccagcctgagtgacagagagagactctgtctcaaaaataaaaaagttttgagtgtgaaaattcaagctcaattccatttgttggttgtcttgagtgtctgatcacatagaatataaagatgttttgatagttgggacagtattcagctacctgctatttaatacattatttcagaaaatatttacaaagggggctgggcacagtggctcatgcctgtaatcccagcactttgggaggccgaggtgggcggattacctgaggtcaggtgttcaaaaccagcctggccaaacatggtgaaaccacatctctactaaatatacaaaaaattagccgggcgtggtggtgtgtgcctgtagtcccagctactcaggaggctgaggcacgagaatcgcttgaacccgggaggcgtggggttgcagtgagccgagattgcacaactgcactccagcctgggtgacagagtgagactgcatctataaaaacaacaacaaaaaagaaaatatttgcaaaggaccttctgggtccaagaacctcatgtccaatacaagggtgcacacgtgggtgagacacggcagctgctctccagaagcccacagtggaggggtttcccttcggtctccttttattccaagcaagtggcaaaactactttactcttaatacaaaccacttccttttatcacaggacgcttcccaagctctgcaactgttgctcctgaggaagggagtggaactgataatctgttcctccctattgtgttcagtatggttttttttttttttttccttttgctggctttgttttcctgtccctgtgatgattaaaattcactctgcaaattagatcacctttcccacgcagagtccctttgacttctgttctagatatccattacatttttgtagtcttcggacacactgtgtgtgccgctttgccctctgggtgacagcaggctgtggctgcggcgacagagctgaggtgaattctcacagaccatcactgggttactcctggagtaagtaattcccaagagctccttctgtgcagatcgttagaaatagatattgaggccaggcgcggtggctcatgcctgtaatcccagcactttgggaggctgaggcgggcagatcacgaggtcaagagatcaagaccatcctggccaacatggtgaaaccttgtctctactaaaaatacaaaagtagccgggcgtggtggcgcacgcccgtagtcccagctactcaggaggctgaggcaggagaatcacttgaacccgtgaaacggaagttgcggtgagccgagatcacgccactgtactccagcctggtgacagagtgagactccatctcaaaaaaaagagaaagaaagaaatagacattgaacacctgctacacagcagggattgtgctagaagtatggatgcaaagattaggtgaatatgttccctagcctcacaaagcatacagtctagtaggagagacagacacgtaaaaagtttcaacagcacagataatcagggctacaccagaattgggcccaagatgctgcaggaatctataggtgaatgggtttcatgaaggaagagcttcttctcccatttataactcattttagcctaatcttccaaacagtcacgcatctaagagcaggtgatgcagaaaataccctcgtgttagttatgaattaccgttggaatccttccagtgtttgcacctgccctgtgctcgggtaacataaaacagtgatataatttgatgtctacttcctcttgtatttgtctgtttttaagtgttctacaattttcatatactctgtttcatcgttctcaaaggaatattttgattgataaatgtttagttagtaagacctaaaaactgaatctcagtagtttgagcttatgatatacaagatgcagctctaacatttaaattggaagggaaatgtcaaaaagatacctgcactcttgtttgttgcaacactgtttacaatagctaagatttggaagcaacctaagtgtccatcaccagacaaatagataaaggaaatgtgatatatatacacaatggagtactattcagccataaaaaagaatgagatcctgtcatttacaacaacatgggtggaactggagatcattatgttaagtgaaataatccaggcacagaaagacaaacttcacatgttctcacttatttgtgggctctaaaaatcaaatcacttgaactcagagagattagaaggatggttaccagaggctgggaagggtggtgaggggttgggggcagtgaagatggttaacaggtacaaaaaactagaaagaatgaataagacccactaggttttttgttgttttgttgttgttgttgttttgagacagagtctcactctgtcacccaggctggagtgcagtggcatgatctcggctcactgcaacctccacctcctgggttcaagcgatcctcctgcctcagcctcccaaatagctgggattatgggcacgcgccaccacacctggctaatgtttgtatttttagtagggaccgggtttcaccaggttgaacaggctggtctcaaactcctgacctcaagtgatccactcgccttggcctcccaaatgctcagattacaggcgtgagccaccgcacctggccactgtttgatagcataatagggcgactatagtcaataataacttaatggtatatttttaaataacttaaagagtataattggattgttgtaactgaaaggatcaatgcttgagggcacagctaccccattccccatgacgtgtttagttcacattacatgcctatgtcaaagcatctcatgtaccccataaatatatacactgagtatataccacaaatattttaaataatttttaaaataaaaaaataaattgtaagggaaagaaaattatgaatttagaaatgtaaaaggtctcaggtaaggaaggaatgagaggatcatgcagaacctcccatcattgctgggactggaacagaagccctaccttttcccaacaccctatccacctgtccctcacctctcagcttttgtgagactctgtctgtgctatgaaactgaagatctaattcagtgctgtttgcattgtcttgcctcctggaccagaggttgcagttgttgagaaaagggatggttggttatgccttgatcccccccagagcatttggggcataggacacgggaactggccagcctggttcactcttctcgattagctggacagcggcatgtcatgtgggtaataggaaggggtggggacttccccgggatattctgctcctgatcagaagcgccagtgatgtggggggagccccagcaccagagcatgctgggagggcgtgcagggtggggcaggtgcccgtttggcctctgctgtctatctgggggatgcatccaaaggcaactgttccttatctgctcttgttgggagcaaggaagggccaatttgttcaatgatccgtatacagccagtccctctggccagagttcaagacagtattgcctcactctatatagagattgtatcttggttagctcttcattcatagcaagaccaatgtttctgtaaattaatcctggtattgtttaaaagcaactaaaaatgatgaaattgtaaaactttgaaactccctgaatataacgacaagcaaactaacattgttttattggtcgatgctcctggccagaagagagaatattagcagggataaaaggcataggccacatgcattttccaccccagtgctgagaacacgatgggcgaaaaagggaggtggccacagcccatccatcacacagtctctgcccatctacttgctttttcctttttttttttttttttttttgtgacagagtctcgctttgtcacccagactggagggcagtggtgcaatctcagctcattgcaacttctacctcccaggttcaagcgattctcctgcctcagcctcccgagtagctgggattacaggcacctgccaccaagcccagctaatttgtttgtatttttagtagagacggggtttcaccatgttggccaggctggttttgaactcctgaccttaagtgatcagcccacctcagcctcccaaagtgctgggattacaggtgcgagccaccacgcctggccccagctacctgttttctttcttttttttttttttttttctttttttgagacaaagtcttgctcttgtcccccaggctggagtgcaattgcatgatctcagctcactgcaacctccacctcctgggttcaagcgattctcttgcctcagtctcctgagtagctgggattacaggcgcctaccaccacgcccggctaatttttgtatttttagtagagacggggtttcaccctgttggccaggctggtttcgaactcctgaccttaagtgatctgcccgcctcagcctcccaaagtgctgggattacaggtgtgagccaccatgcccggccccagctacttgctttctattgggatgaacctcatggttaatacagttagttagtgactgcaacttttgaactttttgttcatagtgaaaaatattttaagtaatgcttaccccattatgtttcttgtcatttgaaaaaaaatctcccttcagacagaatgcagaataaaatactacagaaaatctgtacagagtcccagcctgacttatgctagtaggttacagagaaagaaagtcttctaaaccctatgaaaggttaacagttctcttatttttccctgtgtgctatttgatgatttccctgtgaactttgatgatttattgccagaattccaaacataatatgtgaatttcacaaaaatggatgaaatgtatctatttttcattggtagaagaagccaaaacatcccttcctcaccgcactaaaagctgttgtttacatgaagcaaacctcaaatgtgaacatatttttacgcaaatgcatttaatgggtgaatatttgctttgggacggtattctttactctatctggagagtctggcgttccgtaatcaccatgtgatgacggctgccctgacagtggctggtagcagcacatacccccgagcctctccgtggtgtgcgccgtgggcaccatgtgaccattttcagaaaggaagacagttctggaagctaaaggtcacctagtcagcctcgttgggtgattgatgactcagctgggttcagggaggtggacccgaggcagagcctctagaaggcagcggtgggcagggcggttcaggcaggtggcacctgggcaaaggtgcagacgtggaatcctgaaagcaattctcagcgctgctgcgtttccaggaggtagaagaacagtgacaagtgcacagtcgggtagggacaaatgtggaagggctgggaacagtgtgttcaggagactgggcttcaatctggaggtctcaggaagtggtttaggatgtttcagcgagagcatgatacagactaacccaggaagaaccgctgctttgtcacttatacccctatggaaatgccgttcgctttgctagttgaaatagcctaccattgtctgggactcacccagttagatttgtttggactccacaaagtattcttgaccatacaatcatggtcgaggaccccctacatgagctgccttcatggctacagggagagcacaccaaagtggatgtcacacccagcacacatgccaccggcttggccctgcgccccgcagcctgagccacactggctgcctgttcctggaatgtgccaacatgtttcagtcctggagcctttgcacttggtgttctcttcgctggaacattctcccccaagacatttacacagcttgccccctcattccctgaggttatctcctgccccctaatcagtgaggccttccctggcctcaccccggacactccacacgtgcattcatttcgttgttcaccatctgtgtcccagttacaagggaggctccctgagagcagggatctgatttttgttagttgttgttgttgctgttttgaggtggagtcttgctttgtcgcccaggctggtgtgcagtggtgcgacctcagctcaccgcaacctccgcctcccatgttcaagcggttctcctgcctcaacctcctgagtagctgggattacaggtgcctgccaccatgcccagctaatttttgtatttttagtagagacagagtttcatcatgttggtcaagctgccctccaactcctgacctcgtgatctgcccacctgggcctcccaaagtgctgggattacaggcatgagccactgcacccgaccctgttttttgtttggttttggttttggtttggttttggtttttttttgagacacggtctcactctgtcgccccggctagagtgtggtggcaccatctcggctcactgcaacctccacctcccaggttcaagtgattctcctgcctcagcctcctgagtagctgggattacaggcacatgccaccacacccagctaatttttgtatttttagtagagatggggttttgccatgttggccagtctggtctcaaactcctgacctcaagtgatccgcccgcctcggcctcccaaagtgctgggattacaggtgtgagccactgtgcccggcccagggatctgtttttgtctccgctgtgtccccagcacctcaaacatattgtacggagctgcgacagctgcgcagtcagtgatgactgagagattcctggccccgtgggctatggctccttcaacagtttgttgtttaaaggttcttcactttctcagcgtgctgatcaagagacaagcctggaggagaggctcagtggtgctcctgtgtagatgatgaattcaggtgtatcttggatggtaaatgacgttgcatttaaaaccaagcaagtggccaggcgcagtggctcacacctgtgatcaaagcactttagaaggccgaggcgggcggatcacctgaagtcaggagtttgagaccagcctggccagcatggtaaaaacccgtctctactaataatacaaaaaaactagctgggcgtggtggcgggcacctgtaatcccaaccactcagaaggctgaggcaggagaattgcttgaacccgggaggtggaggttgcagtgagctgagatcgcaccactgtactccagcctgggcgacaagagcaagactctatctcaaaaataaaaaaaattaaaaattaaaatttaaaattaaaacaaacagccggacgcagtggctcactcctgtaatcgcagcactttgcgaggctgaggcgagcggaatacgagctcaggagatcgagaccaccctggctaacacagtgaaacccgtctctactaaaaaaaaaaaaatacaaaaaattagccaggcgtggtggcaggcgcctgtagtcccagctactcaggagactgaggcaggagaatggtgtgaacccgggaggcggagcttgcagtgagccgagattgtgcccctgcactccagcctgggcaacagactgagactctgtctcaaaaaaaaaaaaaaaaagaataaataaataaataataaaaaataaaaacaaacaagtgaacgttgttatacgtcagtcttaccaattgttcctctttcctcccagtagcttggagctcggcggcacaaccagcaccatctggtcgcgatggtggacacggaaagcccactctgccccctctccccactcgaggccggcgatctagagagcccgttatctgaagagttcctgcaagaaatgggaaacatccaagagatttcgcaatccatcggcgaggatagttctggaagctttggctttacggaataccagtatttaggaagctgtcctggctcagatggctcggtcatcacgggtaagtgtgccgtttcctagaaagttttatttagaaatgtttcttcctccaagaaaactgttctctcttttttttttttttttttttgagacggagtctcgctctgtcgcccaggctggagtgcaatggctcgatctcggctcactgcaggctccacctcctgggttcacaccattctcctgcctcagcctcccgagtagctgggactacaggtgcccgccaccacgcccagctaatttttgtatttttaatagagacggggtttcactgtgttagccaggatggtctccatctcctgacctcatgatctgcccgcctcggcctcctaaagtgctgggattataggcgtgagccaccgcgcccggccgaaaactgttctctttagctggaaaagaagtcacacttttttgcaaagaaagcttcagacgtggtaaagcatgacctccagtgcccctgggccctggaaggcgcgtgtcacggctcacggtgccccctcttgtgaaagccatgcacacatcaaacagtgcttgagattcagtcacggggaacagctaaagtacacagaccctaaccccagcaagcccgcggggggcagctagacatttttaagaggagacgtgtgcaagggtctgcatagaggtactgttggtaagagggaaggatgggaaacaagctgtacatgcgtcaaagggaaacagataaattgggatgcatttatacagtggtatatacttcatagcaatttaaaagaacagactaggctaggcgcggtggctcacgcctataatcccagcactttggaaggccgaggcaagtggatcacttgaggtcaggagcttgagaccagcctgaccaacatggtgaggccccatctatacaaaaaaaatttaaaattaaaaaaaattagccaggcatggtggtgcatgcatgtggtcctagctactcaggatgctgagggaggaggaccacttgagcccaggagctcgaggctgccatgagctatgactgccactgcactccagcctgggtgacagtgagaccctgtctttaaaaaaaaatttttttaagcaacattgaatgaaaataaacaagcttaatgaatatttttatgatccaattaatgtaaaatcttttattttttattttttgagacagagttttgctcttgttgcccaggctggagtgcagtggtatgatctcagcccactacaacgtccatcttccgagctcaagcagttctcctgcctcagcctccctagtagctaggattacaggcacccgtcaccatgccgggctaatttttgtatttttagtagagatggggtttcaccgtgttggccaggctggtctcaaactcctgacgtcaggtggtccgcctgcctcagcctcccaaagtgcagggatcacaggcatgagccactgcacccggcccaattaaaatctttaacactaaacaatctagtacatcactggtggaaacagacatacacctattgcaaagggcatctcagctttaaggactcagtcacctcctgagcaagatggagggagaactggggaggggtcccatggggactgtaattctctctaggttgtatatttttaaaagacttcagcagtgtgataaacctgggtggtgtgtacatgggtattacagtcatgttgcttaatgacagggacaggttgtgagaaatgcatccttaggtgatttcatcattgtgtgaaagtcatagagtacacttaaacccagatggtagagcctgctgcacaccgaggctctgcggtgcagcctgttgctccaaggcacgcacctgtacagcgtgttactgtactgaacggcgtaggcccctgtgacacaatggtaagtatttgtgcgtctaaacataccaaaacatatagtagaaaaggttacagcaaaaatacagtattatcatcttatgggaccatgataccacagttgaacttatggtctattgttgaccaaaatgtcactgtgcagtgtgtgactatacagaaataagctcagagaaattaagtaacttggctgggcgcagtggctcacgcctgtaatcccaacactttgggaggctgaggcaggcggatcacccgaggtcaggagttcaagaccagtctggccaacatggcaaaaccccatctctactaaagaatacaaaacattagctgggagtggtggcaggtgcctgtaatcccagctactctactcaggaggctgaggcagggagaattgcttgaacccaggaggcagaggttgcagtgagcagagatcatgccactgtactctagcttgggcgacagggtgagactccatctcaaaaaaaagttggggcgtggtggctcatgcctgtaatcccagcactttgggaggctgaggcgggcggatcacttgaggtcaggagttaaagaccagcctggtcaacatggtgaaaccccatctctactgaaaatacaaaaattagccaagcatggtggtacacacctgtaatgcctgggcaacagagcaagattccgtctcaaaaaaaaaaaaaaaaaaagtaagtaacctgccacggttcatacagccagaaagacacagagccgggcctggaccccgcctctcagcttgctctagagggctattctctgcatgctggcatgatcgcgccttgtaaaaggtggcagtgttctcagcttagtcaatcaggaattgcaagaggcaagtgagcccctgaggactctggggggcctttgtgaccgagcagctttgggagtgaccctgacagacctttacaggtggtgcaagttttgactccctttctcctggcgcgttaagcagaggataagcgctgtggaaggagtgaaggtgtagggagatcatggcccccagagcagtggggaaggggacagggaggctggaggagagcaaggaaaaggctccgtgtcaggtggcgccttgagtggcctgggtaggttgtcttgcagtgaacccgggttaatggccttgacaatgaccgcattgtttcctgagcactgcaggctgcccacacacctcacacctcggcttgcctaagcccagagcagccttgtgaggtcgttgttatgtttatttaaggaaggaggaaaggaggcaggtcccaggacatcctgacgtgctggagatcaccagcccagaacccagctcttaaccccacaatgtgggacctttcttcacccatcacagacacaccccatgctggttcaccgttttcctataatgactatttgtgctatttattagaaaaatcttttccttatggatttgaaaagatttatcttgcttttgtttttcttttttgcctttcttttttaaggcaggcaggctcccgcagccccacccccagggtgaaaaatatagttcattgtctagtaaaagagttcagagatacacttttttctttgggtaagatatactctagagcttgttctgaaatatggaatttgtgtgagctgcgggagtgggtgggtgtgtggctctagctctggaaagttctttcctggcagtggccaggagggctgcccagccccctcctgcctcctctggcagcttaaacacaggaccccttattctgtgctctctcctgacccctggtcctcatgcaggagggaaccctgctcttctagggtccttttctaaaagtagtgtcttttaggtcattgtcaagaactataatctaaaatgtatttttaactcatctggaaattctgacagaggtaaggcttgagaatttcctgcatactagccttgtggtctatataatccattaaaagccacatttaacccaattccacagactgaactgtgcttcccatctaaataaattaaaagcaggccgggcacggtggtcacgtgtgtaatcccagcactttgggaggtcgaggcgggtggatcacctgaggtcaggagttcgagaccaacctggccaacatggtggaacctcatctctactaaaaataaaaaaaattagctgggcgtggaggcgtgcacctcttaagcttaaggacatatttcttatgatccaattaatgtaaaatattttattttttatttattttttgagacagagtttcactcttgctgcccaggctggagtgcagtggtgcgatcttggcctgtaatcccggctactcaggaggctgaggcaggacagtcgcttgaatccaggaggcggaggttgcagtgagccaagatcacaccactgcactccagcctgggcaacagagtgagactctgtctttaaataaataaataaataaatagcgagggttcagggcaggagaaaaagggttccaaatttgttctgaaccaattccaaggaactttatggcacaaagaaaaaaaaggggaacttacaaaaagtgaccacactgaagcgtcctggtcacccatccctggttttgaccaccagcctttaaagtggcaagcgggtgataacccatttcttatttccccctcagcatttcctcactgttattcatacatgtggtcatttgtactcatctcacaattgttaaaacctctttcctcccttccaggttttactgaactgttactgcgaagtctgagagatgaggtcatttaagattatttcttatttgtaaattagatcgttcatatttgtacctaatctgatcttttgggtaatattcctagttatgtagactggtctctcagaagagccggatattaaatgcagtactttaaactttacacccaggagaccggatgggtgaggctggttcactcggccaaagtaccattttatctctgctttttcttcccggctttattgccataattgacatacaataaactgcatgtatttaaagtgtacaatctgttgggtgtacacacacacgcatctgtgaaaccatcatcacactcaaaatagtgatgtagaaattttgctccttagttcgactaaatctgggttcttgtgtcatgaccaggaaaaattaggcacgtggacacgttgaagggtgaggagagcagtattgggcgaaaaggaaaaaagaaaaaaactctcagcaaagctagaggggatcctgccaatgagttcccagctcacagactgattagcaggccaccacacatgagctggaggccaggctcctcccgctgcgcaaggtgagaacttcccgtggctccaccccattctcccaatgcccaggtgggtccccgtcccttgcgggcctgtccagacaagggaaccctgggcaggttccctcatctacacaaaagcacctgaggtaaacacttgtggggcaggttgcagattctctggggacgccccccttctctgcctcctgcatctatcagtagtgcctctgtctgtcacccctaaagtttacttgtgctgtttctaattcctctttccccagccccgtgcctccctgcctccctcccccagtaaaccatgaatccactttctatcattctaggttgctttatatttcctagaattttatataaatggaatcatacagcacgtactctttctaggctggcttctttcactctgcagaatggctgtgagactcatctgcattgcagcaagcatcaatagttcattcttcatccatcatgtggacatagcacagtttgctgattcacgcacctgttgatgagcatttaggttgtttctagcttatggctattacaaataaagctgctatgaacattcacgtacaagtctctgtacaaccctctgctttcatttcttttgaataaatacctaggagtatgacggctggaacagatggcaggtgtttgtgtaactttttaagaaactgccaaaatcttttccagcatttcagaaaaatcttagaaaatgctatactatgttatattcccactggcagtatatgggggagttccagttcctccataccctcatcaacatgaggcatgatcagtctttttaattttaaccatgtcagtaggtgtgtgatggtctctcactgtggtgatttttatttgcacttccctggtgattttgagcatcttttcgtatgcttatttgccatatatcttctttggtgatatttctgttcaaagcctttgctcattttttaattgagttgcttttctactattcactattgaacactatttatatattttgaatacaaatactttatcagacatgtgatctacaaatattttccccagtgtgtggtttgtctttcttttctttctactgatagtatcttaaaaaaaaaaaagaaaaaagattgttttgtttgttttgttttgtttttgagatagggtctcaatctattgcccaggctagagtgcagtggtgcgatcatggcttactgcagccttgacctcttgggctcaggaaaccctccgacctcagcctcccaagtagctgggaccacaggtgtgtaccaccatgcttggctaattttttttttttagatacagagactcgttatgttgccaggggtggtcttgaactcctggactcaagcgaccctcccacttcggcctcccaaagtgctgggattacaggtgtgagccatcatgcccgaccagttcttaattttgatgaagtccaatttatcaatgtcctttttttatggatacttcatttatttatttatttgagagagggtctcaccctgagcccaggctggagttcagtggcatgatctcagctcactgcagcctcaacctcccaggcccaggtaatcctcctacttcagcctcccaagtagctgagactacaggtacctgccaccatgcccgggtaagttttttgtatttatttgtagagacggggtttcgccatgttgcccaggttggtctcaaactcctgggctcaagtgatctgcccatctcagcctcccaaagtgttgggattacaggcgtgagccaccatgcccagccatatatatatatatatatatatatatatatatatattttttttttttttttttttttttttttttgagacagagtctcactctgttgcccaggctggagtgcagtggtgcaatcttagctcactgcaacctccttctctgaggttcaagtaattctcatgcctcagcctctttagtagctgggattacaggcatgtgctaccaggcccggctaattaccagccttatatttttgaactctgtttaaaacatttaggtgcataaacattcaggcttgttatattctgttgatgaactgaaccttttattattatgaaattgctgttgtaatccgtggtaaaattatttgttctgaacactactttgtctgttattgatgtagccactgcagctttcttttgattggtgttaacatggtatatcttttcccattctttttcttttaactggtttgtgtctttatactatggtttgatttaaatctattatctcacaatttgttctctttggtacatctttgttttgttcccttttcctctttttatgccttctgttgaattaattgagtcttttttgttttgtttcatttaattttgttttttgagacggagtctctctctgtctccaggctggagtgcaatggcgctatctcggctcactgcaacctctgcctcctgggttcaagcaattctcctgcctcatcctcctgagtagctaggatcagaggcatgcaccaccacgcccggctaatttgtgtgtgtgtgtgtgtgtgtatttttactagagacgggtttcactatgttggtcaggctggtctcaaactcgtgaccttgtgatctgcctgccttggcctcccaaaatgctgggattataggcgtgagccaccgcacccagcctaattgagtcatttttaagattccactttatctcctttgttggcttattatttataacaccttctggtgttattttagtagttgctttagggtttatagtgtatctctctaatgtctcccagtctaccttccagtggtatcattctatcttacagatattataagaactttatgacagtatactttcatttttcccttcatgcatttgtggtaatgtttcacataattttatttatttacctacattataaatattacaatatgttattgttttacatagacagccggttatctttttaagatagtagtaagaaaaattttttacatttacccacataattaccttttctagtgctatatacctttgtataaatccagatttccatctgctatcattttccttctgcctgaaagacttcctgtgatattatctataatatggctctactggtaacgaattactagcttttgtatgtctgaaaaagtcttcatataaccttcattctagaaagtatgtgattcaaagggccgggcacagtggttcacgcctgtaatccgagcactttgggaggccgaggcgggtggatcacctgaggtcaggagttcaagaccagcctgaccaataaggtgaaaccctgtctttactaaaaatacaaaaattagctgggcatggtggctcatgcctatagtccctgctacttgggaggctgagacaggagaattgcttgaacccaggaggcagaggttgcagtgagccaagatcacgccactgcacaccagcctgggtgacagagcaagactccatccccctgcaaaaaaaaagaaaaagaaaaagaaaaaagtatgtgattctacattggcaattttttttttttttttttttttgagacagagtctcgctctatcacccaggctggagggcggtggtgccatcttggctcactgcacgctccgcctcccaggttcacaccattctcctgccccagcctcccaagtagctgagattacaggcacccaccaccacacccggctaatttttttgtattttttagtagagatggggtttcaccatgttagccaggatggtctcaatctcctgacctcatgatccgcccacctcggcctcccaaagtgctgggattacaggcatgagccaccgagcctggccactttttttctttaaatgcttttaagatgttcctactatcttcttgtttttaattaattaatttattattattattattattattattattattatttttttttttttttttttttttagagacagggtcttgcgctgatgccgaggctggagtgtgctagtgccatcgtagctcactgcagtctcaaacacctggtctcaagcaatcgtcctgcctcagcctcctgaggaactaggactagaggtatatactaccatgcccagccaattttaaaaattttttgtagaggtggagactcgctatgttgaccaggctcctctcgaactcctggcctcaagcaatcctcctacctctgcctcccgaagtgttgggattacagggattacaagtgtgagccactgtgccagtccccactgtcttctggcttgcatcgtttctaaaagaaacttggtgtcatccttatttttgtttctctacatgttatatgtcctctttatctggttgctttaactttatttattaattttagtttaatttttaattgacaaataataattgtatttttatggggcacaatgtgatgttttggtctatgtttacattgtggaatgtgtaaatcaagctagtgaacatatccaccacctcacacacttaccattttttgtgtgtggtgagaacatgtaaaggctgctccttgaggccaggcccaatcccagcactttgggaggccgaggcgagtggatcacttgaggtcaggagttcaagactagcctggccaacatggtgaaaccccgtccctactaaaaacacaaaaatcagccaggcgcggtggtacacgcctatagtcctagctacttgggaggctgaggcaggagaatcacttgaacccaagaggcagaggctgcagtgagccaagatcatgctactgcactccagcctgggcaacagagcaagactccatctcaaaaaaaaaaaaaaaaagtctattccttgagcaattttgaaatacacaatacatcattgttaattatggtcaccatagtgggtagtagatcactaaatcttattcttcctgtctaactaaaacttttttccttttgaccaacatctccccattccctccctcaacctcagcccctgataaccaccattccactctctactgctatgagtttgacctttttagatttcacatatgagatcacatggtatttgtctttctgtgcctggcttcttttacttagcataataccttccagatttacccatgttgttgcaaatggaatttccttcttttttaaggctgaatagtattcgtgtgtgtgtgtgtgtgcgtgtgtgtgtgtgtgtgtatcacattttctttatctcttcgttcattaatgatcatttaggatgattccacatcaggctactgtgtatagtgctgcagtaaacatggaagtgtagacatctcttcagcatactgcttccaatctctttggatataaacccagaagtgggattgctggatcatatgtagtgctatttttgtttttttgaggaacctccatacttattttgcataatgctattctaattcacaatactaccaacagtggacatgggttcttttttctctacatgcttgccaaccacttgttatcttttatctttttatatatctggctgcttctaaatttttttctttcttaccaattctgaaccatttgatggtttcttcctttatgctccttgtgcttgaggttcattgagcatctgggatcagtgcacttattgttttcatcaaattcagaagattaggccattatttcttcaaacttttttgtcgttctctgtctacctttgagagctccaattatacatacattaggccacttgaagttgtcattacagttcactaatgctaagttctttttttaagtcttgtttctgtgtttcattttggacactttctattgctacatcttcaaatttactaattttttcttctgcaatatctaatctgctcctaatcctatccagtgtattttccatattagatattgtagttttcataactagaagcatgatttggttctgttttcacccatgtatctatataacatgtccagtctttcactcagcttcttaaacatttagaatatggtcagaataactttttttgctgttttgttttagagacagggtctcactttgttactcaggctggagcgcagtggcatgatcacagctcactgcagccccaacctcctcgtctcaaggaatcctcccacctcagcctcctatgtagctgggaccacaggtacacaccaccacacctggctaatttttaaattttttgaagagacgggtctcactttgttgcccagactggtctcaaactcctgggttcaaacaatcctccagccttggcctcccaacgtgttgggattacaggcatgagccactgtacccagcccagaataactttttaaaaatgtcttgaggccgaggttgggaaataatctgaggtcgggagttcgagaccagcctgaccaacatggagaaaccccgtctctacaaaaaatacaaaattagccaggcacagtggcacatgcctgtaatcccagctacttgggaggctgaggcaggagaattgcttgaacccgggaggcagaggttgtggtgagccgagatcacaccattggactccagcctgggcaacaagagcgaaactccatctcaaaaaaaaaaaaaaaaaaaactcttagccacaatttctatcatctgtgtcacttctgagtccctttctattcagttatttttctccttgtcatgggtcatatttttctgattcttcatgtgtcctgtaattttcttttctttttttttttggagatggagtcttactctctcacccaggctgtagtgcgatggcacaatcttggctcactgcaacctccacctcctgggttcaagtgattctcctgcctcagcctcccaggtagctgggattacaggtgctcaccaccatgcccagataattttttgtatttttagcagagacggggtttcaccatgatggccaagctggttttgaactcttgacctcaagtgatccgcccacctcggcctcccaaagtgctaggattacaggcatgagccaccgtgcctggccagttgttctcattggatgtcatatgttgggaactttattgggtgatggatatttttgatttcctataaatattcttgaactttgttctgggatgcaattaagttacttggaaaatctttgatcctttcaggtcctgtttctcagcttcattagatgggactatcacagtgtttgttttagagataactttgccccactgctgaggcaaaaccactttgagcttcacctgatgccccatgacttcagtgatcttccactgtgggaggcgagagcaggactatatccagctccatgtgggccccaggcagcgttcactatcatcatttcaggttgctactgaagtatccctttttcaggctctcagctggcagagcaaatacatatatgtatacatactaacctatgtctatacaggaatctatcggtatttctgtctgtggccatctgtagctgtatgaagccaaacatgagtgtgtgctgatgtctccagccctcatctgttaccagatggatcgttctagcctcctccacttgcctacctgtcaattcaccattccttgagttcatggttcattttcagtatacctgcacagtggtatcagaactgttaacccacaccctgtgggaaaaaaactccatcagctagagcacagtgtttacagccagatccttttgcctttagtcttacagattccaatcattccaaattattcggtgcagcgcctttccgcacctgcacccactttttcccctgagattgtttcctacattcgtagcacagttagattgttttgttacattctgcatttcaccctgggatcctccaacctcctaagttatttttgttttatttgcacacattaggttcaatctgaactataaagttctgtgggttttcacaaatgcgtagtgtcatgtatccaccactacattttccttctctctctttcttgctttctcgccttcttgtctcgctctgtcacccaggctggagtgcagtggcacaatctcggctcactacaacctccgtctcctgggttcaagccattctgctgcctcagcttcccgagtagctgggactacaggcacgcaccaccacccctggctaactttttgtatttttacaaaatacaaaagacgatgtttcactatgtgggccaggctggtctcgaactcctgaccttgtgatccacctacctcggcctcccaaagtgttgggattacaggcgtgagccaccacacccggtctctctccttcctttcctttcctctcctttccttttctttctttctctttccctctcctctcttctcctctcctctcctttgatggaggtctcactgtgacacccaggctggagtacagtggcagcataatctcagctcactgtagcctcagcctcccagggctcaggtgatcctcccacctcagcctcccaagtagctgggattacaggtgcacaccgctgagcccagcaaatttttgtattttttgtaaagatagggtttcaccatgttgcccaggctggtctcaaactcctgagctcaagttatctgccagcctcggcctcccaaagtgctgggatgacaggcatgagctaccgtgcccagaccactgttagattttcatatgaatagtttcaccacatcaaaaaaccccatgcttcacctattcaaccctgcctctcccacccccagccagctcagaaatggttctttttaccattgctataattttgccttttccagaacgccatgaatttgaaatcatatagtatgtagccttttcagactgacttctttcatagcaatatgcatttaagagtcatccatgtctttccatggcttgatatctcatttctttttacactgaatgagttcccactgtctgtttgtaccacagtttgtatatctattcacctatctaagggcatcttggttgcttccaatttttggcaattaataaagctggccatgcacagtggctcacacctgtaatcccagcattttgggaggccaaggcgggcagatcacttgaggtcaggagtttgagaccagcctggccaacatggtgaaacgctgtctctactaaaaatacaaaaattagccgggcgtggtaatgggcacctgtaatcccagctacttggaaggctgaggcaggagaatcacttgaacctggaggcagaggttgcagtgagctgagatcgtgccactccactccagcctgggtgacagagtgagactctgtcccaaaaagaaaaagaataaactgctgtatacatgtgtaggttttgtgtggacagaagttttcaaatcagttggacaaatacctaagagtgtgattccatcatacagtaaaactgctttgctttgtcagaaactgccagaatgtcctccaagggggctgtctcatgttgcattcccaccagcaatgaatgggggttcctgttgctccacatcctcaccagatttgatgatgtcagttttgtggattttagtcatcctagtaggtgtgtggtgacaccacattgttgttctcattctcagtgccccgatgacatatcatgctgagcattgtttcatatgcttacttgccatctgtatatcgtccttgctgaagtgactgttcagatgttcagatcttttgcccattttctttctttttttttttttttttccttttgatacggagtcttgctctgtcgccaggctggagtgcagtggcacaatctcagctcactacaacctttgcctcccgggtccaagcgattcccctgcctcagcctcccaagtagctgggactacaggcacgcaccaccatggcaagctaactttttcttttttttttcttttcttttttttttgagatgaagtctcgctctgtcacccaggctggagtgcattggtgcgatcttggctcactgcaagctccgcctcctgggttcacgccattctcctgcctcagcctcccgagtagctgggactacaggcgcccccaccacgcccggctaatttttttgtgtttttagtagagacggagtttcaccgtgttagccaggatggtcttgatgtcctgacctcgtgatccgcttgctccggcctcccaaagtgctgggattacaggcgtgagccaccacgcctagcccccatttttcaattgagttgtttgttttaagacctctttgtatattaccacatgtgtattgaaaatattttctcccagtctgtggcttgtctttaattttcttagcaatgtcttttgcagagcagaaggtttcattagctttcatagattccaacttatattttctctttcatggattgtgcatttggtgttgcccacacagatttttatactgtattctggtgccatttactgagttaacaattgcggaagaactggaagaaaggaagcaaacaaaacgagttctgcgtggcactgtcagtgcgggggcatggggagtcctgcagggtgaggtatgggcggtatggcaaggcgcgggcccatagatgtgcaggtctggagatgtgtgcagcggagatgtgcgggcccgagatgtgcgggtccgatgtgtgggtccggagatgtgcgcgtacccagaggtgcagatcggaaatgtgggggtccggaggaaatgtgcggatcaggagaagtgccagtcccgagatgtgcggatcggagatgtggagggctaggagatgcgtgggtccggagatgcgcagatcaggagatgggcgaatcggagatgcgcgggtccggaaatgtgcagagcggagatgtgtggatcaggagatgttggggggtcaggagatgcgggggtccagagatgtgggggtccggagatgtgcgggtctggagatgtgcagagcagagcaaagatgagctgatcggagatgcccaggtccggggatccacgggtccggagacgcgcgggtccggagatgcgtgggtccagagatgtgcgggtccaaagatgtgcaaatctgaagatgtgtggatgggagatgtgcaggtccggagatgcgcggggcggagatgtgtggatcggagatgctcagatcgaagatgtgggaatgaggagatgtgcggggcgggatgtgtggatgggagacgcgcgggcccggagatatgcggggcggagatgtgcgggtccagggatgtgtgatctgaggtgtgtgggtccggagctcggggtcagctcagcagcagtgagagcgagcatgctggctttgggagcacagcacaatggcagctgtaggagtgcaagagggtgtgacccagaggcagggcccggccccgcatgggtgttctgaggtttatgcctcagcactagaagcctcgtatgcgaaatcacatcctcatagacccggttcagacacaggatagtgatgcctggactattcatccgtctctcctctttttccccagacacgctttcaccagcttcgagcccctcctcggtgacttatcctgtggtccccggcagcgtggacgagtctcccagtggagcattgaacatcgaatgtagaatctgcggggacaaggcctcaggctatcattacggagtccacgcgtgtgaaggctgcaaggtagaggggagctggaacagggcctggtggccgccaccatcaactacttatggtcacttttatagcaaatggcagtcattactgagagattgcagaaagtcccggataagaaactgacttcaggccaggcgcggtatctcatgcctataattccagcactttgggagaccgagatgggtggatcacctgagatcaggagttcgagaccagcctggccaacatgatgaaaccctgtctctactaaaaataccaaaaaaaattagccaggcgtggtggtgggcgcctgtaagcccagctactcgagaggcaaagacaggagaattgcttgaacccaggagccagaggttgcagtgagccaagattgcgccactgcactccagcctgggcaacaagagtgagactccatcttaaaaaaaaagaaagaaaaaaagaaaaagaaaaagaaactgacctcagtgatagattagcctctctttatagcacagaacccctgagagcgtaagccctgttgtgaactgcgtatttgaggaatctagcttgtacgccccttatgagaatctaatacttgatgttccaaggtggaacactttcatcctgaaactatccctccccacccccatctgtggaaaaattgtcttccatgaaaccggtccctggtggcaaaaaggttggggattgctgctttagagagtctaggacaaatggttcctctgtgctttgtaaatacttagagaagtgcattctttaaaagaaaataagtcacattggaccgggtgcagtggctcacgcctataatctcagcactttgggaggccgaggcggctggatcacctgaggtcaggagttcaagaccagcctggccaacatggtgaaaccctgtctctactaaaaatacaaaaattagccaggtgtggtggtgggtgcctgtaatcccagctacttgggaggctgaagcaggagaattgcttgaactcaggaggcggaggttgcagtgagctgagatcgagccatttcactccagcctaggcgacaagagtaaaacttcatctcaaaaaaaaaaaaaagagagaaaagaaaataagccacattaagaacatcacttcattcgaatacaagacagagagctgttaccgttgatctctggagcctccctgaaggccaggtggggcaggtgttctcatgctcctgccagggaaattggccatcagagacacagagtatcttgcttagggtcccacagcccccagcagcagggactggaaccagagactggctgctcctgctccccagcagttccttcctgcacatcaggggcttctccacctgattcaagcgacaggaaccccctgtgcatcttcatcctcctgctggctcagcctgccctaaacagatgtgacctgggccaggagtgcatgaaggcaggccctgttgtcctgcatgctgccagctggactggtggcccttccgtgtttgtcagcgtggtgatgaggagagctcctgtagcagcgtccctttagggttgcacagacgtgctcaagtctggcgccttatgtacgtgatatgtgggagatcatcatctgaatgtttggtttgaatcagaaatcccttctcacggtgcacgctgcaggtgttcactaacttggaaaatgccaccgcctttctggcacaatgtaccatcttggaacaccagcattctgccctgagccaggcctggcctcagaggcctgggccacagggagaacctcacagccaggacactgtggcactctgctgtctagaagcctgtctccccacccttcccattctaaccccatgcgttcctcagcctccccactgtgcaagcctaggtaaggacattatgaagacgtcagcctgcctctcacattcccctgcacactgctgtccctctcccgcgggccaagcagacccactgtggcaaaaatatagaagaatgacttaaaagcaaagagaaaaaagaacccaaagcaaaaatgaactccttcgcatgttttctaaccatatacctttgaaaaagctccttataaagtggccttttccttagggccatgattaattattcatttagttttgttttttatggactatttagtaacattgtttcttgctgggtagagtttaagatgcttttacaaagcaagaaaattgtttacaaacagctggcttccttttattataatttttgtctttgagggagttaatatactcttacaaaaattcttagaaagtctttagtcacaaatatggaaatgtcacaatgctggggatagttacattcatatacattgtaacaaggctgagtaactctttggaaaactataattgtgttttcccaagtcagatgagggcattttgaaatgacttcgaatgctgcctcattttattgtttttcacattaaatgtaacgacatttaaagttctgtatttgtcctaatcattccagacttcttagaagaactatttctttctttttttttttttttttttttttttttttgagatggagtctcactctgtcgcgcaggctggagtgcagtggcacaatctcagctcactgcaacctccgcctcctgggttcaagtgattgtcctacctcagcctcctgagtagctgggactacagacttacatcaccatgcccggctaatttttgtatttttagtagagacagggttgcaccatgttggctaggctggtctcgaactcctgacctcaggtgatccacccgcctcagcctcctaaagtgctgggattacaggcatgatcaccatgcctggcctggaataacttttctctaaattttgttcatttaaaaagaaacaataaatgagcaacaaaaaaggtgagtaaagcaagtgcgctggtttctcagtggcccaggtctttaaatccactgtgtattaccctcacagggcttctttcggcgaacgattcgactcaagctggtgtatgacaagtgcgaccgcagctgcaagatccagaaaaagaacagaaacaaatgccagtattgtcgatttcacaagtgcctttctgtcgggatgtcacacaacggtaggtaaggtggccctgcacattttcccagttcgttcctcagttccccttccttgctccaagggaacagatcaagctatggatgaatgtgcttcaacatttcacacccaagtcattttgtaatcagagtggcctaagaaaataaaagtcgcccaggcgcggtggttcacgcctgtaatcccagcactttgggaggctgaggtgggtggatcacctcaggtcaggagtttgagaccagcctggccaatatggtgaaaccccgtctctactaagaatgcaaaaattagctgggtgtggtggcacatgcctgtagtcccagctactcgggaggctgaggcagaagaatcgcttgaacccgggaggcggaggttgcagtgagctgagattgcgccactgcactccagcctgggcgacagagggagattccgtctcacaaaaaaaaaaaaaagaaaaagaaagaaagaaagaaaataaaagtctcccaggtgcggtggttcacacctgtaatcccagcactttggaggccgaggcgggtggatcacttgaggtcaggagtttgagaccagcctggcgaacatggcaaaaccccgtctctaataaaaatacaaaaattagctgggcatggtagtgcacacctgtaatcccagctacttgggaggatgagacaggagaatagcttgaacccgggaggcggaggttgcagtgagctgagatcgcaccactgcactccagcctgggcgacagagtgcgactccgtctcaaaaaaaaagaaaaaaaaagaaaaagtctcaaatagctgagattcagtggtgcattggactcgctgttagaaacttcagtggtaagactttgatacagaatcgaaaaaccaagtggaaggcaccaaaatgacagaatgttcacctcgtccataggaagggtgtaccacctcaaacatctcaccacgttatgaatttccttctagccaatcatttaatagtttcagaacatgctaattgtgatgtgaatgtaagtcgttcataagagttgcatgtctaccttctggaaaaagaagcagttattatataaactcatcccgaagccccgttcacctccttcactcaaaggttgatgatgcacctgatagtggtgtgcaccctactaatgagacgaacgatggtgtcaccttcagcctgcacctgttaacgatggtgtcaccttcagcctgcacctgtttaaacatctacagtgtatggagtttgagtttttcatctctccatagtggaaagccgaatagtaatgaaggatgggtctgaactgcctgtgaattttcattcctggtttaaagtcctgggggagcccctcgtccagccctgtccgcgcagtcatgacctcactgctcatgcctgtgtttccccctccaaaccctagcgattcgttttggacgaatgccaagatctgagaaagcaaaactgaaagcagaaattcttacctgtgaacatgacatagaagattctgaaactgcagatctcaaatctctggccaagagaatctacgaggcctacttgaagaacttcaacatgaacaaggtcaaagcccgggtcatcctctcaggaaaggccagtaacaatccagtaggtgtttgcggctgttctgggttctcttggcaacatggaaccagtgtcgtagaggacgattaaggacacatgtgttgaatgttgagaaaattatatttatcccacagttaagcaaaggacagcgaagatggaaacagttcattctgagactctgagctgtagcttaacaacaactcctttcttcttgcttggagccacctcaaagctcttagcaactaagttattatactggctatgtaattaatacacttaaaaaaaaccttaatagcttaccaagtactaagatgatttcttaggagcattttttcttaaatagagataggttcttgctctgttgcccaggctggaatgcagtggtgcaatcatagttcactgcagccttgaactcctgggctcaagcaatcctcctgcctcagcctcccaaggagctgggactacaggtgtgcaccaccacacctggctatgtttgatgttgttgttgttttgttttgtttttgttttttggtagagatgagatgtttcccaggctggtctcaaactcctggcctcaagtgatcttcccacctcggcctcccaaagcactggcattacaggtgtgagtcatggcacccagcattaactggatttaaaaaaaaaaaaactgaccaggcaagatgggtcatgcctgtaatcctggcactctggggaggccaaggtgggcagattgcttgagtccaggagtttgataccagcctggccaacatggagaaaccccaactctactaaagatacaaaaattagctgagcagggtggcacacacctgtaattccagctacttgggtggcttaggcatgagaattgcttcaacccgggaggcagaggttacagcaagctgagatcatgccactgcactccagcctgggtgacagatcgagaccctatctcaaaaaaaaaatagaataataaaataaatccctactttgaggtgtattagtctgctataaagaaatccctgagacctggtaatttataaagaaaagaggtttaattggctcgtggcccacaaggctgtacaggaagcttctgcttctggggaggcctcagggaatttgactcatagcagaaggtgaagtgggagtaggcgtcttgcatggcaggagcaaaaacaagagacacacacttttcacccatcagatcttgtgagaacgctatcactagagtagcaccaagaggatggtgctaaaccattcatgaaggatcacccccatgatccagtccctcccgccaggcctcacctccaccactggggattacagttcaccatgagatttgggtggggacacagagccaaaccatatcataaggctagaaaaggaaaccacttacttcccactcaaaatgtgctcttggtcctttctcctaaaactactccctccctctcagacaaacatgcctacattctttttccgccttcagtgaaaagacagtgacatcttggggcttagaaagggccacttgtaagccaggcgtggtggctcacgcctgtcatcccagcactttgggaggccaagacaggcggatcacgaggtcaggagatcaagaccatcctggctaacatggtgaaacaccatctccactaaaaatacaaaaaattagccgggcgtggtggcgggcgcctgtagtctcagctacttgggaagctgaggcaggagaatggcgtgaacccaggaggcagagcttgcagtgagccgagatcgtgccactgcacttccagcctgggcgacaaagccagctgtgtctgggcgcggtggctcatgtctgtaatcccagcactttgggaggctgaggtgggtggatcacttgaggtcaggagtttgagaccaccctggccaacatggtgaaaccccatctctattaaaaatacaaaaaattagctgggcatggtagcggttgcctgtaatcccagctacttgggaggctgaggcaggagaattgcttgaacctgggagctggaggttgcagtgagctgagatcgcaccactgcactccagcttgggcaacagagtgagactctgtctcaaaaaaaaaaagaaaggaaaagaaaggaccacttgttatagaaagcctgtcttttaaggtagctctggaccttttcagaggcagccaaattgcccctcatggttcgtcccccacatccccgcctgcctggcctaagtcctccttccccctccccaacagttaaataagtctttgtctccattacaaaacaaatctcagagctaccttcaaagaagagccagccctcagttggtgaatgaagatactttgacattttcctatgagcatggtgaaacaggtttaatttgtattaaatagcttgaagcaatccttattgggaattacaaggtggaattttagtcacaggaaaataaagcatttcacaagctacttactttcatgaacaaaccaaacctcttctttactgagtcctttaattcttcagtgaattctccaattaaataggccgagacattttagaagtttccagcagacacccacactaggcagctccagaggcttgtcccaattagaactttcctggattacgagagtgaaagaaaaggtaacttttagcttcgagtctctatcctggatatgattagtacagcccaaaattgggatggctaaaacttttgtttgccagcttatatttctcccttggatttcagaattgaaagcaggctgggcacagtggctcacactgtaatcccagcactttgggaggctgaggcgggaggatcacttgaggcaatccaagagtttgagaccaggcaacacaaggagacctcgtctctacaaaaaatgattttttaaaaaactagctgggcatggtggcatgtgcctgtggtcccaggtacttgggaagctgagatgggaggatggcttgagcccaggagttcaaaaccaacctgggcaacatggcaagaccacatctctacaaaaaataaaaacattatccaggcatggtggcacatgcctatagtccccgcgacttgggaggttgaggaggatgccttgaggccaggagttcaaggctgcagcgagccacgatcgcgccactgcactccagcctaggcgacaaagcgagactctctaaaaaaaattcgaagcagagttaagttgtctttcttcctaacaacctgcccccaccatggggtgcgaatgggactcctggagtcctcctgcacctccccttggagaccaccaagctctaggaaccccatcaccctcagctgagggtcacatgcagcaactagcaggcgggaatctgtttgcattttggccttaaagaaataaataataggccaggcgcggtggctcatgcctgtaatcccagcactttgggaggctgaggcaggtggatcacctgaggtcaggagttggagaccagcctgaccaatatggtgaaaccccgtctctactaaaaatacaaaaattagctaggcatggtcgtgggcacctgtaatcccaactacccaggaggctgaggcaggagaattgcttgaacctggaaggcagaggttgcagtgagccgagatcacaccactgcactccagcctgggtgacagagcgagactccatctcaaaaaaaaaaaaaaaagagggccaggcgtggttgctcatgcttatgcctgtaatcccagcactgtgggaggcagaggagggcggattacctgagctcaggagttcgagaccagcctgggcaacatggtaaaaccccatctctactaaaatacaaaaaattagccgggcatggcagtgtgcgcctgtagtcccatctattcgggaggctgaggcaggagaatggcgtgaacctgggaggtggaggttgcagggagccgagatcacaccggtgcactccagcctgggtgacagagtgagactccatctcaaaaaaaaaaaaaaagaaagaaatgatagatgaatagtttaggattggggttcacaatttggttttctgtagaaaaagagaaccgggcactcttccgagagtcagatgccctcttccacccacacccacaaagccagagcaccgcaggtaccagttttcaaggcaacctccaaccatcatgtgactctttgtgtttgatcacactgtttgctccaagccagggttgcgtcccaccccatgtccttgtctgcgcacgggacgctggaggcacggccccctcctccctgcctagcctgctgacgggctttccagagctggctccttcaggtgcaggataccctctctgcttagtctgggaaaaggccccgttggcaggatgcccaccaccaggccacactgcctgaatctattggcagagctctggttttgtggccaaggtgggtagtggaagaccatagcctgtgtcccttacacatctcagaaagcaaccccatctgtgggcaagaaatctgttagggagaccaagcagcggcctggaaacaccttgatctctgcccagtggcccacatgcggtcgccgtttcatcagtttccagcctgggtgacctcacagccccagccacgccccacagagcctcaggaaggcacactgacctcagggccggcggctgacttcatttctgtttggggatgagaggcggcacagtaaactgtccaggccagtaaactaatggattcatacgaaccgtaatgaacgtgggctgtgtgctggggaaggcaggctcgcctcctccctgcaggggctgctggggtgaaagcaaccctgaaatgttcaaagccttgatggggaagcacgggggatggatagattttaatttcaaagcagccctctggtttgctataagcgggggactgaatttctctttgcagtggccaatgcctttcttctgtcaagatcagctcgtggccttcagatcagatgacgcaaagccccatggctgagctggaacaggctagaatgctggggggggcctgaaaccggtgggggagttgtgggaggcctagaatcagccaggaggcttgggtcggggttggaaccggccagggtgcacggaggaggctgtgggggcagggggaggccgctgcatggagccgcatagatgccattgcttgaggaaaggtgggctttagctgagggaaggagtgaggggtggatggagaatgtctgtgtccatctggacactgggactgtttgagcccctgagatttcagaaccgtgggccagaaaatggtcagggcccttggtgatggggaagggcgcctctggggaactcactgccccttgatttgagggtaacagggatggaagcagagtcagggggctgagggaggcaataaaaatgggtgcttttcaacagtgtctaaaaacataagatgttgacctgtcaggggttgagaatgtcgtcagaagactttggaggaagcaacagaaaatgagactgaggggcttgggcagagtcagtgccttctgtgtgatgcacgctcatgcacaaatgcacgcacatacccacactcacacatccgtgcacacacgggtacacacacatacacgtgcacccacatgcatgctcacacacatgcacccacagtcacacatccatgcatgcatgtgtacacaaacacacccacacatacacatgcacccacacgtgtacacagatgcacctccacccccatacatgcacatggacacacacatgcacccacacgcacacaagcatccatgctcacatgggtacacactcacacatccatgcatgcacgtgtaaacacacacacccacacatacacgtgcacccacacatgcacacagacgcacctccacccccacacacgcacacacacacatgcacccacacatggatacacgcacactcacacatgtacccacacctgtgtgtacacacacacatgcatgctcacacacatgcacccaggcacacacaaatccacattcacccatacagtcacacacatgcatacacacacatacaaacacatgcattcacacagatgcatacacacacacacttacaaactacacatgtgcttatacatgctcacatgcatgtatatgcacacacataccctcaccttatgcacacatgtacccacacacgtacccacacatatacaagcatgcacacatatatatatatacacatgctcacacgcatacccacactcacatgtgtgcacatatgctcacacacacgtgcacacacatgctcacacacacacttactgttgctcaggcttagctgctttgggcttaagaagcaaactgcaccttccaaaaaatgagtgtggtgttcagttaaacaaccaaataattctttagcactgaatatgtggactttagaaattcaaactataaggtgataataacgttgtcctgctactttttaatctaacaaacatatcagaactgacactcagttcaaatgaagaaagtaggaattgggcgtgccgtgttattttttcaaagattctcctattgctccaaattgttggggattatcttaaagtctttgaatagcttcagttatggaagattttaccctctgagaatagaactgaattttagacaaaccatgagtccattgtagctagactggcatgcaagttgggattaaacagagtaaaacgtcttgtttaaaaaaataagaaaggccggcttgggcaacatagtgagacctcctctatgaaaagttagctgggcatggtggtgtgcgcctgtggttccagccgctcaggaggccgaggcaggaggatggaggtcaagactgcagtggactgtggttgcgccactgtactccagcctgggtgacacagcaagaccccgtctcaaaaaaagaaaacagaaaaaagaaaaaaaaagttgagcaaggagactaatttgtgacatgcagctgaacatggtttttaagaccagttttgaaagaggaattccaacattattcttaacatttcagaagcctgggcataagggtgacctccagggtgccgtgttataacaggactgctcctttcaacagctatgaccttataccatgtcttggggtgttgcctgccgtgtgacagtccaatattatacctactacttaagttttctttagattaaaaaatgtgcttcatattttatgccatttctacaaatgtatagtaaaacataaccaagagagcttattaaataatttcatccaaagcagttctaccagtgcttcacatttattttttatttatttatttatttttgagactgagtctcactctcttgcccaggctggagtgcagtggcgcaatctcagctcactgcaacctccccctcctgggttcaagcgattctcctgcctcagcctcctaagtagctgggattacaggtgccagccaccacacccgactaatttttgtatttttagtagacacgggcttttgccatgttggccgggctggtctcgaaatcctgacctcaggtcatccacctaccttggcctcccaaagtgctggcattgcgggcatgagctactgcgcctggtccacatttaattttttgcaaaaagatgacagctgctaacagagatgaattctcatgagtgatatcattgagcttcgtaggccacatgagtgtgtgccgggaccagtgtggcagcaagcggggcgttctgctctcggcatggagtgattggggaaaatctaggcagcttcctgcctcacgctgtttaaaacctttataatgtgctttatttcatttatttgaaatgactgcctgtcgtgtcagatatattcatagtcaagcttgagtataaaaggcatattccaaagttaaatataagctgctgcatagatttttttgtaaaatgatctcaccaagaatgtttatccataaagtttagcgaatttgcaagtgtgtttttcaacagcatttctctttagctttaataaacattggtttcttcatggtaccactcattttgaattcagtggtctccagttctccctgctaaatgaggcccactttctaaaaccaaagtgataattttataaaaatgaaatgagatatttgttaccacagaagtcctcatttacgagagtacatccccatagaactagtccacggtgagcctcaggggcatgcaagctgtttaacgatgcccccagcctagaaaggcccaggcttgggtgttcatgctccgctgttgccttcttgaaattcataatcatctttgaacaaggggtcccgcagtgtgtggtggctcacgcctgtaatcccaacactctgggaggctgaagcgggtggatcacctgaggtcgggagtttgagaccagcctgaccaacatggtgaaaccccatctctactaaaaatacagaaattaaccaggcgtggttggtgggtgcctgtaatcccagctactcaggaggctgaggcaggagaatcactcaaacctgggaggtggaggttgcagtgagtcgagatcacgccactgcactccagcctgggcaacagagcgagactccgtctcaaaaaagaaaaaccaaggggtcccacatttgcatttttgctctgggtcctgtaaattacgtagccaggcctgcatttgtcctgggagatgctctaccaaaaaacaataaataacaccaagcattctgtaatcaaacactgtaggaacccctgcttatcctagcctcattctcattctggaagactgcacatttatcatgttaaagactcagctagggaggcccaacttcattcaactcagtgtttcttatttttttaaaacagaactcattttttaaaaaaattattggctgggcgtggtggctcacgcctgtaatcccagcactttgggaggctgaggtgggcggatcacgaggtcaggagatcgagaccatcctggctaacacggtgaaaccccgtctctactaaaaatacaaaaaaaaatgagctgggcatggtggcgggcgcctgtagtcccagctactggggaggctgaggcaggagaatggcatgaacccgggaggcggagcttgctgtgagccaagatcacgccactgcactccagcctgggcaacagagcgagactccatctcaaaaaaaaaaaaaaattatttaacacctttatttctgctgaatgtactttagaaagattgagtgatttgaataaagtgacggtggcctaagagtctattttctggaattgagggaatactgccatcgatccttgaaaaatatttatttagttcctcctagaggccgggcacagtggctcacgcatgtaatcctggcctgcactttggaaggctgaggtggacagattgcctgagctcaggagttcaagaccagcctgggtaacaaggtgaaacccgtctctactaaaatacaaaaaattagctgggcgtggtgatgtgtgcttgtaatcccagctactcgggaggctgaggcaggagaattgcttgaactcaggaggcggaggcagaggttgcaatgagctgggattgcaccactgcactccagcctgggcaacagagcaagactctgtctcaaaaaaaaaaaaaaattatctagcccctcctagaaatgttaattccttaaatctgagcttcagctttctgtgaagcagaattatctccaaactttaacaaacaatggtcagaactgtttttaaggtcttggagagagatcattttcagtctttattaatcggacttgagattatttagaaacttggctctgaatattgtattcagaatgttttcactcatttgtgagtaattttttaaatatcccctttcctcagatgcagaatcagggctttttgtccagcattatgttgcaagtcctggttctgttgaaacattccataccatctgtgtgatggttatcggcacctccaccggtgccctgaagacagttttgtgctgtgagtccagaaacaggaaacacttcaggctgtgtgtcagaagcattgtcagtggttgtgttttgcccactggcagggggcattctttaaatcctgggatgcttctgcgctttgggctccactgttccagcagtgattagaaataacgctgtaggccgggcgcggtggctcacccctgtaatcccagcactttgggaggctgaggtgggcagattacctgaggtcaggagtgcgacaccagcctgaccaacatggtgtaaccccgtctctactaaaaatacaaaattagctgggcgtggtggcgcatgcctgtaatcccagctactcagaaggctgaggcgggagaatcgcttgaacctgggaggccgaggttgcagtgagccgagattgtgccattgcactccagcctgggcaacaagagcaaaactctgtctcaaaaaaaaaagaaataacaccttagcccactgcattattgacctgtgtctgcatgagctgtggaccacattataatcagagagatctctcagatgttgtcactttcctgctctacccgcagatgtaaatttcagccaacagcagtgtttgtgctcattttccccggctctcccacacatgtaatcccttctgagcatgttggcttcaaataatatggccagccacctcttccaccacgagatcttcaggaaatggcaggccactgggtttacatgcagatggcatgggagcacacaaggcacggctgtggggagttggcacttgctccagaatatggagcaccgagtgaaggtttcagtttcctgcactgagagaaacaagggcattccgaggcttttccactttatccctaaagagtttcacaacgcttgtttgccgatttctacatagatgccacctttctgagttgtatgtatttacatgccaaatgtattcattgagcagcgttaaataatggtgttcacccctaaagtgcatatactggtaaaattaagaatgatcgtaattaagcctcttgcaatagtcattagttcagagaatatttaagaatattaaaggtgctttgctaatgtcctcgttagttttgttttgacaaaatcagtacttcagtttcttgtttcttttttttttgagacggagtcttactctcgctctgtcgcccagactggagactggagtgcagtggcacgatcttggctcactgcaacgtccacctcccaggttcaagcgattctcctgcctcagcctcccgagtagctggggttacaggcacacactatgcctggctaattttttttttttttttgagacggagtctcgctctgtcacccaggctggagtgcagtggcgcaatgtcggctcactgcaagctctgcctcctgggttcacgccattctcctgcctcagcctcccgagtagctgggactacaggcgcccgccaccacacccagctaatttttttgtatttttagtagagacggggtttcaccatgctggccaggctggtctcgaactcttgacctcaggtaaaccacccacctcagcctcccaaagttctgggattacaggcgtgagccaccatgcccagcccagtacttcagtttcttagcgatgaaatccacccaatgtcaggcgatgactattattattttactgatttatactgtttgttctctattaatgtcttattttccccaaccgattttgaagttgagtaaggactatgttccgcgggtatcttgagtcctctgaggcactgagcttggtgatttggacgcaggagctgctcattagtgagctgatagctgggagcatagcgcatcccacatcacctgacttaccttggtgtcctcctttgtagccttttgtcatacatgatatggagacactgtgtatggctgagaagacgctggtggccaagctggtggccaatggcatccagaacaaggaggcggaggtccgcatctttcactgctgccagtgcacgtcagtggagaccgtcacggagctcacggaattcgccaaggccatcccaggcttcgcaaacttggacctgaacgatcaagtgacattgctaaaatacggagtttatgaggccatattcgccatgctgtcttctgtgatgaacaaagacgggatgctggtagcgtatggaaatgggtttataactcgtgaattcctaaaaagcctaaggaaaccgttctgtgatatcatggaacccaagtttgattttgccatgaagttcaatgcactggaactggatgacagtgatatctccctttttgtggctgctatcatttgctgtggaggtgagtggttgatttaatctgctggtatcatgtcactgacaggctcctgtcttgaaaaatttgacaatgggaaatccagtaccagcctgagctgttccagtggaggggacactcacatggtgggaagacgtctgacccccagtcactgctgagaattcagtgggaattataacaatattgtataatattatagtatatattgttattatctataaatacatatttaatattatgtaaatgtatgacattttaatcataatattagccaggtgtgggggtgcacacctttagtcccagctacttactcagtagactgaggcaaaaggatctcttgagcccaggagttcaggttgcaatgagttatgaatgcaccactgcactctagcctgggcaacagaacaagacctatttctttaaaaaaaaattatatattttgcacaaatatatatatagagaaaaagaggtcggacatgggcctgtaatcccagccctttgggaggctgaggtgggtggatcacttgagcccaggaggttgagaccagcctgggcaacatggcaagaccccgtctctacaaaaaaaaaaatagaaaaaattagtcaagtatggtggcatgtacctgtagtcccagctacttgagaggctgaggtgggaggatcacttaagcccaggagacaaaggttgcagtgagccaaggtcacgccaccacactccagcctgggcgacgaagaatgaccctgtctcaaaaaaaaaaaaaaaaaaaattatacacacacacacacacacacatttcgtttatattatatctaatattataaacagatataatttatatattatgatattcctgtatatattatataatgatgttgtattcatattatagacaatattgtatgaagtgctatacagatgtcagtatagttgctgtcacagttggttatgttgatgaaaagtatatttcctaatgcaaaatataatatcagtcagcagccaagtggcagtgactgcaaggtttgctttgcccgaggaagcagatcccagggaaggccgatctggtcctctctgtggaagctggctctgcagcctccacatttttggctcggtgtcacgttcctttaaatagccccatctcaggtctaggaaggtcatccacctactgcaaactcggctgaccttacccagggttggtggagacagatggggtctcccacactgcctgcagccatactgcgcctgggggattgactcactgtcagcatggagctgactcagccctaccagccgtgcccgttactgtgtggctgggcacaagtcagatgaaggaagtccttgcgctctggcataaagtgtacaaagacaaagcagttatgcataatttgtcctttagtatggtcaggatgtagcattgtgggtaaaatgcagttgcagaactatttatatgtagcatgatcacagttttataaaggaaattataatcctatatcaatcctatgtatatagaaaaatgtccagtgagatatatgttaaacctattatggtgggattaaaattatgaggggggatttctatttttcaaaagattcctccttttttttttttttgagacagagtctccgtctgtcaccctggctggagtgcagtggcacgatctcaggtcactgcaacttccgcctcctgggttcaagtgattcgcctgcctcagcctcctgagtagctgagattacaggaacatgccagcacacctggctaatttttgtatttttagtaaagatggggtttcaccatattggccaggctggtctcaaactcctgaccccgggtgacccacccacctcggcctcccaaagtgctgggattacaggcatgagccactgcacccggcaataattcctctctttagagacttaatagttatagccccagccactctggaggccgaggcaggaggattgcttgagcctaggagttccagtccagcctaagcaacagagcaagaccccatcactaaaacaatacaaaaacaagaattttagaaataaaaacttaataattacatttacaaccaaaaacaatgaagatgtttaaatcctcatcactagcaaccctgttaagaatcatagtaatgactgggtctgtaagggagcaccgcctgctgaacatggctcagggcagtattttctggaccaagaatcaggtctcatgctttgagactgtcccaggatgtctagtgccagctaccccaggcaggtcatctggtgtgaatgttgactcttcctgcaccaagtctcagacctgccccaccctcctccccactctgggtctcctgatcttggctcactgcaatctccgtctcccaggttcaagcgattctcccacctcagcctcccgagtatctgggattacaggcgtgagccaccgtgcctggcctacaaaacctagttctaacacaatcactccttaaatatggtggaacacttgaagcttgatatctagtttggattcaaaagcttcatttcccatattatgcaaaactggtggttgtgatctccagaatgtactgttcctcctactagctctaatttttctccctgacaggtggtcatcaggtaaatcacaagtgaaaaggccgcaccataaggtgtacttagggcactattgccgcctagtagtatgaatatttaggaaagagtactggtcctgtctgtccctacttcacctattgactttggaaaaacctatgtctatcttccagtcaagttgacaatatctaaaggcagctcagtttttttctaagaaaggccacataaaataggcatgtttggttcctgaaactgataagcagttcttgggtgattatcacactcaaacctctctctcttctttcgagactagatcgtcctggccttctaaacgtaggacacattgaaaaaatgcaggagggtattgtacatgtgctcagactccacctgcagagcaaccacccggacgatatctttctcttcccaaaacttcttcaaaaaatggcagacctccggcagctggtgacggagcatgcgcagctggtgcagatcatcaagaagacggagtcggatgctgcgctgcacccgctactgcaggagatctacagggacatgtactgagttccttcagatcagccacaccttttccaggagttctgaagctgacagcactacaaaggagacgggggagcagcacgattttgcacaaatatccaccactttaaccttagagcttggacagtctgagctgtaggtaaccggcatattattccatatctttgttttaaccagtacttctaagagcatagaactcaaatgctgggggtaggtggctaatctcaggactgggaagattacggcgaattatgctcaatggtctgattttaactcacccgatgttaatcaatgcacattgctttagatcacattcgtgatttaccatttaattaactggtaacctcaaaattcgtggcctgtcttcccattcaccccgcttttgactattgtgctcctttataattctgaaaactaatcagcactttttaacaatgtttataatcctataagtctagatgtatccaaaggtgaagtatgtaaaaagcagcaaaatatttatttcaaagacttcacttctgtttcctgaatctaaagaaagacaacatgctgctttttaatcataggatggagaattttaaagaactgtttgggccaggcacagtcgctcatacttgtaatcccagcactttgggaggccgaggcgggtggatcacaaggtcagcagatcgagaccatcctggccaacatggtgaaaccctgtctctactaaaaatacaaaaattagccgggtgtggtggcacatgcctgtaatcccagctactcgggaagctgaggcaggagaattgcttgaaccagggagttggaggttgcagtgagctaagactgcaccactgcactccagcctggtgacagaacgagactctgtcttaaaaacaaacaaacaaaaaaaaaatctgttagataagctatcaaaatgcagctgttgttttgtttttggctcactgttttcgtggttgtaactaatatgtggaaaggcccatttccaggtttgcgtagaagagcccagaaaacagagtctcaagacccccgctctggactgtcataagctagcacccgtggtaagcgggacgagacaagctcccgaagcccgccagcttcctgctccactcagctccgtccagtcaacctgaacccacccagtccagctgtctgtgggaatggtggtgttcttagggacagactgacaccttacttgtcagtgttcctccgggccccatttggcagctcccgtatcttttgttatgttgcttttaaagatatgatgttttattgttttaactcttggtgacagtagatgctctctggagcgcagacgaggcacatgtgtcttcatagcctgggctgggtgggagccagtcaccctgcggatcgagagagggggtagagtcttcttcaaatggcagttttacttcaaatggcagatttcacaagagttggttattttttacaatggtttaggttgttaagtctcctttgtatgtaaggtagttttttcaacatctaaaatttttgttttagccttcaaaaccaacttaccaacctcagtccagctgggaaggcagcgttgattatggtagtttgtcaagaatatatggacctggaaacactttctctctctgtccacctggtagataaattgtcctgttgagaatttttagatctggactggaactgccaggaccaccgcctccagggagtcgctgggcacctggaggtatcgtcgatgcctctcccccatctttagaaaatttggctcttctgaggtcattattattttaagaatgattaggattgataagggtcccatgaccagcattatgaaaatgcgagagtgggaaggacacagtgtgagacttccactagaaaaaagtgaaagttagggttaggacatccttttttaaaaattacaaatttagtccgttttggtttttgtaatcaggctaggcacagtggctcacacatggaatcccagcactttgggaggccgaggtgggaggatcacttgagcccaggagttcgagaccagcctaggcaacatagcaagaccctgtctgtacacaaaatttaaaaattagttcatcggggtggcacacatcagtagtcccagctactctgcaggctgaggtgggaggattgcttgaacccaggaggtcgaggctgcagtgagctgtgatctcaccactgcattccagcctgggtgacagagttagattccaccctctcccaccccggcaa

SEQ ID NO: 16808 - DNA, 13438 bp, Human
agactaacttggacgttgttccctatcaggcgagattaacccaactaaattaaaaccaagtaggttttaacaaaacagattttaaagaaatcaatcttctctccaataggttatttctgtcacgatttaattagctttctgttactactaaggcttgtatcatataaagtagtggttctcaggctgggcgcggtggctcacgcctgtaatcctagcattttgggatgccgatgcaggaggatagcttgagcccaggagctggagaccagccagggcaacgtaaagagagcccccaccaacaccccccgccacccaccaccaccgccccggaaaagcagtggttctcaaacgtcagcggacattggtatcatctggtgagcttattaaaacaagagtctctggattcaggaggtctggggtggggcttgagaatttgcatttccaataaattccaagccggaactccaggaagataacctgcattccgcgcctggcgaagcccagctacgccatttccttcctaggccccgcctacttcgtgtccctgacagccagggactggctagagggcgcgcggagtcacgtgagtcgagcgacctcgcgcgagagtttgtatttctcgcgagacttcaccgtctctgtcttttcctccttccagtgcccggcgttcctcccttccccctcgccgccgaccgagttcttccttttcagaccgggtcgccttgctgtcgtcgcggtgattttcctgctactgctactgctgctgctgccaccgccactaccactgggctcatttgccccgaccccttcccgccgccccgcccccagccccacacaaggtaacaacccccctgagggagagagtaaggcctggccgggcccgggtccctcccgaggtgaagcggaggcccaaggctgaggagcccgcctcgccggagacgcccaggcgctggccctggatcccggagccacggccgtctctcagccagagctgagcctcggcggcccggccggcgctggcctccgtgcggcggcggcaaacacggcccgcaggggaccgggtcgggtggggctgggcgccgcgcggctccctgtggagcctgcctgttggagcgcggcggggctccggcggtggtcttggagctggcgtgtggatttccacgtccgaatgatcgagttgtggcgggctttgaggtgctgcgtggcggggaggagagcagcctgggtcgctgtaactcttagggggcctttgcaggctcccagcctttggttggacgggaattttacgaaggagaagggtcctcggaaacgtggtacatttgcttataaaccatcaaaaaaggttaattggtatcttattttcaggaaaatgactgagctggatttggcgaaaggcacattcgttagaatgcctaaatgggagagtacctgtgctgttctttttgctgaagataatgcaccgataaatatttaagcgactgggcgaaagatttttgttttggagaggcacttttaaatacactcttaattgaatagttcaagtaaagatcgtagtttgtgtagttaatttaaaaacgcacttgtttggctttggaagcatactgtagtgcttaaaaataagtatttggattgtttttgaaagtttcgacttttccaacagagtagtgctttttaaaaagataacactgattattgagccgaattcagcacctaccctgtggataggagttaaaagaaaattagaaatttctttgtatctgtatgcttttttaaagtatggaatgtatctcaagtttataatcctcagaatctgttgcctttaagtttgtggtttagctgaagtctaaactgagagtaaaggtaatggtggtaaattaagctgcagtgttagaaggagttagaggcaaaaactggtaattcaggcagacaggggagttagttttttatgccttgatttttggtttagttttcatggtctaaccctttttattttccctagatgtcagaggatttagcaaagcagctggcaagctacaaagctcagctccagcaagttgaagctgcattatctggaaatggagaaaatgaagatttgctaaaattgaagaaagatttacaagtaagtatgggtagacaattgtactttttctctgtttttcaaattattgcttgaatccctaagtacccaaagcgccttttgaggggttacaccccaccctatgtatatatgtaaattctgtaggtaccattgcttgtagaagtagggttgcttccccagttctcaggtttctgtacatcagagtgaaatattgttctttgttatataaatcttgtgtgcttacataatttttaaaaactaaagttgatagaaatttccaagtctgtcagattttcaagacgagaggtacatgtaacttcacaatgaaaaacgcttttagtttttaagacctggcaaatgaaatttagttcaaaaagtaacaaagattgaaggagaaaaatagaaccttaagattctttttaataccacaagattctttgaaaatgcgtgccttttttttttccccaaagctagtggattacattttgtattgaaaacacaccacaaaaatgcctaaagagagacaagtgctttgtataattgttacatagatgttcagacttaaggctaggttttacagtaaagttgttgacacttgtggaaattgaactatgtggtgaaaaggagatctttgtcatggtagagtttagtagataatgaaacctttttttgaaaacctgcactgggatttcaagacaaacatagagccatcatagtaaataccttttgtgtttcaggacaccagactgattcagaaaaatgccatatataatttgcaaatatatatgacttttaagagcttcctttaaattctgaacctgatttttaaaaagtttcaagggtgttttgattagagattgctttaccgactgagtactaaactcaaatctgtatcctgtctaaaaattcattccctccctttattatcccactgcccgttaaaactattactattttagggatatcagaactgcaaacaaacttaacggaaatagggtccggatttgggattctggaactgcttatctgggcgtaattaagatgagttgaatactttcaagttctacatttagaataaaattgcagtagtatgttatttttaaacacacacaaactatctgggttaatttcaatatgaacaagacccctcttcgatacgtagaagccaggcctgtgggcttcagggtgccagtcaatacaaaaaagatgttttgggagcagtttctcccactcccaggcccttaagtgagaaataacccagtggtttgccacctgtccatttgatttgctcatatgttgtgagtatacattgaagatgaggcaacagaggcacaccgacctcttattttcttacactctgtaaagtgctttctgtttgccccaaagagagatgccttgactacctttaccaacttaagcagtccttttttaggaaaagaaaacactgggtgccaatgttttgtatattgcttcttgggcagtgggaggaggggtatttgttgaactggttgggttggggaagttgggagtggagttagaaatagcattatcatcaggtctttttaatatttctagaataattcctcattagagtctgagcagaactgccttaccatgtcatgatcatcatagtggaaagtactgtagggggaaaccattgtgataaacactgtagtaagcccctaaaaggcttgcttgcaggggttcagttaataatgacctggaaatcatttttctgtaaagtatcctcttttctataaccatttaaaacagcactgtccagtagaactttctgtgatgatggaaatgttctatatctgctattcagtaccatagccactagccacatttggttggatatttgaaatacagctaggtttacttaggagctgagtttttagtataacttaattagccacacgtgactaccatactggatggcaaggatttagaagtgcaagttttaatacttcagatagtaataacagaatgtttttcctgaccagtcttgatcagagtttcttcccattttattctatcattagaaatttcattttggtccctagataaggtctattttgaattgaaaactactcaaaaacggaaaccatcttttaagatgaggtaatactctgaaaagtatttggctataagcttccacccagtaattgttgtctccattgagactacacttaacagcttctattttgctgtggggttccccccctcattcccctcctttttccttctctgccttctgggatgtatctcatgctatgggtatttaattcagcttgttatatttggtgaaaagtctgttcagactgattttgtggcttcctcatattaatattttttgaccatcatatggtttctaatttcttgtgttcctctatagaattagatccttatcccagttattaatttgtttgccctttgttttatgacaaaatgctttttttgcatcttttcaatgacttcattttgccagtaaggtttccatgtttatctctttcatgtactgtctttcatagagactaaagttattcagcaggcagcaaaataatctactaaagtcctgcctttcttttttcacttaaaaaagtgggtgtgataaaatccaggctagctagctgactagctccccgggcagtctatgataatcagagatagtcaatttattaggctgttttgctgaataagctggttctaaaggaggcaggggtcaagtcacttgtctcatatattacagtggctctctgcatccccgaaacgccttccttcagtaagcagagtgcttgagtgcaccccatttgacctgctgatatgtagatcacaacacctgatgcttcctggaattgccgattactgtaactgctgcccatctgtcgatgaaggagcagtttcagaactcagacttgagggaggaaaagtaattaatggtatgtaccttcaagaaccccctcatacataaaatagtttttctaatactttggtccatacgcacatgtgaagaatagaaatttagaaggttcttcatagtttgttgggagggttatgtaaaaccatggcaaagttaaaggacattaggagtaaatgctctggattttttctaaaaaagggtcatttcagcacaggcctctgaattcactaatatgcacagcttttcaggacccttttctttgatgaaatatatttctttaacaaaatatatttggaaaacagttctgtcctaaaagaaatagagttctaaatctgaaacctacaagtgcagaattcatgtctgtgcttaagttaaatgatccctaggtggatctggaagtatttaatgatagagatttgtgtgggctcttgagtcaggctgactggattacattcctacccctaaaagtggttaaaaataagaccagataatttactcttctgttgtgtactacttgatctagttatttggaaggttctttgctttgtttgcaaaggactgtctaattaaaaagatctaattaatggctagttggcaactaataaaacttagagatattattcctactaaatttttaaatcaaacctaagtgttctatttatttatttataaaactaacctttcttcaagagatttaagactcaaatattagttttttcagaaatagccaggaagatttagaatctttaggagagaggtaatatttaactttcttggctactggaatcaaaattactattatgaaacctcagtgggaactagaagaaactcagtacatagtttaactttgttaatttttctccccaaacacacagtatgatgttttaaatgcaacaatgggtgaacagctatgcaagttcttagatcagataagatgcatagtgtggatcttcattagagtaacaatatagtagacaggtagcagaatctgtcggcttgtactgttctcaattttttagccatccctacaccaaacatctttgaatgaagccaataaatgtaagcctgaattagaaaaaaatatttgccacacagaaaggcattgcctttgtgtgttacctttttttcccccttttaaatgaagctgtgctaatgtgcttaacattaaggtatggaacatttaaaatctaacctggtaatttgcttacccagatggggtgagttttacaataattgaataggaagaccactggtttcttttacattgcctgtagtattttagtcgagatatgtataagtaggaacatttttgttactaataaagctgcttaaagtgttttgggattgcttggcagttaatactgctgagtaatgccctataaaacagtacagttgcataaaatatgttacaataagagtatctaattcagtgcctcatacttgactttctcatctttagagagatctattcagctaaaataggcacttagaaataatgcatggtataagctcaagtcttatattttcattagtatttgtggttaagttgaaaggcaactatatgggcttaagtcacagctctgccacttaactggtagacaatactgtatcagtttctacatggggataatcacagtacttgcttaatagtgttatgagctgcaaatgaaatatatgtagagtacttaacgtacagtatgaaggctgtcatcagaaactaagttgacaatgagaattataaaaataatgttgtagtttttgtttttcttttttaggaagttatagaactaaccaaagaccttctgtcaactcaaccttctgagacgcttgcaagttcagacagttttgcttctactcaacctactcattcatggaaagtaggagacaagtgtatggcagtctggagtgaagatggacagtaagtgtagaaaaaaaaactctaactataacatgaaataataaaatacaatggtaagaagtttttattcagttttaactaccctattttaatcttgacttctattaggcagtatgatttatagagccaatttgattcttgggtggttgccattaatacagtttagttttagctttagattaagttttggggagaagaatggctgggattctggaggaaagaaaaacaggacaatgaatgggtgttttctaaaataatctaaattattttctctaattgaaaattgagtgaatggttggtttttctgagaattctgtgaagagcatacactgacatcattcctataagaaatatcttttcgctgggtgtggtggctcatgcctgtaatctcagcactttgggaggctgaggcaggcagatcgcttgaggtcaggagttggagagcagcctgaccaacatggtgaaaccccatctctactaaaaatacaaaaatcagttaggtgtggtggcgtgtgcctgtaatcccagctacttgggagactgaggcatgagaattgtttgaacctgggaggcggaggttgaagtgagctgagattgcactactgcactccagcctgggcgacagtgagactctgtcgcaaaaaagagaaaaaaagaaacctctattctcaaagacattaaatcacgttgagtaggtacatgtaagagacttgcccagcaatattatgattgggatgtccttttttgatagcagataactaacttcaaccactcttttgtattctctttgctgaaacaaccatttgattatagaagtttcattatagacacatgtaataattttatcactacagtataagtcttgtaggctgagtactaaacctttactcacctgcttacagccatgatatctttacaggtgttatgaagcggagattgaggagatagatgaagaaaatggcaccgctgcaatcacctttgctggttatggcaatgctgaagtgactccactgttgaacctcaagcctgtagaagaaggaaggaaggcaaaggaggacagtggcaacaaacccatgtcaaagtaagtgactttgacttttccattttaggtgcaatcttccccatttggatacttgaagtagtctgcagagagaatctatgcataagaaagttgtaatactgttttaccgttgttttgaagattagcaacaaagggtcaacattgtctgtgtaagtgtgcctaagtaaagtgaagataattttgattcccatttaggcattcagtaaatattaagaagataactatgtacaatgaacatcttcccagcatattttataagccaggtactggggctataccacaggagaccacctcaggccttgtcccaactgagtttatatttagagaagaaaactcatcattaatgaagtgctttaatagtacagtgtaaacattacaaaggagctataacaggtactgtaagggaacaagaggtactcagcctccacttttattattagggcagatttctttgagaaaatgacatctaaactgagatttgaaaagagtaagagccaagtacaaagctacaaggcggtatgatgttgatctgggcttgaattctttgttattaatgagcattatgaccttggagaagctgtttaactctgtttcctcatctgtaagataggggcagtacattattgggttgtgaggattcaaacgataagtgttagtaaagcttgtaacagttctttacatgtagtaagagcttagtaaattttttttaaaggggggaggtgagcacgtacaagtaacaaatccctgtggtaaaaacttggggcctggaaggtgggtggtctgagaagagattagagaggtaaagtccagaacataaagagcttgtaagccaccgataacattttaagtagaggggatatgatgtgatcacatttgagctttagaatgatcactgtcagtagggagaggcaactactgctgtgatccaggtataagatgatggcctgaacccagggagttgcaatgggaatggggaactatgcagttttgaaaagtaagaggcagaattaacaatattttggtgaacttctgcatatttgccacaacttagtcttttgatttgtcaagagtttttgaaacttaagttgctacatatttatatttgaatatgcaaaaattatatattaatgtaagcattccaataaaataaaattctagaacaatgtatatatatattttttaatgtctttgtcatctgtgtaaaaagccatagcttcatggtggtaatatggtaccggggagtctagatattgcccctcttaaggatctttcttttcatccttttggtgagaagtcagtgttaactgagcagaaattattgggggttttaggctctgatcctatttagaatcttatttagaatgtttttgaaacccccaggtgttttgttttggtgagaattattagctatgatttccatttgtgctgctgcattcttccaatgtaggtaaaatattttatctgcatcgaatctcttcatacatttttttctaaatgctgcacttgttaactatgtctatttggaagtagttgaaggcttagatacccattaatactgaaactcaacttattcctaaaacaactggtaacagctatacaaaagtaaaatagaaagtcataattaaggctgggcgcagtggctcaagcctgtaatcccaacactttgggaggccaaggcaggcagatcacttgaggccaggagttaaagaccattctggccaacatggtgaaaccctatctctactaaaaatataaaagttagctgggcatggtggcatgtgcctgtagtcccagctactcgggagggtgaggcacaagaatctcttgaacccaggaggtggaggttgctgtgagccaagattgtgccactgtactccaactccagtctgggcaacagaacaagactttgtcgccaaaaaaaaaaaaaaggcatagttgaaatatttaccttatatgggtaaatagattacagttatgtttgaaagcttccaaggatgccattttttaaaaaaacatttcttagtaattctgggtgattggtactgattttaatgatttagtactttttattcatagaccattgtatatgtttattagattttttttttgcactgccggtgtcttcaaggaagtcattcttgtatgataagtcttaacagttgacatttaactttttttcatgcagaaaagaaatgattgcccagcagcgtgaatataaaaagaagaaagctttgaaaaaagctcagagaataaaagaacttgagcaggaaagagaggaccagaaagtgaaatggcaacaattcaacaacagagcctattctaaaaacaaaaaaggccaggttggtaaatctttttacactttgtaaatttgagaaatgcaactgtcattaaaataactttaaaatgaaaagagatgtagattttttgtaaagtatgattaactcagattttgtattccgaatccttgttgatgctcaatttaacttattgaaaaatgttagccattgtctctgcaataaaaatattacaaatgagagaatttatatcagaaattacaaaaggtctatgttcttttccttctataaactaatatttgaaaaaatagttgctacttagaggcagtgtgcttaactctatctgctttgttaacatgccttcatgctgggcatcactggtagattttatttaaaagtgcattcagtttcccttgatacacttaccttgtgtgtgttgggtagaaaataactgtagcattcatataggaagttgagaataaggataacctgactttcacccatgtgttactcttcactgccatcaaggtagcccttccattgatggacatggcttctggaaagaagcgcttccttttcataaagatgtttattttgtgacaaaggccaagggacttcacaatttggctatcataacaggccccacagtaaaccacaatacagccagagctttaatcatgctagaatggctagctcacagctgaagttaggatttgcgtttacaaaactaaaattttgacgtatcagaaggcaagtgttatgagtattagtaaatgtaatgatattttccacaacttagaagttacagtaaatggcttccagcatgggaccacttctgtacccattttttaacactaaacaaaggcaatatgtttttcttcttttaaacgttgaaaccagaatatattttaacattacttaaaatttgaaattttttattttttccaacactaatcaggaatgatttctgttttctttcccttaggtaaagaggagtatttttgcttcacctgagagtgtgactggtaaagttggagtaggaacctgtggaattgctgataaacctatgacacaatatcaagatacctctaaatacaatgtcaggcatttgatgcctcaataatcagaaaaactgttggatttcatctctgcagggctttacatttacctttttatccttatatttttctaaaggtaaattatttgttagatgagtaagcaagataccattgtcgtcattggttggcttcagtagaatgaaacgtgaagaaattgcatttgataactgctattcatttaacttttctcattatcagtaccacggttccctcaaagtttgttgaataaagcaacttttgtagatgctgtttcatacagcacttagatgaattattgatcttcctaatatcaggcgcctacttaacctatggtatgtactttttgtaagttgtaacttgaaattttcagatgctttgaacttgacacatactctagcaattcattggaacaccaaggcaaaaacaccaacctgctaaaagagatcttttcatttttcttattttcagctttaaaacttagctgtcgttcagttaagcttaaagataggttaatttgtaaatggcaaagtttgttttgaggtttttcctcaataacttgtttcccaggcctattaggccatctctaaaattgatctagctgttttatttttatgtactcttagttttatgtaagaaaccttaggatgagctcccttttctaaggtgtttttgttttttgtatgtttgcttttttcctgttttttgttttttccatttacggcagtggtaccatgttttggatgtgtgatgtttatatgggagaacaaaaagctgatgtatagccctgtatacagtgtagatactatttttgtaaaaacacaaggctaaattaatgaacaagaatactgaatatttcatcattaaaaatttcttgtatttcttgtgcattaatctgacgataatttccctgtatattatgttcatttagctgtttgtaatttttgttaattagatcaggttgtctgcatttgttggtgtaagtgaacatcatcacagttatcctgagttgagtttaagccaaatacatgcatagaaaagggtcttcctattaatggaagaaggtaatttttaggatgtgtattatttcagttttgtatgtttaacttttattaaataaagtgtttttaaaatctccagggtgtgttaacaaaagggtaaagtctttagctgtcagcacttaaagcaattaaacctccaagtacttgcacacggcattcatgcaagagaatactgagtgtgtgagaggtttcagtaaatgcttaagtattccttccattagaagaaattggatcttaaagggcaaaccaggcctgtgtttataggatgtcctcattttaatgggtgtttgtagatttttggtggaaggggaaaataagtttttatttcatgaattttaattttttttataaattgaaacttaggacagtggtaggtagaattcttcatctctcccttccacacccacccctctcaacccaggagggtcactttttcttcatataattcgtggccacagggtaggacacaaaggacagaaaggcacaaactgcagtagaaaaagggtttgttgaagcctgtaaacttctaaataaaatatactttgttattgtaacatcttaagagcttatcaataatcaagagtagccttgatggattgcaagagaatcctttgaattaaaaagcactgggaagaaatttggtgtcattgtgtgaccccagaaaatggttgttgagattaccttggtggtattagaatagtaattcacttgatgtttgtgtaggcaggactgttaacagtcttgtccctcttttgaccctggggggccttagttttcccagaggactttgcagtaggagagagaaaaagaataaaagtgaccttaaaaaaaaaatgttttgaaaatagacctttagaatgaaatcagcaacctttgtgtcaaagatctagatgtggccctttggaaaatcctagtgtcaggatgatgtttgtgtctctgaactaagaggcaggactcctggggagacta

SEQ ID NO: 16809 - DNA, 62327 bp, Human
  misc_feature (1)...(62327): n = A,T,C or G
ccttccgacgacctttgcgaatcttgcggaacgcaggcgccctgaaacggcgtgtgcactacgattcccggcagccgcgggcgggtgcgggactacatttcccagggggcataggcaggggggggagggggctgatcctgattttttatttatctttctcctcttattattattttttcttttttttttcctttctttttaactttccttcttactcttcttactttctattattttttattttctttttattttatttttttcctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcgcgcgtgtgtgtgaggggaggggtgagcgcatgtgaggggaggggtgcgagcatgtgaggggaggggcgtacgcgtgtggggaggggcgtgtgaggggagggccatgcgtgtgtgtgagggcaggggtgcgcacgttaggggaggggcgtgtgaggagaggggcacgcgcgtgtgtggggagggtcgcgcgtgtgcggggagggtcgcgcgtgtgtgaggggtgcgcgcgtgggagggatggtgcgcgggggggaggggcgtgtgcgggaagggcgtgcgcgtgtgtaaggggcgtgcgcgtgtgggaggggcgggtgcggggaggggcgcgcgtgcgtggggaggtgtgtgtgctgagatcgtgagtggaggcgtgtgtgagaggtcgcgcaggtgctgggggaggtgcgagggtgcgcacggagggtggggctgtgggtgtgcggcgagcgggaaggagacgggtggagggaagttggagagagggcggtctggggctggagagagggtgaccgtggagaagcttggagggccccggagcgggagagggtgctgggagataagaggaaggaggaacacggatgctggggggggtcaggggaagggacgaggccgggagaacactgagcgggggaaaaccggtggagaggggcctttgaatacctgcggggtgatgagatggggtccctttagcggtggcagcccaaggggctgtagagatggcgcagaaagaccaggaactcggagactgtggtgtcgagagagaaaatgtctttctaagacttgttcgaagtacacaaaaatattgggcttaaagagactctttagaacagagagagttgaaagtaaaggggaatttttgaggcaagcgaagtcaatgaggtgaatggtaactggtcacaaaatttttgttctaaagcatctgaaatctcaagttcttgggagagaaggattttggaaaggggggataaactctttggtttagaggaggtatcaaaacaccttccagctggtggggtgtcacaggattgatgtccaggcgagggacattaattttctaaccaaaaagagtggaaacattttacctcttttcctgctttcaaaaacctgttactgcaaagacctcggatttgtgggtcaatggatttgggtactatattcttcttaccgtatctttttttcttgctttcttcagagtgtgaacatggctacgcctcttcattcccgtccatgccgagcccccgactgcagcattcaaagcccccacggaggttgagccgggcacagaaacacagcagcgggagcagcaacaccagcactgccaacaggtagcaagctgggaacgcttagaagagggaactggagggaaggagcacatttctcctgtaatcccaagtctgaaggagcagcacttgatgggttcctttaccactaccctggggatttggcccttttaaaataatgaagtctagaaatcataacctggttttgcatggaaggaaaggaatataatctggaaagacaaccaaagaagttcttgctgggattattaagatggctatgccaagttgagagacttggcagcatgtgtccatgcatgcagccacctgctaaaagtaatcgtgggctggctttcaatattctggccaagttttggacagtccaagaagattaaaaaaaaaatcagaaataggtctggcagggtataaagcagaatcaagggtttgttaaaggaataaaaatatttaggtagaattggtagtgagcggatgtggttatttgtttaaggagaaaagggaagaccatgctgtgaaagttttgcctctttaaatgatgagatcggattggttggtgggctcttaaagcaaaaaggaaaaaaaaatctgtttatctttcaagcagaatagatctttaaaaatatacttgtctagatgtacttggaaaggctgggcctagtggcttacgcctgtaattccagcactttgggaggctgaggtgggaggattgcttgagcttaggagttcaagaccaacctggatgacatagtgaaactttgtgtcaaaaagagaaaaaaatagatgtactaagatgtagctgacttccatttttgaaaacttttgagtagtatgtggctatctcttcggtgtttttattctagggagccagtgaattcctaggattcatctcataggaagttttcaaaaggcctttcttaacagaagattaacagatggctgccttttccattgataaggggaattaaatgagacctttatttctgtttcccagagctttgtctagagaatataataaacattcattttgaggaggacagagcaatccctgggtaaccaaatttccctgaaggctttggggagcttcagtcaggtggttggttagtcatttgggacagcagattgggtcagaatggggctcttgattcagaaagcctgaggcttctacagataataattggaactcatgaggttggatcatcccactctgtatttcagacatcaccgaggaaaaactaggattcacttttctcctttgacttctctatagagctgcacgtttccttttttagcttcttttcattaagactactatatagtttttaaacttaatttcttaagttataaaaataattaaccataagcttgatgtactatctgtgttgtgtgtgggtctagagattttgttgtagtatggtgtatttgagatgaaaatatgtagtatgatatacagcattttaaaaaatgtacatttgcttgcccttacggtttcagtgtttaagctatcaagaattaagacctattcaggaatttatgtgtctttcaatccacatagattaaaaaacttttttttttcaacttggagacataggaagagtacacataggaaactagacctgggttctgtcgtgctgcaagtatttaagcctttcctattttctagaaattaggtatataatttcagtacatttcccatcccttactgtattcatctgtaaaataagatgcattagagtctcaccaaggtccctcgttctcctgaacttctatgactctgatttattgacagttttagagattggttactatattagtaatttagtatgtctcccatcattgcagatgtgacatttttaggaactcaaggattatagaggcataaataagatgcacattcctaagttttatcaattatgttaccggtcattaataagaaactcttagtcatctgttgacttacgctttgctcagcttggggtttgggctaagtgatgtttctctttcatgctagtgtctctgttaggattctaatattatgtgtgggaccacagtgctaattactgtgttttagcatagcatgtcggaaaatttgtaaaactgcaagcatgccatattgttctgatagtgcccaaaggagaatatgtgtacattagaccacctaaaacaggagaagatactttttttatgggaatataagtagcaagaaagagagagagagagaaaaatatattttagaatatattatctcaagatccaccaatgtgtgggttttgggctggggcttatgagagagaactagtatgttaaaatgaaacactagaaattatttctcctttgccacttatttaaaatgcctgcttcatggaagtaaggagagctgaggtagaaattccaatactggggtatttggacaatagtgttggtccatttgaaagaggacactgtaggcttcttcttaattttaagtttactattggattttaatgagattttattatgctggttacataaagcagaaagttagaagacttacagaaatttccatgtatttatcatctgaaacaaggaaaggaatggacttcataagtatatatgtcttattttttcctgatcaaaaagctactagtgtggaagtagctgttattttattactatacatcttgaacactgatgtatgttataaaatgacatttgtttctctgacatcgtagcatctttaagatataatggtgattgactattttacccctgatattctcaggtattatatgatatgcctgataaaatgttactttaggcagggtgcagtggctcacgcctgtaattccagcactttgggaggctgaggtaggtggattgcctgaggtcaggagttcgagaccagcctggccaacatgatgaaaccctgtctctactaaaaatacagaaattagccaggtgtggtagtgtgtgcctgtaatctctgctacttgggaggctgagacaggataattgctggaacttgggaggcggaggttgcagtgagctgagattgcatcactgcattccagcctgggcaacagagtgataatccaccccccccccctcaaaaaagtaactttataaatttatgctgaaagtagttaactcctaatattataaattcctattcccctttcccccattccttaaaatcttattttcaaagaagtaaaaaggagagaaaataaatgatataatgtgatattacaaatatgttccttgcaaataccagtaattttatcatttgggatccttctgatagttggaagtggcacctataatatataattaaaataaatgcttgattttactgtggtcttggtcacagccttctggcacacttccaaaaatcaacattgctaagatgttactgctgttagagaatgtggctgcaatagctatctggctttttggggagcatcagataagttcaaattccagcttctttactatttggtaccacaggtgaaaaatctcaaggtctgtcatccttaaaactctactaaataagccatgactgcagtgtaacactgatttcttcctaaatatctcttcagtcggccttctttcctgttaccttcattactatcctcctaatctcagctaccatcatctcttacttggacgactgcagtaacttcctacctggtgtccctgcaactacagtttttttttttgtctggttctgttgcccaggctggagtgcagtggcgcgatctcagctcgctgcaagctctgccttctgggttcacgccattctcctgcctcagcctcccgagtagctaggactacaggtgcctgccaccatgcccggctaattttttgtatttttagtagagacagggtttcactgtgttagccaggatggtctcaatctcctgacctcatgaaccgcccggcttggcctcccaaagtgctgggattacaggtgtgacccaccgcacttggccagttcttatgaattacattggccagccttcttttgattccttcagtacgcgttttcttctacctcaagatctttgcatactttctgttccctgcagggaatcattttccctccccctttgttatctctgttgaataacactcttcttcagctcaatcataagttcctcaggaatgtttcctcatctgccgtagtagatcaggtcttcacatacttcatggcacccctatttttccttcatagtgttcatcacatttgtagaaatacagttatccagttgtttcttaaattcgtgtcctattcactggattaaaaaccctgcgaggcgggcagggattgagtctcttctgcttaaacatttatccctagtacttatcacagtgccccgtaaatagtatgtgtttcttaaagaatggaaggttttcaaactccaagcagactgtcttaaattgaatttcttttttgtgctgagtaccatattagactggaaggaagagtgataaaacccctgttttggcaaactctgattactttgtgttccaagggatgttaatgatacatttggaaaaacagcatgtagtatttaaagaataaaaatctctaaactgtcaattcttttaaacaagcaggctacagaatgctacacttaattttgaagaacattcagtgtcatcctgtgtcatgaaaataaaataataccaaacttgcatattgaaagaaacagaagtctttcagatattggcaataaatattcatatgagcctgtgacacacacatagtaattgcattgttttaaggtaatctgggaagtagtaaatagccaatttatgctttaatttcaagttgatatatttcttctctttagtgtcctatggatactaaagaatctcataaaagcagtatctcagttccactttctaagattgaggacactaaaaaacaacttttctgttgtttataaggctttagtttaatttttcttaaactgtagaataaagaaatgctttagtcttattttagatagaattattgtattgttattttttagctttgcatccttttcagctatcttcatggatttttagtttttctggggagagggatggtggtgaattattttcctaggatagtttcaaaggattttttccagtagtaatttgagatgctttatcttctctttattctacgtgaacctatttgttcacagaagaattgaatgaagccttatttttatttttgtgtaatttttttctactattctgtgtttttcaaatttttttatattaaaaagtagtttctgggtctttgttccgtagaaaactcccaaagtttcaggacaaaaatgtagattagtagcagttaaactcttaatgatgttgttattattcttaagtattttctgcattttgagtgattaacacatccagtgaaatgtgttttgtgatagtctgtcttctaccaaaattgacttaaatgaaaaattcccaagaattacttatatgccttatactaaaaaaactgaggctttcctttaaatgcttctttgaagtgtaagtttgctattgctgggtttcttaaggttatattcctctatggaagtattgaaggaaacttgtatgatcatgccttgtaagtcagtaggacagctgtttctgttcctagtcgatgaaaggcatttttgtcaaaatattgaatatatgatgtagaagatcacaaaatgtagaaagggaattctttagtacaattctctgatttatgaagacaaaatattatcactcattttatgattaaagcacatgtggcttagagatggtgattgcttaagccttacagctgtagatgatggttgactttattgtcaagctggattttaagcaatatatgcatcattgttataatcaggcagtactgttgactggaagaaagctttctcttctagatttctccttgcaaatgaaagaacattgcctgcttttgaatatagcatgattctttgtcatttcttcagtaaggacagttttctagatactaatctaatcaaagaggcttgatggtatgctttgacagagtgtatttccaggtcccatttttagtgtgattgtatagtgctgatgaaatataaacatgcattttttgttagattgtttttttgttttggtttcctacattttaaaacacagtcagtggtaccataattaacagcattacccataatatcaaacctatttttttgaagttgctcctaacttttatattattattaatatactcagctcctccccatagatgcaggtgttatacatctatggtaccactcgtttttcccccaacagttatttactgaatgtttatttcatgcctgactcttaaaatgattacctttggaagtcagatgagttaggaaattgctgatattttctgtacttttaaaggttttttagaatattgctctgtaatagaatttgttgttaacaaatgaagtagtctagataattagttgtttaccttaatgtgttttttaacttcgagaatatgtttaagagcaattattttaaccttcaaaattctctgtagtttctagtgttgctgccttacctaagaaatattattttacaaacaatatttaactttagaatgtataagatgcttcttaatttctgctgctaccaggtgaactagttattttaaattcttaacattttataaaggtaatatatgtatatagtttaaaaagtcaattaatactaaatagcttataaaggaaaataacatccccatgccccacctctctccatccaatttctgcttcttagagactaccacttccgataatttcacagcttcttctgttgtttgctttcatatttctaaatgagaagcgtttcttgctatagaagatgagaatttgactgtcatactctttgactaacagcagattaatatgccagaaatgaagatttttaaaaagtacatgagagcaaatattctccaaaggaatgatgtttccaaatgagatactttgtagtactgtttattattaatcacctacagaaaaacattgatattttactctcatctctgagtactttatggtaaattattgcctcagtttcatgatgaggtttattagttaaaaaaaataagcttggccgggcacagtggcttacacctgtaatctcagcactttgggaggctgaggccagcagatcatgaggtcaggagatcgagaccatcctggctaacatggggaaaccctgtctctactaaaaatacaaaaaaattagccaggcatggtggcgggtgcctgtagtcccagctactcgggaggctgaggcaggagaatggtgtgaacccaagaggcagagcttgcagtgagccaagattgcaccactgcactccagcctgggtgacagagcaagactctgtctcaaaaaataaataaataaataaataaataaataagctctattggccgggtgtggtggcttatgcctgtgttcccaacactttgggaggccgaggcaggcggatcatgaggtcaggagttctagaccagcctgaccaaaatggtgaagcccgtctctactaaaacacaaaaattagccaggcatggtggcacacgccagtaatcccagctacttgggaggctgaagcaggagaatcacttgaacccggatagtggagtctacagtgagttgagatcatgctactgcactccagcctgggcaacagagtgagactccatctcaaaaaaaatttttttctctattttcttctagcagtttataatattaggttttacatttagatttaaaattcatttagagttaatttttgtagagggtgtgaagtaaaggttgaagttcctttttttttttttttttttttttttttttttttttttgcaaatggacatccagttgttccagtatcatttgttgaaaagactatactttattcattaaatggccttggcacctttgtgaaaatcagttgaccacagacttgtgagccttatttctggattttctgttctgatcctttgatctaaatattcatccttattctaatgccacactgtcttaattattatagtttttcaaaaagttatgaaatcaggtaatgaatgtattccgacttggttcttctttttcaaaagttcctttggctattctaggtcttttgcatttttattttaattaatttatttttttgagacagggtttcactctttcacccaggctggagtgcagtggcatgatcatggcccactgcagccttaaccttctcgggctcaggtgattctcccatcgcagcctcctgagtgaggagctgggactacaggtgtgcactcccacactctgctaatttttatattttttgtagagataggctttcaccatgttgcccaggctggtcttgaactcctgggctcatgcagtcctgccacctctaccttccaaagtgttgggattacaggcgtgagccactgtgcgtggcctgcatttttacataaattttagaatcagtttgtcagtttctacaacagagcctgctggaatttttattgggattgcactggatctataaattaatttggggaaacccaacatgtattaactattgaatcttctaattcattaacatgaattaatagacatggtatgtctattacttagatattttcaaatttcagcagtattttttaggttttcagagtatgggtcatacacatactttattaaatttttccttaagtattctttgatgctattttaaatagcaattaaatttggcattttggttttgtgaactgacttcgctaaacttaattgttctaatagtctgtatattccttaggattttctaaatagacagtaatgttgtttgcaagtaaagacatttttatttcttccatttccttctgtgtatttccttttcttgttttatttcactggctagaacctctagtacagtgctggatagaagtgatgagagtggacattcttgccctgttcctgatcttatgaaaaaatgcattctttgaccattgagtgtgactatagtttttcttagatgccttttaggttgagtaaattcccttcttcccttatttgctaagagtttttatcatgaatggatggtaaattttatttaaatgctttttctacatctatttaggtgatactgtcattttcttttttattctgttaatatggaggattacattgatggatttttgagtcttaaacctgcattcctgaaataaatcctacttattcatgttgtattttgtactgttgcagtactgatactaacaacacagagctaaaacaaacttcacaggtttgaggatttagtccccaacatgtctgccctcgctacagatgccagccataagttcaggagtcctcaggccactctcacatctgaccaactggctgcaaattcagaggttcctacagccccttcaggtttgataatttgctggaactacttataactcaggaaagtgctacactttgtctgtgtttagagacagagtctcaactgtcacccggagtagagtgcagtggtgagatcaaagcccactgcaacctcaatctcctgggctcaaggcagtccttctgcctcagcctctcaagtagctaggagtacaggcatgcgctacaatgtccagctgttatgcttataattgcaagttttattataaatgatacagatcaggaccagccaaatgcccagacacagagagagaggtctgggaggaacctggacacagagcctctgtgctttttccatggaatcaggatgcattactctcctggcacatttatgtgtttaccaaccatgaaactcacccaagtttcaggttccagagtttttattgggatattattacataagcatgattgattgaatcattggttatatggttgtcaattcccagtacttctctcccctgtgttgggccacaatcagtgactcaaagccccaaccctctaatcacatggttggtctttctgatgtgaccatcccctatcctgagttatctctccttggcataaactcaggtgtagtccgaagacccactatgaataatgaagacacacctaattactcagaaaatttcaaggttttagaagctctgtcccaggaactagggtactttctgtatattattgggttcaatttggcaaaattttgttagaatttttgtgtctgtgttcatgagagatgttagtctttgttttgtttgttttctatgtaatttgtcagggtttggtatcaggctaatactggtctcataaaatgatttggaaaatgttccctctctctttattttttcaaagattttatgtaggattggttttatttattccttaaatgcctggtaaaatttgccaatgaagaactttcaggcctggagttttctttgtgggaaggtttttttaaaaattattattttaatctctttaatagatgaaaggcaattcagagtttctgtttcttcttgagtcagttttgatcatttgtatctttcaagaaatttgttcatatcatctaagttatcaaatttagatgatgtggacaattattggcataaagttgttaataatattctcttatccttttaatgtatgatgtatgtagaatctgtaatgatgtacactcttgatactgtttttgtattgtaatttttgtattttattcttcatcagccttagaggtagtttatcaatgtgttgattttttaaagtcagctttcaattttactgatattcactatttctcattttctatgtctttcattcctgtccttggtttttattatatttctctacttcagtttctcaacgttagcagtcttgacatttggggtcagataattctgttttgtgcatcataggatgtttagcagcatccctagcatctcctcacaaaatgccagtagcctcctcctgattgtgataaccagaagatctccagacattgtcagatgtgttggtgggcaaaattgcttacagttgagaaccgttgctcaacttctttcagtttagtttgttcctttttctactttcttaaggtggaatcttggatcattgattttggacactaccctcccaacagaaggatttaaagctaaacagttgtgtttaagcactgctttagctacattcaacaacttttgatatgttgtgtcattaagttcagaatattttctaatttctctgcaatttgttctttgagctgtgatttatgttccaaatattgggatttttctaattagcttactgttgctgatttctaattaaatttcattgtgattggagaacttactctgtatgatttcagtacttttagatttgttaaaaatcatcctttacaaagcacatttgtttgagatgtagtatgccaaaagatttgtcaaggacttacattagggtgtttgctatatttgaagtaagaattgatttttaaagaattcagtttgtatgctattaaaaaattttttcctgtttaccaaagtaaaatgtacatacaaaaaaagcatacaaatcctgtgtacagctcaatgaatttttacaaaagcaaagaaatattacaaatcttagaagccccctcctgacttttccagtcactgtcaccccctccccaaggtaactgcaattccaacttttttttttaattccaactttttatgccataatttagttttgccagttttgaactttatgtgaatggagttatgtagtgtgtactttttgtgtgtgtttggcttttttcattcaacattatgttgaaattgtgtagattaatccatgttattgcacaatagttgtagttagtttattctcattgctgtgtaatattacattgtatgaatatttcacaatttatccattctactattgatgaatgcttccagtttggggccagtatgaatagttctatacaagcattcttttgtatgtcctttggtgaacatgtaaacatatattggcttggtatatgcctgtaagtggaaatacttagtcataaagtatacatatatccagctttgatatgtaagttttaaggaaaaaggttattgattatagttattgttgtgcatcctgtttagatacttgatgttcgtgggcttagttattgtggtggtaattgttttgtcattgttaagaaagaagcaatacatttcttatgaggcattttttctaaaagtttatagtattcaaattttactgtttttaatggtttttaaaaatgagatgtacttttcgatggaaacaaatgcagaaaactaccgtcttaaaagaagaataataataaatagaagttttactgttccactaatcccagtatattttcaatctcaacccctttggtatatccttgaaagatacctgctctactatagctaaaattttctggtttttttgccctctacatgtatgtgtaagaattgtaagctttaggataccagttagttagaatttagctttgtagaatatgctcttttcattgtgtggagggcaacatctgtgaggcactttaggattagaaagtaagttaaatgaaaatgttaacaaagtagggattggctcattaattctgcaaaattagaggtcttttcttttgctagaagagagtattgaaattctggagtggggatttttattttctttccacagtggtactactcttgagccaaactgtaccatttcgtatagtttcatttctatggttcatttctttgactgccaccaaactacaccctaaataatcacaagtttatgtattggagctatgttgtagtcaatgaaaagtcacatatctggttaaggtagtcacatttcatagataatgactcccattcaaatagggaatacattaggatgcctctcttaaagggatgctgtttgcgaaaaagattacctgtgattcaatgataaaatgatagaaatgtctttgtcattggaagttgttaagtgttcagggtaagggtgtttgaaaggaagacacaattcattagtgtttgctctcagaggtgcattttattgggagaagaaaagtgggctaactagatgggttattcagaacatctcagccttacacagggaatttatcataattgaatatttcaatggaacattattggaagggcttggttggacacatacctcagagaagcaaaggggttgtttctgaatgtgctagtgtgtgatacatttaattacttgtttatcgcctgtactgtttggattactttctctgtgtacgtataattaggcatctctctctgtaatatactcctaaaccttgtactgtcctcacagctgactaaatgataaagtagcttcagtcacctatcttttctttcagtttctctttccatcattatggttgttgtttgcttatttccaggctaattcaaagtgttattgagaacctatcaatttgttgtcccatgtagtatagttaataacgttttgggtaacataattttagtcttttaaaaaagtaataaaaatactaacagtagctagcatctattaaatacttattaggagctagatgtttttacatctgtttctctaattctcacagtaacctggccaaggcatgtgtaatactccagttttacagatgaggaaactgtaaaccagcgaggttaaataatttgtctcaaagttacacagcctgtgtgagtgacagagttaatatttagattcatgactttctttctctaacaccatgggtctttatgatctttttgtgttgtttgctggttttgctttggacttcacaactcgacttgtttgcttatcttatcccttccacttggaatggcatctccttaacagtttcagactctactagtagcaaatgtacctattatttaagccttagaccaaatgccacccttctaaagcttttcttacagtgccatttggaagtaaactgtctcttttgagctcccacaatactttgtacctttctttgtatatttattttgccttcagttataattattgctaaacatatcttaatttacccaatggagactgtctttgatttcctgtagtgtaagacagccttgaacactgaaggtactcagtatttgttgacttgacattacaggtaaaaacccatcaaaataggagtaaacactattgatgcttttgtaaaaaaaattggaagaacatggcaacatggtaatgatttgtatatttatgatcatttttgcttctcgttatttgaaaatcttgctaaattttgctggtggtataattaaatgtggcatgcatttcctggtttggtgaaaaggttcataatcttagctatcattttctttaaaaaaagataataaagaaatgtctgtttggcaggcaggaagaacctgctgttttaattttgttcacagcagtgggtcagattatgatcttttggagctagctttgataatagactcaatataatattggaattcaacaattggttattgttgagtatattatctcttgcactgatggctgtcagtgggattgccagactgtttagaataagtttatggctgtttagaataagtttatggcaaatagtctgctcttctctaaatacaatgtttccatttattacttactgtagtattttatatgtgcattgtctttttgttttgtttttagttttcttctcagagagaggcaattaaaccaaaacttgctcaccagtgggggtggggaatcttactattgattatttattcaaattttgaattatattttttcttctaaacgtctttaaataggccttttccctcttctaacttgactgattaacatttaattcaaacaaagattaacaaaattttaaacacttttatggtgataaaggcacactgtggttataatttattgaattttgagctccgagtctctgttaaactaggatttctgactgtgcttttatagtttcttctatctgaattcttgaaacatcataagactctatttacttccctcaaaggagaagtccttttgttaagataatatttttaaatgaatatcagtctttttcatttcatgtctcttggacttgatgaaattactcatgaagcaaaaggtggataggagacagtaactcaaagaagtcttttggcccttaagctaagacagtgggtaaaagttacacaaattatgagaccagcaaaagcactcttaattttaaggtttgagaatctgattattaaatatccattgaaataatcagattaaagccataaatattctttaagcatttgacattaaccagaatctacaaaatgattaaagttttagttctagtgacaggaatttaaattctccttcataaaattcctgttgttgttaatgttaagttattgcaaaagtaacacatgttaattctagggaactagtataacaattctaatagtagctaactttagagttcattatattttgctatttagcataaacctgttagtccttataacaatcatatgaggcaaatactgttatttttcctatttcatagatgaggaaaccgagcacagagaaatgaagggactttactgaggccatacagtatttggactcaggcagtttggccttagagtctgtgcccttaacctctgttcagtattgcttctcactgagtggttaagatttggggattgttaagatagacctggattgaaatcatggctgccactttatactcttgggagaggagtatatttcttgacttctctgagcttcagtattcttgattataaaacaaaggttgttttagggataaaataagatatattaactgcttatcccactgttccccagatgctgtgcttgttcaatagaaggtatcatttaaaacaaataatgagaaacaaaaggaaaaaagtcaccaaaactaaacaataaccattgctaacatttcgagttatccagtcttgtaaaacacgtttcttgattttattaatatattttttctttatattaattttctttcatgtataactttttcttgtttttgtttcacaaaataaggtgggaagacttggatttgcctgtatcactaagcagtaacgcaagcctttttcagcttctatgctagccaaaacttttttttctctgtttagaagtgggtagatggagatagaggaggacatggaagtacacccacttttttttttcctttttaaataaaaacaggattatgtttaaaatttcttatataacatctgcagatcaacaaaatctaggatgctagaagtagggagaacatgtgctagtattacttttattaaaataacaatgaaactccagtttcagactgttaagagttgttaactgaaaatactatatttgtataaacaatcctaatgaatgtagactatttcctctcgatgagtgagcttgtagaagtctgaccatgtgttgcattgttaaataaattcactaggtgtagcatagcagtaactaatctgtctttctatagctttagcaacaaagcatggctaatgcttttttttttttttgtcttttagatctacacacaatgagctggaaaagaatcggtgagtcagtgatgaggtacagctttcacttacgtttaaaagcaaactcaccattttacctgtgaaaataatgtaatagtgcatatgtagttgtaattttatttttcagatgtatagcccattgtgaatctgatatatatgtattttctccaaaaaatgatttaatagtaagcttatagcagctagaagacataaatacatttttaaagcttactcgaatttgagttttaggtatagcctttatttctgtctctgaaaatgagttaattgttacaagctcatggtttaaatgtagttttgctaaagggtaggatttctaaagagtaggtaataagcattacaaattggagggcattgaatttttcttcctttgtaatttgttcattcattcattcatttattcatgcattcaacaactatttatcaaacatgagctgtatgtcagtgccaggcaggcagaatgctttatataggaaatacaagaatatatatgatagtttttgtccttaaggaattcagaactttgtaagggaaagacaggtaattaaagtactatataatgtggtaagtatggtaatggagaagcagaaggtactagagggtactgaaagatattttagaaggtcacctgatacctttttgaagggagtcttggaaagttctgcagaggatggtgagtgagcagtgtatactgaggaaactgcaaaaggttcagtgtgactataaaagattgtaacatgagtaaagcatgccaggtgttgaagagtcttgtctaccatgcccaagagtttagacttcctgagacccatagggagcagttaaataattttaaagtggattatcatatgatcagcctgtgtcttggaaatatcgttttggctacagcttgaagaattggttggttgggagaagggataccagaggcatgaagatgcttttgaaggctattgcagtaatctaggtaagagatgatggtggccactgagatagaagtagacaaagtaaagagtatggaatggagtcaatagaaattggtgattagttagctatggatagttgagtcttagatgatattactgttaatcaagaaaagaaatagaagaagaagacaaatttggaagagaacataagaattgtaagagtaaaatactttctttttggtgtagagattagattaatagcagccaggcatggtggctcatgcttgtaatcccaacactttggaaagcccaggtgggaggatcgcttgaagcaaagagttcgagaccagcctgggcagcaaagtgagatgccctccatctctaccaaaaaaataaaaataaattagctggtgtggtggcatgcagtcccagctactcaggaggctaaggcaagaggatcacttgagcccaggagttgaaggttgcagtgagccatgatcatgccactgcactccaacctgtgtgacagagagtgagaccctgtcttaaaaaaaaaatgagagagattagattaataacaaactgaaatcatatgtaccagctgtttttgacaaataagatctcatgaccttcaactttttgtcctccctttaacaaaaaatatattggctagcccaactgcctcattgcaagtaagtttaaatgtcaaatccccttgaaaaggcttagcatagtttttcaggcagactcagtggcttttactactttgcacagtgctgtgttcttgtctcttattgtaaggctgaataggtagcattgtaattatttctgccaaatgactatgccccaaatgcaaagatactgttttgttcaattttgtatcctcagtgcctagcatttgaggcatgtataggagacaatggctctagtattgagtgaaggataaaactggaactcaaagttgagtggtctagtcaaagacattttggtagttagtggtagaaactccttcgttttaaagaatcttttctgccttttatttctgatttattaaagatctggatggataaaggaaggacatatctggctattttaaacataacaaaaaagactaagaaatgaaacttctgaggatcctaaaaataaaaccttaaattgaagtttactctaaattagatcatagagtatgttttgggcccatggattaaatattgataaacatgtggcttttatagttatttcatttgaatgtggtccttgggagaccttcattggaaacctggtgaaaaccattaacactggactagggactctctttagtaactatttggaatggagctttaaaaatctttgattcagtgatgatgagcattttttcatgtgtcttttggctgcataaacgtcttctttcgagaagtgtctgtccatatcctttgcacactttttgatggggttgtttgtttttttcttgtaaatttgtttgagttcattgtagattctggatattagccgtttgtcagatgagtagattgcaaaaattttctcccattctgtaggttgcctgttgactctgatggtagtttcttttgctgtgcagaagccctttagtttaattacatcccatttgtcaattttggcttttgttgccattgcttttggtgttttagacatgaagtccttgcccatgcctatgtcctgaatggtattaccgaggttttcttctagggtttttatggttttaggtctaacatttaagtctttaatccatcttgaattaatttttgtataaggtgtaaggaagggatccagtttcagctttctacatatggctagccatcagagaaatgcaaatcaaaaccacaatgagatgccatctcacaccagttagaatggcgatcattacaaagtcaggaaacaacagatgctggagaggatgtggagaaataggaacccttttacactgttggtgggactgtaaattagttcatccattgtggaagtcagtgtggtgattcctcagggatctagaactagaaataccatttgacccagcaatcgcattactgggtatataccaaaaggattataaatcatgctgctataaagacacatgcacacgtatgtttattgtggcactattcacaatagcaaagacttggaaccaagccagatgtccaacagtgatagactggattaagaaaatgtggcacatatacaccatggaatactatgcagccataaaaaatgatgagttcatgtcctttgtaggggacatggatgaagctggaaaccatcattctcagcaaactatcgcaaggacaaaaacacaaacactgcgtgttctcactcataggtgggaattgaacaatgacaacacatggacacaggaaggggaacatcacacaccggggcctgttgtggggtggtggaagtggggagggatagcattaggagatatacctaatgctaaatgatgagttaatgggtgcagcacaccaacatggcacatgtatacatatgtaactaatctgcacgttgtgcacatgtaccctaaaacttaaagtataaaaaaaaaaatctttgattcagttttgtttaatgcattttgcagattatttctgactcattgataacctttttaaaaaccctcacagaagatgtgtgcatcacccatagtattactttggtatgccattataagttgtttaatctagcatctagctgtggcataggtataacacatgtggttttattacctgggctgtgtgtaatctccaataaaagtcatttgttcctattttatttacttagatataagactttcaggctggtttcttaccctaccttacttcacttaaggcatgatttcctcatcatcttctaatagctttggaagtgctaatagatattctttattagcccaaaggactaataaacattgtttatttctcaaattatttcttccactctctctttactctttttcctcctttactctctctattccctgaggcttcattgaaagatgatatagaattaacttttccaagatatatttgtttttaaaagggatttttatcaacaaaaataaaactcgaatttagaataataatctgtaccctacttctgggaagttaccagtggtggtctggcaaaaaacaaaaatactggtagacttaggataggggaggtggtttagcaagaaggtggcacaggaatatttttaaaatttaaccctgtattatttttacattttaaggcccccatccagttctgtttaacagtcctttttaccaaggcatcatttttatttgacgtgttaaacaaagaaaagttattctagctttggcatcctttaaaataaatagaattttggctttacctttgatctgcctttgagtgtgatgttatatgaagatagtaactcactatgaaaagattagttttgtctttgttctgaaaagacattcctgaagtaattcatattccttaaaatttgccactttgtataacatattcatgtcagaaattgcttttttcctttttagcgtggttctgaaatcttggatataagcttctctgagttagataagctggaacaactgatacctcagtatcagttgttactgattacagtacattaaatacaaaaattagacaggcatggtggtgcatccttgtaatcccaacttcttgggaggctgaggcacaagaattgcttgaacctgggaggtagaggttgcaatgagccaagatcacaccactgcattccagcctcggtgacagagcaagactttgtcaaaaaaaaaaaaaaagaaggtacactaatagtgtttttcatactgaaaaatgaaactcactagtggtctatgtgatcatttagtgaatcattttgaaaaagaaatggaagaaaataccaaagtacactgcatgaagtaaagttaaatatggaattgtgaaacctgtgtatactggattatgatataaaatactgtgggtcatagtcaaaacctactactctggatataagcttctctgagttatgataaaaaacataattatttttattggagcaaatgcagtgagatttggagtaggtgattttaaattgctggtgaatggctaagtaattccagatagctatctcaaacaaaaccgtgagattgttgaagccctggggtctggccttaaggagataatagccaccaaatgttgaggttcatactaccagatctccgagggaagcctaatggtggagatttgggttttggcaggcccagagtagttggttgtgatccacaattaccccaggattcccatagcccattagggagctctaggtagtttcaggactgatagagaaattcagatttttttcttggataggtcttgggagctgatatctgcccaaatccttgttggttatactgagtatgctctagatggttcagagcatttgttacctatgtaccaaccctgtccccctaggcccacaacaggtcataataggcctaggagatggaggggaagcaaaatacttcagttgttctgcattcctcaggaacctatgtgaatcatctcatggtaaacttaatgagactttgagattgaagaattaagatattactttgcccattggcttatcttacagtttgggtcctttgccagataagacacaattcagtatcagtacagattttagattgcctcattgttttttcattttcttaattcaaattgctgatgatgttttagaaagaatcaacaactttggccaggcatggtggctcatgcctgtaatcccaacacttttgggaggctgaggcaggtggattgcttgaggccaggagtttgagactagcagggccaacatggtgaaaccccatctctactaaaaatacaaaaattagccaggcatggtggtgcatccttgtaatcccaacttcttgggaggctgaggcacaagaattgcttgaacctgggaggtagaggttgcaatgagccaagatcacaccactgcattccagcctcagtgacagagcaagactttgtcaaaaaaaaaaaaaaaaaaataacaactttaacaggactctgatggtcaagaaccttagtgctgactgcaggagaggccatttaaccttaaatagctgttattccatcaaaacaaaaggcttatccttattataactttggcaaagctagaagggccaaggagaagtgactaagtatttgttaaaaaaaaaaaaaaaaaaaaaaaaaagagaaggatgtctagtgagtagtaataggtattctccatataaggactttcacctacctctgagggaaaattggaaattagcatttatagagttcttactgtgttcctccactgtgcaaggctattacataattctgtaaggtagaaaggcagaaagtttgagtcaaagtgtcaaaaactggccattttatcatcatagctacaatttgaaacaagatggatacaaacacaaaacagttctaatcatgatcctttttgatcatgaatatgagagttacggttaatatcaatctttcagcaacaattaataaataccatgtgtggcatcatgatagatcaaatgaagtataagataccctattctattctagttaaggttaaggtcattatagtttggtatttatatttcacctttcagtaccattatctagttaagttaccagtaaatgtctagaaaggtacactaatagtgtttttcatactgaaaaatgaaactcactagtggtctatgtgatcatttagtgaatcattttgaaaaagaaattgaagaaaataccaaagtacactgcatgaagtaaagtgaaatatggaattgtgaaacctgtgtatactggattatgatataaaatactgtgggtcatagtcaaaacctactactctgggtagttaaggagaatgtatactgagccgtgaagaagagagataatttgaatataagaaaagaataaggaaaggagtcagtgtgagtagagccatggaagcaggaatgtagcatcataagctgtgttcaggaaggagtgggtagaccgtattgagttaaatagcagagtcttatcagattagtagtggaagatgaggctgaaaaggtggtttggaattagactgtggaatgttactgaatgccaagtaatttggattttattttattggcagtggtgaatttttgaggcttttgaagcaaagagataggcatgtacaaagcatttaaaaaagtacaatctagtagctgtagaagcagggagaccagtttggatgctttctgaagtagtccatataataaaaagatatgagtcagcactcaggtgatagaattgggaacagaaaggaaaacaaaggtctaagaaacactataaataaaaagtattttctgttaattggtactacttatttcttcacatagctgcaaaagttatcttctcttagtgcctactgcagcaaggaaaaaagaagtgatcttctcaaagaacatatcaaattgagtcatttctctatttacagtcttccattggcttctcactacaattagataaaatctgtggcctacaaagtgcaccactctatcccttctgtagctcttctgacattgcttcctttcctttctttaaacacagcgtgatcatttccatcttagggcttttgcacttgctgttccttctgcttggaaagccctgctctagttcttcatcattatttagttctcaactctcaggtcatctgcttagagaataataatcacctcctggtcacactctatcacattactttttatgtcgccttaacatttatatctgtctgagttatttattcatttatgctgtctgacttctttcactaaaatataagtttcaggaaggcaggactttgtcttatttaccctagcacatagcagtcattaagtaaaaattcattgaatgaaaaaatgatatgtgatagtagatttataatcaacatgttttcacattataatgacttcagtgaaaagtgatgaagatatatactcttgagagttcagttgacataataaaagaattttataataggcaaatagaaaatttaatgaattcttaagatgtaaataaattatatgagaaaacttgataagtaagaacagcttaaaggatttttaccatgccggagtttatcgtacttttttagaagcatatggactcatttagtcctttaggataccatacagtgcactaagataaggataggtaattttataaaggagaacactttatctgatgaagtttatgctatacttgtgggatctttattcctttctcatcccatgacttgaaaatggtaagcatttttacaaggaaaagatttgtttatacttgtaggcaagaatcctgtaaaaaatttcaaatttttcatgttagaatttttgatggattagttctgtttattccaattgtttggacacgataatgaatgcatttttttttctatactgcctatcgtgtccccattttacatggatgttttgagagagtgatggttttggtctgccttatcttagaacaaaacgtaagagtaaatctttatgactgagggttaggcagtgttttctcttggtacatcatcagactaatttaggattccttggcaggaagaacatatctgaaatcgttttcactgcctattttgtatgcttttaagatatttgtttaaaaagggcatagtttttttacacggtgtacacattctacaaaaaaatgtacacttgttagtaggaaagaaacaacattggtttgacagaactttctttaaaactcttacctcaactaatagtacttaaagggtatttgcttgcattaaagtcaggttgcagggttagggaagtcaaacttttattctaggtttgaaattaacctataacttcagctggattaaaagtctacagttttagattgggtcctgtaattttggaaagtttagtcaaaatcccattttagccttggtttttactaagatgcaaagggtattagtatgtctcaatatgaaaataccttagagtaactttctcaacctgataaacagcattaatgacaaacccacagcttatggcacttgtaatggtgaaaaactgaatcctttctccctaagatcagaaataaggttgtcaactttcatgacttatactcaacattgtactggagcttctacccagggcagttagataagaaaaaaaaaataaaaggcatccagattggaaagaaagaagtaaaaccatttctgcttgcagatatcatgatcttatgtacaggtatacttcatttattgcactttgcagatactgcattttttagcaattgaaggtttgtgtcaagcaggtcaatttctaatcgcatatgttcacttcatgtttctgtgttgtattttggtgatttttgcaatattttaaactttattataatttcatacgttacgatgatctgtggatctgtaatctttgatgttattattgtaattgttttagggtgtcacaaaccatgcccatataagatgcagacttaataaatgttgtgtgtgttctgatggcttcactgactggctgttgccccatctctctccctcttattgtccctgagacacagctatattgaaattaggccaattaataaccctacaatggccactaagtgttcaagtgaaacaaagagtcacatgtatttcactttaaatttaaagctagaaatggttaagcttagtgaggaaggcatgtcaaaaaccaggatagactgaaagctagatctcttgtgccaaatagccaaattgtgaatgcaaagggaaagttcttaaagggaattaaaagtgctactctggtgaacatccaaatatgaaagtgaaacagccttatgggtgatatggagaaagttttagtagtctgtatagaaaccagccagaacattctcttaagccaaagcctaatccagagcaaggccctaactctatttaattctgtgaaggctaagagaggaggaagctgcagaagaaaagttggaagctagcagagtttggttcatgaggtttaagaaaagaagtcatctccatacaaaagtacaaagtgaagcagcaggtgctaaggtggaagctgtagcaaattattgagaaaatctagctaaaataatcaacgaaggtggcaacagattttcaaagtagacgaaaccatcatctattggaagaagatgccatccaggactttcatagctagagcagaagtcatagagaagggaagtcgatgcttggcttcaaagcttcaaaggctgggctgtcttaataggggctgatgggctgatgtagctggtgacttgaagttgaagccagtgctcatttaccattctgaaaattctaggcccttaagaatgaggctaaatctcctctgcctgtgctctgtaaatggaacaataaagcctgaatgacagcacattgtttatagcatagtttactatttgacgcctactgttgagacatactactcagaaaatttttttaaaaaattattgctcatcgacaatacacctggttacccaagagctctgatggagatgtacaaggatattaatgttattttcatgtatgctaacacaacatccattctgcagcccattggaccaaggtgtgatttcaactttcaagtcttattatttcagaaatacatttcataaggctgtatctgccatagatagtgaatcttctgatggattgggcaaagtaagatgaaaataattacatgtacaatagcatctaaaagaataaaatacctaggaataaatgtaaccaagaagatgaaagctttgtacactgaaaactattaatacaaaatacttttgaaataaattaaggaagacctaaatagatgaaaagatatcctgtgctcatggattggaagacttaatattgttaagatggccgtactttccaaattgatctatagattcagtgcaagccctatgaaagttccagcttcctttttttttgcagaaattgacagctgataatataattcatgtgaaaatgcaaggtacccagaataaccaaaacaatcttgaaaagaataaagttggagagcttgcatttcctgatttcaaatctcactataaaactatagtaatcaaggcagtatggaactgaccaaagaacagacttactgattagtggaatagagttgagcgtgtagaaataatttctcacatttatggtcaactaatttttagcaaggatcacaagacaatgtaatgtattttcaacaaatagagcggacacaactggatacctacatacaaaataatgaggttggatccctacctcacaccatacacaaaactcaaaatggatcatagacctgaattttttaagagctaaaacaataaaattcttagaataaaacataagtgtaaatctttatgatgttgcattaggcattggttttttacatatgacaccaaaaacacaaccaacaaaagaaaaaaatagacacattagaatttatcaaagtgagctgggcatggtggctcatgcctgtaatcccagcactttgggaggctgaggtgggcggatcacctgaggttgggagttcaagaccagcctgactaacatggagaaaccccatcgctactaaaaatacaaaattagccgggcatggtggtgcatgcctgtaatcccagctactcgggaggctgaggcaggagaatcacttgaaccaaggcagcagaggttgcagtgagctgacattgtgccactgcactccaacctaggcaatagagtgagactctgtctcaaaaaaaaaaaaaaaaaaaaaaaaaaagaaatggccaatatacatgtgaaatgcttaatatcagtagtcattagggaaatgtgaatcaaaactataagataccacttcacagttactaagatgaccatctagggttgctcaccaactttgtagtcatccattcatcataccagttaccactgatcagagaaaggtcttgaaaagtccactgagtttgcagtttggcacttaaaaactgataatgtcatcatcagctgatggcactgcacagatggctcaacactttgcaattacttaagacatgtaattaaccacaggtaagttttcaatatattatgtggtgccagtatgtaatgtggtatgagtatttaataatggagaaagattagtctctatttagcatatgaaaagaatatacctttctttcagctggaattaccgtcttccagtaatttaccaaaataacaaacataaagggaaagaggaaagactcctgatatacgttctctgggtttcttagaaaacatggaattgttcctttggccacagacatgcgattctacaaaaaagatgatattgtagatatcaaaggaatgggtactgttcaaaaagaaatgtccacaaatgttaccatggcaaaattggaagactgcgagcatgctattagcattgttgtacacaaacaagttaagggcaagttttttttttggttttttttttttttgagacggagtctcgctttgttgccctggctggagtgcaatggcgcgatcttggctcactgcaacctttgtctcccgggttcaagtgattctcctacttcaacctcccaagtagctgggattacaggcacccaccaccacacctggcaattttctttctatttttagtagagatggggttttgccatataggccaaactggtctcaaactcctgacctgaagtgatccacccgctttggcctcccagagtgctgggattacaggcatgagccactgcgaagggcaagattcttgccaagagaattaacatgtgtattgagcatattttttaagcactctaagaactgaggtagcttcatgaaatgcatgaaggaaaatgatcagaaaaataagccaaagagaaaggtttctgggttcagctgaagcaccagcctgctctatccagagacgcgtactttataagaaccagtggaaagatgcctgagctgctggaacctattccctgtgaattcatggcataataggtgtttaaaaaacaaacaaacaaacaaaaaacaaaaaccctctggaaaaaaaaataaggggggaggtataggttttaaggatttctaattaacaatgaaatctaacaaaattaagactagatattgaaagaatttactagttttataaatttcatttaacaaaattaagactagatattgaaagaatttactagttttataaatttcatttaagatgtaacagaatataacttgattatatttgttatgccttgaacaacaaaattaagaagtatagttgtggaggaaaggaaaaacaacattgtccagtgatcaggaagtagctactgatccagttttctggattttatttctggcaaataaaaatggtggttacttcccatttttagcctaaaggtagaaaattgatacccatacttttaattattgcaaaagtcctgaagaagataattatattctttgtacttttttagacagtaggagtccagttgcagggctgaattatagagggttactgtagaacacttatgtcttggaaagtaggggccactcatttaattgaattttcttatgaaactcttagaaagtaggtgacactcatttacttgaattttcttaggaaccggataaatatgtaaattaacattatcaaacagtatgaagaacagtatcatttatcagagagctatataattcatgtatttctttttgtatgcaagtaaatgaatattttaactgtaatttctatagggataggaatactgaaaactgtagaccaactaaaaatagttgtcagagggcagagataggcacctgttagagttagaattgaatgctatatgagataaagatgaagtaatgtgcaggttttagagataaaatagaggaaatgtagccaggataaaattacacatctaaaatgcagtctgtacaatgaagtcattgcagttgtgtctagatagattcacagtttctatactgacctttgttagaaatagttcattaagactaagctttcttctccctgacctaggttacatatacagcaaggtgacagaggctcattcggagacaaagactgaattgtaggaaccaagtgtttttagtacttcagctagccagttattaaagtttaaagcaattctacaactgatgtgtgggaagaaatgagattatgagatcttaaaaaataatcagaagtactgtaacttgaaattcagcttctaaaattttgtatagaaataaacaaataagtcagacattgaataattgacatggtatattatagcgaagttgtggtagctttttatgcaagtgattgcagagtgcctaacttaagctgtaacttgtttaagaaaacaattcttctcaaactatgaatttgtaatttaaaaaaacaacaggaagagtttaattaatagattttcttgagatattttagatgatgcaatgtaaacaaatttattttatatgcagctttgaggaatgtgtttgattcataaactgactatacctttagtactgatgcttgtaataattacacaggagaatcctactagactttaaggcaatatgttattttgctaaattcttttgctgcatattgtaaaggaatttgtccattgtaaatgctgtgataaatattgaaaattgaatagtaagcacaattcaaatactttttcttaaactagaatcttcttcatttaaagataatttctattctggtacaaattttggcaattaaagcatgccaagaggaaaatcagtaaaaaatgtctttttattagatgagagactttgttagtatcttgcatttatattctaaaaatgaagagattcagatattttgatatattttagctgttttgaggaagaggataattctttacttcttgcttatctttttctacttattctagtaaataatgtcaatcccatgacagtgaaagtcccgtaagtgttactagtgaaaaactttaggtctaaactaggattcagtaatgacaacagaatttcctaatctgattactagctaaccagttctttaagacgaatttgtttggaaaataattaatcagcactatgacaaacacatgacatagtgcttatactcacatcttctaaatcaagaaaagttggaacttaactcataagtaaatgacttccttgttttgttgttattttgggaaaagccaatggagaaagataggttttaatactaaacatgattttggagccaaattgtcaaaaatgatacccagaatccaacacagatggcccttgggagatatgtaatgcattgacatgagtatcgtaccagaagtcagaagacataatttttcctttcatctctactactgataggttgtgaatgttgtataagttaaaccacttcttggagtcttgcttttcttggctattaaaggaggatctctagatgatcttagaaatccctgcctacatgtaaagttttgtacagttttgtgaatttttgagttaagtaattattggcatattagaaacttagttgttactctgctgtttctgaagcattttccttgatacaggtgtgtgtgtgtgtgtgtgtgtgtgtgtgtgtgtgtgtgtgtatacgcccacagatatatacatatatataacgcttgagacacacacacacacacatgaaatgaaagaccagcaggaaaaatcagcttagaatctcacttcatttaaaatttggtactttgtaaatatctaaagattattataatacatggtactgtagctataataaggttttaatttataatgaagaactttgataagtagtaaatatttatataagactagaatttgccctaagaaacatatatttgtgtgtatactacaaacacattcctcaaagctgtgtgtacacatacacacactcatatggatagatatagatacaaattctgaaatttaaatgctcaggaacattcaggaccctgtcccttttggaaaactacttaccactgacttctaaggaaatgtagttaatctggtaagcattattgtgttataacttctggccacttttttgtattctctgacaagtttatatttgctcaggctccagaaatctggttttgtggttgtaactgtattatattgttgtatctcatcagtcactttaataggctccagtgatcactggatggagtgagccatataccaggaggaaagagcacactgctcttacacaaaacaaggagcacagcttagctcatctaaaatatttgtctataaacaatctgaagagaaagtagctacaggtcagtatgttggaatctttcttcctaaccatttagacaataaaagtagcttttaaataatgtcctcactgctttgataatctgccaagccccattcctaattctaggacatgtctactgtttattttttttgcttgcagagttgctaagcgttggaaatgagagctgtgctgactgggtccactagatagttatgctgtgtttaattgcagccttctatggattggccattttcacttctcattgtccccctgtagcatttatcataatgactattcaaaccattttttttttttttttaacccctccaagagagtgtgaggcaaaagccaaagctctagaggtcatcaaatcatattgtggtttacagacaggaccttagttcctctaaaattacgtgatagagatgaatgatctttaagatttcttctagactaaaaatttctgctatttgaagtacccaatcccactttttactcttagatctagtttttgaatcaatggctaggacccatatctcccatctcctagtctaaagatatttccagtataccattgtgactcttcatttctccctttgctgaaaatatggatgcctggtctgagctttttcatcttctcctatattttctacctttataacttcagctcagattgactatatactccccctgccttgtgaacttctactcatgtacagataggcatgaacaagaataacaaaagtgtttataataaaaattagaagtaacatgaatttctgttaacaggggaatgactaaataaatgatgatacatccataccatgtagcaagtaaaaagaatgatgtagatgtgtatatgtgtatgtggagagatttccaagacatattaaatgaaaataagcaaattgcaaaatggcatttcaatatgatctcatttatgttaaaaaataacaaagcaaaatcacatacagttggctcttgtatctgtgaactccacatccatggattcaaacgactatggattgaaaatatttggggggaaaattgcatctatgctaaacatatacagactttttccctgtgtccttattccctaaacaatacaatataacaactatttacatggtattcacattgtagtgagtattataagtaatctagagatgatttaaggtatagaggaggatgtacataggttatatgcaaatattacaccattttatatcagggacttcagcatttggggattttggtatcccccattgatactgagggatgattgtatttctatatgtacatgtatgtgtatgtaaatgcatcgaaaaggcacacctcaaaagagatgtcagatggatacacttttgttacttctggggaaaggagtgagattcaaggggaaacgatcatgttgattttattgtcatagtttctgtagtaagagtgcattaatttgtgaacttaaaaaaagattttttttgagccacttagtttacagtactttaaagtaagatttttaaaaaggcaataggtgtattctattcatacatttccacagataataaaggtgggagagaccttagaagatcatctagtagagtactgaaaatctaagtccctgtaagtaatatgctctaccagtctggttaatgacaaagtcaggatgagaaactaggttttctgattcgcagaccagagttttttacactaccttcaagatgcacagctaagatacataatttttcacaaagtgtttcctgattatccaaactgatctctctaaattcctatctcagattcactgtttgtgtcacttgtatgaattttaacccatactactttatactgttatttcctccctttctagatcatttatattcttgctagagcatatatattccatgagggcagaaactgtaacttgcttgtctttgtatctgacacggtgccttgcacttagtacttaaggtgaattagtaaggaacatttctgtagcaggctctgcacctttcgttagattcagagaaaaaagttgactttggccaagtcaaataaatagctgagttttttttgtttttgtctttgctggtaaaacctgccatgtcgagatagaaaatattttaggaaggcacatagtgagatatttgctaccctgcaaatatattccctttccaaggaaaatagttttgttctccactcctgcttcaaagagaacagtttgtccccatagaatattctaggtaatatgacccacttaggaaatatgtggtgattgtgcttcataatgggacctctttgctaaagttgtaccatgagaaaatgcctcttgagtgcaatggttttacagatgaaagtacattttttttctgtatttgaattggtacagcagaccaagaaactccattgtgacttcaagtttactataattagcatagaagctgtgacagatcttttctgttatgaaaacctttccttagaatttttggaatttatacaagtatctggcccttgaggtgttgttaccctgttctgtctaaatagctctataatttgatatagcatctttgtagatttcagcttgcttttcgagatatactcttttctatgattttcatctgcagttgtgttaatcctattttccttctgatttttttgtttcttctcacagctatttaatttgacatcatttaaggcctgtagaattatttacagaaatagaatctttcatggaagtttccatgatctgctggaacagtgatcttggacagagccttaggaagacccattcctttttggaaagctaattgtctctcttagtttagaattaatagctttaggaaaatatctcaggatgttctaaatttccatacatgctgctagctacagagattgttattgaagtggccaatgggttcatctggagccatttttctgttaccataatttaaaagtgtgtgtgtgtgtgtgtgtatgagagagatacatatacacatctttttttccacaaaggtatatgagttacatatatgtgagttctgagtttgattcatttgaaggctgtgaagcaattagagataagaggttattaaaaagaaagtaatttataactattttagtgagtttcaaatatggtataccaaaacttgttcctgctgtattgggcattgtattagaaattttgaaagtagttttgtttagcacattctgatttgctgtgcttagaaagaaatatattagtaattgattttttttttttttttgagatggagtctcgctctgtcaccaggctggagtgcaatggtgtgatcttggctcactgcaacttccgcctcccgggtttaaacgattctcttgcctcagcctcccgagttgctgggattacaggcacccgccaccacacccagctaatgtttatatttttcatagagacggggtttcaccatgttggccaggctggtctcaaactcctgacctcgtgatccgcctgcctcagcctcccaaagtgctgggatgagccaccacgcccgtcctagtaattgatttttaaatattcttgagatcataaaattttaaacttcatccagatgaagatttcttatgtagattaatttactcaggcaaattcctgttaactttatcatattatttttctagattttaactggctttataatttgccataataaaattccattcatttaaaattgtagtcaacaatgttttagtttagtattagttgaatggaatataaaaaaattgatttttaaacattagcttgaggctagtgctggttagtgctttatgttaaaaattttttttttttcaaatggtggtcctcgatggagaaatgttttctagaaatggtatacagaactgtattctacttctatttaggattttttagttcggatatgaaaaagctggagctcaaatatatgtttgagtttggcaccttcaatttgcaaaatggacacatctttcttgacaggtgaaggttttgatagagctctgagtacggaggagttagatgctagtacaggcccaacattggttaggaataaataatagttaagaattgtttatcttttagcaacagttttactatattcaataaagtacaatttggctcctctctctgactcttcttcctcaccctttgcactttagatgacataacaaggaaatacgttaaaactttagatttagggtttgtttcaaacttccttgattacttgatcttgaaaatttaggatttgttttgaacttcctttgattgtcaatctagggtgacttgcaagtaatgggtaattatgctaatgtctcttaacagtcttatataccccaagatgatgttttctgatttgaaatttttggtggaaatggagttcatttgaagtggtatagttcctgacactgacagaggacttataaagataattacaaatcaactgacaagcacttattagacattgtgtgctaggtaatgggaataggataaaagaagtagaagtcctgagccctgctctggaggattatagtctaggtagaagacaaaagatattataagctcctataagcagcatataattaagtgctaagttgtatgtgtttgagatgggagttgaggtaaactcatagcagggggttatcacgggctgaggctaatatgaactgcttagacatgagtggttattcctctgcatggttctctcttggagtttgccgtaattggtttttatcatgttttcagtatgtttaaaagggctttcaggagaaacactacatctgagtctcttttgctcttttaatcattatagttgtcacttactctggggtgaaagtgaacttgcagcttttcagcatggataagatagatataggcctgagagtacatttggagaatgtgatacaaccttcttactaatttatggtcgcttttctggtatgtctctgatgacagctaaaatacagagtctttttcttttctttctttttttttttgagacagagtctcgctcagttgcccaggctggaatgcagtggcatgatctgggctcactgcaacctctgcctcccaggttcaagcagttctcctgcttcagcctcctgagtagctgggattaagggcatgtgccaccatgcccagctaatttttttgtatttttagtagagacggggtttcaccatgctggccaggctagtctcgaactcctgacctcgtgatccgcccacctcggcctcccaaagtgctgggattacaggtgtgagccaccgtgcctggcctaatacagtgtcatttttaatggctgtgttttctatgaaggagtgtctacaatggttctccctctttttgtggtggcaatgttggtgaatgcccaaatgtcttgtgaaaacaaccaaaagcctcaactgggacagatcaatctatcattacctctgagtaaatgaggatacctgaacatccagttccttagccctccataatttcttagaggtcattgtgttttggagtactattgaagatgtcaactttattctagcaggccctatatgatgaagagcctactaacttttgagatcatgtatttcacgttgtacattatattttatctgagtgcttctcatcctttaatagagaaccccaagcaagatgtttgcatgggaaatcttgtgccttttaaaactttctgcctgctttagtgcatcaacctgtgattattgatttttaaaaattttaacccataacctatctcttataagcttccctaaaaactaagattgataggggattttatgccattacagaaaaatatatgtttaatagaatcctttattttctgatacttttatcctgaagtaactagagtaaagctgaccctttaaaatctaaaatcaaatgagaaagatacaggctttctaatgttgaagtgtaatggctaaattaagataagggagaaacttggaaattaggaaaaggtacacttagatttcttcatcagaaatcataatgactaaaatgagggtgtctattccctttgaatcctaaaagaggaattctcaaattaaaaaaggcagtcttaatacaatatgtggtaactatatggggacttactaccccaataaaaaatagaaataaaatcaaaccaagtttagatcagttctttgataaaatattgctattgggctttagtaaggagatgttaggggtatgtttctgtaatatattggttactgtcttggaggacagccatcatagttttttctgagccatctgttggtgtcattgtcaaaagtgaactctttggcatttggaccattgatgcaaccaaatatgtcatttttcttcagaattgtaatgtttgtaggctttttccatcttgattcactttattccagcctgattcacaattattcctttacagaacagcttgtattcgacaaagctgtgaaaaaaatcactcttctctaaataaggttctttttttgattagaaatcccatctttgcagttaaaacatttgtaaacataacacaatttagatagagctgattgacttttcaagactgctatttttataatggaaaagaatttttcttaaagaagcaatttggtgatggggcccttagaatgtccttgaaaacagctggaatttactgctagcatatattgggtcagatgaatgagggagcatgggtttggctgatttgcaatgttcaagaaatattgatattcttagaagacaatacagaatatatgttgggtcttattttccaaaatgtcaaagtgtccttcatatgccttttgttctgtgagataacagttgttggtgatcctgaaagatgttttagaactttcatcctgcagtatctgaaaggaaatgtagccaagattggaaaatttaacctccatactctactggcttctttagttggagtagtggtcaatatgttcttgctgttggaatatacttaggcgagagagccacacaacctgcctgatgaacaactaaaatattgactggcaatggtaacaaaataaaacatgttcccctccgcctgtctcttccttcttttctcaaatccctggaactgtatagatttttcagggctgttctcctgagctattgatgaaatgaaaataatagcacttgtgtagcagtccttagaaaactgtaatggtattgagctgaggctggaatcatataaaataaatactagagctttgattcctctctcatttaatcttttcctgggcttttctagaggagagtcaaactaagatttagacaaatataaatagaagcaagtcacacagtgtaatgttgcaacccagatataacttgaacccagtcttttacttgataaagaggagataattgtaattgttgttaatctatcaaacacctttcccttttcagaagggttttaaaaaataaagtagttcttaaggcatgttcactttctatctacctaaaagtgctaatctgtaagtgccctactatatataacactgagaaaatttctgccttatcagaggagggcatgcccaggattggtgccaggtgttgtgttatgctaggctgcctccaaaagttactctcaaaaactactcttcagttgggccctttgtggtcaggaaaaaaaaaaagtgatacagtataatgaaagagaggtcaaaacagttaagtaatttagaaataaaaagacataccaaaacattgattctctattattatcagggactatggcgtattttaaattctgtaaattttatttttccagaggttgcaaatggcctgtaaatgcttcagttattaacaacaacaacaacacatacacacatacacactggccaacaattcctctttgttaccctttttctaccgcaaattttatctcctcctcaccaaaaaacaaactgcattttgattttgggaaaattgttctaaaatgggactttaaaaataattcctggctggcttgactggattggcagatgtccagcaatgccaaaccatttgccatctgccagtagtaagcatggttaccacttttaatcgtttagctctctatttcaggttgctcatattcagtacaaattatgaatattcgccttccagggatgaattaattcttgggccagattgttcctgttccatttaataaaatgtctttcctcctatatgaatattccccttaaaatgagctattatacaactcacatcttattagtagggccacttttaaaggtgctttgctattttcattttctgcttctagatgaacagctatattacaaagcattctttaaatgtgctgttttgtgctatgtaagatcaccattttaattagagatcagtaacagtatttcgtcatttccctcttccatcctggacaataatttgatacaataaagcaattacactgggctctgggtgggaatagagctgtgagagttagacttaaacttttgtagaagagaagacttaattcttgcattttgtacataaaattaggtcagtgtcttgtagaacattatcactgcgtctcagatctcacttgccagcacgtaggaagtttgttttggtttcaaaatgtactttaccccatggtggctggcagggtacaatactattgacatcactgtgtttcaaatagaaagttaacaagtagctactgttgtgattgcagattgccttcccagtccctgtgagagaatgctttttcttttggacagcaacacttctcagccccttggtaccattaaatcagccaatgggggctgccagaatagagatgaacaccaacaaaaggccaaagagtagaaaaactgttaataaggcaaaaatctttaatcagtttccaaattgatgtgaaagataattaaaaaatattctctcccatcgatggctaagttttgacagtagtccaggttcagagcctgatctctctagagaggagtatcccttccctctacccagacccctggaaagttgccaaaggaaaataagctattttgtatttagaacaaattgccactgttttctccagtgatgtagccctatttcccagactttgaaacttggaatacagaaagttcttgtgtgaccaaagaagaaatatggtgaatgaatgatcaagtttttctttttaactaaatccttataaacagataagagaggggaagtatgcatagaaactaaatttagcacagaatggatgtcaagtgagcaatttctgttaaatcactttggagtttgggttccttgtgggagttccagtgaagaacaaatgcctctggaacaagatttaattatttttttttttttcaaatgaggctgtcaaaaatgaagtcttccttagacatgaatgcaggataattaaaaaaaatagttgtttatatgttctgcactatagtcttcaacttagcaagcagtccatggatctggtaagcatacactagtttctcatttattacatgggattaagaactgttgacttaatttttttcttctttgcattgtggaatattgctttttagactttcccttctcataccttggttttcttagctgtttgttttcctagtcctaggcccctttcactgtaaatactttgataaagtcattctgttgtaaaagctgcagttcttaaaccctttgcttcactattaaaaaaggtgttggccggttgcggtggctcatgcctataatcctagcactttgggaggccgaggcgggcagattgcctgagctcaggagtccgaaaccaccctgggcaatatggtgaaaccccgtctctagtaaaataaaataaaaaaaaattaggcttggtggcacatgcctgtaatcccagctactcaggaggctgaggcaggataattgcttgagcctgggaggcggaggttgcagtgagccgagatcgcgccactgcactccagcttgggcaacagagtgaaactacgtctcaaaaaaaaaaaaaagtgttgactctcatcaagagttaggttggagactgttggttactctacatgtagacatctttggtggtatgcaccttattaacatttgctggtgatttcagctgcaccagaaaaaaaaaaggttaagagttctggcattcataaatagatctctcacaaatgctggcctggcatctgattatactgtttggaggtcctggtgttgattgttacctcaactttggtgagttagagagtcccagaaacatccactagaagtattacatctctcctccccactgtgtgccagtcattctgtttatttgaaaaacagaaatgactaaaagtatggattcactctcaattgaaatacagtgtgattagtatgaaatcaagtatcatctgaggaaggagtatggcaaggatgatcttgtggaagaaattgtttggccatggcctgaaaatgagttagatgcccaccaggtggacatttggagagaatgcattccaggtagagatattggcaagtataaaagcacatttggttatggaagaggtttgcaagggtatgagttatgggaaatgaggctggaaaggtggtaggcagaggactaaattatagtcttcaaacaggtaaagattatactactgacaacttgaaaaatcgttatagcatttagctcagtggtataataaggcactattgtttactgatgataattgttattgactgagtggcacttcatgttcttcatatttctgagttgtaaagactaaatgacatttcagcctatgtggtatctgtgtagtttgagaaagaatatgtgactattttgtcatcattaatttacatctccctttcctctctcttccatatcttctctcccttctcccctgtcccttctttttccctctccaaacctttgagagacataatcccagccatgagtcaaaaatgatgttccaaagtccatagtgatgtgttgtgatttgctgtagcagtttgaacatagattcctggaggccctgggatgtagtacaggttgagcatcccaagtccacaaatctgaaatgctccaaaatctgaaacattttgagtgtcaacatgactctcaacagaaatgctcattggagcatatcagacttaggatttttggatttgggatgctcagctgagtataatgcaaatattccaaaatctgaaaaaatgagaaatccaaaacatttctggtcctaagcatttcacataaggaatactcaacctgtctgaaataatatgaaatttgaagtcttcttttaaaaacacattttgcattatctgtgtttgtttttatataaaatatttttcttccaaatttttgaaaaaattatgacttctggaaaggatagtataaccctgtggcttcaaatatcctctggctcagtgttgaatacctctagaggtatatatagcctatgctaagaactatttatattttattgaaagaaagtggttttaaaaagtctcccaagaataagtaacatgcatctcaaccattttaattcttatttgtatacagataagccctttcatgctgaggctgacaatgtgacagaataatttatattattatattatatattatatgtaatttgtagaatttgcagctttattataccacttgttaatatttctatttgattattttataagataccaattaagaaggctatttaagtgaaagctgcttttttgaaaagtgagaagagagtcccagctattttcctaagtttttatttctgtcatcattgagtcccatgactaccacaatcagatctgacactagggacctgccacttgccacgttactacctgggagttaacagtctgtttattttctgtgaagtagataatatatgagttgtaggtgaaacatacgattatcaaatgccattttgtagaaatagcttgtttagcttttttttttttttttttttttgtgagatggagtctcgctctgtcaccctggctcgagtgcagtgatgcgatctcggctcactgcaacctccgcctcccagtttcaagcaactctcctgcttcggcctcccaagtagctgggactacaggcatgtgccaccacgcctggctaattttttgtgtttttagtagagatggggtttcaccgtgttagccacaatggtctcgatctcctgacctcatgatccgcccgcctcggcctcccaaagtgctgagattacaggcatgagccaccgtgcctggcctttgtttagctttcttatttcatgaaccgaataagctgaacagcagaatatgatcatacatgttttagtaaataaaactcatgaaccacaatatgcttttgatatatcaggatccatttttaatgtcatttttcattaggaaaacaggcaggcagggttttttggggggataaatttgggttttcagaagattctcaacacattaagttttagagacactttggtatatatgtgtaggaaaagtagctagctgctgtcacgtgcaggagtgtgtgttgggagttgagaaacctggccacaagccactgcagctttgaagaatgtggctcatgagaggactcatagttcattacgtaacattcagcagagcggaaaatataagcactgtctccatcacttgacttgctttccattttgatttagttatctggtaaagtctaggtatcctatagtggaagaatgaaagacaagcaggttccaatgaaggaccatgcttccaaaggcatcagccagtggatcgtttgtggggccaggcgggggttagatctattattgttggacaggggtattagagttttgaaagactacttgaaaaacataatcaaatgatacttggagtttgttccgaaagggtattctttcctctctcttcccacaacagtgtgcgcttcctattatagttgatatacctgtgctttaaaatagcacagctactagtagaggccattttataccaaaatcatttcccttcatgttctgtggtacatcagtttggcagtagaggttacagagtttgaaatcaaaaggagcattggttccttcagggaaaaatgataccaatctaccaaaataaaagccaaacagactctcattgttctttatcccacaaggggcttgccctttttgaaggtgtggttaattttgataggactcttctctctaacagggttagtggctgggaattaccttttcccctgggcaaaacccactttaaaatctcattttaaaacagaactcaaagtgtctttgaaaataaaagtactttgggaactcttcattgtgtaaccccatccctctcagcaaggggactccagttttctcacagggcacttcctgctgcagtacctaattctaactttgttttactataactcatgctaaaataggaaaggtttcagctttacagtttttattagctgttcatgtgtttttaaaaagtatgtgttaaataaaaataaagtaaatgtccaccaaggagctaaatttttaaaaatcagtttccattaagtctagttctataaatgtttcagtaccaggttttttctacttgctgtttgtctaatgttcatcataatattcagaagagcagccttaactttccccaaccttctttcccttcttttactagaggtgcaggaccatgcctttcatgaatcgttattctctatgtcagctcttctctcccttggagacttgaaaaacatcatcatatgatacttgcagtttttttcctcagtgaataaggattttttttttttttttttttttggtggagtctcacactgtcacccaggctggagtgcactggcgcgatctctgctcactgcaacctctgcctcctgggttcaagcgattctcctgcctcagccgacagagtagctgggattacaggcacggaccaccatgcctggctaatttttgtatttttagtagacacagggtttcaccatgttggccagactggtctcgaactcctgacctcagaagatccacccacctcggcctcccaaagtgctgggattacaggcatgagctaccgcacccagcctgtgaataaggattttcaaatcaaaccaagcttttttcttctattgcttgtcctttttccttcccccaaagtcttacagcacccatgatttggcagcctcatacaggaggctcttgagctaccagtcacatgagaatgaaggcaagaaaagaagggaccagatggcatcaaaagatatgcctttctaggtcactggtggttaagcttgcaatctggttaccaacagggagacttatgggggaaagggtggagagcagcatcattgaaaaggaagaataattttgccatacaattgctgttctaagaatttgcaggagagaaaaaaaacttagacactgaggagaatcgatttttctgatttaactctttccagtttacagttacagggcatccattgctcttggaagggtacatttacctaagtggcagctaaggacatgtggtaactgtgtgcattatttggatgggactctccctcttggtcagctgctgttcttcaactgccattaaccatttgttattctactctccaaatgcctgtttcatttaaatacaaaaacttaaggaaatgacatttatcttccacaggtacacctctgtccacaagagcagaggaaataattcactgttcatctttcatattaataccgattttggaggactgtatttacaaaatatgaagaatggcatcactggcctttgtgagatatctcagggtatattttcttggtgtaagctgtatctcagagcagatgaataattatttgacaataaaatgttcagtagtggctaaaaaaaatatcttttagagcattctgccttccctgttcatttaggcatttttcaaactttggtctgggtacctcctgatttgtcggtgcattgcagatcctcagacagctgaaactagctgattatttccatatagaattccagctcagttgttttcccttgaaggagagaaaataaggcattttaaattttatgtttaaacttggtcccagtctataaatttaggtcctttactttttaaattacctagaaaatcctcgctttttcatacacaaattctatattattcaagtccaaagtcaaatttgaacctcttttacaggtctacctcctccaattacaatctctccatttattcagattttttcaattttatgtttaaacttggtcccaatccataaatttaggtcctttacttttaaaattacctagcaaatcctcactttttcatagacaaattcaatattctttaagtccaaagtcagatttcaacctcttttacaagtctccctcctctgattacaatctctcgatttattcagattctgttgtccttgatatctgtatgactcattcagtatggaccaaatgaaacaaagtaatatgtttctttctgtagtcttgagtgtaaactcttaaagttaacattttttttttacttttccttctcaagcaagtgtctggaacagtgctgagtatgtaaaatccatgtaataaatacatggaatgattaaagagagaaaaaattttaatatgttagttattttcattctaggttttagcaagtatcacaaaacggaaaatagactcacctttcttttccttgatgtgaaagtttatggaatcattttgattttcctttctttcttttcttttctttttttttttttttcttcctgaggcagagtttcactctgtggctcaggcagaatgcagtggcgccatcttggctcactgcaacctccacctgctgggttcaagcgattgttgtgcctcagcctcccgagtagctgggattacaggcgtgcaccaccatgcgcagctaacttttatatttttagtagagatgaggttttactgggttggccaggctggtctcgaactcttggcctcagtctgcccaccttggcctcccaaagtgctgggattataggcatgagccaccatgcccagcccattttaagtttcttaaaaactaaaaaataaaagataattcttacatatactgaagttttggagttaatttgaaccaaattgacaaggtattcttgcggtaatgtgcttgttaactttactagttgctttgttgagttttttagaagactgaatttaaagcaggattgtctattagtgtagctgccagtctttgtttccacgctccagtcatattatatgagtgcagttgttatcatatgccataataatcttaatgaagagtttaaaggcactttttactctggtgttttgttgttgttgctgtttgtttgctttttttggtctgctgagcaagagcactgtggtcacatgagaatcctcacctaagaaattttccagttaaaaatgaaaattttgttaaaggttctatgcatttgggtagtacagcaggggaggaaagtgactttgaagttgttaaatatcattaaggagaatccattgatatacctttgatttagggattcctttatccacaccagttacgtcaggtttcagcctggacccaattattagacctgaggtactgaactcaataaagaaatttgaaatggaaatactgtcagacctttaactatagttaggttagtaggtgctagaagaatcttaattcattagccaaacctctgacctcactacccttaatcatccttgcttgtcatgacataattggctgcttattgccttctcctacctctcttttcaaattgctagcctttgagaatttcacttgacattatttcttgtctattaagacagagaaagcgcatagtttggtgtgtgaattagcaaaaccattttagtcctctttcagaagagaatggagggtgtgtgttttgttcttgatgcagttaagacagttaccaaaagttcaattataggtctttaaggactaggggtaaactgtgaacgtatttgtggattttcttttcagatatgctgttaactgctgaattaccttaccccttatgaaacacaggaccaaagatgtggactagtattgttttaggatgaagttaaatactcagaactctctcatcaccatgatcatagttcttttagggcacagggaaggtaaatccatgaggttctctgctagcatttctaggagaaatttccctcaactttcccacaggaaggatagattagagaatgcaatgactttcagtaagtaatttttgtcacctgttgtccttgtggattggaggcaggtagtgagagagacgagagaggaagagaaaaaagaaataaaaattaagctaacgagctagcacacttagataggaagcaggggattattttatgggttatttctgtggctagaattgaccacagggcatatattttgtctaaccctaccctagctggtcacagaattttgctgtttctgttgtattggagtataagaaatcaacatttttataagtgaaaagtggttgaatatcagaaatttcatgtggttcaaactaatatataacaacatgtaacacactgtaggatggctacagttgtagagaggtagggtgtgtgtgtgtgtgtgtgtgtgtgtgcccacacacgtgcaagcaagtaaaaggtgggaggggggaaatagaaacttgtgagcatattatattcccttggggtaccatagctgaaaacctctcctctcgcctgtggttttagttattcaagatcaaatacaattgtcctggtatgttttcacacttccatattaatacagttgagacagtttatggggtgagttaaaaaataaaccatcttgacagagattaccattggggataataatctaaagtgagtgttgtctaaagagtacaacagaaatagcagagactgaaatgcggccacccctacattctttgacagtggagaattaggggtgtgacatctatcctataggctgaataaatgcaaattattgtttatcttaaaataggttttatgatatttctagtgaaataaccagactgtgctgatttgactttttgtctttcttagacgagctcatctgcgcctttgtttagaacgcttaaaagttctgattccactaggaccagactgcacccggcacacaacacttggtttgctcaacaaagccaaagcacacatcaaggtgagaatttttactttcagatttgcacaattccctcagttctggtttaattattggcactgattcctattcatatacatcagctagttcaccatgccctccttaataactgacctcaagagaagtctttctaaaaacttaccagctaatctgatgggaacaacataacctgattaaactaaattgttttgacagcgtggccatttgaagaactgagaacactaggaaaataacaattaccctcttcatactcggaaggcagttgtgccctctggtggagatgacttcatttggctgtgtccttccgtatttttccatcaaataccatactagaggaagtttctccgtggagattactttacagacttttagaagtccatcttgttcaagtaacatagcattcattacatacacacaaaagtaaagacaaaactattttttatttttaaaaatatgtatttatatgcattctcattttggaggctttaaaatgtatttatatatttttatacacactcacacatgtatattcattcatgttttctctgctaaaggaggaatcagttttattgtttgtactggactatacacaaatgtaaaaatcatttcatcatttcagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgttctgattcagagcgaggtaggcagcttgcctcttctctaatgaaatactaaacatctctgtatctggatttagggaaggtatgttgggaggcactgtatttgctttctttctagccaacagagtaacattgtaggttttatgcaatcataatattgtctacagcagtgccagtgtggactataaaactttttgttttttccttgaaaaaaaatatatttatatatttatattataaattatataatgtccctcaatttaggtttgtctgatgttttcaaatgattagattgagggtatacagttggggtaaggaatatcacagaaatgatgttgtgcccggtggctcatgcctgtaatcccagcactctgggaggccaaggcgggcagatcacaaggtcaggagatcgaggccatcctggctaacatggtaaaatcctgtctctactaaaaatacaaaaaattagacgggcgtggtggcaggcgcctgtagtcctagctactcgggaggctgaggcaggagaatggcgtgaacccgggaggcggagcttgcagtgagccgagatcatgccactgcactccagcctgggcaacagagtgaggttccgtctcaaaaaaaaaaaaaagaaaagaaatgatgttgtgcctttctcaatccattgtgtcaggaagatacacgatgtcgaagtttttactactggtgatgtgaatttttatatgtagattttaaagtacaacaccctttatttctctttccatctatcctagaatatttatctttgacagagttaaagaacagaagtcaaccaaaaaagaatggtttgaattttactgattgttcttcccaaagcttccaccacatcaggcttcatatcacattaaaagatcccagaggtgaacactggtgatttgaagtcttacatttggagaaaggagctcatgagctctttaggattctaaaacatgagacaagtgacagagtttttttgtttgtttgtttttaggactctgattttgttttttgtttttgacttttttaagtggaaattttcaaacatacttagaatagaataatgaactcctgtatacccaccattcagtttgaatagctgtcaacttgtttcatctgttcttcactacgctcaccctcaatattttttctggaatgctttaactcaaatcccagataacatcattttgcccctaaatactttagtatgtatcttgaataaataggatttttaaaaatgtaattataatgctattataataccccacaaaattaattcagataatcttttttaatatcatctaatacccagtctgtgatacattttctccagttgtctcaaaaatggcattttaccattggtatgtttaaatcaggatccaaaggccacattgcatttgtttgatgtgccttttaagatattaatctataataattttttctcttccccctacaccgttttggtagaaacaaaaactgatttctacataacatctcaaaaagacttctttggcagagaaaacatgaaggaatatataggtatagatctgtgtgttgtatatatgtacatatttttttaaacatcaagagactgagtcatttttcttatagaatttcctacatcctagatttggctggttgaatcctcatggtgtcatttaacatgttatgtcctttatattgactgtaaactggttggtagatgcagaatacttcataggtggtgctttgtacttcctgttacgtcagtattgtgtgtagttgttgttgcacttttaatattaatcaataggttcaggtaaggtcattttaatacatttatataaatgtatagcctttaacttaacagttttagcaattattgcccttatttcattgggtgtcataaaatagtgattttctaattgtgtcattcctcttgtatttataaactgtttttctcctataaacattttctcatcaacttttcggttatcctgaaataaagttcatacagggaaggtgggataaatgcttggtcttggtttttgctttatcagttttccaaacagagttggtaacctagcagcttccagaagtaacaagttttggttttactattttttgattatatcatgaactcatgttttgctgtactgaatgtgttccaatccattgcagtcatccttttaaattcttttgaatgctcaaactgtcccagatttgctgagtaggagccttttaaatagttttttcatcctttttaacgcaacctttttaacacaaccctaggagttcttgtttttctgttttgttatttttctatgtaaaagtttatttttgtgtggcagttttcaagaaaagtctaccagaggcagtagcaagaacctgaagtacatgctacatttatcagtaacagtgaaatatagcagaaataaccctgaccttggtgtcccagtctttcctctattgctaactagcggaaacctcttcttaggtctttaggttttagctgtccttcctgttacctcctccttgtacccaccccaactacctccaaatttcagagaggagggtgtattttcatcactatagctctcatttttttttagtgttcccagtgtaccttactttagcggtaccttaccaagtaccatccttatcctgagctggcaacctcctttttgtagtgttatgggggcttttagttaacatctgtggtacacttggctaaagcagtttctcattttactttgtttttttgggtttttaaaaaatttttttaaacatatttttaaattttattaaaatagagatgggccttgttgcccaagtggtctcaaactcctgggctcaagcaatcctcctgccttggcttcccaaagtgctgggattataggtgtgagccactgtgttggccatcattttactttattttgactgagttcagcatgctcttttggatagtgtgccttgttattatcttctagttgtaggttggatgagtgttcagtggtgctgggaaacaatggcttctgaagcaattcggatatagagccaatatatgaattcacagattatttggacagctgcctacattttaaaaacatctctagaatctctaaaacttttgaagcaacaagcccttttgaaaagtatattcctggaaatagcttcaccctgtccttttggcctcacaagaatccacttttttttttttttttgagagagagtgtctcgctctgtcgcctaggctggagtgcagtggcgtgatcttggctcactgcaacctctgcctcctgagttcaagtgtttctgctgcgtcagcctcccaagtagctgggactataggcgcgtgccaccatgcccagctaatttttgtatttttagcctagacacggggtttcaccatattggtcaggctggtcttgaactcctgacctcgtgatccacctgcctcagcctcccaaagtgcttggccgcacccggctgaatccacttttttttttttttaaagcagttgtgattagtgtgaacccttaaaaagtcagtgccaaatgtgaaacatcaggctttgaatttaagtaaggtaactgaaaaatcctgggtttcactctagctctgatgggagaaaacaactttttaactcctttttgtttttaacatgtgtattgatttatgtatattattgatgattgaatatctagtatttaacaattaagatttttttttttatttttaagagacagggtctcactctgtcacacaggctgaagtgcagtggtgagaccttggcacactgcagcctcaacctcctgggctcaagagtgatcctcccaccttggcctcccgagtagctgggactactggatcacccactatacccagctaatttttgtgttgttgttttttttttggtagaaatgaggtctcactttgttacccaggcttgtctcaaactcctgcactcaagtgatcttcctgccttagcctcccaaagtgctgggattacggacgtgagccactgcgtccagcaacattatctattgatagctgagtcaaatatgtatttgtggtgttttttttttttaatgtttggcttttaagtctgtatactaccaccaaaatggatctcactataatctgaagacttttaagtctcaggcccttatttcaagctatatttgatgcaagaaaattaaatctaagacatatacctcaaactctactttataatgacttgtttgactgactagttgaagatctttatgatgaatcctagaagtctgttgaactatctgtagaatggcaccaccaaaggcttggatgggtaaattttctagtttgcctatattaagtttatgctcctgcccaccctttaaggcaaccctgattaataaacagaactgagaattagtttgtggtttaatgcaaaacagatgtttttaaaccacttgggggttgggaccttttaatattaagcactaattcccaaatacgccaagtgctttagggaggtccagacggactggcgtcaaaggatttaggaaatttgctgcctaaattaagaccaccactgtatatcagacattccccttggcaaaaaatattcctgtctcttcaccttgttcctctgttctccagacatcactgataataagcttgttgtgtaacatttcttatacctcttttcctcatgctgttagtttttgaaggtgcgctatactcgataattaatgttcttctttttttttttttcctttggcagaggagattgaagtggatgttgaaagcacagagttctcccatggagaagtggacaatataagtaccaccagcatcagtgacattgatgaccacagcagcctgccgagtattgggagtgacgagggttactccagtgccagtgtcaaactttcattcacttcatagaacccagcatgacataacagtgcagggcaaaatattcactgggccaattcaatacaaacaatctcttaaattgggttcatgatgcagtctcctctttaaaacaaaacaaaacaaaacaaaactatacttgaacaaaagggtcagaggacctgtatttaagcaaatacttagcaaaaagtggggcagagcctcccaaggagaacaaatattcagaatattcatattggaaaaatcacaatttttaatggcagcagaaaacttgtgtgaaattttcttgatttgagttgattgagaagaggacattggagatgccatcctctttctcttttctagtttgctcatactacattgagtagacacatttaaggatggggttatgaacccttcctgagctttatggtcctaaaagcaaaataaaaactattcgaatgaaaagacaagaaaatcaggtattaatcttggatagctaataatgagctattaaaactcagcctgggacagtttatcatgaagcctgtggatgatcaatcctttattattattttttttttttgaaaaaagctcatttcatgctctgcaaaaggagagactcccatgaagccttttgaaagggatcatcatgcagctcaactttctgttggattccatgctaagcaagctaaccttatcctgcattgttagcactaggcacccagctgccacctctccatcctgctgcccttaggccacatgggagcagtccatgcatgacagcctctatcctacaaggcctatgagtatggattgggggggccaaaaggaaaaagctccatgtgcctctttgtctgcgtgggtcagaagagttgtgcacgcagattagcaggccaaggtctgagccacagcagcatttttatttcagattttgataactgtttatatgtgttgaaaaccaaaatgacatctttttaaagcttatccataaaaaaaaatagatgtcttttatagtggaaaaacacatggggaaaaaaatcatctattttgatgcagcatttgataatgataaaacacctcacacctcactctttatagtgcacaaaatgaatgaggtctgggctaggtagaaaaagggtcaatgctatttttgtttttagaatcattaccttttaccagcttttaaccatctgatatctatagtagacacactatcatagttaacatagttaagttcagcacttgtctcattttaatgtaaagatttgcttccattttcctacaggcagtctctctcttcctcacagtcccactgtgcaggtgctattgttactcttacgaatattttcagtaatgttattttcttctaagtgaaatttctagcctgcactttgatgtcatgtgttccctttgtctttcaaactccaaggttcccctgtggccctctcccttaccctgggaaggcctcttggagaccttacccctggctgtttggactttgtatactttaaataatttaactacccttaattacttaaaaaaaaaaaaaaaagctttatgattttcataacttattgctgattttaatggattgttaatttcagtcctgtagttttattttatgtttagatagggctgggcaaggaaaaagaaaataaagacaaccatatttagcagtgcagttgagttgtgtgttaatgttagactatccctttgtgagtgacactttaacagcattcactgcttctatatatagtgtaccatcttggtcatacattacgcctcaacatatacttgtgctcttcctttgcctccagaagaagtttttccttgattgtgctatgtttcagtggaagaaattctttgaagtagatgtgagtgaaaaactgcatgcctttagaagcccagtatcagaacttgctacgtttcaggtgctagggacttaatgaaaaacaggacaaaacaattcctttttgtggcccaggtaaattatttctggtttcacttataattactaatggctgagtcaagatgttgtctctgtgtttgcttactcttgatcaagtgtgagacagtttgaagactgtgctaccatacaaagtgaatgaagccagtgactaagcttctgtttgttttgttattctcatggccttcgcttgcattatttgggccttcattcagatgaacttgaggtgccattttgttgcatatgtacaggattatgggctggaaagcatttgttataaacctatagtgcacattttaactgccccctaaattacccttccctgggtttgttttccttggggtggtgtagattgtatgagtaagaagtattaattttttaaaagacaaatcaactttgaagacacaaaagttaattggaagaaataaaaactgtgaacgaagaatacctttctttttgtaccatccttctttatgaaggcaaaaacatgaatgggtatccacaccttaagaggtaactatctcctaaatgtctgttgataccaaatcagtatcaatgccaaatcaaatggcagtttgaattataattgccattcctgttctgcaatttaaacaggagcctgactggtaactccatataacctaactgcatgtggtttaatgtgccacattaataataatattaactgcctcaggtaggacacaaagccattctcatgatctgttctctaaataacttttgggagcatcctttagctacactattattcaaattgcaaacaagtctggaagttccactaatcttatttagggtaccctatttatagaacacctgagtgacatttatattaaaaggtacaggtaggccaggtgcaatggctcacacctgtaatcccagcactttggaaggcagaggtgcgcagatcacttgaggtcaggagtttgaaaccaccctggccaacatgatgaaattccgttatccactaaaaaaaaaaatacgaaaaattagctgggcgtggtggcatgcacctgtagtcccagctactcaggaggctgaggcaggagaatcttgaacctgggaggcggaggctgcagtgagctgagatcgagccactgcactccagcctgggcagcagagcgagactccgtctcaaaaaggtacaggtaaaacctactgtagcgcgttatgactagaggattctgaagtcactgcaactcaagtttctggttagaataggtatgagaactcctacagaaatgcctttctaatctccctgacaatgactgcttttagcattatgaaggaattttaagaggcagtgaggattattgaggcaaagttgctgaccaaaatcaggttcccaacagttaacccagaacagtaaagtgtgggaaaagcaagtgttttaattacactttaatcccagttccaacattgctgaccctagttaagttgcttgatttcttcatggagcccttttcttcctgaaaagctattataagtactacctctatcttgaagggttgtaaggatttaagctgatatatataaactaccaccccactccctgactgccatctaggaaga

SEQ ID NO: 16810 - DNA, 8612 bp, Human
agatcacatcaggtagtaagcatggagctctggaacttaaccaagagctccgctgtctgacgcccaagcccaggttgttaaccactgcaccactttgccaccaggaaggctgctctgtacgcatggaagtttgggaggtttcgaggaggtgatgcagatggacattttatctctagaggaagagaggaaagagggaattttttccttcctgtctttacctgaaatacttactttctcatattgatcactattgaaatggagtcagacaaggccttgcatctcatgctacgcaatcagttttgggtttcagcccagctctaccactgactagctctgacttggacaagttattaaatgcatctgagcctcaagttgcccatccgtaaaatgggaataatgttacctacctcacagattttgtgaaattggtatgatgtaggcacatctaaatggttaagcccccagaggccagccatagtagatgctgataaaaataccagttgttattaccgtatgtaaaatcttgtgtaattttctttcaagtgactgaactggcctttgcttaaacacttgacttctcaggaaacaaaaagctaactccgggtgtggggtaaattgagaattgcctgtggctggcccctgtcccacgcacccttccctgttagggatctggctgagagtttccattccgttcttattccagggcaggaaatggaaacacaggaagcagatggttggcatgggaaaggctcccaaagacacagccactgtcacccagccccttgtttccctctcagtctctaagggctcccatttttccaaccatcactagcttttctgccaccttcagagccctgtaaatgctgtgactgccagagtctaaccagcggttcattttagttttgcctcaaggtggatggtctctggttcccccttgactagaaatctggggtgtgggtagcctcccaaaaggatggctctgtaagcgggtctcaccagcaccttcaacaaacccccgtgtgaagaaggtcagaggcagggaagcccctctgcttgtggcctgacaacattttttatctaaagattctgagtaggtagtggttattttcatttctaaaaagcatacttttttgtggaggtggaggtgcattttaacatctctaaaacctgggtgcatcttaggatcaacagtgtcttaggtttgatgaaatacaccatataggctaggcttggtagctcatgcctataatcccagcacttcaggaggctgaggtaggaagatcgcttgaggccaggagttgaagaccattctgggcaacatagcaagaactcatctctaccaaaaaaattataaaattagccaggcatggtggtacatgcctgtaggcccagctactcgggagactgagacggtaggatctcttcagcgtaggaattcaagattacagtgagctatgattgtgccgctgcactgcagcctgggtgacggagcaagactctgtctttccaaaaaggaaaaaaaaaatacactatgtaaaatgtcaaggctgtaaaggaggacacacaccatgttgagtcctggtccattttatctgtaaagaaagcaagactgtcccaaggcataggagattgccctggtactctcagggcagctgtaacttcaacacaggcctgtcaatttttcccatattaccacatggcttctcatccttgtcagcgcaggaaggctgtcggcatatcctgcctcctggatatgtgcaaaaaagtgaactctttgctgtgtggattttgctgtcattgagtcacaaggcagtcacataaggtagagagttggccaggatggagatacaaccacacttggttgaactgccctggctctgaactccacttggaaaccagaaagggaaccacccatcttaagaaacaaataggtcggagttgttttttcctctctcaaatgaacaagctaatccaatatttcctgattgtcctttgtccctgcatccagggtggcccagttgaaatccttcccttcctctaccttggaagtgcctaccatgcatccaagtgcgagttcctcgccaacctgcacatcacagccctgctgaatgtctcccgacggacctccgaggcctgcatgacccacctacactacaaatggatccctgtggaagacagccacacggctgacattagctcccactttcaagaagcaatagacttcattggtaggtttagccattccccttcagttattttgggagcccctttggggcatgtgttcttgacttttgatgccctgatggaagctaccttcactgaaagaaaagtgtcttgtatatgccgctgctgagagttggagccaacatgggatgcagctaccaaaaaggtggaagggaggatttaagttgctatgaataggagctttaatttgcaagataaatgaattaatataattttatggcagtactcactgtcgatcttgttattgtttctagctgggcaggagctgagtgtatccctgcgtaatgctccacacaaggaaagcagggggaagaacctccctaactgtgcttctacgtaggttgggtttatttttaaaagcaaacagaaggattcagagagcactacttacgcactgagccccaagggcccccagcagctttccatactcttggtgaacggcttggggcaatttgttttgcattttcagctaattttggattaaagatagcacttgactcaagctccatgctgtatgcacagaaaagttggcatcttttgcctgctttctgcattcttgttacgcagttatttattccattgcatagacctgaaaaccgaggccttggcctctggtccctctgccaggaaagggctgtggccttagggtttccaggtcctctgtgttgcctggattgttctcccatttggcatcttctcctcccccatccatcttcctaggaggctggcctgacttttttctgtttcagatttgcaagtaccagtctctaaccttgtgatcatgccccgttttccagctcccatcttcctctttaacatacgtagttgttgaaactgacgcgtgattttcctgtctcttgttccaagggatgttggaagaggaaaggcaggtgttagcacagcaataattacttagtgcagatagcaattaaaggtcccccttgagccacatagtggccctctgttcaccacacaatttctgctccccaggaaaccctgacgagaaactcatcagaggcaaaaggccgagcctgtcctgcttgtcccctgagcctctgggctgaaatgattcctttggagcttgaaaggcagccaaatgatgggttcagggtgggaaacccttgacttgttctccctgtccctgggaatgccttgcccttctcagcctgttatttaattacctgggtagctacttcatgaggtcatgaaacacgcccccatccagttctcagaaccctccctccccatcctgtgtgtgtattgtgtctgtgtacgcacaatccacaaacccacagcagtttgaaagcacaggatgctttttctccgattgcttgccctgctaatggaaggagagactgggtctccccagtgagccatgtgctgaatatatgctgaccccttccaagggaagagggccatgtggaaggcaggctccgaggtgtcgagtgggctccagaggcaatacactctggaccctttgcattcttggatgtggcactaggccagttaaaagctaaactttgaaggaggccaacagaggagcgaagggagataggagcccgactctgtaattctagggacttgggggtctcccctttgaactaatttaaagagactgttttgttgtttcttttgagtcagactgaattggaggacacccctattgaactgctttggggtatgctgtggggtttttgttcagatggggaaactctaggattcctccctgatgcctcagaaattttatcttttagatcttgcagattgatttgcatactttgaccttggggcagggaagtggagggtggtaaggggaatgactttttcttttggcccttcaaaatcgtaaatgtttttgcgtattgtagcctgcgtagtgccagctacatctaacttcctgtgatgtaattgtttcctcactagcaagagagggaattggaaagactgtattttttgtggatttgatgtgtacgtatctttaacctttcaccccttcccatttttaatagttgtagctggttttctgggggcagggggctgggaggtagaacaggaagggaggcatcctcccctttttgtcatattgagctaaagaatgctaactgatggtggtagctttatagcagcgactcccattgttgagcaagatggaatttgtgaaagccatttatatcctccgtctagtaggcgtcacttagccagggctataattagtggccatgcgctatttattgtgtgtttggtggtgagaaccctgggagctgagccaagcatcctgccctggcacagccagacagggtgcccggagagaccggaaggcctctaccaggatcggggttaggttgttacccttagaatcagacctggagagacaagagttgcttctccaagtcagtctttgagcctgggatgctctccttagaaaaatgtatgtgcccaataaaaatgtgcacaatttcaaggattttccagtgccctcttggaaccatcagtggaacctaggttaagatggcatccccaggaagggactgctccaggtccatcgcctccagaggcacaatctgcaagtatcttgggaactgtaaagcttctgtgtgcttatgtctcttgtgacaatagctgctgtaaactgtaaaggtcctacttggggatagtctttgctgggaccccaaaagctctatcctcaccagtggggattaaagactggcagaagtgtagtgtagggccgtggctcttaggcaggcacaacagtttcatatctaggttactccagtgtttgattcttgtgttttgccattgcccttagattctaatcccaactcactcccaccatcttttcttccttccagactgtgtcagggaaaagggaggcaaggtcctggtccactgtgaggctgggatctcccgttcacccaccatctgcatggcttaccttatgaagaccaagcagttccgcctgaaggaggccttcgattacatcaagcagaggaggagcatggtctcgcccaactttggcttcatgggccagctcctgcagtacgaatctgagatcctgccctccacgcccaacccccagcctccctcctgccaaggggaggcagcaggctcttcactgataggccatttgcagacactgagccctgacatgcagggtgcctactgcacattccctgcctcggtgctggcaccggtgcctacccactcaacagtctcagagctcagcagaagccctgtggcaacggccacatcctgctaaaactgggatggaggaatcggcccagccccaagagcaactgtgatttttgtttttaagactcatggacatttcatacctgtgcaatactgaagacctcattctgtcatgctgccccagtgagatagtgagtggtcaccaggcttgcaaatgaacttcagacggacctcagggtaggttctcgggactgaaggaaggccaagccattacgggagcacagcatgtgctgactactgtacttccagacccctgccctcttgggactgcccagtccttgcacctcagagttcgccttttcatttcaagcataaggcaataaatacctgcagcaacgtgggagaaagaagttgctggaccaggagaaaaggcagttatgaagccaattcattttgaaggaagcacaatttccaccttattttttgaactttggcagtttcaatgtctgtctctgttgcttcggggcataagctgatcaccgtctagttgggaaagtcaccctacagggtttgtagggacatgatcagcatcctgatttgaaccctgaaatgttgtgtagacaccctcttgggtccaatgaggtagttggttgaagtagcaagatgttggcttttctggattttttttgccatgggttcttcactgaccttggactttggcatgattcttagtcatacttgaacttgtctcattccacctcttctcagagcaactcttcctttgggaaaagagttcttcagatcatagaccaaaaaagtcataccttcgaggtggtagcagtagattccaggaggagaagggtacttgctaggtatcctgggtcagtggcggtgcaaactggtttcctcagctgcctgtccttctgtgtgcttatgtctcttgtgacaattgttttcctccctgcccctggaggttgtcttcaagctgtggacttctgggatttgcagattttgcaacgtggtactactttttttttctttttgtctgttagttatttctccaggggaaaaggcaataattttctaagacccgtgtgaatgtgaagaaaagcagtatgttactggttgttgttgttgttcttgttttttatagtgtaaaataaaaatagtaaaaggagaaaagcacttcttcatgttgttggtgaattgggataaggtaggaatacccttgggtggggacccagcctgcttcattgggatttatttatttgtaaatgaacaacagggtgatggtggtggaggtgcagctataggcatgacgatacagaatgttgctttccaactgaggggttttcctaagctaaccggcaagagaattccttagtgcaggcctcatagggaggtggtgagagtatctgcccactcagggcccttcactgccatcgcactaggcaaagagctctacttgaacctcagattcctcacctgtgaagagtgagctgagttagatgatcccaagagtcccttaaagcataaggcccttggttccagtaagcctgagtgccaagcttgtggccagctacctccctccagtgcctggcatatggcagactcagaaaaggctgggtaagtggccaagggatggagaagtgaatgaggtgaaagtttgccctgccagcctgcctgacgccctctttccactcttgcaactaattctagataattccccaggagttccaacgtaaatccctcaatgagtaggtttaaatccaaggctgaatcgacttgctttgtgagtaacttcctctgcgtaggtggaggaaggaaggggcagttgtcagcttctccccatgattggctctgcctgggctccagcctaactcctgggtcctgttcctaatctgagggaacagggagctggttggggtttatgccatcccagtcagctgataaataacagggattccagccatacttctcaatgctggagggtccaaagggtgtccagttctcccgacatgcattgtgtcaacaaatagcaagatggtggcagagcacaggcagcccagctctctaaattcctcacctcaaaggctttgcgtgaggtctttctctccacctgtctttcctttccccaactgtgttcagaggttccttggaaagtccacagatgagaaggtcacccagggttaggatgctgaatttctttcagcccactcccctcatctgtgtaaccaaacagcttccacagtgaagagcactagaccagatggtgagaagttgtgggttctagcccttgcccttcccccagctctccagtggtttggagctaatctccaacctctgtggactagatttctccagggctcttatctagctggtgcctaatccctcgtggtgtcccatctctgagcctctgaccagccttggagtgtgtccctgaagcctgcccattgtgtgggcctatgcaggtgctgagtggctaaaggaaccttgggtagggagagccggggagtaggaagctggatgcaggctggggtgatgtgctaagctcagcccacttgctgacatttgctttattgcattaaagtctttctctgaagggtgagtaagtcctctaaatcaggcatatgaggattgctcatcggtgggtgagtcactggagggtaagccaagtgaagccccacagctggggatggctctagaaccctcactccacttaatagtctcttcattgattacatctccattcttgccaagaccaactctacactggcttccagtgccaaatggggaattcaagctgatggcgtttagatccttcatccccaggttttgagaaacacctctgtcggtctccaagcatcatcgcacatagagatgtgttcaggagaagaaagatgttagttctctctttcccggctgtacctgtaggaagccccctcagatccaccctagctaatgagctaggccagatggggcaggagttgtgtgagcagtctctaaccaggatccagtgtgctggcaggagtcctgggtactgtggatcttcactgtgtgaggccctcaggaaagtgcctcaccaatttcaatactctgaacagctctatctctttgagttactggttgttcttctgaacaccataaagctcatgactgctctgtttcccttccttgct

SEQ ID NO: 16811 - DNA, 14239 bp, Human
tgagtagctgggattacaggtgtgcaccaccacgcccagctaatttttatatttttagtagagacatggtttcaccatcttggccagactggtctcgaactcctgacttcaagtgatccactcaccttggcctcccaaagtgctgggattacaggtgtgagccactccacccagctgatctgcttttaaatgcacttattagcttgccccttttctagggtagaaaaaatcttgtgttttctgatgcgacccactgggtcgcatcagaattacctaggaagcttatttttcaaatacaatactgagagccattggattggaggggtggctggcggaggtattttggagtagcttcccagaggactctgattctccactgcccctatcactttgagaattactgttgttctagaagcttaaaaggattgaaatggatattagctgccttatcatgaactcttaacccactttacagggatgggaggggccatgattcagtgactttaacaattccagtggccagtccccagactgacaggttatcgactcttggggcaatagagtgggatctctaagttcaggaggtaagaaaacagcagcagcggtgtttatcactagaggcatgaggagaactaatttctaaaaagcactggagaactatactgtaaaaaagatctggggtgctatgatgcaaggaaggaagtattacttggttggggctggaaaaataaagcaattatagtaaaaaaactaaaaaaaaaaaaaagtctagatcccggcttcttgacagtgtggtctgagaagcaacagcatcgctggcagcttgttacaaatgcagagtcctgggccctgccacaatctgcatttttaataagagcctcgagtgttttttatgtgctcattaaagtttaagcagcactggtccatatcacggcgaggagatccagaccatcagagggtaggctccctggcacagctgacgcatttttgaatactttgatacagcacagtgtacctgaaaagatactgcatttttgaaaattaagtgctataaatactggagaaagacctctttttttaaactgcggggaggtttctcataagccaaatttcttttgactagaagcattttctggggagtaaagtaccaggcttccttaaagtgaggcggagccacgttaaaaatgtgcggtagaactcagccttggccaagtcgaccgttcaccagctgggtcaagtctggagcctcctaggtcccttggcagttccgagctaccagcatgagcttttacaggaagttgagttggctgctgttctgccccacagagcagctgagtcttttttttttttttttttttgatgagtttcactcttgccgcccaggctggagtgcagtggggcgatctcggctcattgcaacctctgcctccaaggttcaagcgattctcctgcctcagcctgccgagtagcttggattacaggcgcccgtcaccacactcggctaatttttgtatttttagtagagacggggttttcaccatgttggccaggctggtctcgaacttctgacctcaggggatccgcccgcctcagcctcccaaagcgctgggattacaggcgtgagccacagctaccgactctgagttgagtctttaacgccgaagatgcagaaaggagacttgacaaaactattttcggggagtgtggccgcggaattcggtgagggtgctataccgggagagagtagtagcaacggctcattcactgtgaagcccctaagtgaccttagacctctgaccccgcgcctcactcggcgcttccgcgcgcagcttccgctcccgcccctccgacgaaaggctgggccaaaggtgggggggtggggctctgaggtcggcagttaggggcggtgcccgctgggggcgggtctcgcgaggggcaggattcgaggaggcactcgagcattgggcaccaggtagaggcggggcctagtgctgggctgggttgggcggggcagggagttcgtagccgcctctgggtaactcgactcgggcggccaaacctccggaggccggggacggaaggcgggcccgcagcagatcctggatccggaatctcccgggcaggagcggaatctgtcccgaaccgggtctgtgaggaactcgcgaacttggattaggaaatcccggagcccggatcgacaaatcccggaacccggaattaagatcgccaagtcccggatcgcggagcacagagcacggagtggactcgacgcggagcccggagtccggatcgcggcaccgcgggacgggacggagcgatgtcgggccgaggcgcgggcgggttcccgctgcccccgctaagccctggcggcggcgccgtggctgcggccctgggagcgccgcctccccccgcgggacccggcatgctgcccggaccggcgctccggggaccgggtccggcaggaggcgtggggggccccggggccgccgccttccgccccatgggccccgcgggccccgcggcgcagtaccaggtgagcaaggaggacgcgagcggacgggggcgagaggcgctgcgagggcgcccgggccggcggctgaaggggcctcgagtgagggccctggggaatgcatgaggaactccgggagacggtggagggcgggccgggaccctcgggctgcggcgggtcgcggtggagaagtgggaaggggaagcaggttctgcagcggagggctggaagcagctgggaggcctgggggcttccgcggcacagggattccgagtgactgggagatggaggagtttggggagccagtgaattgtggcgggtgggttgagaagtctagggtaggagggctggaaagtgatgagaaagtttgggaaagggccctcgctgagaaaccggggttaccctgcatcggccttggtcccagtccaagtctgccctgttttttctgattgggaactggcggagctctagcgtgtctgagatggctcccggctgctaataaggaggaaggagcctggcttcccacgggcacgggacgctgaggctagggccaggggattccagcttgtgcacgggcggactttactcctgaggcagggccaggcgccttcgctgggaggactccagcttagaccagagacggtggtggcctggcctgaggggaggcccagcccagtcacaggccggctctcttctgggctttctgcctcctgtcatcgtgtccgggagttgattagtctggacgtgcagagtggagccctgctggtctggggccggaggagtctgcgagagttgcttcaaagagtgctgtcctgacccctttggggttttgagagctgctcagattgcagcttcaaaagcccttgcaaagcagcgacttctgctcagtgtgtgaggacctcagcctgaccctgccagtgctctagtctgctgttcaggttgccccagagggcttggaaactgtgcccatctgccttgtcaccctctctgcatttttatttggccttcaggttctaactccaccacgtccgaagccatgtgcccaagcatttgacactggcttcttgctcatctacgggtttgctgtgggcttcctctgttttcgactcatgtctccaggcagaggtccttagggatcctcgtggagtatacacagcctacctgccccactgggccctcacttctaaggagatggcttaactagggacagtgactggatttttttttccttcttactcctcattcttcctcctttctcaagagaaaagagagtctgggtatgggcagagacagacctggtcccagggattccagctggggctcatctctcccaccttgctgtccccgttggggattcatgggcccagggtgttgctgagggctccctgcatcattcattgtagcccttgggcctgcccactgagacctggcctgggcaccatctgtgggcctttggccttggaaggacctggaacagacaagccgctccagtttccttggcatgcaagccataggaaatgtgcccttgggacagcccctgagaggatggattccacatgttttggtggggggtggccttgggcctgtggcaaggccaagctggctggctggttaggcctgggctgctagctgtgcggaagtaggagatggccctgagtctgggtttcccatcccactagctttcctcctcctggcaggagaggtagatgggaaggagaacccagccagctaactttggctgagtttgaagaggatcctatttgccttctttccaagtccagttgtatgactgccaggagaagggacttgagatctgggaaacaaaggggttcctgtctgttagggctcatgagatgcacttgaaaagtgagaatttgaggcccaagctgagcaaatagttgaaagaagggaagtgatgacctcccttcctccagagggtggttctagctgtggatcacagttaacagaggaacctaaaaaaagaaaaagaaaagaaaaaaacctccagggcaggatatggtgggctcacacctgtaatcctagcactttgggaggcccagacagaaggattacttgagaccaggagttcaagaccagcctaagcaacatagtgagaccatcatctcttaaaaaaaaaaaaaaaaatttagccaagcatggtggtgtgcgcttatggtcccagctactcaggatgctgtggcaggaggattgcttgagtccaggagttcaaggctgcattgagctatgatcctgccactgcactccagcctgggcaacaaaataacaaaaacctcagattgctgggttcactccagagagttcaaaaagttcaaaaaaaaaatttttttttttctgatacggagtctcactctgtcgcccaggctggagtgcagtgacatgatctcagctcactgcaacctccgcctcccaggttcaaacaatcctctgcctcaagcctcctgagtagctgggattacaggcgcccaccaccacgcccggctaatttttttgtatttttagtagagacgaggtttcaccatcttggccaggatggtctcgaactcctgaccttgtgatccacccgcctcggcctcccaaagtgctgggattataggcgtgagccactgcacccggcctcaaaatcctttttactcatgggagagtgggtggtatgttccccaactgaggccctcaggcccaggttccaggagcatcagggccacatttggggcagggcaaagcacgctcaccggagccctggattcctcatctggggttcaggggattgatccaggcctacctggtcctgctgcaggcagggagttagggaggctcagagtgctggactgcttttttttttttctttaactcctgagttgtttttttttgtttgttttgttttgttttgttttttgaagtgggaggagttgctagcgcctataagccctatggagcttggcaaggctcagctgggacttgaactataagcagccttcccctggggccctgagtgagccaggggctctgggcccaggaaacctggagcagatgtctgggtggagcctattccagaccctgcctatgaggccttgtcttgggacttcctgttaccggagcacctgcccaggagggatgggtggtgctgcaggttttgtgaacactgcagcagggagcttcctggggaccacagggccctcgctcacctctgcaggacccactgcttcagttcttccctgtctttgtctcaggcactaggaaaaactagtctgggatgtctgggcctgggcttacagctgtagccacacttagtttttttctataatctcaggccagagaaagaacaatctttaaggcagagaaagaggctgtcttttgcctttcaacagctctgattaatctcttcctgatgcagagagactttggcaggactcccaaagccccagagccccccactttgaactttttattctcccaaacacttccgtcccaccctgctcctcctctccccatcctcacgtctgtgggtcatgtttctttccatctccgcatctggtcaagaatctgaccctctgtgttgggaacatgggtttagtgcgggatgaagaggttggggaagaatctcatctccatgatgctggggtgggggagggtcctttgatttggtacaagtctccaccctgccgggcttggttggctggttgtgctcgttgcataatctgggccctggggccagccctgtgaagctgccagggacagtgtgtgcaaggcagagctgccaaacaggccttgcaggcagcagccatggggaggcgggtgggggtggaggtgactcccagatgggctccacagaaatgtcagggagcaaggcctcaggtgggaaatccttctgcaggcatctaaagaagctatttctgtctcccactttcctgctgctcagcctgggcctctatccttgcctcccaggataatcttagcccccttctccagcttgggattgccagggctacacggagccagagccagtcctggctgccaggtggtgcctggaccactggcagagtccaggtgctagctgctctctttcccacaggccacccaggagccatagcttcccttctggggtcttctgtcataggggtagtagttgggcagtagggaggtaagaggagggtccagttctgggctgtgggtgggggctatgtgataccagactacagggtacagggtccctgtaccctgcccgaggccacccccaccagctggtacacgttccaagccatcctgttgcagccctgctcacctggggtgctgctgcctaccagacccctttctccctcggccacagaggatggggattggggctctgcgccattggcctactcatactatagtacactcctctgcctggcagtgacactgcccctgtgcctctcagccatgcttcttcttcatgatgggagaaagagaaggagggcagggcttggcaggactgtctgagagaatagggaccagcttgcccagggaatagggcacagcatgctggggctggaaggtagcaatgggccctgaaaagctccccaaggcccttccctctgcaggcaggaccctcctcccagcccaggttctggcaggcctcattcgctggcatggctgccagggcggttgcagggggcagggcaggtgtggtttacactctgtgctcaggcgcccactcccctttgttcctggggctccagcagggctctggtgtgctgctcaggccctacctggctgacgagagggatggagggcatgggctatgggtcccggagggccttgcccctgacctatgcacccccgttggctcacttcccccagcgacctggcatgtcaccagggaaccggatgcccatggctggcttgcaggtgggaccccctgctggctccccatttggtgcagcagctccgcttcgacctggcatgccacccaccatgatggatccattccgaaaacgcctgcttgtgccccaggcgcagcctcccatgcctgcccagcgccgggggtaagagcatcctgcttctctcactctgcctaactcagctctggtggtagcagagggtttccttctatcttaagagctttggtgactgaggatgactccaggctctcctgggggagagggtcctggagactggaggggcgttatgggagtgagtgtccttttttggaccattgacctcttaagtgggtttctgtcctccccaggttaaagaggaggaagatggcagataaggttctacctcagcgagtaagtgttaagaggacacctgggaggcctgcccagtggccaccttggggtgggtgtccatctctctcaaagctgggctgcagcaggaagggaggaaagagccaggctttggctgaagcaagctgatgagcttctgctaccttccttcagatccgggagcttgttccagagtctcaggcgtacatggatctcttggcttttgagcggaagctggaccagaccattgctcgcaagcggatggagatccaggaggccatcaaaaagcctctgacagtatgtgtggccctgaccacctctagccttcccaggtttccttgccttccacccccttgttttccaggggccaagcaagttgggctagagccgggtttttcacatgcaggatgcagcccactagtagagtacgaactcagttgaatgtgttggggccagtatgttttaaatgaatatatgacagtagaaaatcttaaaatacttcacagtagtacttaccatagtagtaaatggattctttcatgacatttttgtttctgataaatagatatgcagaccttgggtcataattgaaaatgtaaatcttatgggtggtggtcaaaagtttgaaaaccactagactaggggataaaggtagttcctttctccttccccttccccatccatagagaaattttcttttttttttttttttttttttctgagatggagtctcgctctttcacctaagctggagtgcagtgttgcgatctcggctcactgcaaccttcgcatcccaggttcaagtaattcttcttgcctcagcctcccgagtaactaggattacagatgcctgtcaccacgcccggctaatttttgtatttttagtatcgccatgttacccaggctggtctcgaactcctgactgcctcggcctcccaaagtgctgagattacaggcgtgagccactgcacccagccgagaagcttttcttaataataatgtagaacagtcccgagtggtgaagcctttccaggggactaggatattttggagccgtgatgggtgtttgggtttcatgtaagatgtgagccagagactggctgcgtgttactccatcatgccgtagcaccagtcccactgtgctggcattgttggtgatgcatctctttccccataaaatggtgagttccggccaggtgcggtggctcacacctgtaatctcagcactttaggaggccgaagtgggcagatcacctgaggtcaggagtttgagaccagcatggccaacatgttgaaataccatctttacaaaaacacaaaaaattagctgggcatggtggtgcgcacctgtagtcccagctacatgggagactgaggcaagagaatcgcttgaacctgggagtcagaggttgcaagtgagctgagatcgcgccactgcactccagcctgggtgacagagtgagaccatgtctaaaaaaaaaaaaggctgggactgggacttactacttctgattcccagtacctgacaaggtgcctggctggctcatggtgctcagtactgattgttgaatggttcatatgagaagatgcggtagcactgtgtcccagcatcttggtccacctccagttgtgattgcctttctctctttagcaaaagcgaaagcttcggatctacatttccaatacgttcagtcccagcaaggcggaaggcgatagtgcaggaactgcagggacccctgggggaaccccagcaggggacaaggtggcttcctgggaactccgagtggaaggaaaactgctggatgatgtgagttggggagggaggttctggagggaaggaggcctgtgtgggtttaagactgagaccaaggagtttgatactagcctgagcagcagagccagaccccatctctacaaaaaatttaaaaattagctgggtgcggtggcatgcacctgtagtcccagctactcataaggctgatgcaggaggatggcttgagcccaggaggtcgagcttcagtgagttatgatcacaccactgcacttcagcctgggtgacagagtgagattgtgtctcagaaaaaaaaagactgggccagacacttgggcgctcccagagaagtcctgccatagggaggggggcgctgctccaagcccgttggaggttgatttgtgtggttattacagtgttcctgcagatggcagtcgagtgtctcgaggaagtccctcgtgggctgcaagagggcaccatttccctgcctccagtctgcccagagtcctgcttccatccttcagggcccaggaatcttcagtatccggagctccagggctgaaatggggcttctctttcttgggatttagcatagcttgagatttgagagctcagcagcaccatctcacacccctttccatccccagcctagcaaacagaagaggaagttttcttcattctttaagagcctcgtcattgagctggacaaggagctgtacgggcctgacaatcacctggtggaggtgagagtgggcctggggcaaaagcaggctgatgtgcaggtttggcagggaaatggcctcagggcccttgggaggccctgtgttcacgcccacccccttggtgataagccatgcttccctccctgccagtggcaccggatgcccaccacccaggagacagatggcttccaagtaaaacggcctggagacctcaacgtcaagtgcaccctcctgctcatgctggatcatcaggtgacagagaccctggggtcatttctgggcccacagggacccctcaggaggggagctggttcctagaaacccttcctgtccctgccctattttcccactgttctactataagaacccgttctgactcccctccatccaactccagcctccccagtacaaattggacccccgattggcaaggctgctgggagtgcacacgcagacgagggccgccatcatgcaggccctgtggctttacatcaagcacaaccagctgcaggatgggcacgagcgggagtacatcaactgcaaccgttacttccgccaggttagccagatgccagcccccgttttctcagcccttgctttgccttgcctgctgggctactccttggccacagcctgcagactgctgccctcactggtcctggaatggtccactccactgtgcccacaagccaacgctgagcctttcgtatttcctccagatcttcagttgtggccgactccgtttctccgagattcccatgaagctggcagggttgctgcagcatccagaccccattgtcatcaaccatgtcattaggtaaatgcaaggagggggacaggaaggctcttctaagagcagattcacccttggcttgaactaaagccaaagaaagcatcaggtttctttttccctgagtgtgtgcagagaatgggccccagatttggcccaggtgggcaggatgaagtcagctatgtgccttccctccccatgtgctgcctgcagtgtcgaccctaacgaccagaagaagacagcctgttacgacatcgatgtggaggtggacgacccactgaaggcccaaatgagcaattttctggcctctaccaccaatcagcaggagatcgcctcccttgatgtcaaggtgggccctctggctccacagcttcctctggggcccaggattggggtgggctggctctgtccagcatttccatacatgtagcacctggaggacgggatgggaactctggctcagttgcttgcatgtaagctttgggggcacagtctgacacaggtaccctctccagatccatgagaccattgagtccatcaaccagctgaagacccagagagatttcatgctcagttttagcaccgacccccaggacttcatccaggaatggctccgttcccagcgccgagacctcaaggtgtagtcctctttcccgaggggactcctatgtaaagctctgggtgatttttacccacagcagttcccagggtggattagcccaggggtggggattatgctatggctttcctcctggctctttgcagatcatcactgatgtgattggaaatcctgaggaggagagacgagctgctttctaccaccagccctgggcccaggaagcagtaggcaggcacatctttgccaaggtgaggctctgccctgttttccctcctttggccgtgagtagcaaaggcctgagccacttggtttctcccttctccaggtgcagcagcgaaggcaggaactggaacaggtgctgggaattcgcctgacctaactgctcagggatctttcttcccagccctggagcctggagggagaccaccctctgggtccttgctggggccgcagacacgtaggctggggtgaggagtgtctgctgtcaccctctactctccagctttagttttataaatgtagtgataggattccttgttgcttggtccccaaagccttatactttttgcattggctttaattgggttcagcagatgcctcctctgcccccctgcaggcaggcccaagtaggactgctggaggctgtgctttgacattgtaagacatttccgaaccaaaggctgctgggtttgcatgtttacagactccccctggggcgagggtcagagctggctctggggagctgggctaggaagaggaggtgcagcccagactcttcctagcctttctaaaccaaagttctttgccattcctacaagcccagccttgctgctggttttttcctttcctttgggtatttgcactattttgggagcaagttttctatgtgggagccactttttttgtacaggggtaagttgggggttttcagggagcctgttaggtgcctccttcttttctttcctcaatctatgcaagcggctctggccgccatcatctcctgggatgccagagggctgcctctccagcggcttgggccggggaggggacactccagttctctagcatggcctgaggtatggggtatgtgcatgtggaggccagggtaaggtgaatggggaggctgggaggactggtgttgccctttggagcttggtgaggagggtgggcctagggcttggcgagtgccacatctggcaggtttggaaatttccaaataaatccttttgtctattggtggtgcctggacctggtccttgaacagcacagccctcattaacagactggagtcctagaggacttggcccacagagctttattggagagatacacacaaaggctgtccactcacttccataatttcttgatggacatgtttttctcactgtccttctgcatgacctaggggtgggagagagaatgaacattaagttacgaacacacacatgccctagcccactgccccagagccaccactggcaaaggcacaaagatggaggcctataccttggctactgccatctcaaagtcctcctgagtgacatggactcgccgttctcgcagggcatacatgccagcttctgtgcacacgccctgaacaggaaaaggaaattgaggccccactgctgtgcccctcatctgtggcccttgagcccagagcttcctgcctctgccctgttttcagtgggtactccaattaccttcacttcagcccctgatgctcctggcatgagctcagcaatttttctcaggttgatcccccgggtcaggttcatcttccgagaatgaatcttcaaaatgtccagccgggcctggagatggcaaggaaaagcctgagccccacaccccacccccacagccagagccactttgcacagtgtccatcacaaacctcctcattggggggtgggaattcaatttttctgtcaatgcgccctgggcgaagcagtgccgagtccaggatatcaatcctattagtagccatgataacctgagcagagaaagcaagtggggatcagctaaacctcttcctcagcctgcgtggcacccaggccttccctgggcccatcccaaggatgctaccaccttaccttgatgttcttggtggcctcaaagccgtcgagctggttgagcaactccagcatcgtgcgctgcacttcactgtcccctccagaacccccctccagccgcgaggagccgatggagtcgatttcgtccatgaagatgatagatggagcatgttcccgtgccatgacaaacagctccctcaccattcttgcccctgtgtggaggccgagctggtgttagggagcttattagcttattagctctctaaccccctacccctacctcttgcttctcacattgctagccatggttaccttcccctatgaatttctgtaccagttcagagccagagacacgaataaaggtacagtccgtatgatgagccacagcccgggccaacagtgtcttcccagtgcctggaggtccatacagcagcactccctacaggggaacagcaggactcagggcagaaagctacacccctcatttcattcagt

SEQ ID NO: 16812 - DNA, 8530 bp, Human
ccacctccaccatcacctgatctccaagcaccacactccctgtaccttgtgagtaagcatcatggacccagctagccccaacgttgggggccccatcattgagcacaacatcaaccttccaggtcttcagctccttcctcagggcctaaagagaagaaaaggaactatggaaacagaaacactggaatggccctggttcagccatttgtccatctagtcatttgctgagtgcccatcatgggccaaatgcagtaccaggcacaggagatacaatagtaaacaaaaacagtatgtctctaccttcatggagattacagtctgacactgaattcacaggagaagacttcactaaagatctctgcccttctcccaattccaaacacctttatccctgactctaaataaagcctggagtggacactacgaatgccataggtcttgtcgtacagatgtcaggcaagaacgtgctcaaagcacggtaaaaaggaaaaacttgcctttagaggatttcagggatgtagatgtttccgtataaagggggaaggaagagagagactcctattacctgcctacaacgttctgttgtgatgtcctgctggagagtcaccacattggggagaggcttgattggaaccaggtccactcctggaagaaatcaggtcagagtattctaaaaggttgcttcaagcagggaggagagaaatacaggacaaaataccttatacacccaccccttaaaacaccaaggagagctgtccgttactcacccacaataaggctggatacaggcataaacttggcagctacctgcagcctataaaaggaacagaaatttaaaaacctagagccatccttttccccctcttggcaactgatctctcatccctggtgttacgtgtactggccaaagcatatcataggcacgtattccaagccctttctctgcaatcaagaaaggaaacggcccccaagaggaccgggattcgggttcccctcccgcagtgaaactggaagccatcccagctcagaacccagaaagcggccaccaggagcaacctgtggcgagtgttacgaaccatccccctggcgcagcacacaggtccagcaaggctcgggctttctgcaggaactgaaagcggcgattgagctggatcagcttgaaagcagatcgggaacggtaacctggacaaaacaaccaagtgcgcaaactgcttcactagtaggatttctccggcctcgcaaccgaccaccccttctgcaggagaggtacataatggtcgcaaagagcaggcgaaccgggcagagatcgctcgctcgctcgcagactgagcgaatccggactcacccgtctccttcgccaagtgataaaacttgtctcgtcggctcttgccaactttgcccttcttgcccatggtggaaagggggagtatccctcaatctggggagaaagtagaagttgggaacgtctctttccggagcaccagattccacttccagtttcccacttccagtttcccacttcccgcagcaattccaccccgcgcccctctccgcacactacctagacccagagccgctttctccacacttggaaccgcacaagtatgcagctaactacttccgcttccgcttgcgtcccctgcgtccctggctcgaggttttccgccattttgagtgtggccctagattgttctcaatactctgtccttgggttttgtaagttgaaagttgagactaggaaggcatatcacaagaactataaacagagtttcaatgaggcaacactgaggaggagttctactccttcctcatccccttccaaagcccctgaactcgagtagccgcccctcccatcatggttcccttagtgtggtctcgccgcacaccccgcccattgacccggaattcttctctgcctggtcttcaggtcccaatcctccgcttccgcgcttgcgcgccaagacggctcggatgccggcggtctctgctgaagagagaagatggcgcttgacggaccagagcaggtatggcgggtgcagtggcggcccggcaggttacggggctgggtgcggagcgagcgtgatctgagtggagagcgggccggggcaggagcgtcgggtgggtcggaggtgcctggaccagtccatgctggacgctgcctgcgaccggatctgctgtgtcagcgccgccctcggtgagtcagggcaaggctgggagaggaagacgcggtagaagcggagtgagtgagggaagcgatgggcgcgggaatggccggcccacgggtcgcaggagacgggacgccagtcctttggctccgttccgctggctccttcgtcagtactgacacctcgggcttgtagagcacttcacgcagtgcaaagcgccccccgtctatatcatatcgcctctcggtcctcctaaaagtcgtatgaggtaggcggcgttcccattcttttattttagtcctgggaaaatggagggttccaagggagggagggattagaacccagatcctgagcctccgaagtccaaactttttctactacgcaaagctacctggtgtcaagccttattcaaagtgccctgcaagtggctttaccccctcggatgtttaacctgtcgtttaagactcactctgtgtcttcagatggagctggaggaggggaaggcaggcagcggactccgccaatattatctgtccaagattgaagaactccaggtgaggacggactccagagggagctaggaagggtgatgatgggggatggaaacggacttccacaaatccatctaattcctttgggagtgcagtggaagaagctgctgcttctcctttcttgtttgtttcttagctagtagggtgtatgtatcagaagtaagcaatctcttgttctcctccagtcccatctctttgagggtcttagtgttcacagtttgttacacatcttcgagtcaaatcttaatagtaaaggtacctctagccaaaggtcaacccttttggaagaagcccgaatgaaaaggattcttataaaagggaaacataagctcaggagttgaaatttatcaccaagaggttgggtgagggtgaagtgagaatgtgaggaagggcatcattgagggatctggacaatgctaattccatagagactgaatgaaagaaattgggcaacccagagccctagcctaaagcgctaaaccatagaaaaaggaccgtttatgttgttaatcaaatgtttgtgttaccagtaaggcttccagcagtaaggtatggcttccagtagtaagccttacagacaacataaacagtagtctgttagtgttacgttatactgttacggtaggctgttagtagtttaactttggacaggtccatggattttcaatttcaccctaaccccctgcgttgttcaagtgtcaactgtaatataaattggatgggggaaagccacaaaagacaattctgaattccaagtgcatttgcaggtattatgtttagtttaccatttttgaatgctttttcatgtgtttttattcgttcaccttagtagtcttgaagcagggtagctgatgctatacccatgtgccgtttggtaacagatctagatttttaaaaatagattgtcttacctttactttgcttttgattgacagcggctgggctagaactcaggtttctcacctaacaatctttccaccaggtgttgttgccttcctgcaagaaatttggtgttacatgagccagctgtaacttttctccattagattctgttactcctggaccagtattggacaagcagccttctttgatggctgctgtaaggtccagagggactcttgaaggacagggcagggtcattaggatcatactggagaatctgaaacaacatgcaggtgccctgtgcccttccctcagctcattcagacctgtgaggtcttggccaagatcctacctcctcctgtctcctgcccttgaataatggaatttgtctcttgtctgccacagctgattgtgaatgataagagccaaaacctccggaggctgcaggcacagaggaacgaactaaatgctaaaggtgagtggagaaagatgggaagccgcatgtgggcagtttgtctgaggtctgtccttatctccctgcactgtgtcttcacagcagtgcttactgttttctccctgtcatcatctagtagtttcacatgcatctctttttcctgagccctattgtagcctccttaaatacatgaattttgacctttggccttcctttaataagagtgatgcttagctcatgcacgtagaattgggtcctggagactccaaaggagtagctaggtgaccactgtgtctgtttgccatctagttcgcctattgcgggaggagctacagctgctgcaggagcagggctcctatgtgggggaagtagtccgggccatggataagaagaaagtgttggtcaaggtaaaagcagcatgaccccagggaccagctcggtctccactgcattcccacccctttgtgtgtagcctcgggagacagggttctgtgttctgtcaaggtattgtgggattctcataggtcttcctgggtaggattagtgatttggtggctgtcaaggaaggtcatgagcccttgtttctttaggtacatcctgaaggtaaatttgttgtagacgtggacaaaaacattgacatcaatgatgtgagtgtagcaggtgaggtggtggtggtggtggggtcagctcttactgtaccacttctgaaactcgcccccttcacccaggtgacacccaattgccgggtggctctaaggaatgacagctacactctgcacaagatcctgcccaacaaggtagacccattagtgtcactgatgatggtggagaaagtaccagattcaacttatgagatgattggtggactggacaaacagatcaaggagatcaaagaagtgatcgagctgcctgttaagcatcctgagctcttcgaagcactgggcattgctcagcccaaggtgaggagcagggcttctctgagagggccaagctgtacttactcctcctgccccagccagccctactgcaggggttggggaggcaccgggataggctgcatcttgcttgggctggccctccccctgaaaagagtggctggggaagtgttcctagggcggtgaggtggtttggatagaagggaccttgatgttccttttttttttttgtatccctaacatctagcaagggacccagcactcggtaaatgttcactgaatgaaatgaggggtgtagctttctgccctgagtcctgctgttcccctgtagggagtgctgctgtatggacctccaggcactgggaagacactgttggcccgggctgtggctcatcatacggactgtacctttattcgtgtctctggctctgaactggtacagaaattcataggggaaggtaaccatggctagcaatgtgagaagcaagaggtaggggtagggggttagagagctaataagctaataagctccctaacaccagctcggcctccacacaggggcaagaatggtgagggagctgtttgtcatggcacgggaacatgctccatctatcatcttcatggacgaaatcgactccatcggctcctcgcggctggaggggggttctggaggggacagtgaagtgcagcgcacgatgctggagttgctcaaccagctcgacggctttgaggccaccaagaacatcaaggtaaggtggtagcatccttgggatgggcccagggaaggcctgggtgccacgcaggctgaggaagaggtttagctgatccccacttgctttctctgctcaggttatcatggctactaataggattgatatcctggactcggcactgcttcgcccagggcgcattgacagaaaaattgaattcccaccccccaatgaggaggtttgtgatggacactgtgcaaagtggctctggctgtgggggtggggtgtggggctcaggcttttccttgccatctccaggcccggctggacattttgaagattcattctcggaagatgaacctgacccgggggatcaacctgagaaaaattgctgagctcatgccaggagcatcaggggctgaagtgaaggtaattggagtacccactgaaaacagggcagaggcaggaagctctgggctcaagggccacagatgaggggcacagcagtggggcctcaatttccttttcctgttcagggcgtgtgcacagaagctggcatgtatgccctgcgagaacggcgagtccatgtcactcaggaggactttgagatggcagtagccaaggtataggcctccatctttgtgcctttgccagtggtggctctggggcagtgggctagggcatgtgtgtgttcgtaacttaatgttcattctctctcccacccctaggtcatgcagaaggacagtgagaaaaacatgtccatcaagaaattatggaagtgagtggacagcctttgtgtgtatctctccaataaagctctgtgggccaagtcctctaggactccagtctgttaatgagggctgtgctgttcaaggaccaggtccaggcaccaccaatagacaaaaggatttatttggaaatttccaaacctgccagatgtggcactcgccaagccctaggcccaccctcctcaccaagctccaaagggcaacaccagtcctcccagcctccccattcaccttaccctggcctccacatgcacataccccatacctcaggccatgctagagaactggagtgtcccctccccggcccaagccgctggagaggcagccctctggcatcccaggagatgatggcggccagagccgcttgcatagattgaggaaagaaaagaaggaggcacctaacaggctccctgaaaacccccaacttacccctgtacaaaaaaagtggctcccacatagaaaacttgctcccaaaatagtgcaaatacccaaaggaaaggaaaaaaccagcagcaaggctgggcttgtaggaatggcaaagaactttggtttagaaaggctaggaagagtctgggctgcacctcctcttcctagcccagctccccagagccagctctgaccctcgccccagggggagtctgtaaacatgcaaacccagcagcctttggttcggaaatgtcttacaatgtcaaagcacagcctccagcagtcctacttgggcctgcctgcaggggggcagaggaggcatctgctgaacccaattaaagccaatgcaaaaagtataaggctttggggaccaagcaacaaggaatcctatcactacatttataaaactaaagctggagagtagagggtgacagcagacactcctcaccccagcctacgtgtctgcggccccagcaaggacccagagggtggtctccctccaggctccagggctgggaagaaagatccctgagcagttaggtcaggcgaattcccagcacctgttccagttcctgccttcgctgctgcacctggagaagggagaaaccaagtggctcaggcctttgctactcacggccaaaggagggaaaacagggcagagcctcaccttggcaaagatgtgcctgcctactgcttcctgggcccagggctggtggtagaaagcagctcgtctctcctcctcaggatttccaatcacatcagtgatgatctgcaaagagccaggaggaaagccatagcataatccccacccctgggctaatccaccctgggaactgctgtgggtaaaaatcacccagagctttacataggagtcccctcgggaaagaggactacaccttgaggtctcggcgctgggaacggagccattcctggatgaagtcctgggggtcggtgctaaaactgagcatgaaatctctctgggtcttcagctggttgatggactcaatggtctcatggatctggagagggtacctgtgtcagactgtgcccccaaagcttacatgcaagcaactgagccagagttcccatcccgtcctccaggtgctacatgtatggaaatgctggacagagccagcccaccccaatcctgggccccagaggaagctgtggagccagagggcccaccttgacatcaagggaggcgatctcctgctgattggtggtagaggccagaaaattgctcatttgggccttcagtgggtcgtccacctccacatcgatgtcgtaacaggctgtcttcttctggtcgttagggtcgacactgcaggcagcacatggggagggaaggcacatagctgacttcatcctgcccacctgggccaaatctggggcccattctctgcacacactcagggaaaaagaaacctgatgctttctttggctttagttcaagccaagggtgaatctgctcttagaagagccttcctgtccccctccttgcatttacctaatgacatggttgatgacaatggggtctggatgctgcagcaaccctgccagcttcatgggaatctcggagaaacggagtcggccacaactgaagatctggaggaaatacg

SEQ ID NO: 16813 - DNA, 65300 bp, Human
  misc_feature (1)...(65300): n = A,T,C or G
gatgggatatatatgtgttaatttgacagatgtctttttgtagatacccactttctcctcattcattatcccctttactgcatgctttctatattacagctatgtcactctcatacatacttttgtatatgttttgaagtggaatcatatgggaagttatgctcctggtggttttcctgcaagttttaaatctaattttactttcctgaacaagcaaaaacctctttataggcaactttgtccttttctgtacctcgtcagagggcatatagggcaccagagcagatttcgtctaggaagaggggagaggcaaataaggtgaggggccaggcacggtggcttatgtctgtaatcccagcattttgggaggctaaggagggaggatcgcttgagctcaggtgtttgaaatcagcctgggcaacatggtgaaaccctcgctcaataaaaaatacaaaaattagcagggcatggtggtgtgcacctgtagtcccagctactctggaggctgaggtggaggattgtttgagcctgggggtggaggaggctgcagtgagctgtgattgcaccactgcactctagcctgggcaacagagtgaaaccctgtttcagtcagtcagtcaatcagttaatcagtagtgggagaagagacttgagcagttttacttcctacatttcatgctgttcgtttctttccacagggtattagaatatttccaagggacagtgataaagggtagaagataggcactctctttgggtggaatcttttgtatttgcttcttttaaggtgtgccccaagtccccaaatggctcagttgtcaccaaagcaagtgtaacaactcatccctcatgttcccttcacgatcaacagatttattcattttcaatctccaaatgctatttgaatgggcaaagatctcttaaaggacctgggaaaaatttgtacaacatggaattggactggtttgtgttctgggttttggccagttgttttcaatgtatgagaactctagtactccatgctatttcaagaaaaggggattaaaagtaatgccagtaaggtggagacaatgcattgcttggtcagcttagggaggaaaaacaatagaactaccctttgacttccccatgggaagtagtaggcctataaacttgtaaagagttgtgggggttgctggtggtggcggcattcaaatgctaggcttgtaaaacaacttctgttcaaagcagttacctgaggcccttatttggtaccttttaaagtgtgctctcctccttatgatgctttaagaataagtctgggactgacactgtgccataatcctctctctatggattcatcttttcattcagtaccatattacattgtactgtgttcttcacttcaatttttcatctatttttcctggttaagtttctctggcactggaccaactgccctgtttgagcgtgtcccttccctgcaatgaattggtaaatattgctgcaggaaatctgattggagggctattaagaaaccattaaaggccaggcatggtggcccacacctgtatgtaatcttagcactttgggaggccgaggcaggaggatcactggagtccaggagttggagaccagcctgggcaacatggggagaccccgtctctacaaaaaataaaaaaatcatccaggcatggtggtgcatgcctgtgttcccagctactcaggaggctgatgtgggaaggtcacttgagccccagagttggaggctgcagtgagctatgatcacgccactgcactccagcctgagtgacagagcaagaccttgtctcgaagaaaaaaaagaatccattaaaattcaaattgccatagtctgaccttttgggctgcatctgattatagttacagggtctgtcattttacctgggcagaactccctgagtattagttatacagtttgtgaaagagctttgctggtctgtatttaagtgtcttagtccatgtgctctctttcattgcagacgaacaggaggcattgaactcaatcatgaacgatctggtggccctccagatgaaccgacgtcaccggatgcctggatatgagaccatgaagaacaaagacacaggtcactcaaataggcaggtgtgtgtgaccctggcagagctaagtgagatttgttggggaggggttttcaaatgggaaatatacgaaaagccaaggagactacattaccagggttgaatgcttttgaccccttcctttcacagtctgttaaatgggaagtaatacataccaaccaggtatggttaaatggtaagtgatattgggaggccgaggcaggcggatcacctgaagtcagtagtttgagaccagcctggccaacatggtgaaaccctgtccctactaaaaaacacaaaattagccaggtgtggtggtccatgcctgtagtcccagctactcaggaagctgagacaggagaatcgcttgaacctggaaggcaaaggctgcagtgagccgagatagcaccactgcactccagcctgggcaagacagagtgaaactctgtctcaaaaaaaaaaaaaaagttatatatgccatgcagttatggatctatgatttggagtcttaaagccttgtgtaagcatttcatctgttatggggacagtattcatattcgtttttcccctttactgatatttggcaaatatttaattcagattcatgatccctaagtcagaaggtttttagctaccttacagtatatagtcaggaaaaactaattaatttggtattagcttatgtaaaatataattaagaaggtaaatttattaattaaaatgtcacctagtatattctgaaggcaataatgagtgattttgttattactgtttacagttattttaccttattaaccttattgatagtgcctgttttattgagagttgtatgcttctttaggaaaacattgcctattttccttaacatttaaacttgtgtgtcattgacaatcttcttctcacctgtagtgccacttacctgtttcctgggtactttgttctgcagagaggagtgaatgatggggagctttcctacctagtgggtatccagtgctgtgtcagctagctatattgggcatgtttgatgaaaatttgtgtatgacattctcccttttggttctgtttgttatcagctaacctcctttcttctcatttgcaccttgtttaccaattcttcagaattggttcctagagatagtataaggccctaaaacttttcctgtctgtggtctgctagatagagccttccagagtatttcctgcctttaggaatcctagggaccccaagggaagaggagtccttttgtttcatgttaaaacagaaggattagtttaaaaagctgcttttgttgttgttaccttatagtactggaggtataaacagataagggcccattcttacactattttcatatgttattcagtctgactgtgtgagttctcccttgctataactcatttgtattcaaagccacttttcgaaggagcattttaccagaagtgagtcccctcccccttgcttgagcctaatgacctcactttccttcctgtcttcctatgtagtgtgtgcttgctaacattgctccagttagctgatctttctccagactggactattagcatgaatatcagttagtgggtgaaaaggggaagctttcttgaattggaaggcccaaaaggacgaggctgggaaaaggaggggcggaatggtcactgatggttccttgaaggaggattcctttttaggactccttctgcttagagcctaaaagccatgatgagggaagtcttgatcttttgctgtgcctgctgctgcgctggtagagtgaagtcagtggttatgaaggcagaagcctaaaaaggattgactgttaggaagtaatcttaacaagaggtactagatctttggatccatgatttacttcaatgttgtcaaacttatgttgcacgaaggatacaaattattaacctcagtttttttgtttttaaagaaaaaacacaacagcagcagctcagcccttctgaacagccccacagtaacaacaagctcatgtgcaggggccagtgagaaaaagaaatttttggtaaggatccagattacctgttaaagccaaaatgtacttttaaatctgctactcatgctgcaacagcagaattcacttcccagacaagttgttttagtggatttgtaaaaagcattggttacccgtgacctgtgttcagtgcttctagtcaccatttctcacaacagtattattcataaacagcctctatcagtgctgtccaataaaccttctgtgatgacagaaatgttttatatctctgctgtccaatgtggttttgtagccactagctacatgtggctgttgagcaactaaggaactaaattttaaattttatatcattttaattaatttagacagccacatgtggctagtggctattgtattggacagcatgactttatgcactatgtaagggactgttgatttattgggcaagaaattatgtatatgcttggagatgtgtagatattcattggtatgttcattccttacacacgtcatgagtttctgtacattgtgataagctaataatgggaatcctacctaagatttctgttttaggaagaatgtgaagatgtggaactagaacagctgtttagaaattgaagctcaaagttttatgttaatatgggcaaaaggggaaataaaatgctaagatagcttttcctcttaatgaagtcaaggttatagaatggcctgtcctgggaagtgtagcagatgttttgcttctgaccaagagggatattcttcagcaaaattctgaaagcagaaaaagacaaagtctcagcaaatgcatttctaggaaagatagggtaagaggtagtgcggggaagatgttggggagaggtatttatagcctagtataatgaaaggagcctggtgatattaataatcatttaacatcggattttataattcacagagttacacatttattattattattgtagtttttgttagcctaggcctgagatagaatgaaacagttttcttcattaccagttcttctgccagaaagtccatgcttaggaagagagaggaatgaaagatcaaaacctaatttaaatggtgaagagttgccaaatttggttaagaaatgtctaattggattacagattcaaattacagagtcccagttgaaagaagctaagcattttggctagctggaaaggttgtttattcaagggtggaatggggctggcagaggcaaacagcctttcactatgagaatggcagtgctggctacaaggcagagtcgagactggcacagcttcatggagctcaagcttggcccagcaaggaaagccagaggagctgtgggttcattaacaggattgtttgggtgccgaggcctggaagaactgaaaaatctaatttaatatctctgcttagcaagacttgagacatccttttccctaagtaaacaagcttggtaagtaattgaaaaagagaatggatttgagaacaaataggcagctatggaagtacatgggcagtgagctattaacaattttctaggaggtagattctgtattctctgtattctaggagtacagagaatactgtacactaggagcatttgctgtattctcccttttgtatattgggtctctggaagcctacagcgtggttagagctgactgaatattcttagatgtgtggcacatcctacgtgtggctgggtcctatggatagttttgcaggccatgatgtgcagtgtccctttagcagtcattaactcacagtgagttatcaatgggtgttagttctctgtgggtctgacaacttagtatagtgaaaagagtgctggcctgtggctgaacatgctggagaagagcttgcctggccacagggacacagccacgcagatccagcatgtgtctcccatgtgccaagtggagcccccagccaagaaggcagccacactagcagagggtgacaaggacaatgacattgacctgtttgtcagcgacaatgaggaggaagacaaggaggcagcccggctgtgggagaagtggctgaggtggtatgtggagaagaaggccaagaagactgcgttggtggtcaagtcctccatcccgctggacatcaagccttgggacaatgagaccaatatagcccaattggaggcctgtatgcgcttcatccagctggacgggctggtctaggggggcctccaagctggtgcccatgggctacggtatccggaagctgcagattcagtgtgtggtgggggacgacaaggtggggacaaactttctggaagaggagattaccaagtttgagagcgtgtgtagagtgtcgatgttgcagctttcaacaaggtctgaagccttagagtgtgtgtgcgtgcatgcgcacgtgtgcaagtgtgtgaggccctgccactattaaaaactgagaccaaccaaaaaaaaaaaaaaaaaaagagtactggcctaggagtcatagagttgttactcatctattaatgtaggattttataatttatagagtgctttcaacaacagttaacatcaatgctataagcatgtgtataaggtttacacagcttttacacaaaggtattgagtagaggcaggaagtaaatccaagccttctgattcctagtcaccgtaattttaccatgtataagtcatataacctttctgaagtgagtttttccatctgaaatatagacttaatactcactgtgtctacctcttaagattgttgtaagatcatagacagaatgtgaaatattttgtacattgtaaaacaaatgtacaaatgtgaagttgcagtggttatgtcacttcttatgttctggcactgcaggtgtgagctttggggaaagcttctaactacaactgtccatagtgttgtggaactgaaaggattaaggtttttctctctttatgggattatcattactgtttatctgatgatctttgcaaatttctgaagctagcctaatttctgaaaatcccagtggaggaagaaatggaatccttatttccatggattcctgtttcccttgaatcttatcaaaatggtaggtagatacttgaacagagtctgggctctggatctaaccctccagatgttcatgagtgggtgcttcagaacagaaaagctgctttcttcatgataggcacaagcagggcagggccttggctatcatttctagaggaagagaattccaggatctgttcccccagcagggtcagtgattgagcagactgtcttttgctttcagtgtgaaagacctggctcttcaggacctcccttctctttcaagggttgttgataagatgggctggccagtttgaaaataagatataaaacaacacacaagcctggcattatattttgtaagaagattgctttataatcgtctcttccactgatctcctacaactttccagagtcatgcttaaaaataaaattttaatttttgttgtatttttttttcctttcattcacttactctctttggcaaaataaggactgcaattccagaaatgtggggaggcatcaaaggtatgtagcaaatgcagggagagaaatcagtacagaatcagagcgaggataagaagaatgatgggtaactgaggcctttttcaggtcaagttagttcataaacctttggttaataaatcctgatttttctggattcttgaaagctttttgggctacatgttcagctgttgagtccagactttgagaaggtcatttctgctttagtgttattgtcagttattcctgttgctcctgctgagtccctgaatctgtagctcaacccgacagcccgcactgtctctctcctgagcgtggctgtcactactgctctcaccggattgcctgtggtggggaggggacatgaagctgcttagacctgaatttctgtactagaacttttttctcagtagctgacacctccattcagtttaacatgtgcctatggtcacgcttctcagacacacaaaagaaatgtatgtcggtcaggagtggtggctcatgcctgtaaccccaacactttgggaggccgaggcaggcggatcacctggcctggccaacgtggtgaaaccctgtctgtacaaaaatacaaaaattagctgggcatgatgataggtgcttgtaatcccagctacttgggaggctgaggtgggagaatcgcttgtacttgggaggcggaggttgtagtgagccgagatcactgcactccagcctgggcgacagagcaagactccatctcagaaaaaaaagaaaaaagaaaggtatgtcatattccctgtaccccaggaatcatgcagtcttactgggaagtgaggactacatgaaaaaaagaaagtatgatatgactatgcctcactgtgtggtacagagagtaagtgctatagaaggccaggaaaatgaaagatgagcctgggccagaggagctatggagtcatttcaggtggaagggcacttgaactaggctgtgaaggaagtataaacagttaggtagaacggaggaagggtggcactccaggtcaggaaacagaatgattaaaggcctaggggaagaagcaaacatggcttgtatcaggaaacaaggtgagctttgatctggctttaaaggggggtccctgtggggaacaaacagtgtgagatgatcaggtaaactgaatgagcctaaatcccagagggctttgagtgatagcagagaatttagactttattccatagataatgggtatcactgattaccttatgaacaaagaaggaacatggtgaaaaaggtgattgagatggttggaactgtagaggaacgcagagtgggttggaaatggggagctgaaatgtatcctcactctgattctgtactgatttctctccctgcatttgctacatacctttgatgcctccccacatttctggaattgcagtccttattttgccaaagagagtaagtgaatgaaaggaaaaaaaaatacaacaaaaattaaaattttatttttaagcatgactctggaaagttgtaggagatcagtggaagagatgattataaagcaaccttcttacaaaatataatgccaggcttgtgtgttgctttatatcttattttcagctttatacatttataaatgtataaagatataatgctttatatcttattgactctgggatcaaggggaaagggtctcactgaaggtgatgtcagggagaatgggaagcagagtcttataccggaggtctttgagaggagaattgaaatttgctccctggctgtgaggaggaaaaggaaggaaagaatcaagcattactcagagatgtaactgtgtagctgggagcacagcagtaccaatgttagaaatagtgacactgagccaggcatggtgacatgcgcctgtagtccaagctgcttgggaggctgaggcaggaggatcacttgaacccaggagctcaaatctgtagcgcacagtgattgtgcctgtgaatagctactgcactccagcctgggcaacatagcgagaccccatctctgaaaagaaagtaatagttgagaagggagactagtttaggagagtagttgatatagacacatatggctagattgagtttgagattacagtgggaaaaaacctcaagagtgtgtgaggtatgtgtatgtgtgtacgttgatttttgcaggtccataatctgttatctgcagttctgagatccaaacagtactacaaactaaaggggtatttttagtttttagtttctatttattattttttaatttgtagcagactcatttggcaaccagacctgtcctgaatagacacagggcaatttatggtctttctttattctacttattgtgaatattcatacttttcattgcaaaaattaggatagcttcgataaaaagcatgtactctgttaacaaatagactccaaatctcagtgatttaacacagtattcccagtacaaggagggggagaacagtgttgcccagagttacttaggaacctggattgagggagactcctctgtcctaggacatgtgcctgccagggaagagagtatagaacttgattctgttcctagctcttggtcagaactagggacaaaccccccaaactaacttttaagaggtccaggaaatacttgagcattctgcctctaccacagtagtactgtctcagacaccccccactccactgcctggggaggcatcacatgatttatagaacatctaccatactacccctctaaatccaaaacatgcattctgaaacacttttggccccaagaattttggctaaaggataatagacctgtattaccatttaccaaccacttgtatatcaggtactgttctaatcactttacccaattatatgatttaattcttttgataattccgtaaattggatactatcattctcactttacagatgaggaaactaagttataggttaagtatgaggctgcagtgccattactttttttttttttttcctgagatggagtcttgttctgtcacccaggctggagtgcagtggcgtgatctcggcttgctgcaacctccacttcctgggttcaagcaattctcctgcctcagcctcccgaatagctgggattacaggtgcccgccaccacacccggctaatttttgtatgtttagtagagacggggtttcaccatgttggccaggctggtctcgaactcctgacctcgtgatctgccctccttgacctcccaaagtgctgggattacaaggccaccacgcccagcctagtgcagttaggtttaatggcaaaaactgcaattacttttgcaccaacctaagttcgaggttacacagctaggaagttgtagagccaagatttgaagcaggcagttggactccagtgctacattcttaacaactacatattggcctcagatacgtggcaagcagatgagccttgcttcagtgattggggctacatatagagattgaggaatcatctatttagaggcccactgagaagttgtatgcagagcaggagaaagccagaagtcagaagtcgcaaggttgaggaatggtcatgtgtttggggaggggtgggagagggcatgaacaagaggaaccagcaaagaagcagaagtggtcagagtggtagcaggttccctgtgctgggatagagtcacagaagttggaaatagagttggccacccaccagtgtgaaatgcctcagagaggacaagaagaatggctggccggaaggcattgaatcaaattatctttatctgaacttcccttatctatggcttattatggtcaacctgatgggtgaaattcagatttagggactcagaagatttgggcatatcatgtggttcatggaagcttgtaaggctgtcatggcatcaaagaagcatctttgtttacactgctttttagtcacaggcttggttagtcttaagtagcagtgatttgtggtttggaacaaaagtttaattccctttctgaataaattcatgtagagcagtgcttaggttatggctcgttatgaaataaatttagttccttcatttccataaaggcactgaggagattccttcattagtatatctaaatataatgttgtcccagggctggggcagtggctcacacctgtagtccaagcactttgggaggccaaggcgggtggatcacttgaggtcaagagttcaagaccaacctggccaggggtgaaaccttgtctctactaaaaatacaaaaatcattcaggcatggtggtgcatgcctgtaatcccagctacttgggaggctgaggcaggagaatcacttgaacccaggagacagaggctgcagtgagccgagatcgcgccactgcactccagcctgggcaacagagtgagactctgtctcaaaaaataaaaaaataaataaaatgttgtcccagtttaagaatgaaagctgttatgtgtgtgtgtgtttttaacctcgtttttttgttttgttttgttttgtttcaatatatttttgagacagaatccttgttctatcacccaggctggagtccagtggcgtgatcatggctcactgcaacctcaagccccccgggctcaagcaatcctcttgcctcagctttccaagtagctaagactacaggcgtgtgccaccacaaccagctaatttttgtattttttgtagagatggcgttttgccatgtcgcccagactgatctcaaactcctgggctcaagcaatcctcaaacctcggcttcccaaagtgttggggttagaagcgtgagctaccacacctggcctaaaacttctaaaaatgaaaaaaaaaaaaaattaaacaaaaacaaaaacctgaggaaatatgtgagtaaactatggactttagttgatatatcaatattgattaattaattgtaacaaaaagaaatataccatactaatgtaagatattaataataggggaaactggctgggtgtggtggctcatgcctgtaatcccagcactttgggaggctgaggtggacagattgcttgagcccaggagtttgagactagctgggcaacatggcaagaccccatctctacaaaaagttacaaattagcccagtgtggcgacatgtgcctgtttgtagtcccagctacatgggaggctgaggtaggagaatcaatcacctgtgcccgggaagtcaaggctgcagtgagccgtgatcgtaccactgcactccagcttgggtggcaggagtaagaccctgtctcaataataacaataataataataggggaaactgtacaaaggggagaaggatatatcagaactctgctctgtatgctcagtttttctgtaaatgtaaaactcttctaaaaataaaatttattaattaaaataatagagctacagcaaggtatgctgggctgtaggcaggaacaggtaaaaggatgtataaccctcccacaggggcagacaggactacaaacttcatagagcacttgggatactccagatccagttgaggaaatagtgtgggaagctggagaccacacatcagagcatggcaactctgctttagaggactcttgtcatggtaactgtttagaatttcaggggaacgagaaaaagaagatagtgaaaaactgctctcagtgcctgtgtgacacttaagttgtagcatagcatggtagttaagagtcaggcttccagggttcaaatcctacctcttcctttacaagcgatatgacctgaccttgggggaacttacttaatcttattgtaactcagttattttctgtaaaatagggataataatggtacttgttttgaggatcagtttaattaatatatgtaaacatgcttagaacaatgcttggtttgtggtaaatgctcaataaacgttagctattatcattattattaatggataaagtggtccatgtgttatcttacaggataagaaggctatatcagggctgtatattttttgagacagggtctcactctgtcacccagactggagtgcaacagcattgtctcagctcactgcaacctctgcctcctaggttcaagcgattctcctgcctcagcctcccgagtagctgggattacaggtgtgcgccattactcacggcacactttttgtattttaagtagagatgaggtttcaccatgttggccaggctggtctcaaactcctgacctccagtgatctgcccgcctcggcctcccaaggggctgggattacagttgtgagccactgtgcctctggcctttaattgccattttaaatgaataaagtaaattttctcagttttaattttgaatatggtaaataccaatagatataatccacataagcaaaagctctttggggtctttaataatttttacagtgtaaattagaaccactcttgtaattcattgaactggaagagaagtctagtcccttaataccttgggaaaagggagtcctttaggcatctacccttcctttcaaactcactcccttttctgttgtctgtttgctatgtgttcttcatcttcaaatactcttaagtcctctttcttccaagccacagcctattaatttgtcttcttcaaaataatttttcttcatcgactatgacttcattctctcctttatctctattatttgctggtttcctgcccatcttacctttcttttcctctacacctgttcttctgtaatatctctctcctttccctgtcattttttaaactccctcaagttgtttgtttgcccttttgcaatatctcttcctctttaatttgttctttgtcattttaacatttctacttcctcttatttctcatatttatacttctgttcttcaattcattcaaccacttaacaaatattattaagcacaaatattatatgccatttcctttgcctggcactggggatatagaaacatgatagacctcgggaggccgaggcaagagaatcgtttgaacccgggagacggaggttgcggtgagccgatattgtgctactgcactccaacctgggtgacagagtgacactccgtctcaaaaaaaaaaagaaacatgatagacctgatctctgctctcctgcagtttacaggctactcatgatggtcattttggaaaaggctgggaacagtgtataagatcctactttacccccagtggggtagctttgggagggttttgggaaatcaatgatagtggtaccagtggcagcagcagcaaaaaccaaatattgcatgtctattatgtgtcaggtattttacttacatttagttgttgtaagaactctgcaaggtatgtttaggcttactctacagatggaaaaactaagactcacagaggataagtaacttgcctgtggtcatatagctagaaagcatcagcagcaaaatttcttttttgtcttcagtcacatcagccaacaaggaaatgtatcctggtcaggaggtgatagagtgggagaaacttccagagccaattgtagaaatagggtgtgtatgaagctagaaacagcatgtcacagcatagcaactgagctgggcagccacctagggatcttaccctaagagctttgttgtccctgatgttagaactggaagttttaactcattggaaaggaatgcccatgcccatctgggaagagaagctggaccaggagccatcagggatgtatgcctaatgttgctaacgaactgcccaaggcttacttggcaatggcaggagtgacacattccagagaattctctaacctgtctatcattctttttggcagagtgacgtcagaatcaagttcgagcacaacggggagaggcggtaagtctgccttctgatgagtagctgtgttcatgtatgccaaagttctcagatagcattgagttcatggaagtcattcccctgtcctgatccctgtggggccactggctgggtaatagggtggattgggcataaagggaggaaagtttcacccttgtcttggcctactaattgaaccttgttcctatcttagcattggaagccatttcaactgctgatgttttactgttctgctctattctgctgctgtgaggtctgacattttattaggaagtgaggactctggccctactcagagtcatggctttcagacacactgacactgtgtcacctgtgggcattagagggagggcaggattctcctgtgatatggtgccattactattcccagtagagcagccctggctttgtccacatcaagggtcaggttggtgaattagaagtttcttcatgatgtctctaggtcatgggaagctgcaccaagtccatcagttgtaaaagactttagctcctttgaggacatagaaagagggagtttttcggtctgtgttctgaatcttacctcattagggaagtgaaagtagtgttacaaaactcttctgtccttttctccattgtcagtattttcattattgttattttttgtgggaagccaaggtagaagttctcagtagaaaaaatgtgactgtacttaatttctgaagttatttaaggaaaacattcagaaagcatacagaactctggacatgggatatttgggaccttgcatgtttgtgcatgtgcggcacatgtacacataaatgtgcctttcggtgttttttccactctttgcctttctttcccattgatatactaccccctgccaccctcagctttcctttgctttgagcatttggacaggtgaagagcatacccattagtatgaggtcttcctactttaagagtctcaccacaggaccttagtacctctaaacattcttgattctggtagttctctacagttggtacctttcagcctactttgcagctggctccagaggagacctgtggctactattctccctttaaaatacacattcacaagcctacaaggttgtcagaggcaacccggtggaagcattgtggaaagtgtggtctgcagagccagggtccttctgctcctatgtgagttccaggcctggagggaggaaggtctgagctctgtccccagctgctcttcctgtgtcctgccattagcagagaagttaaattgtcacttcactgttgctacttttcacattttccaacctgagttttaaagggatggccaaactcagagcagcagagttttcaatcaaaagcacaattgtgttggagcccaattacgcagttaggctctcctgaattccctgttcccaaagtggtatgcagttacagtgagcaggcttacactgagaaagtgtatgtgtttggtttcagagaagctgccagattgaaaccacaaatatttaaggtggtcaggcaggaatggccttctgaagccctgagcagcagaacgttgcttatcaaggttttgaaaatggtgcattctctttttacggagctgttttcaggagccatggcatttcagtgtttgtgtactatatgtggaattgaggactttataaagttggtgcagggaagccaacagagttagtactctgtgccacacagctctagtttcgtgtatttcacgtcaggattttgtagagaatgtcattatgggcattttaaactttttacctggaatatgggtagtatttatctaaatgtaggcccttatagaattagaattcacaggaaagaggaaagaagtcatgacttttcccacttatccatgacaggtattcattctggtgggctgactttccctttactttgagaatatggggaccagacccctgactgtcctcccttttggccccaggagggctggggagaaggattgtagattaagatctccttccctttggaaatgttaatgacacactgatgggggtggttgcatgggtgttagacctctctttgaagcactggcctaaaaatgcctgttattcaataggatggcagcagcttagatcttacccaatctggaagtcctggcctctgatcttgaccagactttcaagctgcttttgtgggttttgaatggctcattgctaggccaaatgcagaagaatttatctctgatcatgatcctttttcaatagtgtgctagggacatctgagtggacttctggtattttatccagaaaggctggacccttttgcactgttgctgaggccttgaagaaggaggggtatgatttgctattaggcattaatagaaagctatcctctcaaaaggcttcagaaacacctctatctagagaatccatctagatagcacctaacagtatcactgcttgggacagttgatttggaagaaaaaaatataagaattacagtctgggccgggtgtggtggctcacgcctgtaatcccagcactttgggaggctgaggcgggcagataaaaaggtcaggagttcgagaccaatatggtgaaaccccgtctctactaaaaatacaaaaattagccgggcgtggtggccggcgtctgtagtcccagctactcgggaggctaaggcaggagaatcgcttgaacctgggaggtggaagttgcagtgagccgagttcgagccactgcactccagcctgggggacagagcgagactccatcacacacacacagaaaaaagaattacagtctcaatgggtttcctagtggagatgaaactaatttggttagcagtataatttccaaaaatgaaaggtggtgatggacaaaggaaaaaaacaggaaggaattaccttcttgagatgttaggctttgcgtgaaggatagattatggtttatattaatagtctatcaatgttgccctgtagaactttctgctataatggaaatgttctatatctgtgctgtccagtacacatatggctgctgtacatgtggctaatgagcacttgaaatgtggttggtgagacagaggaacctttttcttttaagacagggtctctgggccaggtacagaggctcacgcctgtaatcccagcactttgggaggctgaggcaggaagattacctgaggtcaggagttccagaccagcctggccaacatggtgaaaccctgtctctactaaaaatataaaaattagctgggtgtggtggtgcacacctgtagtcccagctactcgggaggctgaggcaggagaatggcatgaacctgggaggtggagcttgcagtgagccgagatcgtgccacttcagcctaggcgacagagcgagactccatctcaaaaaaaaaaaaaaaaagtagacaggatctctgttgctcaggctggagtacagtggtgtgatcgtggagcctccacctcccaggctcaagcagtcctcttgcctcaaccttccccaggtgcctgggacaacaggcacactgccatagccaggtaatttttgtagagacagggtttgccattttgcccaggctggtttcaaactcctggactcaagctatccacctgccttggccttccagagttctgggattataggtgtgagccactgtacctgttcaggaaccaattttcagtttaatcaatttaaatttaaatagtcatatgtggctaatggctgccatattgaatagtgcagatgcagttctagatgatgaaggcttttatgcttctcactgatttgagccaacctgttacagaagaacattaaagaaattatctggtcagattttattaaaacccaatggtttagatccctctctcttgtggcttattgcttcttcctctggttacaccacttcccactctgggggagcagggaagatgagaaagaaccacacacttcttcctctcagcatggaagaggacaagaactgcgcaggcccatggctgaatactgcttgctccaacacacactagtctgattttatcctgcttaggtgtactaagagatgaaggttgttttaataggcatttctccagtcacattgggcatcttttcatgtgttttattagccacttacaattcttctgtgaattgtctaatcttttgccttttctattagattgtcttttattgattttttacaagtattttctcaaagtttgatatttgtttaactttgttgatggcttattttgcaatcagaagtttatttatttatttttttgagacagagtctcttgctctgttgcccaggctggagtgcagtggtgtgatctcagctcactgcaacctctgcctcctgggttcaagtgattctcctgcttcagcctcccaagtagctgggattgcagggcatgtgccaccacacccaggtaatttttaaatttttagtagagatggggttttcccatgttggccaggctagtcttgaactccggacctcaggtgatccacccaccgcagcctcccaaagcgctgggattacaggcatgagccatcttgcctggcttgtcttctgtattttatgttatggttaggaagaccttctctctctctgtctcttatagagagagagagagagagagagagagagagagagagagttttttttttttttagacagggtctcattctgttgcctaggctggagtatagtggcatgatcacagctcactacagccctgatctcctgggctcaagtgatcctcccacctcagcctcccaagtagcttagactataagcatgtactatcacacctggctaattttttaaaaaaatgtttagtaggcaggagggctcactatcttgcccaggctgatcttgagctcctagcctcaagcgagcctcctaccttggcctcccaaagtgcttggcccccaagatttttttttaattctgtattttcttatataaatttgagagtatgtgtgtgtatgagtttctttcttatattcttttcttcagttatctctgattatttttagtcatttctgttctagagtattgggttgaacccatataaaattgccacttttatatatcaaaaatggtcggccatcagtagtctcatatagttcaacctaatacattcattcaaactttttattggccaagcatggtggcttacacctataataccagcactttggaaggccgacgtgggaggattgccagagttcagaggtttgagatcagcctgggcaacttattgaggcccatccctacaaaaaataaaaaattagtcggtgcatgccagtagtcccagctacttgggaagctgaggcaggaggattgcgtgagccccagaggttgaagctgcagtgagccgttatcattgccactgcactccagcctaggtgacagaacgagactctgttttgaaacaaacaaacaaaaaaaccccacaactttttattatggaaatttcaagcacacacaaaagtagacagagtattaaactgaactcccatggacctgtcacccagcttcaacattactaacattttcccagtcttgttttatcaattcccacttttaaattttgctgaagtatttaataacaaatcagattttacacctctttggatgactccttactctaccttatatttgtagaaattgttctttgaactgacctaatgagtctctccagaaaatcttcaatgtcaatactagttacatgcacagatatgtcactggttaagaaaactgatcaggcatatcactaactcaagggggaattcctgtgactctgtagtagaaaatcttaattctgaggaaaatcagtatggagattcttatggcatctcaaagatgaacgatggaaaagacctttcaagtcctagagttgagtcccttaggagttgaggccatgttttcaggactgctactccagtctgtacgttttctaccttatttcctaaataatttttttctttcaacttttatttaagttctggggtacatgtgtaggatgtgcaggtttgttacatagttaaacatgtgccatggtggtttgctgcacagattaatccatcacctatatattaagcccagtatgcattagctattcttcctgatactctctcttccccaagtcccaacagccccagtgtgtattgttccccctccatgtgtctgtgtgttctcatcgttggaacatagtttttaaatctagtggcctcttctgtcattggcagaagagtctaagctgaagtggtagatgaatggttgggattgagcaatagttgtgggtactgttgtcaaacctgatagatgctcagagggtgaaaggtaacggtagagaagaggaaaaaaggaaacaatcgggaaaaggcaaattgagtgaaagaaaacagaatcctatgttgagaagaaaggaagaatatactcagaccattgctttttaaaccctacgttttaagtatacaattaaccaacctttctttctgtttcttttcagaattatagcgttcagccggcctgtgaaatatgaagatgtggagcacaaggtgacaacagtatttggacaacctcttgatctacattacatgaacaatgaggtgagaaggcagatggatggggcagggacaagaggggcagatgcctaccttttttctctctgtttaccagagcctttaaagtttgttcctctaatatcatctgcaggttttcattttctagacccccttttcttaattccaacaactgtgggatctctgttttttactacatgggagattactcagccatctcagccatctccattccccctactcattcagtgcagatagctctaatattccatggtggaatcaggtatggtaccagggctagggcttatactgtctcctttacattttgtaggagtatcttatttttttccccccagcacagccttaacaagaagcagagggtttagcaggggctagggaggtgtgaaaaaccagtgagtaggtcatctattacagtcataaatgcaggattcttctcttagagtttcttctgattggagcttatttgtttcaaatgttagcacctgctccaataagttctttaactcctcctcctcctcactccaccccaacggtccttatttacttctactttgaatatcacccaggaaggaattcttttgaatgtcagtttctgggctgctttcccagctccaagaagaatattacagactacaatcagcttaggctggtgctttgcagtgtatttatgctgagtaaagaatgtgtacctcgaggaaattgagttaggggtgcaagacaagaaagctgggcaacatcatgaccctttgagaaccagatcatcactgtgtagttttattttatttgatgaggagttaaaatttttcttttagtaaagacttttctgaatcatttagtactcttttctttttcagttaatatttccattaagaattcctgatgtttctttattctaaagccaaatataaatcattgttattattttagttcatacatgtcttaacatactctactaatgttaatgatcaggagttgactaacttacatttgattaatttaaaatccctcaattccgttcttttgtttgccctttaaaccctgcactgtcaagatctaagaatcccaaatgaaaaatctactgagattttatttatttatctctttgtaattatagttttattgagattaaaaaatttatcatctaaaagtataccattcagtggtttttagtatgctgatagagttgtgcaaccaacaccgctatctaattccagaacattttctttttttttctgagacagagtcttgctctgtcgcccatgctggagtgcagtggtgcaaacacggctcactgcagccttgacctcctgcgctcaagcgattcccccacctcagccacccaagtagctgggactacaggcacacaccatcacacccagctaatttttttgtattttttatggaggcagggtttcaccatgttgcccaggctggtctcaaattcctgagctcaagcgatctgcctgcctcagcctcccaaagtgctgggattacaggcatgagccaccgcacttggcctccagaacatttttatcactccaaagagaaacctgtacctattagcagttattcccctttctctcctcttctcagctcttggtaagcacttatctttctgtctctttggatttacctattctgaacatttcgtgtagtgcaatcatacagtacgtgaccttttttgtctggcttctttgactaagcgtatgttttcaacggtcatctgtgcatgttgtcagtatgtcattctattttatggctgaataataaatattccatttatggatataccacattttgtgtatctgttcatctattgatagacatttgggttgttttcattttttggtgattaaatagtgctgctatgagcatttgtttacaagtgtttaaatgaacatatgttttcaattctgtaaggtatatacctaggcgtggaattgctgggtcataagataactctaactttttgaggaactgcccagattttctataatggttgcacaattttacagtcccactagcaacttatgagtgtattagtctattctcactctgctgtaaaaaactgcccgagactgggtaatttataaaagaaataggtggctaggtgcagtgactcacgcctgttaatcccagcactttgggaggctgaggcgggcagatcacgaggtcaggagttcgagaccagcctggccaacatggtgaaacgccgtctctgctgctgatataaaaattagctgggcatggtggtgcacacctgtagtcccagctactcaggagcctgaggcagaagaattacttgaacccgagaggcggaggttgcaatgagccgagattgcagctcatttgagacagagttgagactctgtctcaaaaaacgattaaaaaaaattattttattttatttttaaataaacaaataaaggaaagaggtttaattgactcacagttcagcatggctggggaggcctagcaaacttaacaatcatgatggaagggaaagcaaacacatccttcacatggcgacaggagagagaagggccaagcaaatgagaaaaagcctcctataaaaccatcagatctcgtgagaactcactcactatcaggagaacagcagcatgggataaccacccccgtgattcagttacctcccactgggtccctgccacaacacatggggattattggaactacaaatcaatatgggatttggatggggacacagccaaaccatatcagtgagggctgcagtttctccaccatccttaccaacatttgttattttcttcttttaatagccatcctagtaggtgtaaagtgatatgtcactgtgagttttgtttttgtttttggtttgagacagggtttcactttgttgcgcaggccagagtgcagtgtgcaatcatggctcactgcagccttgacatcctgggttcaagtgatccccccacctcagtttccccagtaactgggacaataagcacatgccaccacactgagctaattaaaaataaatttttgtagagatgggggtctcactattttgcccaggctggtcttaaactcctggcctcaagtgagcctcccgccacagcctcctaggattacaggtgtgagccactatccccagcctacttggttttttttatttaactcccttcccaaccattcttatttattcccactttgaatgtcacacaggaagaaattcttttgcaatataatatgatttgcagaacattctcccattccataagtagttttgagattttattttaaatatgtactgtttttggcgaggcgcgatggttcatgcctgtaatgccagcactttgggaggctgaggcaggcagatctcttgagctcaggagttcaagaccagcctggacaacatggtgaaaccccatctctacaaaaagtacaaaaattagtcgggtgtggtgcctcatgcctgtaatcccagctacttgagaggctgaggcaggaggatcactttagcccaggaggcggaggttgctgtgagccgagattgtgccactgcactccagcctgggcaacagagggagatgctgtctcaaaaaaaaaaatcttgtattataaattgggaactgtgtaagttaattggacttttgcttgattttgtgtttaccatacgtgtataaaatctgaccaggcgtggtggctcactcctgtaatcccaccagtttggtaggctgaggtgggcagattacttgaggtcaggagttcaagaccaacctgaccaatatggcaaaacccagtctctactaaaaaaaaaaaaaaattagtggggagtggtggtgtgcacctgtaatcccggctactctggaggctaaggcaggagaatcacttgaacccaggaggtggacattgcagcaagttgtgattgtgccactgcactccagcctgggcgacagagtaagactctgtctccaaaaaataagaagaataagaataagatctgacatttgctaggtcctaagcaaggcatacgtttgcatcttatgaatctcttaataccaagtattcataacatgctctgctttttgcagtgagtgagacttatttgtaccctcagggaccttctatttaatatttcactggaacgtatgagtgtattagtctgttctcacgctgctgtaaaaaactgcccaagactgggtaatttataaaggaaagaggtttaattgactcacagttcagcatggctggggaggcctcaggaaacttacaatcatgacggaagggaaagcaaacacatccttcatatggcgacaggagagagaagtgccaagcaaagggggaaaagctccgtgagaatggaggaggtagttttcaggttctagtcactgactttgcccttaaacagaaagataattaaaccgtgctatgcagtctaaatttgtgtttttatttgtataacaattttcatcctctgaccatccctccaccccttctcttccttttctgcttgttctattaatgtcagcacaattggcagtagagtgggacatgatcctacttaatttggaaaagaatatgggggctgtaactgtttgcaacttgatattttgaagtaaattagtgtttttggagaggcagctcttctcagaaagtatctcacaactgggtactgaggtatgctacagcatggatgaactaaaaaacattaagtgaaagaagctagatgaaaaagattgaatctttatgaattgaattgaatatgtatgaattgtatgagtctaaatggaatgaaatgtccagaaaaggcaaatcaatagagatagaaagtagagtagtggttgcctggggctggaggtgggaaggaggagtgactataaatgggcacaagagatcctgttggagttctggaaatgttttaaaattggattatgatgatggttgcacaactatgtaaaggtactacaaatttttggattgtacatttagagaaaaaaatctgtatggtttcaactagatctcttaagaccccatagtatccagtgagattgttttcctccaaatgtatttttattttttgtttattttatttctgcaaagtgaaacattgagataaacttctgttttatattattttccttttctatgtcttgtatcacagctctccatcctgctgaaaaaccaagatgatcttgataaagcaattgacattttagatagaagctcaagcatgaaaagccttaggatattgctgttgtcccaggacagaaaccatgtaagtagcccttgtcatggtctggcagctgaagacaaagcttgctttccttcaggaacttgtctcgcctccttgacagacattttcgttcctcagccactgccaaattgagagcataagcacagcacagcccacttgtcagtggccagtgaacattctgcatttgatttcaccgaaaagccagattgtcagtgttaacattgcatctaaaggttatttgacttttggtgagggaggaaggaaaatactttatgataaagaataaaattcttgtgctctaaatttatgttttttcaattagattttgaccccaacaagagaaatttgattcgtttggcagtgccgattaggaaagactgtcaaagatttgagactgtcatgctttataaacccaactcccacaacaccttgcctttcccttggaacacttgtaggaaacaaacttttccttttgttcagtggaaaaagccatgggttgggggcctcttataacttatcagctgttgctttacccaatggcaggcagtctgtagggtgtcagaagtggggaattatcccttatgcacagtttcctctcctgaaggattcctggaggcccgcatttcacaagaatgcttgcaatctgtatctgtcttccaattactgattcttctaccagttttcttcagatgcatgtttctgaaggtttcttggcaccatttccttttcttatgcttgacaggctttccttttctttatgtggacagccaacatggcagcataagtgtgggtgtagtgactaggacaaagtttaggtggaatgctgctcatgctgaccatttcttttctttttttttttttttttgagacagagttttgctcttgttgcccaggctggaatgcaatggtgtgatcttagctcactgcagcctccgcctcctggcttcaaatgattctcctgcttcagcctctcgagtagctgggattataggtgcccgccaccatgcctggctaatttttgtattttttagtagagacaaggtttcaccatgttcgtcaggctggtctcaaattcctgacctcaggtgatccacccgcctcggactcccaaagtgttgggattacaggcgtgagccactgtgcccggccattttttaatttttttagtagagatggggtctcactgtgttgcccaggctggtcttgaattcctgagctcaaatgatccacccactttagccttgcaaagtgctgggattacaagtgtgagccactacacccagcctgtggtgaacatttttctatgttgtaattataatttgtaaggatacatgtttctcttgagtcgatataccataatttaattaaataaccatttttgctactgttgggacacagaaactgctcctgttttttgcatttataaatatttacatttaagagtaacaatggtaatgtttggtgatgaaatctttcctccagaacttcctcacctagactttaggcttcttaataaatggaagaattatgatccaaaattgctctgtgctcaggaatcctcacctctagaacagtgttcctctaactatatgtgatgaaatatcagttttgttcttttgatttcaaatctgtcatggacttttttttttttttttttttttttggagatggagtctcactctgtcgcccaggccggagtgcagtggcgtgatctcggctcactgcaacctccacctcccgggttcaagcaattcttctgcctcagcctcccgagaagctgggattacaggtgcacgacaccacgccccgctaatttttgtatttttagtagagaaggggtttcaccatgttggccagactggtcttgaactcctgaccttgtgatccgcccgccttggcctcccaaagtactgggacaggcatgagccactgtgcccggccgtaccagttctttttttaaatacaaaaactgagaagtgaaatggaaaaataaactagaggtatataaattataaggctacagttttcattagtagattcaataaacataaaatcactctgccaaattgctctaaagtttttcaaagggccctctccatttctttacttacttggtggaagagcaggacgagcagtataccagtgtgtggactggcaccagcccagatatcataccttaagtacactgctccaggatactatatcacctggtcttcatcacctccgctgatactgtcagtcactttgtttctccactttgaatttcctgcatttgtagcagttgcctcaccgccttttgttaccacctattcctttatttccctttttttttgagatgggatcttactctgtcacccaagctggagtgcagtggcgcagtgacagctcaccacagcctcaacctcccagactcaagttatcttcctcccatctcagcctcacaagtaactgggactacaggcgtgtgcccccatgcttggcttttctttttttttttttaattgtttgtagagacagggtcttgccatgttgcccaagctggtctcaaactcctgggctcaagcaatccttctgtctcagcctcgcaaagtgctgggattacaggtttgagccaccatacctggctgtttctcttcttgttcctgttttgaattgtgctatctctttcttctctttggattcttcttcttcttcttcttcttcttttctttttttttttatttgagatggagtttcactcttgttgcccaggctggagtgcaggggtgtgatcttggctcaccgcaacctctggcttccaggttcaagtgattctcctgcctcagcctccccagtagctggggttacaggcatgcaccaccacaaccgcctaattttgtatttttttttagtagagacggagtttctccatgttggtcaggctggtcttgaactcccgacctcaggtgatccgcctgtctcggcctcccaaagtgctgggattacaggcatgagccactgcaccccgccttggattcttctgatccctatatggcagcttctaattttccttctgtcttcattcctcacaaggtacatagtcttacctctcccacctcactttggccaaggccatgtctgagaggcctcaatattattcttgagaactcctgagttttggtaatcacagaactatctctttttttttattttgaggcacagtttcactctgtcacccaggtacgatctcagctcattgcaacctccgcctcccagattcaagtgattctcctgcctcagcctcctgagtagctgggattacaggtgcatgccaccatgcccggctaagttttgtatttttggtagagatggggtttcgcactgttggcgaggctagtctcaaactcctgacctcaagtgatccgcacgcctcagcttctcaaagtgctgagattacaggtgtgagccaccggatctggccagtctctttgtctgaaaagcctctctctagccttggtctctaccatcattttaagatacttcattgtctccttctgtagtttttgctgtcctaagcctctgctttggaccaccaacttttagcttatgcatctaacttttacatttgtctttcagctcttgaccttcttaggactttctagtctcagatcttccactgtcataaagtaatatcaagctgaaccttcttttgtaacttgtatttgtatacgataaaaactaaacacctagccactttgttttgttacctcatattcgcgttgacaaaaataagcttctaatcttctcacctaaatattgtaagttaaaaatatcaaggataatttaaaaggtaattcttttcagtccttgtaaaatagtgggacaggtgcaggaagataaaacaaacctgattgggcagaatagcttcttctggcccctgttaaaaataaacactgggccgggcgcggtggctcacgcctgtaatcccagcactttgggaggccgaggcaggcggatcacaaggtcaggagatggagaccatcctggctaacacgtgaaaccccatctctactaaaaaatacaaaaaattagctgggcgtggtggcaggtgcctgtagtcccagctactcgggaggctgaggcaggagaatgacatgaacccaggaggcggagcttgcagtgagccaggattgcgccattgcactccagcctgagccacagagcgagactccatctcatctcaataataataacattgggctgggcatggtggctcacacctgtaatctcagcactttgggaggctgaggcaggcagattacttgagcctaggagtttgagaccagcctgagcaacatggcgaaaccctgtctctattgaaaaaaaaaaaaaaaaacgaaaattagccaggtgtggtgcgtgcctgtggtcttagctacttgagtggctgaggtgggagaatcactgaggccgggaggttgaggccgcagtgagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagctccgcctcccaggttcatgcccttcttctgcctcagcctcctgagtagctgggactacaggtgcctgccaccacgcccagctaattttttgtatttttattagagacggggttccactgtgctagccaggatggtcttgatctcctgacctcatgatccgcccgcctcagcctcccaaagtgctgggattataggcatgagccactcccggcctagcttttagattttttaattgagggtttagatagtatgtcctttggtacacatttcaaattcatgttgccatgattttttgaattcccactatgtgtaaggccctgcattcaggcaggtggcagggtgctcatcatgcacctcctctttgtgagtgcaagactatgaccctcccttgcccttcacttgcctgcctccccagtatgtggctttgactgttgtttcctttttgacccttagcagagagctattgcacatcggaggcttcagcaagaacattcacttcccccttggttctgacttcccgttagagcaagacagtttttcaagacaacctgcatgtgataaagtctggcatggggactacaggaggttgcttggcagctgaactctcccctgagagcaggaaacctttttcctggaggacaggatatagagtttgtttagatcggactttttttgttagggggaggtagaggagatagaggagcaagtagaaactttgaaccaacttgtttgtaaatcctgagctctcaccccgactctcaccagtgccctgcttatttgtaatagcatcctgacatcacttgattacctccagggtttagttttaagctttctcagtgcaaaggcccccctttgttgcttagttttctctggcggctggactgggcccagtggaaagagtgggtgggtgctgggaggattgctgaccctcctctcaggcccttgacctctgtctggcacaatggtacttatgatagcttttcccaattgaacatgatcctgagatgatttgtgtgtaaaccctggaatcttcttaattttcagggagtgattattgttgggaaaaagaagcaaattgagctacttttaaacatacatatataagctgggcatggtagcatgtacctatagtctcagctaacccggaggctgaggtgggaggatcccttgagcccaggagtttgagtccagcctgggcaacatagcaagactctgtatcaatcaatcagtcaataagataaatacatatatagcaaccagaattttgttggggagggaagttgccatcattcactctccatcctgacttcctcctctgcagaaataattttctgctactcttcctaaactctctggagaattttatgagagggtatttacagctctcttttctgttttgcagattattacaggaatgcctgttattcctccatgtctggatcatcacctgttaaactggggcactaggtctcagcgctcatacatcattgaagctataaaactacattgagcgaatagtggtttgctgagacaaatagaagagtgagatttgggggaaagctgggtagctcatgtattaaaagcatgaaggtggctgagcctgcagggagtccttaggaaaagggtgagaagaccttgataggcctgactgtgtaaagatgtagcttggcctttttcctcttcttttacagaacagttcctctccccactctggggtgtccagacaggtgcggatcaaggcttcccagtccgcaggggatataaatactatctaccagccccccgagcccagaagcaggcacctctctgtcagtgagtatttcaacccttttttctccccctctattttatctgcccacattttaaaaaagcaacaagtatttgttaattaaataatcatcaaatatttattaactattactctgtgtagagtaatcctttatgcctttattttatttagagaggaagggcaaagaaataactgggatggtatcctgactctcaaggaacttaaaatataatgatatagtagtgtgattaaattccttttaaacatccctgaaaaagtgattgcctcagacatctgcttgaagacttccagctgtgtttacactcacttttgaccattcttgtgaagaatagagacttgtaaagttaggaatcgggtctaagtttgaattttgaccttaaacctcttgcttatgattcctgagaagtctttatacttcagggaagatagtgaccaatgaaacttttgagagagtcaagctaagttgtctggaaggaaaggagactattgacatagtacagtcatttctctgtgtttgtaggggattggttccaggacccctgtggatgccaaggtctgtggatgctcaagtccctgaaataaaatagtgtagtatttgcatataacctacccacatcctccttcatagtttaaatcatctccgggttatttataatatgatgtaaatactatgtaaatagttcttatgctatatttttatttgtatttttttgctattgttattttttataattttccatatattctcaatctgtggttggttgaatccacagatgcagaacctggagatatggagggccaactatatatacaaccctctgctaactagtcagaaagctctgtggctgctaccagtccttcccaggacaggaatctaaatcaggcctgtgcattattacttgttaacccaggattcctgtggattccacttttgggagtctggggagaaagcccccatttcttgaattgtggaacttgtatcaaaagggaaatctggtcttatcaaacatcgtgttgagcctgctgccttaatgttgtggagacccctgctgctgctagaaagccagctttgcccttatccatataggtagaattgcttcaaattgaagtgtcctctgaagatcctgagctgagcttgagagatctaagcactgatcctgttgctgagtttgtctgtttgcaatatgcctcctgagggagttacaggaaaaatatgtttctgaggtactgactttgccttactgagtaacttctggaatccaggcaagtactggtagtaagtattgccaggctgaaagtctgtatatgaatttcagatttctgtagataattggggaatgtgttggttgaggatggagagctagtaccctagcaaggagagcctagccacagcgtctctggccctggaatctgtgtgcctcagagcctgggaagctctgccagtttggcctcttttccgtagtccttgtagagattgaggggatggaggtgggcagcatggtcccttgtaatcagtaaggattgatggggcagtaactgggtctcttgcccccaagcaagagcctatgatatgtgcatggaggcaggggctaaatacttagccactggaccctttctccatgttaccgggagctatatatggaaatgattttcctggctgagaatgctgaggagtgagatttctgtgaagtagttcctgtttatctggaaaatgggcaacacggcctcttagcatacctagatcctggcttccttcattcagcaaagcattaagtaccagctgttgggctgagatgaatgctgcagtgaagcatttgaaagagcaagggtggctggagcagattccgcctgggagagaggggctttcacagaaaaggtaacatcagagctgacactccaaggaagatttactgagcatcaagtagagagagatatctcaggcatagtaaggagcacctgccaggcatgatcacaaaagaacttggtgggttgaagaaccccaggggctttgcactgtgtgtagggtaaggtagatgtggcaagagaatgggctgagcctgtgagcgtttccatagagccaagaaatgggagagatgatttctaactggaatgatctggaaaatgcattctgaggggagctgttccagctggaccttgaaagattgtggaggatttccacaggggacaaggggagagaggagagggcttttagactatgtctgtggagagctcgctattcttcaggtccaggctggctgatacatttggaggaggaatagagaggccaagaaaggatgcctgggtgttttctaagggactctcagctgcactcagactcttttggtaggcagtggaagccactgaaaatgtttgccccttatacccatcaccattataatatttattatgttgtctttttttttttttctcgagacagagtctcactgtcacccaggctggaatgcattgatgccatctcggctcactgcaacccctgcttcatgcgctcaagcaattcttctgcctcagcctgttacaggtgcacaccaccactccctgctaatttttgtgtttttagtagagacgggatttcgccatgttggccaggctggtatgactcctgacctcagatgaccacctgcctcggcctcccaaagtgttgggattacaggcgtgagccaccacgcctcaacctatcatgttgtcttatctttcttccatcatactacgtttttgttcattcattcaaaagataattactggctgggcatggtggcttatgcctataatcccagcactttaggaggccgagttgggtggattgcttgagcctcaggagtttgagactagcctgggcaacatggcaaaaccccgtctctacaaaaaatacaaaaattagccaagtgtggtggtgcaagcttgtagtcccaggtacttgggaagctgaggtgggaggatcacttgagcctgggaggcagaggtttcagtgagccatgaatgtgccatggtactccagcctgggcaacagatcaagaccctgtctcaaaaaaaaaaaaagtaattaccaaagtatctactatgtgccagaaatatgggaagcaaaaaagacacaggccctgtccctgtggcctttacaatccatggaaagacagacatttacttcttatgatgtgattaatgtataattacaaactgtgactgaaaggtgtgtggtgctgcaggtgggctataactaagaaatgggctgggcatggtggctcacgcctgtaaccccagcacttggtgaggccgaggtgagtggattgcttgaggccaggagtttgagaccagcctgaccaacacagtaaaaccccgtcactaataaaaatgcaaaaattagctgggcatgatggtgagtgcctctagtcccagctactcagggggctgaggcaggaggatcacttgaacctgagagatcgaggctgcagtgagtggagattgcaccactgtactccagcctgggtgacagagtgagtgagactctgtctcaaaaaaaaaaaaaaaaaaaaaagaaagaaagaaagaaatggtgggctataactaagggatgggacctgatcctgatcttggggccaggaaagccttaggcatgaatgggatttgggaattaggcaaaagggatgcaaggaagagggttccaggcaggggatgttacaagagcagagacttgatggcaagaggaagtgtggtatgtcagaaatggaaagaagtccagatagctggagagctgggagcaaggggaaggggagggcaggatgaagctggggagggaggcagagccttgtggaccctggttaagattctgatcattgcatggaaagtagtgaaaagctactttagagtttttaagtgaagaggagtgggtgatgttacatattcgtatttgtattttgaaaagattgatctggctacagtgtggataacagattggagggggcaagaatgcatgcaagggaactgcattaggctaatgcagtggtccaggtaaagaaaactgggcttggagtaggctgatgaagtggagagaggaaggagcaggtgaacttgtgacatttagaggtaaaactgacagaacatggcgttttggtggttctcaaagtgtgttctggggatcctggggagtcccttggatcctttgaccctgtgagttcaaaattattttcttttttttttttttgtgacggagtcttgctctgtcaccaggccgaagtgcagtggtgtgatctcggctcactgcaacctccgcctcccgggttcaaacgattctcttgcctcagcctcccaagtagctgggactacaggcatgcgccaccacacccagctaaattttgtatttttagtagagacggggtttcaccacgttggccaggatggtctcgatctcttgaccttgtgatccacctgcctcagcctcccaaagtgctgggattacaggagtgagccaccacgcctggccctcaaaattattttcataatcatgctaagacatgacactcaattctctcacaagggtacaatggaggtttccagaggtcaggtgcctgaggtgatgtcatcaccgtaatggcttaatggcatgtgtgcttgtatatgattgtattcttaaaatttcttttttcctccactggtttctcctgagaaaatgtttttaaaatttctgagttttaattgcaaatacagtaaatatcagttgatatatcctacataaatgaaagctaagtggcctcagttttaaggtacagaggggttctaagaccaaaaggcttaagaattactatagtattggattgaatttgcaggtgttttcaggaggctaaggtgggaggatggcttgattccaggagtttgagcttagcctagacaacataatgagacccaatatcatttaaaaaaaaaaaaatgaggccaggtttggtggctcacatctgtaatcccatcactttgggaggccgagatgggtggatcacctgagattaggagtttgaaaccaacctgaccaacatggtgaaaccccgtctctatgaaaaatacaaaaattagttgggtgtggtggcatgcgcctgtaatcccatctactagggaggctgaggcaggagaattgtttgaacccgggaggcggaggttgcagtgagccgagatggtgccattgcactccagcctgggcaacaagagcaaaactccatctcaaaaaaaaaaaaaaaaaaggaaggaagaaaaaataatttgcagatattgagagagagggaggtaaattactgctttgtggagatgaataaatggcatcgcctttcactaagacaggaatactggaagagagcctggttccaggtgctgggaaggggcagacttaatgttttagacatgttggtattgaagtgcctctgatacagccaacaggagatatcagagaggcagttagatatataggtctctagctcagaggggagaaaatcagggctagtgaaaaaatattggaaattgttatgttgaaaccatgcacccaggcgagagtgcctaagcagagactatagaatgagaagaaaagagggtccatgattgagccttaggaacccaacacttagtggccagttagaagaggatgagcctgtgaaggacacagaaaaggagtaaccagagaagtaggaaaggaaattaggagtgtggggagaaggcattacacagaaccagccaggttggtaaggacagaccaagggtaagagacagaaacctgttattttcattcacagatgtttgagtgcttgctgtgtgctggtacagacaagactttctggaagggaaacagagacagaagtcaaggtatagcatgagagacttggaaaagtcctagcagtagaaatggggtccaagaagtccttggttagtaagccttagcaattcagccttccactgggttcctctgttgcctccttgccatcatcgtttacatacatgtgaatatttagtgagtctgcagcaagcaggctactcagttcacactggaacatttgcattgatggggaagcgcagggtagcccaatcaaattccagacatgtatatttgaaattcttctttattttggattgaaaatcagctttctctcactttacccactgattctagtgctgctcccttgagcaacagataaacacagataaaatctttcatatgacagtttttcaaacatgtgaagccaggtatcatgtttaccctttgttgtttccatcataatatgcataccttgaattccaggtttttttcaggccatttagtctgttaaactagttcatgctaaacaaaacagaaacaaacaaaaaaaaccctactaagtaatgagttaatccaaaggaattaatctctctgtggggagatcactaggcagataggtggaatttccttacctgaagacatcctctctcataccttggcctacggaaattctacctacctttgaagctcaagcactatttttccatgatacattgggtggtgcccttaagccatgtaaccaagcctcaactaaaggacttgtcggcggggtgcagtggctcatgcctataatcttaacactttgggaggccaaggcgggcaaatcacctgaggatgggagttcaagaccagcctgtccaacatggtgaaaccctgtctgtactaaaaatacaaaaattagccaggtatgatggcaggtgcctgtaattcgagctactcggctgctgaggcaggagaattgcttgaacctgggaagcagaggttgcattgagccaagatcgtgtcactgcactctagcctggacagactcttggtctgtctcaaaaaaataaaaaataaataaaaattatccaggtgtggtcgtgcgcatctgtaatcccagctacttgggaggctgaggtgggacaatcacttgaacccgggaggcggaggttgcagtgagctgagatcgtgccactgcgctccagcttaggcaacagagtgagactctgtctcaaaaaaaaaaaaaaaggacttgtccctgctacattctgactcctgtatggtctaagttcatcttgttaagtgcctttgcctcagttctcactctgtctttctccttatcttgccactttgtcccatagtgaggcaagccatactccaacgcctgagtggaggcaatcaggtttttctggagtttggtagtgaaatggtggacctgccagttgcagtggtgcgtacctgtaatcccagcactttgggaggccaaggtgggtggattgcttgagcccaggagttcgaaaccagcccaggcaacatggcaaaaccccatctctctgtcacccaggctggagtgcagtggtgccatcatggctcactgcagcctcaaccaccgatcctcgcctcagcctcccaaatagctgggaccacaggtgcttgccaccatacctggctaatttgttttttgtagagatgagttctcactatgttgcccagcctggtcttgaattcctggtctcaagcaatccttctacacctcagcttcccaaagtgctgagattataggtatgagccaccatgcccagcccaggatgttcttaggctagagatatgaggaagtgtatgaagggagggataaagacagctgaaaaggaggggttaaaggtgatgaagaggagaccatgggggagctgactcctgctggagatgaatcgagtccaggtagagggtttataatacttttgcaaggaagagaggagccctctctgcctctgagagacatggagggaaaattcaggcagaggacaagaaagaatgttgaaaggatgagggtagattatagcgacaactgggcagtaaacagagagcagtgctcaggaccagcttccagtcctagtaccgatttgaaagggtagaagccaggactgtagaggtagtgaccatacacttggaaacaaaatggttagcttctttcatcttcaaaggttttttttccctccttgctataagttctatgatgctacatgagatcagaaactttgatggtggtagcagctccaaaataaaatgggaattttgaaagttgaaacatagaagatgttcttagggtcttatggaaattctacccactactgtgttctacagagtgtggtccactgtgagcatattggtaaatattagttaagattttctattgagaaagaaaaaaagtttgatttctctccccatctcatctgtccctgaagagagaaaagagtttaggaaatagttagtggccaaaaaagctatctctttatacttgcagtgacctgcacattaacactgacccaaagccctagaactccctgcggagacaacttcctgactgcatcagcttcctgattagggttctgctatgagaagggctagaatctgagagcctgtcgttcagctttaagtcagagtacaaagcaaaagaacctaccatatccgagggtgagagtgtatctttgactctgcttctttgggttaaggaggctggtagagagctagcacgcactgggtggaatgaggatagctggcagcttaaaccccgcttttctccttctgtgtaaaataccttcatgggaaactgtgggcctctctctgaacagtggaactgctactgtgctcctttgcttcagctggtggcacaggtggcgcagtgaggctagagcaagttcaggctggaataccagggaaaggtgtcccaagaaagcctgtgacccctgcctatgcagccttctgagacctacggaatgagctgttttgcatagctctgtgctttgggctgtctggctcattgctatcactgctggtaaatacgtagttttatggtccagtatcctatcctgtttagctccctgtctcacttgctctcaactgttgtgtatctcattggctcccaatttctgaaatgaagattaaaaacaaaactgaaaatgccctggagcagttctgccaactcctggtttttccattcggttcctctgatagccactggtttggggagacttccttttcctgctccagcctgtgggcctgtgcacaatagccgctggcacatagcccatcagataacaaggctggctctctgcaggcacagtgtggattggaaaaagtgaaagtttctggctggaaataaaagctcagaaaacctttgctatttttccccccagaccctcctgggtctgtagtgctggcctcctgtgagctagtcccatcccacctgtaaaaccaggggagagttcagtgcagctgatgaaggaggggacaggtgtcagggggaccatggatattttatcccagggaagtctcaccccagacactccatgtaacagattgagggcatttcatcctgcctaggcatagtttggaccagtgtctgaggtttcataaataagagtttttctttctctccaatcagtcccttacaagagacatttttatttgttctaggtaaaatgtataatacagctccagagtgtgttggtcagagttcagttgtgcagaggagaacccactgtagctagtttcaggaagaagaggttccataaaccagaggtgcacattgtggattatggaatcaatgagggaagaaagagaagcagcctctaggttaagacacaccacagagcgtcctccctcttctgtaatcaggaagccaccggtccagaagtccagtgcccctcaggtctggtccacacctgtcaacatcggcaaagctggagaccaggtgtggggcctctgctaacactgtggcagaaaaaccaaaggcttctgtgactgctcaggaacagcaggaagcctgttaatctcatagaagtgcatgtgattagctgaatctaaagaaagtcttagaaatacagcttttagccagttagcttctcaagtacaggaaggcacagtagaagggtggaatccatcttacgcctaccccatatatctgccacatagagtgaagggtacaaatgggattctacggagttcctactgtgagatggggttatgcggatatgtacctgtgccagcacatttataacttccgaaagaaattatgaggtagatagttctccccatttttgcagttgaggaaattgaggtgagagcttagatcatttagctaatgagtggcaaagcctgatctgaacccacgtatatctaatttcaaagcttagtcttttctccgtgcacctcacttacctccttagagttgcttctgctgctgacaaatgttgctgacatgtggattgaattgccatagaacttgtggactaccaagatgtcatccaaagctaaaagtaggaagcaggcagtaggctaatttttataagcaaagggttaaatagtgctctctctgtgttttgtgacatgataagacttaggaaaaccatcctttttttacagttgcactggaattttgtgttacagtagcaagggaaacagccaggtacatgggtctgtgaggtctgggtcactggaaagtggagtagttcccttggtccagatttcccctaaacctccatcttgtctttgcctacaaaccctctgttggccaagcggcattttgtattcctggcctctgactcccaaatgaccatggagaaaacaactctgaatttgagctgcatgaaacatgccactgtggatgtggctcacacctgtaatccctgcactttgggaggctgaagcaggaggatcccttgagcccaaggagtttggggctacagtgagctatgaacacgccactgcactccaaagaaagaaagatacatggcactgtgcttcccctgtgctgccaggaagtccccacgttagcctccctcccacacctggcaggctgtcatatttccttgtggatgggatctccatcctccatagggattactcatgggggacagatggcctggccagttcaaggagaagttatgtcttgtgccactgtgttgagcagcatgcctgccctttttggaaataaattatggtccccaaattgccttggctgaactgtatgagagtcacaaagcctgttttctcgcttcggccccaccataaagtcactttatggctttggggcttgggtttccctctgcgcaatgtggatgatgataatgcaccaccactgcaggggtgtagtaagggttaaatgagaggtgacaatatttttttaagaaaaaaaaattgccttgactgattttattgctctgttagttcatggtacaatatccctaaatttacactcagagtaactttagtttctgttaggacttagaaaataggacaaattctcttccatgggctgtttgagaccattgcaaaggcatggctcagataccactttatctcagaattggtggcctctaccctgtgagtgagatgttgagacaggaaatccagcaaaattctatgcctgttttcagagcaattttgtttctggcctttgctctggagtcaggtggggaggccagattactgaggaccccatgttagctttcctgccagagagacatccttggagggaggctggggtgatgtgtccaagaagagattggaagtattctccaataccagttcagtggtgaattctcaaaatgtattcagcacaaccacatgaaccatatgttctgaacaactgacttaatatagaagaattaaagagtcagtttcaactgggtgcagtggctgacgcctgtaatcccagcactttgggaggctgagacaggcagatcacctgaagacaagagttcaagaccagcctggccaacatggtgaaaccctgtctctactaaaaatataagaattagctgggtatggtgacggccacctgtaatcccagctattcaggaggctgaggcagaaaattgcttgaacccaggaggcggaggttgccttgagccaagattgtaccactgcactccagcctgggcaacagagcaagactccgtctcaaaaaaaagagtcagtgtcagtttcttaaaggtcattgaaaaacaatagtttaagcttcttagaaaatgtctttcaaaaagcaaccctctggccaggcatgggggcccatgcctttaatcccagcactttgggaggccaaggcttgagaccagcctaggcaacatagcgagaccctgttcctaaaagtgcacacacacacacagagcaagcctccccgccattctttttttccattaagtatttttcttccttctgagggtctttgaaatagtgggagtctctctggctcagggagtttgttgagctccatcagtctgtcaggcccaccctcttttccgggatgttctaagaccctggactgggctcttgagcaccctctgctgtagatgcttagtccctggtgcactacctctacttccaggtacaggctgagtgctcctggctccacatgagctttgttgttttgtctatgagacagggtcgcactctatcacctatgctggagtgcagtggtccaaacacggctcactgcggcctcaacctcccaggctcaagcagtcctcctgtctcagtcttccaagtagctgggtccacaagtgtgcgcctggctaatttttaaaatattttttgtagagatggggtctcaccatgttgcccatgctggtctcaaactcctggcctcaagcatttctcctgcctctcgaagtgtcgggataataggtgtgagccactgcacctggccacacatgagtttttgagcaataggaaatatatatacatatatgtataaacatgtatacacacacacatacataaaactaaaactgtgtatctcagattttccatctaaaactggtctggactagggatctatcatcaagaaaggagagaagccaggcatggtggcacctgcctgtagctgaagggggaggattgcctgagcccaggagctcaagactagcctgggcaacagagtgagaccctgtctctgaaacaaaacaaaacaacaaaacagaatagaatgagtcaggtacttccctaggtctccagctaccaaacttggtctctcttgcttccttagccatttccacagagcatcttgcctgcagttccatttcagaaaacctagtgctacagcccctgaactagactggagaaaccagccagcaaggaaagtaacctgcattgttgagggatggtactactctattcctggtgtctgggaattgctgggtcgtgggagagaggtaaggggtggtagataagggaatggagggctcttgtgtctctggttttctaaacaacaggataaatttgttcccttcagaacaggaaaagggttcaggataagagtcttacgtttaagttttgaagctacaagaaatatttgtgtgggtatagttaaagctttttttaaaccttctgaaaattggctcttctggtttggtgagcttaggaaggaaaaaagatgcaaacttttggcctcatttttgtcttctctgatcatggaaagcaacacagccagtcagaaaaagctcttgggctaggaggaaggaggacctgatttctcggactcaaaatcccttatggcagaaaaacattgctcagtgacttacaaagtgtgtcatttgtaagactgcacacctctgtcattcactaacattaggatgataaaccatttcatcttacaagctgatgtggtgaaagtacctgttaattggttttatagtctcttatctgtaaaacataaataattgtttttgggtgttttgggttttttttttttttaagatttaagttccttgagtctccgtctcctcctctgttaagtaaagcaaatgcttacctctcaggattgttgaaaggattaagtgaagtaacaaatgtaaaaataccttgtggaatgattgccacttagcagccactcaaaaaatatttgccaaacctctgttgtagagatgttgaaaatcaaatgaggttaattactgtgaatgtgtaacaaaaagtaaagcaccacataaatgcaagataatatcattactcagaccaacctgagcaacatagtgagaccctgtctcaatttaaaaaaaaaaaaaaaaaaggtaatatcattactcataagccaggaagtgtgggagtgggtaggaatggagaagcctgccttttgatcctggccagaccatcacgaaggcctttttacctgatacaagtagagaacaaataaggggagacactggctgggggaacagggcaacagagagagatgcacaggtatattcagttacctttccctggtccccaccctcaaaatactgcttggacccaaaactaaagaggactaagctgatgtattgagctgatgggaggaaatggcattagtgctctagaggaagagagaaggtgacattatgaaggagtaattatatataagaatttttttaaaagctagtctgattgccagctaaaatggtctcctaggggttattctggtttctgttttgtgtcaaggtttttttggtcggatatgccgtagtgcctgctccatctctggagtttgtttcctattaggaagggactttgtttgcctgagggagctggcacatgctggacgttggtgccatgacccatctgagtcacattcctgacctctagggcctaatagttggccccatgcctgctcctcttgggccacacaccctgggctctgttgttgaaagcctcctttatgtgctctaggctcccagaaccctggccgaagctcacctccccctggctatgttcctgagcggcagcagcacattgcccggcaggggtcctacaccagcatcaacagtgagggggagttcatcccagagaccagcgagcagtgcgtgagtataggggggctgggatatgcctgtggcctgtatcagcagaccaagctcataacaaggggttcttagtagtcacagtgcagaactgagggacatgaaccccatttgaaagctcttttataaaccaggcctgcccaaatatggattgtccctttttaagggccaaataacaatttctgccaaagatgggatctaaaggatctaaactacatagtttccttgttgttgggtgaggatttaacagatttttcttcatcgtggtcctctcattgttcctacaggcaggcaccaccacgcccagctcatttcagtagtgttttaacatacgactggttctaaagtgacaggttatgtttttcattggatatattttagttttgctgtttcttgatgaaaggtaaggagtaaaccatatcaaaattacactgtaggattggttaggctgatcatttatgatggtagacagttgtattagttatctattgctccataacaaattaccacaaacctagaggcttaaaacaatatacatttatcattttccagtttccctgggtgaggagtccaggcatgactcaaatgggtcctctgctgagggtcacacaagactgcgatcaaggtgtcagccaggctgcctgcctttcttgagtttgaggctcttttctaagctcagatggttgttgccagaattcagtttttttgtggctgtaggactgtggttcctcttttcttctgaatgtcacccaagggcttctctgagttcccttcctagaggccacctgcagttccttgccatggggccctctcacaacatggcagcttcttcaaagccagcaggagaatcttttgctccaatctgcaaagatggagtcataaaacatcacataatcataggaatgaatattctatcctctttgccatagtctattggctagactcacgtcacaggttctacttgcactaaagggaaaggcagttcattgggactaattggaagagggagcaatcaccttagggtgtgtctaccacagtggctcagccattttagtggctagcttttaaattggtggcttacttgatgcaaatggcaatttggcttagtgaactcaccaagcatgagatctctagcttcattctggtcttttcaataaacttgctttgatgtaaaagaaaaggctgctcttacactttctgggcttggcctgagaaggggaaatttcttaaggggaaaatgtccaacagaagggcctgtgctgtcacatgggagatcttataaaaagctgattcttgtaacttttctttcattattcaaactatgtaggctatgagaagccctttgtactcttcttccttctatactcctgccttccagataaattcatgtttggagtagtgacctggagtgccattagctgcagatttcctttttgggcattttactgaccatcctttctggtttctctaaccagggcacttctggacatcagctgttctaggggtgacttgggtgtaaaatcccagagattgcagatgagcttgattgccctcagtctatgtccctcgccatggtcctatactctgcccccttcacttttttactttgcctgcatggccctggaaggcctgggaggatttgactcccagtgaggacagacttttagaaagaggccaaggaaggcagtggttggggattgccaaggtcctcccccagcgcctgcctctttagctgaagagaattgctcctggtaacaggccatttgagatcaatctgcttaacaggaacgaacactgcatagtatgtaataaaagaatattccagtgtgactttactgaaaagtgaaaatatgataagttttgttttttctttaatcaggtttaagcaataattgcatctatttactaatttttagaatgagcaaagcatgattcatgttaattttttggcctaatttttccaacaaaaattatgtcagtccggtcgcagtggctcatagctgtaatcccagcactttgggaggccaaggcaggaggattgcttgaggtcaggagttcaagaccagcctgggcaacatagcaaaaccctgtctctacaaaaaaaaaaaatttaattagctgggcatagtggcacacctgcctgtagtcccagctactcgggaggctgaggtgggaggatcacttgagcccaggctgcagtgaattgcactccagcttaggtgacagaatgagaccctgtctcgaacaacagcaccaacaacaaaatgctagcacaatgtaacgtccttcactccctgcttgacttctaaccataaagaacgtcattttttacaagagcgttcacaggactcagcagttttccccaaggcctcttgtgaatctttggtattcttcctccaccacacctgccatgttatttatttgtccattttgtctttttctgttaactagtctaaatttgccaaatatgcatctgatggatttaaagcaattctctccgatgttggtttcatccactttggctatcctatatccttagcaacatttgcagttttactttgcaattaatttgccttgattggcagattttaaaaaatcatgtgtgacaacatgacttaaagcatttgaaattatgggtggggatggaccctggtattaaatgggaaaaaatatttgagttggaaactaattttatggaggtcgttagtgaattttcataattctgatactttgtttccctatgtaattttttaaaattaattaaaaaaatatttaaacagaaacaagatctcactatgttgcccaggctggtcttgaactcctgagtgcaagtgatccttccctctcggctcccaaagtgctaggattacaggcatgagccaccaagtctggcccctatgtaatgtttaatgttggagctcggataatgaatattctgaaattgaagaccccaccccaacttttgtgcagagaaaatgaaagggaggaccttcaggacattgattggagaaaaagggattccaaaggccttttgttgctgcatttgaccaggggccagagaaatattttattatatttagatatctattacctctgcattggaccaggaactgggacatttttgttctggtatcagctgtgcactaactagttttatgactttagacaagtctcctaacctttctaggcctgtagtgctcatctgtgaaatgaggcaatccttgtctttgtaaattataaattatggagtgtaaacagaagcattaaggtcccacccgaactcactggaaggctcagcagggtagtaccatctccagcgccaggctccagtgttaatgagccaagaacatgccaacaagaaaagcagagcctctgctttgctctcctgccagagctccttgggatgccagccaagcatttttctccctcctggaaacttgcctttcaaactaagggggaggatggtacctttctaactattcttcccattgcatggggagaaaaaggacactttcatgttttgacaaaaaggcccatttgctggcccttgccataaagcctgggtcactggggggaattggggctgggggtgtggcttcattgtttgacttgccttacagatgctggatcccctgagcagtgcagaaaattccttgtctggaagctgccaatccttggacaggtcagcagacaggtatgggactgtgggtggtttggagggtaatgcataggcatttttggaattgatgggttgaggaagaagagttagctctggaggcccagggttaaaacatcatgcttctaggaaaagccttctccttaatttccccaacaccacgagaatgttatgatggcataattaaatgaatgtaataatagctcataaaatagcagctcatttattaagtacttgctttgttgttctaagtgctttacatgttttgactttccatataatatatgccgctctcgtacttttggcctcactgctgtgatctgaactgagaaggagtggactgtcagtgttttagggggagaactgaattctcatccattgctttaccatcattttttattccaagtgtttttggtggagtaagaaactgaaacccaaaaacagaatatccagaatgcctagtgtaccatgccacctgcttggtgtatatcttcttcttacactttgggaggaaacaagtggtgtcctttacataccaaatcgcaagggtatgtttggagaggccttggcattgatcttgccactccctcgcctctgcctcattatgcccaagaacacttttgatcacgtctgtctgggcttaggactgtggtcagaggctatggaaaaggtttggggatttttttactttgtgtaactgattaattgttcatttgggtagtgatattatgactatggctaaatttgcattgtcttgcctaatagacctgagcactgatgagcactgtcttccctttagatatcatagaatacagtcatggttacttggtttccaatgtgtagccttgtttggggcttgctttccaaccaggggagtaagaaggcacaggcaagagtgccagggcttgctgtcatagactgagggctctgccaagacagggattgactctggctttggattatctcctaagctttggaggggaaaggggagagaagaggactacagaaggtctagtagttgggaaatgagggggcagcccccttgtgccactgccttgagagtttcaaacctgtggcccccgcaaaaggccaataagcactcttgtgtaagggaaagggccattcaggtgggtgctgggaaagatagctaaatttacccgcctctctattcttgggttttttcctctgtgcctgcagtactttgttttcttctcattgtgaatgacctggacttatttccttgaggtccagcctgacttgggctcagggctttcatcttcccttcacgggatctgggaaagggcatgagatctggagccagacaaacctagatccagtcccagctccaccaaatattagttgaatggcttcagacaagtcttttaacctctctattcctgaatttccccatctccaaaatgggatggtgatgattaaggtgaaagaaagatgcctggtttagcagcaagaacatagactttgggttcatagacctggatttaaagtctggccttgaggcaccgtggctcacgcctgtaatcccagcactttgggaagctgaggcacgcggatcacctgaggtcaggagtttgagaccagcctgaccagcatagcgaaaccccgtctctactaaaaatgaaaaaaaaaaaaaagccaggcgcggtggctcctgcctgtaatcccagccctttgggaggctgaggtgggtggatcatgaggtcaggagttcgagaccagcctggccaacatagtgaaaccctgtctctactaaaaaatacaaaaaaaaaaaaaatagctgggcgtggtggcaggcgccgtaatcccagctccttgggaggctgaggcaggagaattgcttgaacccaggaggcggaggttgtagtgaacccagatcgccccattgcactccagtctgggcaacagtgtgagattccgtctcaaaaagaaaaaaaaaaaaagcaaaaaaaattagctgggcatggtggcacatgcctgtagtcccagctacttgggaggctgaggcaggagaatagcttgaacccaggaggtggaggttgcagtgagccaagatcatgccactgcactccagcctgggcgacagagcgagactccatcttaaaaaaaaaaaagtctggggctgggcgcggtggctcatgcctgtagtcccagcattttgggaggccgaggcgggtggatcacaaggtcaagagatcgagaccatcttggccagtggcgcgtgcctgtagtcccagctactcgggaggctgaggcaggagaatcgcttgaacccgcgaggtagaggttgcggtgagctgagatgctacagcactccagcccggcagcagagcgagactccatctcaaaaaaaaaaaaagtctggccctgtcttcctagctttatctttgagcatatacataggactgtgtgtgcctaatctgtaggggtgtctgtgaagacagaaacagcctagctgctcatcaagtggatctgctattatgctatttttattatatggtgtatttgctacctcacagcgttctgaggattaaatgagaaaaacctcactttagaaaataggtaagaaagcagcagcctatcaacgatgatgctgtggctgtttttattactgccctgggcaaaggattctcttggagctctttgcctgttacagaggtgggaagaaaggccaaggagggagagggctgtgcagccaggctggagttgggtcagatgggggagatttaccactcagggtgctgtcaaatttgggtcacagactagtgaagggagggtggagaaagcaggagctgggctcagaaaagggctatttcccgcaaaatctgcttcccccacctaatgctgtggcaggggttagaaagggagactgcctggacgccctgcttggttgctgtggaagtgtgcgggagtctgttttttctttttgttttctccagcccatccttccggaaatcacgaatgtcccgtgcccagagcttccctgacaacagacaggaatactcaggtgagttccacagagcctgggtgggtaatgcagggtgtctgggtggggcctcaggtggctctgcttcgacttttctgagtcagtagctctccttgggcttgctgctttgaggtctcaggtgccttggggacttgggggcttaagtggctcacattgacctacccagaagccagtgattcccctgtcttactcagatcgggaaactcagctttatgacaaaggggtcaaaggtggaacctacccccggcgctaccacgtgtctgtgcaccacaaggactacagtgatggtgagttcttcttcacctgctccctgctggctgcctcaagaaaggacaagttgccatggggagggtgggttcgtccatgcagtgcctgtattttccttcattcctgaggatttgtggcccagacttgaggcatgggagacaggaaaaaaacaaaaacaaaaacagggaagatagtatttgtagaccagatgctgccactgggaactctgaccttgtttgaagccagtggtgtgctccaggggcaccatctctcccatgtcctcttctgccccacagcagcaggtggcctgggccctgtagaggggtaaggagtaggatacaaggaaatcagtgccttcgggtgtggcttggccttgcaagcaattgggagcctgttggccagccatacaccttccctttggccagatctccctgaaccagactacttcctaatttctgcttttgtcctgattcttggagtgcttgggacagcagcctctgtggaatgagtcaggtgggagtgcggacgggatgggctggagctggtattatctatcacttctggctgagacctggtttgtatattccgccttgtagcccggggtgtctcagacctggtttgtacgttccgcctcgtagcctggggtgtgacttgctctcctctggcccttgcaccctttcaggcagaagaacatttccccgaatacggcgtcatcaaggcaacttgttcaccctggtgccctccagccgctccctgagcacaaatggcgagaacatgggtctggctgtgcaatacctggacccccgtgggcgcctgcggagtgcggacagcgagaatgccctctctgtgcaggagaggaatgtgccaaccaagtgtgaggagctgtccctggctaggaggagactgcccaggtggtctcagacaagctacgggggcaaacagctgggcccctgggacccttaggctcagcaggtggtggctttggcccaaatgcaccacatgggataagccttggagtgtctgaagcctggctccactattgtgtgacaagcctcttctcctctctgatctttagtttttccatgtttaaactagggaagagcacacccttcatccctgccatattaagatatttaggggctttggaaggaaatgcatttgatcaatgcagaagagcatttaaccatgacttcagccaatcctctgcttcttaggactctgacttcaggtccgagtgactagggcactgggcttgctccagattgtggtggagatgctctactaagagatgatgggtgctgggtgagggggagcctgagccagagaccctgttcctggagaatgaatgggatattcataaataatgtacacaaagtaactctttccttctgctctcctgtagctcccagtgcccccatcaactggcgccggggaaagctcctgggccagggtgccttcggcagggtctatttgtgctatgacgtggacacgggacgtgaacttgcttccaagcaggtccaatttgatccagacagtcctgagacaagcaaggtacacttaacccgtggtctgacttcagttccctcctttcaacaaaaatgcctgtcttaccacacagagtagttgcctgagatgctgtaggttgcttcctctgtcattcttcccaaactccctttctgtccatcctggtcccagccacagggtgaaaggactgtggtctgaagagcaccaagcacctggaggggagggattgggtgtaaggaactaagctgatgccaaagtaccaagtaacccaaactgagaggtgatgacctgtgacacagaggggactccctcccctagacaagtatctctccccagctctcagcccaggaaggagctgtggggctccttcacttggtccagctctagaggaggaatcatatggcctgtctttgcagttcagctttcaacgtcgcttatacttcaagttctgtggacaaacagcagttaccttaactaagcacccacggccccttctcccacctccctgcctccttccacccatgggagtgccaccatcccaaggcctgcccagcattgtggccaagagctagacagttaagagagtcccccttttctccaactgcagttcccaaggcagatccctgtgaggccactaactagggcaagctgagctgaacccaggcgggcagaactagggccctgagagctgaggcgaccactgacccctcccctaggaggtgagtgctctggagtgcgagatccagttgctaaagaacttgcagcatgagcgcatcgtgcagtactatggctgtctgcgggaccgcgctgagaagaccctgaccatcttcatggagtacatgccaggggtacgtgccccttgaatgcatgtgagacacacacaaaagagggcctgacctgggggctggggcctgcaggaggggggtcaccttggataggagtttgaacacctgaggctccagaggcccagaggagcaaagtgaggtgatggtgggacttggagtcaggagggccctgcctcaggttgcagtgggagtatgagatgacagctgtcctaggtccagcactcccctgaggcatgcagggctggcccactgtccagtaaatgcagccttcatctggagcagagaggcctccctgctcctggatttgggtggcgctctgcttgagaaggacttggggtactctcttttccaaactgcctgacagctcctggcaaaatgccctgcccagccagataggaattgaacaaatcactcctttgctgccatgctgggggctggaatgggcttgcccctccaccagccctcccctgaggggactcctctgacttcttgtggcctccagggctcggtgaaagaccagttgaaggcttacggtgctctgacagagagcgtgacccgaaagtacacgcggcagatcctggagggcatgtcctacctgcacagcaacatgattgttcaccgggacattaagggtgagcagggccaggatacatggagtccccaggacctgggttcaagtctaccattgagtgcctgcaggggccaatcacttaaccattctgaactttctgaaaagtgggaccccagttgtttccctgaggaactggtgagattggttgagcaatatgagagaatattgccaagttccctctacatgtgggccttggagatggtcattttgtgcggtagatctgagactcccctttgctaaatcctttgccctttgcagttcatgtctaattcagtggtagccctgccctctccagcagctctcagtgacccgggggtggggaggatgggagaaaatgcaagagggtccagggttgcagcctctgccctttcatgcctcaggagccaacatcctccgagactctgctgggaatgtaaagctgggggactttggggccagcaaacgcctgcagacgatctgtatgtcggggacgggcatgcgctccgtcactggcacaccctactggatgagccctgaggtgatcagcggcgagggctatggaaggaaagcagacgtgtggtgagcactgggacatgcagaacccattcttccacccaggccatagtggccccccattagaaacacaccctggggactttgtggtgtggcaggagggagtgtgcccagggcccaggctgcagtgtgtgcaagggtattattgggtgcagtagcacacacaccacatgggtggtgctcaaagcacactccattagagctgggaacttaggccatggaaaacatccctcatgtttgctaaatctcttaaggaagcaggatccactctgaaggcctgaaggcctggaccagtctctcaacaggagcaggcttctgtcccttctcctagcactcaagacagtttgcacttgctcgacataaccttgtgtctatcctctgaaatggcccctaagtcaggagagcttctccccttggaaagctattgtggtgggctgaataatggcccccccaaagatgtccactgcctaatccctggatctgtaaatgtgattgtatatagcaaagggcctttgcagataggattaggttaagggttttgagatggatggattatcctggattaagggtccttacagaagggtctcaagaggtcagagtggctaataggaggtgagacaatgaaagcaagaggttggagtaatacaaggaggggaccatgagccacgaaatgcaggtggcctctagaacccaggaaaggcaaggaaacaggttctcccctcagagcctctgacaggaaccagccctgccgccaccttgactttagccctgtgagactgattttagacctctgaccttcagaactgtaagatgatacatttgtgttgttttcctgcctctaagtttgtggtcatttgttaagagcagctatgggtagctaatacagttattgtagagttctttctgtcaagtctaagtgattctctttttccttatttcaagaagtacccaggtgtgtggtgagtgtaggtccatgaagcccacgtggacagacatccaagctgaggtatccctcagcttggcctgtcctgcacctcagcttgctgtgagaaaggcgcctctttctgcagtggtgggcaggacagctgggagtccagggctggctgaggggtgacacggggttctctctttccaggagcctgggctgcactgtggtggagatgctgacagagaaaccaccgtgggcagagtatgaagctatggccgccatcttcaagattgccacccagcccaccaatcctcagctgccctcccacatctctgaacatggccgggacttcctgaggcgcatttttgtggaggctcgccagagaccttcagctgaggagctgctcacacaccactttgcacagctcatgtactgagctctcacggccacacagctgccggtcgccctttgctgcatggcagggggctgctgctgggctcagtgaagttgctgcttctcccaggcaaggctgtggaccatggagtggcagcccagccagcgtcggtctgtgccccttccgccactggggctcagagccggggtggggtggctgcagcctcaggactgggagcccccagcctgtcagatccaggagctccagtgtcctgagctcagcgtggaggggtaggggctgggaacagtgtgcaaggcagccgtgggccccaccctcggggatgtgtcctgacactgcaattggcaccgaagcccagagggtctgggggcacaagactgacgccagggtatgaagagtgttattttcattcaaagtgttattttgtttttccttccaatgtctggagaccaccagggcatctctgggctggatgagctcccacaagcctgagggaaaggccagcactcgctagcagtggcaggcagaggcccaggctgccgtcccctagagtcccaggttggctctgccagtcctgtcctttaccaaagatgaatgaagcaaatgtcatgctgccttattcagggaaggaggagcctgtcctgcctgtggccatgaccctgcctctcccaggcaggggcccgcgatgtggaactgctgccactgaggggggatccagttttgtcaatgcagttgtctctgttttacaagttggagtcactcttatgctgtacccagtttctaaactggagactgtgtgtgccctctgggctctgagtacccctgctttgggcttgggcctaggctgcattgaaaagagctgaaggttgtggcctttgcgctcctggcccagcctttgttccccactggagcagaaggggagatggacgacacggtcggggcatctggcctggccagtgccctgatcccagagagcccgaggaggtgtctcaggctgcctgagtcgtgacctgctaggccagagcccactccatctggtagaagggaaagcccatatgctaccaccagctgtgtccaaaaccgccagctctgttcttcctcagccagcctcgcccatccccttgaggtctcagcccctttcccttgtagctcctcccctggagggggaatggcagcaggggttggggaaacagcatctccaagcagcttagagttggccatatttacctcagcctgggcgctggtcctttcttccggcccctcccctccaaaatgtgcctattgctagagctcctccctctcaacacccagtttccttgggagttgtcattaaaggaaaaaaaaaaaaaaaaaagccagtgcccagggatgggcatctccagggagctggggattagtgccaggcagccctgccagccatgcctacatccccatgggcacagaacaagccaaagccttcgttgtatgttgacgatgcacttttatgaatgtagtttctatcgctgtttttagccttttcacatcatgtaatgtgaggccttgtacttgttaatttatatctcagatcatatttgatggtttttatatatatcaattctagactgttacaggtgacggacgcctcaagagagagaagagaaaatgaaagcagctggttttgcagaagtgtgtgtcgcatgcgccagttgggcctggaccctcctgtgtccatccctgttcccccaggggctctatcagcccctgtaccccacactgccctctgaagacaacacaggctcctgcttccacctcggcccttgcccagggtggggcctggccctcatcttgaccaaagctgctgtgtggcagctcggcctctctacgaccccatcttggtggctgcacactcttcctggcccgcacccccatccccagtccctgttccccaagaggatacagagcacggtgctggctgactcaactgtgcgtcccaggttcagggtcttacagagctccaccccctggggtcttacctcactgggaatgtgttttgaaaatgaatttgaagacaagccaacaaaccctgcactccaaaaaagcaaaacagaccctaatttttttgtgccaaaaactgtggacatgctggctcagcatcctcaggaccaagttgttgcttaatttattgttttttaataactaatccagataaaaagttgtggggcttcagggtgacctgggcccaaaggttctgaagggcagttcctggcagccccaggcttgctgtgggaaggggccgtgccgtcactttctcatcattccatggggtgtgtctgcctgggccaactctgcatggagaggccagggctggggacagtc

SEQ ID NO: 16814 - DNA, 7616 bp, Human; identical to SEQ ID NO: 14541

SEQ ID NO: 16815 - DNA, 7616 bp, Human; identical to SEQ ID NO: 14541

SEQ ID NO: 16816 - DNA, 8165 bp, Human
cccaccctcaattctctgccacagtgatcttccctagagcccaaatctggcctcagtactcaccctccctctagccctggctccccagcctcctcccatacaacaatgtccaagccctgtgcccagcccatgaggccctccatggtccaggtcctgttggcttcccagcctcatccccgtttttcccccacatgcccggaacactgttctccagccctggccttctcattctggagcttctgcccatggtggaaagccaggcacttctccgcctacccttcacgacccacctcctttactcatgcagccgccagcccaccatagcactttctcatggcttcccttacagccatcatcatctacttctttttatttttatttttattttttattttttttaattgagactgagtttcactcttattgcccaggctggagtgcaatagactgatctcggatcactgcaacctctgcctcctgggttcaagcgattctcctgcctcagcctcaggagtagcagggattacaggcatatgccaccatgcccagctaattttgtatttttagtagagatggggtttctccgtgttggtcaggctagtctcgaactcctaaccttaggtgatccgcccgcctcggcttcctaaagagctgggattaccggcgtgagccactgcgcccagcccatcatctacttcttaacgtggttgtggtcagattccaccccaactatgcgctccttgagagtggggactgggaggggttcagctttgaatcctcagagcccagggccaggtacatagtaggtgctcagtaaaatacctgctgaacactcagggaagggagggctgtgccgggcctcagaggagatgttaagagagcagacagggtggccaggcatggtggctcacacctgtaatcccattactttgggaggctgaggcgggtggatcaactgaggtcaggagtttgagaccagcctggccaacgtggtgaaaccccgtctctactaaaagtacataaattagccgggtgtggtggtgggggcctgtagtcccagctactcgggaggctgaggcaggagaatcagttgaacctgggaggcagaggttgcagtgagctgagatcacgccactgcactccagcctgggcgacagagcgagactccatctcaaaaataaatatataaataaataaaaataaaaaagagaaaggacagggtgcacagagccaggaccccaccccctcctggtctggaccaccctgggccatctcctaagcttgacactctcaggcctgaggctgtcaggccagggcgctttgactatcccctgcctgcccctgaacgcggccaagcccgaggccttagccaagccctgcagcctcaggcttggcgcccggcccagcctttctttagccttcccgaggagccagcgagagagcgctgcagcagccgcagtccttgcttccggggaaggcccgggtggggccagggcctgtggttaagtcagtggccctctgcagacgcgcacgcagcaggagccacgccctggtccctgcccgggagtggcctggtctcccccagctctgattccctgaaggaccctgcacctcctcagccatcttctctgggcaccccctgagcccagcctgctggccacaggccccttcccgccaacttgtgggcctagctcatcatcaaactattttccactggcttcccccaatctctgccacagcacaattttggtggggaggtggagagggatgaaggagaataggaggtggagcttggactctggccgggggcggcggggtgagggggggcagcagctcgccactctgattggtcacctctgctccaaaactggcttcaaaattccacggactccgcccccagtggcccccagccctatcctgacttgcaattggctgaactttcagggggcggggctcacccggtccggtccagttaaaagggtgggagcgtccgggggcccatctctctcgggtggagtcttctgacagctggtgcgcctgcccgggaacatcctcctggactcaatcatggcttgtgtgagtgtggggacccccccccaaggtccaggggatagggcaggaactgatggccagaggagagctgggcagatcgggagcagattctagccccagctgtgtggcctggaaccagtgccttctcttttctggacctcagtggccacatctgtaaaatgggggtgggcgccatggtccctcaaggccttctctgcattgataattgtctggattcctccagggtctgaaagcacagttatttctgcccagggttgacattctgcagctctctgagaagtgagcgtgggaagggtgtggccaactgggggacacccaggccactatccctttccccctcctccaccccaaagagcctcctgtcccctcccccctgcagctgtcccggtcaccaggccagggcagagttaccctctgctccagagaacgctgaaaagttgccaggacccgagacaagctgcccaggatgggcccttctaggtcgggggtggagggtggttgtgtccaggctggtggcggggggggcgggggaaattcccttccaccacccccaagctgggaggttggggtggcagggaggtgagaatcttcctcgggccccagggaaagggttcaagtttctggcagaagaaaccactcaaaccagttaactcttgcccacccactcggggtgccagggaacagcagtgcccagcagtttgctcaatcttgttaaccctgagccagcccagccacagcccgactgcagggctattctccctaatgcagagaggccgtgtttttcagggtctcctctctagcccctgggcctctttgcagagaggggcttgaaggagaatagtggggtcgcccgcccctagccacttcctctccagcagaggggccggcccctccattcagtgtgacggtgggccaagtgtcggcccctccccagcctgatcctctccatctgcgatgggacagagcaccccatctcccaagtcactcttgagtccaaaattcccaagccaatctgcaaaatcttctagagcctgtcttctagaaccttcacgttacagactgaagccaaccccggtgggaatagggactttcccaggaccacatagacaatcggaggctggaaattacagctcaatcctttccccaggcttccccttggcttggtcagaggatgccgggcgggaacaaccccactcccacccccagccacccccggacacttcgagcagtggaggccttgtcctctaacccggctgggccggggcttgtctgtgcagggtctggtcgccagcaacctgaatctcaaacctggagagtgccttcgagtgcgaggcgaggtggctcctgacgctaagaggtgagaagtgaagtcggggtggtgggcggcagggacgggcttggtccagcagggagggcgtggccggccaagcccacatctcctccctggccgggagcgggttaacggccagccgccgatgctgcgttttctgggtgactcacttcccccgcagggtctgggcgcccccaccgttgccgccccctcccccgctccctccctgctgtagcctcttaaactaaaccagctgcagcctcgtcatctgtaataccttgactcccccgcccccacccctttccggtctgggcgggacctgtcgctggggagggcggggagaggagtggggcgggcgtcaccgccgccttccccctgagtccctccttcctgcgtctggtcattcattcattcactggctcagtccggtccttcttccttcacttctcattcactcagacggctgccttattttctcggcagttaggtgaccttggaccagtcaaccaacctcacctagcctcagtttgttagaaaaacaaggggggaggtggttgtgtggaggaagtgagatgcggctggcgcagtgacagtgaggaggatgaggatcagctgatattgttaagagccgcacacttctcatgcactaatttcatttcaaccaaaccctcagaggcaggtattgctattatcaccactcaacaaatgtatttattattttatttatttatttattattttattattttatttatttattttttgagacacagtctcaccctgtcgcccaggctggagtgcaatggcgtgatctcggctcaccacaacctccgcctcccgggttcaaacgattctccggcttcagcctcctgagtagccgggattacaggggcccaccacaacgcccagctaatttatgtacttttagtagagacggggtttcaccatgttggccaggctggtctcgaactcctgacctcatgatctgcccgctcgcctcggcctcccaaagtgctggggttacaggcatgagccaccgtgcccgggagtattattattattatttgttaattcgccccataattactaagcatctttttctggtgtgccccacttgtgctgggcaccgggaatacagagatgtacaagacaggacgggaggtcaccatctggagggagtcactgaccttgaccaaacgggctaggatgctaatgacttcaagaatcaagcgagccctcctgtgcagcccccattgtacagatgagcaaacaggggaagaggggcaggagcaggtggcatggccagagctagaatccaggtttcttgtctctgttagtgagttcttccagcaaggtgcgttcatgggatactgagtgacagattagtcggtcagtggggctggagctggccgaggtggcctcatgcccacccgttaccccccagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagcgggaggctgtctttcccttccagcctggaagtgttgcagaggtgggctgcagaccggaaccggggaccagggacaggggctgggtgggctggggcggggctgggttagtgactagagaccttggccctgcctgctctttcccctccccttccctcccttcctgtgtgatggccagtgtctgcccctctttgaacctcagtggttgattacaataaaacgaaggggaaaaaaaaaggctgggcttggtggctcatgcctgtaatcccagcactttgggaggccgaggcgggcggatcacctgaggtcgggagttcgagaccagcctgaccaacatggagaaaccctgtctcgactaaaaatacaaaaaattagctaggcgtgatggcgcatgcctgtaatcccagctactcaggaggctgaggcaggagaattggttgaacccgggaggcggaggttgcagtgagccgagattgcaccactgcactccagcctggccaacaagagcaaaactctgtctcaaaaaaaaaaaaaaaaattagccagcgtgctggctcatgcctgtaatcctggcactttgggagaccaaagtgggtggatcacctgaggtcaggagttcgagaccagcctgaccaacatggtgaaaccccgtctctatataaatacaaaaattagctgggcgtggtggcacacaactgtagtcctagctactcaggaggctgagacaggagaatcacttgaacctgggaggcggaggttgcagtgagccgagattatgccactgtactccagcctgggcgacagaggagactccatctcaaaaaaaaaaaaaaatctatcataggattagagtaaaaagaaagaaaaaatattataaatgtacctccgcaggctcagccacaaactggggctgtgtcagggccacatgaggaacgggttctggaagggcccatggcatgtgggcccggctcactgctctcctctacccccaggtgtgcatcaccttcgaccaggccaacctgaccgtcaagctgccagatggatacgaattcaagttccccaaccgcctcaacctggaggccatcaactacatggcagctgacggtgacttcaagatcaaatgtgtggcctttgactgaaatcagccagcccatggcccccaataaaggcagctgcctctgctccctctgaaccagcctcgtgtgtgtgcttgtgcgtgtgtgtgtatgtgtgtgcatgtgtttgtgtgtgtgagaggggtcccccacctccaggcctgcccccttccttcacttccattcgctttgtccacgggtacctcctcagttccaatgacgtcttccgctgggtcccccagacaaagcacacagagtttggcacatagtaggagggtcagtgaccactgaataaaagtcagtccctgccctgaaactgtttttagcctagtgggccctagcacacagcagatgctcaaaggatgttgcataaatgacatcaagggggaaagaggcaaggacagaccaattcgtgtgtagtgacggggcagaagacagggaggtggagggaagaatacgagacccctctcatttgccttcatgagctagaaagagatttggagtcagacaacaacgggctgccagctatgtggccttgtgcatgttaactgacctctctgaacctcagcttattcctttataacaaggaggataacacaaacagcctatcaaagagttgttccaaagaccagtcacttcttggccttctggctgagatcaagtggagattaaatgaggtgttgcatgaaagaagccaagttcaatacctggcatatggtaaatgcttagtggatagtggtttcccatacctcgtgcacggattatttttttttttatttttatttttttagagatgggggtcttcctatgttgcccaggctggagtgcagtggttgttcacaggcatgatcatggcatactgcagactcaaagtcctgggctcaggcaatactcctgcctcagccttctgagtagctgggaccacaggtgtgtgtcaccgtacccagatccctgcaccacttttgaggtgctattactccaattgaaggggaagaaatgggctctgattgatgaaatgactcccggatctgtaccaggtccagctgagcctgcggggctcctcagggatcccggctttgtgggctcaggccatgcaccccactttgctagactgtatgggcaaccaaaggactagtctggaagctgccggctctcattcctgggcagatgcccccaccccaacagtgggtttgggtgatgaccctggcaccccattgccagcccgtttctgtggtaggaggagctggggttgggggctacgtcagcctctgcagagaaccaagaggtaaaagccagccaacatgaggcccagcctccagactcccgcagcctcctccttggggtacagagtaggggtgactcactcaacctgagatgaggtctccatgagcctgttctctcctggtttccaaagacagtgtctcctccaagaccagcccaggctgttaccttggagggtaatgcttaacccaaccccatcaaacccacccatcacaactgctggggcctgagtggacggctagggtgccctgcagactgactacttccctgcaccttttccttcctgcttgctgctgcagtcagatcttcccagggcccctacctctctgggaaccagctgcaggaactgagccaaagttcagaaggttagaatgagaacatcattaggctcccccataaccccaaggcacagtctcctgaggcatggtgcgtgggtgggggggtcttggcaaatctcactttctagggcaactggcaccagctgtgagtaggtctcttatacacccagcctcagtttcctcatccataaaatgagacccattttgggtagatgatttccatctcagtgggtgccctgggacctgggtggaagcgggggtcatgtatctctctatgaggtcaaagaggatggaacacacatgctgagaactcccatgagccacacccaatctccaggctctcctggggctcccaggtggccacccggaaacagcttcagaagcctggctgcagatggagtgccctctgctggacattggagaacacgtcccccaggctgccctgccttgtcctca

SEQ ID NO: 16817 - DNA, 13677 bp, Human
tcagaaaaatgccacctttaaaaggtatagtttctgttgattagtttccagggagaaagccttttaaaattccttatctcactggggttttaccatgcctttgggagaaaggccgagagaggattaatttccttgtgggtgaaaggaggaagtcactcctcactccgggctggcaggggactgaaggtggtgtcctatgtgggcactgggcagtgagccacctgcagactcctggcaccgagggccctcggcaaggccagttccccacatcctgcccggagtggccaccgccaactctgatggaaaacgctctggctcgccaaatcctgagctctagaaaagttctccttctgggaatctgccctacataagttgtcacgatgcagccaaagtttatgtccaaatagatttaatgcagcagtatttttaatagcaaaaatgtagaattaatgtgagtgttcagcagaaggaaattggttaaataaattcagtcgttgaaaggtagactatttcgcaggcaataaagtatggttctgaaatatagatttgtggtctttaatgtttcccaaatgaagagagataaacaattgcacagacagaggggtgtctataatgtaaatctgtggagaaccgcctggaaggaaatgtgccaacagcgtaagccagttccctcgtggcggtggcattatgagtgattatttttctttttatttaatatctctaattgtctatagtaagcatgccagttacataagtaacagaagtcaagagcaaagcattttcatcctccatgtcccccactcagccctcccactccttctgcacttttatttattttttatttttttatttgagacggagcctcactctgtcgcccaggctggagtgtagtggcgcgatcttagctccctgtaacctccacctcccgggttcaagcgattctcctgcctcagcctcttgagtagctgtgactacaggtgcgaccacgcccagctaatttttgtatttttagtagagatggggtttcaccatgttggccgggctggtcacaaactcctgacttcaggtgatccgcctgccttggcctcccaaagtgctgggattacaggcttaagcaaccgcgcccagctctcctctgcttttgaccatttgttgtaaatagtttgaaatcttttctttgaatccgtgtattggttttgaaacctacatgtccgatcagataaataatatggggagggaagaagaaaacataatgctctctgacaatgaatcataacatcatagaaaattagaaccttaggccaggcgcaatggctcacgcctgtaatcccagcactttgggaggccaaggtgggcagatcacgaggtcaggagatcgagaccatcctggctaatacggtgaaacctcgtctctactaaaaataccaaaaaattagccgggcatggtggcgggtgcctgtagttccagctactcgggaggctgaggcagcagaatggtgtgaacccaggagattgcattgagcggagatcgttgccactgcactccagcctgggtgacagagtgagactctgtctcaaaaaaaaaaaaaaaagaaaattagaaacctagacttttttttttttttgcaaagcaaatctctctttttacaggcaaggaagctgggctaagtgagggaggctgggagagctgtcaagcggctgcattgcggtttgtgtgggggcagagctggggctgcttcccctctcgggctctgggagcgctgaggagggggaggctgggctggagggaggccaggaggatgctccgggctgggtggggtggagctggctgaggagtcttctgcctgtttgtgctgggtactgggagatgcaggcggggagacacaaggtagaaggggcaaagtcctcacctaggaccttgagggagttaatgtgtaatattctaggatataagcttgaccacgagttgagaccctgagcacaggcctccaggagccgctgggagctgccgccaggagctgtcaccatgacggtgaggacactagccccctgctgcctgccccactctgttcatctttgtctttgcctgggtgggggcttttagggaaaaccattgctgtccctctctgggcctcagtttccccatctgtgcagcaaagaagttggacagaggtctttttttaaaaaacagcatcttgggccaggcgtggtggctcctgcttgtaatcccagcactttgggaggccgaggctggtggatcatctgaggttgggagtttgagaccagcctgaccaacatggagaaaccccgtctctactaaaaaaatacaaaattggctaggcctggtggcacatgcctgtaatcccagctaatggggaggctgaggcaggagaatcacttggacctgggaggcagaggttatggtgagccgagattgtgccattgcactccagcctgggcaacaagagtgagactccatctcaaaacaacaacaacaatacagcatcttgctctgtcaccaggtggagtgcagtggtggcaatcataactcactacggacttgacctccttggcttaaatgatcctcccacctcagcctcttgagtagctgggaccccaggcactcactaccacactggctaattttgtttgtttcttttctttctctttttttttttttttttgagatggagtctcgctctgttgcccaggctggagtgcagtggcccgatctcagctcactgcaacctctgctgcctgggttcaagcaattctctggtctcagcctcccaagtagctgggattacaggtatgtgtcaccacacctggctaatttttttttttttgttgagatggagtttctgttgcccaggctggagtgcaatggcacgatctcggctcaccacaacttccacctcccaggttcaagcgattctcctgcctcagcctcctgagtagcagggattacaggcatgggccaccacacccgattaattttgtatttttagtagagatggggtttctccatgttggtcaggctggtcttgaactcctgatctcaggtgatccacctgccttggcctcccaaagtgctgggattacaggtgtgagccactgctcctggcctaatttttgtatttttaaagtagagacagggtttcaccatgttggtcaggctgatctcgaactcctgacctcaggtgatccgcccaccttggcctcccaaagtgctgggattacaggtgtgagccaccccacccagcttatttcttatttttcgtagagatgaggtctcactatgttgctcaggctgatatcaaactcctgggttcaagggatcctcctgccttggcctctcgaagtgctgagattacaggtgtgagccactgtgcctggcctccattgatctttatagagataaaaaaaaatctcagcttgggcaatatagtgagaccttttctgctacaggtgcatgccactacgctttgccttaaaaaattagtgggggtagcggcacactcctcagccttgggaggctgaggatcacttgagcccaggaggtcgaggctacagtgagccgtaattgcactactgtactccagcctgggcaacagagtgagaccttgtctcatatacccacacacaaaacccaagtcttggagagcaaattgcccaaggccacaagctgcaaatcacaaggggttgagtggattcccactgaggtctctgattcgttgattctacaccagactctgccacagctttactgtgtggccttggccaagtcactgaccgtctctgagccccagtcttccttacatctgtggaaggggatcacaggctgcctcttctgaggattagatggtgtattcattgcctagggctgcaataacaaattaccaccaaattgtgggtggcttcacacgatagacgtttgttctgtcttggttttggtgactagaaacctgaaaccaaggtgctacagggctacgctcctgctgaaggcgcaaggggagggttctttcttgcctcttccagcttctggtggctcctcgcattccttggcttgcatcactccaatctctgcctccaacttcacgtggactcctctgtgtgtctccgtctctgtgtctatatttctctcctcttatgagaacactggtcgtattggatttaggaccaaccctaaaccagtatgacctcttaactcgattacatatgcaaaggaactatttttaaataggtcacattgaggctgggcggggtggctcacccctgtaatcccagcactttgggaggccgaggcaggcggatcacttgagatcaggagttcaagaccagcctggccaacatggtgaaaccctgtctgtactgaaaatacaaaaacaaaaaagaagaagaagaagaaaaaaaattagacagatgttgtggtgggcacccgtaatcccagctacttgggaggctgaggcaggagaatcggttgaacccgggaggcagaggttgcagtgagccgagatcgagccactgtactccagcctaggtgacagagtgagacttcatctcaaaaaaaaaaaaaaaggtcacattgacaggttccaggtggacatgaattttcgggggacgctattcaagtgcaggggggatgcaggatgtgaatgtgccaggggtcctgcgtggaagggtctatgccctcatcaccctctgcctctcggggaggactgctgtggcccacggactctccccaccttctctttcctggtcatctcacctctgccttttctttcctctctctccagctccagaggccatatcatccaaatcccttatacgacagataagggaaccaaggcccagaaaggggctaagctggccccaggcccctctgccaattaggggcagagtcggcactagagtctgggcccccaactccccacccccccagctctagggacgaccacacccccacccagttctgcctgtctctctctgcgcctttgactctgttgggtggggacaaggctcccgggcctgcaccctcccgcagctctcagcatccctatttgtccaagtgcacccctgaccctggacttccgagtgcttctgccctgcagcagcccccacctctatccttggggtttgagctttgctgtttcagtcaggcagcccccaggagctgcaaggggagtgtgggtgcttctcttagtccaggcccagctcccctatcctggcctgactgttgcagggctcggggtgtgggcacaggctgctggcaggaggcagggagccatctcctgatgcttggtgttagacgtgtgtgtgcgcagggcacacgtctgtgagtgtctgtgtggcgggcacacctgtcttctgtttcttgtttgagccccttttggactgtcctcactggataacctcatctcccagagataatggtctttgtcagtgagagactgatttttttttttttttttttttttttgagacggagtctcgctctgtcgcccaggctggagtgcagtggcgccatcttggctcactgcaagcaccgcctcccgggttcacgccattctcctgcctcagcctcccgagtagctgggactacaggcgcctgccaccacgcccggctaattttttgtatttttagtagagacagggtttcaccgtgttagccaggatgatctcactctcctgacctcgtgatccgcccccctcggcctcccaaagtgctgggattacaggtgtgagccaccgcccctggccagcaagagactgattttaatcccgtctgtctggctccaaaatctggacccaaccccgttgtgttaagcaaagacatggggagttaggtgtccagcctccaaaccccactttctctaaagcagggaggttttgctcccaggagacaacggaccctgtctggagacattcttggttgtcaccgctcaggggagggtgtcactgacatccagtgggtagaggccaggaatactgctcaacatcctacaacacaagagacagaccccaacaaagaaatgcctgccccaaacgtccagacggccaaggctgagaagctctggtctgagcagcctcctgtctgacatgccgccgtcatggcccgctgtcctgggttaagcattgctgcctcctccaggcgtctcttataaaatgtactgccaggccgggcacagtggcttacacctgtaatcccaacactttgggaggccgaggtgggaggatcctttgagctcaggaggtcgaggctggcctggacaacatagtgagaccccatctgaaaaaaaaaaaaatcagctgggccaggtgggatgcctgtggtccaggctacctggggggctgaggtgggaggattgcttgagcccaagaggtcaaggctgtagtgagctctgatcatatcactgcactctagcctgggtgacagagcaagacctttaaaaaaaaatgtattaccggctgaggcaggaggaccacttgagggtcaggagttccagagcagcctgggtaacatagcaaaaccctatctctacaaaaattttaaaaattagctgggcatggtggcacacgtctatagtcgtagctacttaggaggctgaggcaggagaatcgtttgagctcaggaggctatgaggctgcatgcagtgagttataatcgtgctactgcactccatcttggatgacagagcaagaccctgtctcaaaaaaaaaaaaaaaaagaaagaaaagaaaaaaaatgctgggtgtggtgtctcacgcctataatcccagaactttgggaggcccagaggggaggatcacttgaggtcaggagttcgagaccaacctggccaaagtggtgaaaccccgtctctactaaaaatacaaagaaaattagctagctatggtggtgggagcctgtaatctcagtgactcgggaggctgaggcaggataattgcttgaacctgggaagtggaggttgcagtgagctaagattgcaccactgcactccagcatgggtgacagagtgagactccatctcaacatctcaaaaaaaaaaaaaaaagaacttactgcctgtggaagagttgagcaatacctaacaacctacccctacatgtgaccaaccagcgggtcacttcctcctctgcagagaggaggcggctgccagcgagagggcactgagggtcctcccatggccactgcccccttgacttctggcaaagtgccccagtccaatgagctcattcagggcatctcagatcatgctttttctggaaataaaaagtcagtgagcagaactcccacaatgtaaaagtgtcctcccataagttgttctaaatctttggtgcctgttgcgtcctggtcagaccaaccctcaccctctggtcatagatgcgaaaactggtcttgggtaatgagtttttttttttttttttttttagacagagtcttgctctgtcgcctggcacaatctcggctcactgcaacctccacctcctgggttcaagcgattctcttgcctcagcctcccaagtagctgggacgacaggcatgtgccaccacacccggctaatttttgtatttttaatagagacagggtttctccatgttggccaggccagtctcaaactcctgacctcaggtgatctacccgactcagcctcccaaagtgctgggattacaggcgtgagccaccgctcccagccctgggtaatgagctttgaaaacccagcttagaaatcttccctagtaaccattgtgaggctagaggaggctcctactgtacagaaattcaggtgctgctttcctatggaaaataaggagcagatgaatcttaacaacaagtaatcaaaatgatggtcatttgggcagaccactgtccagaaaaaaagaaaaaatttaaaaaagaaaattaaggctgggcttggttcacgcctgtaatcccagcactttggggagctgaggtgggcagatcaattgaggccaggagtttgagaccagccacaccaacatggtgaaaccttgtctctactaaaaatgcaaaaattaggcatggtggtacatgcctgtagtcccagctactcgggaggctgaggcaggagaatcgcttgaacctgagaggtggaggttgcagtgagtcgagatcgcaccgttgcactccagcctgggcgacaaagcaagactctgctcaaaaaaacaaaaaaaaaaacaaaaaaagaaaaggaaagtaaaacaataaatgatggtggtcctgtgatttgctgttggtctacgtgaggccctgtgcatgggatttcacaaacatgttcttgaatcctctcaaaaccagcttgaaggttggtggtgtctccctggtgtgacagggtctgtcatacagctggcattcagcaacaacaacaacaaaaatagaaatgggagtctcgctatgttgcccaggctggtctccaactcctgggctcaagtgaccctcctgtctcagcatcctgagtagctggaatacaggtacacacttccacacccaggctatcaactgttttttaaatgaataaatcaaattagtcaattttacagaaggggaaagtgaggcttggagagagactttgatggacataggacttgcggagttttatagattcttagtttttgttcgtttgtttgtttttgtttttgagacagagtcttgctctgttgcctaggctggagtgcagtggcgtgatcttgtcttactgcaacctctgcctcccaggcttaagccattctcctgcctcagcctcccaagtagctgggactatagatgcgtgccaccacacctggctaatttttgcatttttagtagagacagggttaaatgttaggcagactggtcttaaactcctgacctcaggtgatctggctgcctcggccttccaaagtgctgggattacaggtgtgagccactgtgcccggccttttttttttgtttttctttgagatgaaaagtcactcttgtcgcccaggctggagtgcaatggtacgatctcagctcatggcaacctccgcttccagaattcaagcaattctcccgcctcagcctcccaagtagctgggattacaggcgcccgccaccatgcgcagataatttattttattttattttatttattattattattattattattattattattatttttgagatggagtttcgctctgtcgcccaggctggagggcagtgacgcgatctcacctcactgcaagctccgcctcccgggttcacaccattctcctgcctcagcctcccgagtagctgggactacaggcacctgccaccacacccggctaactttttgtatttttagtagagatggggtttcaccatgttagccaggatggtctcgatctcctgacctcgtgatccgcccgcctcggcctcccaaaagtgttgggattacaggtgtgagccaccgcgtccggccaatttttttatttttagtagagacgaggtttcaccatgttgcccaggctggttgctaactcctgacctcaggtgatcagcccgcctcggcctcccaaaatgctgggattacaggcgtgagcccctgcacctggccagatttagttttgggtgggccaagatcttgtgcctctgatacagtcattttccatatcatatttttgtttctggggttctgctgagggcagcgtgatttcatcacttgaacactttgcggaactgggcaggaagcactctgcccatttcatagatgggcaaactgagcctccgtcctgtgcctcttcgggttggggtggataagagcaaaacagggcagggagtggggaagctctgggaggccttgatcagagcgctctggctctgccactttccagcttggtggtctcctgcgtcctcacgtgggcagggggattgagacctgcagctgggttggcatgaggtggatgaagctgctgggcaagtgtgggattgattttctgtggggactcgagtggaatgtttctctgttggcccagggggaacttgaggttaagaacatggacatgaagccggggtcaaccctgaagatcacaggcagcatcgccgatggcactgatgggtgagcaaggtttcagggttgggggagtctgcaggcccggaataggcagggcgggtggggcaggcagggcagccctgtgaagtgctcaggcaagagggacgtcaggccaatgggccctttttcacacccttctccccacacccctgctggcccccacttcatgtctgaggctaggtttggggacctgcagaatttcagagttgatgccatatgctctattcttttgccccaacagccattgaaggggcaggtggagaagcccctggaactctgtctggccccctgcggggcaggtgcctctagggaacgcccaaatccccagagacaccaccctctttacccagcagaatggccacaggctggcatttcatgagcattaaaccagggcagccaccaggggaggctgagtggtctcgctggcattctcttggttagaaccagcggcctcaccacctccgtgagtcacagtccagcgaaaggctctctcgcctgcagaacatgtcagcgcatcttggaactgtgctttatctacttttggttagagagggggcgggcaggtgcatgccataggagctaagggaaaagtgacttatttctcctacttgggtccctcaagtttgtcaaaatgtgtgatacccttggtctgagactcccaaatgaagacaccccatgacccagaatgccccactttcaggaaccctgcaggtctagcccaggctcctgtagtgatcttgccaagaagtcatacaaccccggttgcacacccatagtgacagggagctcaccaccttaggttggctgctggtggctaaatttaataggtcttcagatatctaagagatagcatttctctctcccaggagagccacccccaattcccgaagctgtcactatcagttacccttctctcaacagcgtgatccctgctccaaatggaatgtgctaccacagtgctaagtctgagcaggttgttacctcccttgttttaaggcacagatctcaactaacacaagctttgattcttccagcttgtggtcaaccaaggtcctccaacccaagctgctttatccaggcctgagccctgaacctcacctgctaccccttctcctgcagctttgtaattaatctgggccaggggacagacaagctgaacctgcatttcaaccctcgcttcagcgaatccaccattgtctgcaactcattggacggcagcaactgggggcaagaacaacgggaagatcacctgtgcttcagcccagggtcagaggtcaaggtgaggtcaaagggggaaagggcactggggtgatgtcaaggggagggcccagatggaagagagcctggcctggacacaggtgctggccttgtttgagccatcaggcactgccctggcccatttccagggcctcctgcctccttgacaccctccctccccacagttcacagtgacctttgagagtgacaaattcaaggtgaagctgccagatgggcacgagctgacttttcccaacaggctgggtcacagccacctgagctacctgagcgtaaggggcgggttcaacatgtcctctttcaagttaaaagaataaaagacttccagccgagattctctgtcctggttcttcttccgagtcacaccaggatcaacagagcttgggtgtgttcccctatccctacctgcagttcctgccccagggctaaaagcaaacaaaataatctgtttttatcgagtcttcctgtggcaagaactgtggcttgtgactcctttctctcttgggtccctcaagtttacaaaaacgtgggatacccctggtctgaggacctctgaatgaaggcaccccatgatccagaatgtcctgctctcagggatcctgaggtcccgtagtgatcctgcctcctgccacacatcctctggttgcatacctgtagtgacagggagtgcaccacctcacgttagctgtttgtggctaaatttaactggtcttccgatacctaaggagggcatttctctttccgtgcattttaatgctcctggcattttcataatactgaggaggaaacagatatgaggacacccggctgccatgttgggaggctgagacatgctcccaacagtcctacgcacttgcttctgtctacttgcccccactatcgccagagcaaatgccacgctgccctgtgggattatggggcagacacgagtcccaggcacctgggccaggggctgttcccggaactgcagataagggctcccacctgggcctcttatctcaggggcgttccagcctggttactcattaccctccccttggcgcgtccacttcccttccctgctgggggccttgatgggggatccttggctttctaaactccctggaggggaggggactgaagcagacagagctgatgctgttgtcccatgtccccaagcatcttgcaggacaccttttatcaaaacagccttatttaatcaggccccagaggcaagtctggggtatacaggcaggtgggattcctccccgggaggtcatacctgacctttctggggtaagagggaggctggggcggggatgttggggaagcggcctgggagacggctgtcagggttgcagcagggacgctctgggatgagctgggggcaggcggtccctttgggaggtgagacaatggccctgtgtggtacactccctgccccccaccccccacgggccgcttggtctggcacaaaggacacactgtgaggctgggtcctccagctggtgggggtggcatggagtggggcctaaggaacagctattaggtccagagtggcagtcgggggaggtggtcagtttggcagggcctctgggagcataaaagtcccagagcaagcctggccttccctgtcctccctcccatgtctgtcctgcagaggtggggaggggtttaggggcaacatgacttctcccctctccggtctggtaggaaccagctgttaggtgaggggccggctctgcacctaggtggggccctgggaccgtgccccagcccctcacaccttgacctcatcatcctcctcagcatccgcaaattcaaaggtgtttgcttgcactgtgctgggcactggggtcctgctgcctgcctggggcgccctccactcttcgtccaggctctcccaggaggcccgggcttggggcagcacctccacccgctcctgccgcgcatccatctctgggtagtggtggccgccatcccagcctgctccccagtgcctgccgagggcagggccagcaggtcctcggggaccccctcccactgggctggacttcacctcagccactgggcccaacccagctgttaccccattgggacagtgtccatggggtgtggagcttgcggcaggggctgggggatttgcagcaggacccgtgggggttgcggcaggtgctggggggtttgcagtagtggctggggggtttgcagcaggacccgtggggtttgcagtaggggctggggggtttgcagcgggggctggagtctcagctgcaggggcttctggcaggctcatgacccctagcagctcgctgaggagtgagggcccaaggtcgaggtcca

SEQ ID NO: 16818 - DNA, 15907 bp, Human
agcggggaggtcctttcctcaaagaggaggaactgaggggtggaaggatgagtggggacccaccgggagagagagatgccaggcaggcaggcagcgggcgggcagcagcgggtgttggaggcgactgcagggcagccgggacacgacggcagatgctcgtccctcgtccctctgtccatccagggcggctcctctccgggcggttctgaggccgagcgggcgctgttaaaaagctttttatgtgtgtgtgtgttaatcacatgattgccgttcacctgtatttcgaacaaagacagctcactgtttcaaggccccgaacaagagtctgggcacagggaagagaagggaggcggggggaggagggttggcagcgccgggggtggcgtcgaggaaaactggggggagattgtccaaggccagcaagcgagagaaagagaaaacccttatcaaactcctaattcactgggctccgaggccccagacacactggcccgattgtctggctggttgtgtgtgtgagcatgtgtgtgtgtgtgtgtgtgtgtgtgtgtgtgttccagtgtctgctccccccacccccaacatgcctctgcctcgtgtgactacctcattgtgtcccatttcccaccccctacacccctttggactttcccaagcatgaggccttgcctccccagaccctttgcagcccactccagacaggaccccttggggtggtcttggggctttgccctgctgttgaggagctcagaacgtcacatggttgccaatgcgaccccagctccattacataacccacatacaccccacctcggcctcaacaccccggcggggctgccctcagttaagagaacagcactgcgacctttggaggagaggccaaggaaagagagagaaaaaggtgtcaacggaggatgggcaggaaagaaaaggggagggagggagaggtgggcagaggagggaagaggcagggcaagtccccaccccttgttggggtgggggagtagaggacttcgtgacaatcaggactaggactcccctaccctctcccaagacagggtgagcccagtgtggaaggagctgggtcccagtaggtagcaacccaaaatgcctctaagacctactgagagagggcccccaacctgtcccaccttggcctcctggcagctttagtcttgtgtttccaccttgaaccagaccagaacgcgcgtgtgctgggtgtctgcagagaagggaccaggggtcaagctggggctctgcacttctcagagggatccctgagaagtctctcttactgtgcaggatggggcagaaagggctgcctgggaaaaggtaggaggcagggtgaggagctgggcatcagtgcctggcacacactaggcactcaacaggatttcgcagacgaagcagctagggccagccaccctcacgggcccccaggaccctcaccgccttcacgtctctccctagtcccctgccaagtgcccatcctgccacctgaggcagacgttaggagtcctggttgggcccaattttcttccatccaacaggttctgaccctccagcctacatctcttccttcctcggcctaacctcccctccacctcccagactaagcccaagataagcctcagcaagatgggcctgggcagtagggcagggagctgggtgggggggcctgggctccgggtggaggagccctgagtgttggggatgaaggaaagcctggaggctccaccttctgcccttccctccctcctctcccctcccccctctccccctccttccttccccagccctccgcagcggctcaggctcagtcgctcagtcagtctcgggctgtccggccagggtggttggtggtaaggattcaggctccgtcctaacgaggccgtggcctgaggctcagggccccccgcccctccctcccagcccaccagcgtcacctcccagccccgagctggaccgcacaccttgggacacggttttccacttcctaaggacgagccccagactggaggagaggtccgaggaggtgagtgcgcagcctgctcctccctggcccgcccaggcctgggaccctgctgtgaggtggagagaggcgacaccccgcccttgccccccacctggctctcctctaaaccccgttggggcaggctgagggaagaaggaaaggtgagagaaaaggtgggaaattccaggggccgggattagagcaaaataaaggctccgtttttttcttccttatcatcaacaaacctccacccaaaaaaggaggctaaaaaaaaagccacccacaccaagagacggttgggaccaggtggtgggaagacacagaggcgggacgcacccacctagagtctggcatgtgcgtgggccccaggggccagatgggtttagctggagcaggaagggccgccacctcggggctgtgcccacgtcctgtctcgggccgccctcggggctgcgcgcgcggccgctccatcgcgccctccttccatccaggtgggcgttggactctttgcgaggaccccggcggctggcccgggggaggcggccgaggcggcggcggcggcggccgggggcgacatggcggaggagcaggacctatcggaggtggagctgagccccgtgggctcggaggagccccgctgcctgtccccggggagcgcgccctcgctagggcccgacggcggcggcggcggatcgggcctgcgagccagcccggggccaggcgagctgggcaaggtcaagaaggagcagcaggacggcgaggcggacgatgacaagttccccgtgtgcatccgcgaggccgtcagccaggtgctcagcggctacgactggacgctggtgcccatgcccgtgcgcgtcaacggcgccagcaaaagcaagccgcacgtcaagcggcccatgaacgccttcatggtgtgggctcaggcagcgcgcaggaagctcgcggaccagtacccgcacctgcacaacgctgagctcagcaagacgctgggcaagctctggaggtgagcacccgaccgccccccgggctcgggccctctagcttcgggtggattcagggtagccgaggcggcccggcctcctgcacctcagagcgggactgtctggcagtcctccttggatagggctggaagaccaggtgtgggggccgcgcccgcccttccatcacaaggaccctggaactcggaactccagcggcctaggccgggtctccctacggggcggcgggcaggaaggcgccccctcgtggttggaattttgcgggtggcagaccgtggggcctggggctttggagggagggaaggaggccttcactaactcctgcccacagatacgcacactatgccaccagctgctgtggtcaggaggatacgagggaaacgcttggaaagaaccaaagggttggctggagattcagggaaactgaggcagtcagatggagaactcaggggaggtttaaagaaaacggaattcagatgagagtctttggaagagtgagggatgaagaactgcgggacaaatctgctgctgcgggacctcatcctatcctagggctcttccctgggactttctgacgccaccctcctttgagttgggggcttcttcatcctcctagggagaggacacacagtaaggggctccccctcctgccctgccccagagtcaccaagctgatctctttcctccctctcccagttcggcgccatcttccctgccagggccccaccccaacgttgagcaacctcttccccactgccccagagctggagctgagcactctggccagaaggaaaccttggcctccttcctgcccaggggccctcagagtcccaggttccctgggaccagcccacacctctaggaaaaacatcccccgcagggagcaattatcccaccctcgactcaggtctggggttcagccaggcctcctggggatgtgtggaacaagacagtcccccactcccacccgggagtgccagagcagctctgaaagagaccagggactccaggagatgtgagccggtagcagtcacctgattctcgctagactgaccaagagacaggcccagaaaggcaaaggaatcacaaaggtcacatagaagttggtagcagagccagggccagaacccaggactcccatactctctgtccagaggacttcccctgaccctggtgacagtggtggatcacctacactttgaggagtggtcaggaggttggggggaagcaagaagatgagaacaagagtgaggagcatctgggttccagaaaattagggctttgtcagaggagcccggctctcttccgctgccctcccccttgccagccacagttgggtagagattgggtctagaggcttagagtggtagaaggtgcaggaggatctccaagagaccaaaagattcacatcccgccccctggcctgttcttgccatgtgtttgctgaagacctggtgccccttcccctgccccttctcagccctcagtgccctgctcacccagggcaggcccagggctcagcgaccagcccgctgtgtggacccagacagcccagttctgcccaagagcagaggtcacagctagctcctccacccaaggtccatccagatctgggtggggcttggcccaggccagtatctttagtgccaggggacaaagagcaagtgagaaacagacaaccaggagagacatacagatagggcagactctggggaccatgagaagaccacagtacgagcccaacgagagtcaaagcaaggacggacctcattttccctccatctcccattgccaagggtttaagattggctcctccattgtccctgtccccaggttcccccagcccagaaccctgggcttggactcccttcaggaggacttattcttggccatcactcaagctgtgtgcacaggggccagcctgaggtgtggcagtcaggaaaactggcactacttgctgaggacccaatcccaatgggaggatggggccagaaccatggcaaggatcaaaggcaatgccaacagagggtggctccctggaccctggaggggggtcctgagagacatttggatttgggctgggctggccaattgctccaggggcttctcctgaaacctccccaagctgtgactcctgggatgtcaagaagtggggtggttaggtaggcagagctggaaaacaggtgtcttaaaaccaaaaagagaaagatacacacagactgtgtggagtgccccaagggagtgtgggatcagacacactggagcccaggtcctaaggggccgtgtcagccccaacagtcattctaacctttgatgcccatctggggaggggctagttgaggctgatcacagggtggtgcctgtgggttggctgatctgcctggaaagaaccagagccaagaaactggaaaggcggacacaggcaagagtccctcctgtgtggtgggggtcacccagcctctgttcccagtgccacaggccccttccccaagtagtcttcttatgcccctggcctagcaggacacaggtagcagcaatcagtgccccactgtgggaggtccccggttggggtttccagtttgggtgaggaatcagcctacctcttcttgcccccattccaaacctgggagaccagggagaaagagggctgacaggaaggtgcagatgaggactgggtttggagttagagctggaggcgaagttgggggtttggggctggtaatgttgagtggggactggtgctggagattgggtttacatggtgggcaggctgggcttggggttggggtggaggtggaatcagctgtccggcacagctggtggaggagggagctggggtcggggatggcagtggccccaggcttagatttctgtcagggttaggctaatgctgggaactagcttaggaggtagcagcggaatccgatgttggaatcctctctctcttctggcccctgtcactttcttgctgatgctggctgccagctgggcagggggcaagggaaggataggtgaaagagtgagctctgtgtcccatgtccccagccatcccagaagcccctctgttggggtccactgctggcggagcagctctctcctctgtgggttctccccagtcacaccctcaaggcctgctccaccccctcccctggtcccagccgtcagagagggtgcccacatcccactccctgactctcaaggccctgctccggcatctttgtcctaagtgtgtacactgactctgacagagtctcggctggagggaccctctgagaaagctggggctagggctgggctcagggccggggtggggggagtagacagggaggctaagccgcagaggaatgctgctgccggctaggaggtgcctggcatgaccacccccgcccagcctggggagggagggctcggccttctgctgactgggggaagagggcactcactggggtgtgaggggtggggcagctgaagagacaagccctctggactgacagacaaggctgctcccacaaagactcatggattctcagtaccaaggtctgggattctagaatctggactttcccctcgaccccctctgtaaggtaccccatcctgccctcctcaccctggggcagccaaaccctaaatgccctccaccctccaaccctggcctaaggctggagtcggtggcaagggcgctggcttcagggcttcttctctccatgtgttggtttcagggactgttccagggtctgaggagaggctagcttcctctactctctgctattttctggacaaggatataggatcccccacaggaggcagtaccccccacccagacccatggtaaagaggagccacatctgccccctcagtcccaccacactggaattcacacaatcaggacccagagttaagagtccaaccctagatcctcctgtccaaccacccccgcaagcagcattagaaaagcacctcttggggccgggcacggtggctcatgcctataatctcagcactttgggaggccaaggcgggtggatcacctgaggtcaggagttggagaccagcctggccaatatggtgaaacctcgtctctactaaaaatacaaaaattagccaggcatggtggtgcgtgcctgtagtcccagctacccgggaggctgaggcaggagaatcgcttgaactcaggaagccgagattgcagtgagctgagaccgcatcacggcactccagcctgggcgacagagtgagactctgtctctaaataaataaaaaattaaaaatagaaaagtacctcttgggctgggcacaatggctcatgcctgtaatcccagcactttggaaggccaaggcaggcggatcaactaaggtcaggagttggagaccagcctggtcaacatggtgaaaccccatctctactaaaaatacaaaaattaaccgggcgtggtggcgcatgcttgtaatcccagctacttgggaggctgaggcacaagaatcacttgaacctgggaggcagaggttgcagtgagctgagatcataccactgagctctagcatgggtgacagagtgagattccctcacagaaaaaaaaaagaaagaaagaaaagcacctcttcctcaaggtgctcagcccgcttcccaggccctggtgcaaggcatctcacatccattattctggccaatcccacacccaagttaagccaatgttatcatccttttataggtgaagaaactcaggctcagagaagtaatttgctcaaggtcacacacacagctagtaagtagcagagactgagttctcccccagccatgctgcttctattgcccaccctcagtcccagggagctcacccccactgaagtagccaattccacttgcagacagctttgatgatgagaaagtttttcctttccttgaactggcatctgccccttgaaacctctactcctacttctaactcctcctcaggggctgccaggagcagcgggctgacccctctctcaccctccagcccatgaaagatttgggggcagccctctgaggctgttattccttgggcctcacatctctcagtccacaaatcatagggcacagcccccaccccgggtcctgtcctctgggtgccccatcccagggcctcacatcttccaagatggacactcagagggaggccaacctggagtgctctggcattcacgccagcccctctgctgtcctctccgcctcccaccacaccccaggctgctgaacgaaagtgacaagcgccccttcatcgaggaggctgagcggctccgtatgcagcacaagaaagaccacccggactacaagtaccagcccaggcggcggaagaacgggaaggccgcccagggcgaggcggagtgccccggtggggaggccgagcaaggtgggaccgccgccatccaggcccactacaagagcgcccacttggaccaccggcacccaggagagggctcccccatgtcagatgggaaccccgagcacccctcaggtgagtgctgatgacagagctgagggtggggcaaggccagtcagtggagacaggagatggctggatggcaatgagaccctggactctagggagagcgtgccaggctgtgcagttgccccagcagagctgcaggggcccagagggagctccatgggggttccggtgccaggggaagtggctgggtgagatggctctggccagggctgatcctactgggcaaagagggccagttaaagactgtggaggccgccgggtgtggtggctcacacctgtaatcccagcactttgggaggccgaggagggcagatcacgaggtcaggagatcgagaccatcctggctaacatggtgaaatcccatctctactaaaaataaaaaaaattagctgggcgtggtggcgagcacctgtagtcccagctactcaggaggctgaggcaggaggatggcgtgaacccaggaggcggagcttgcagtgagccgggatcgcgccactgcactccagcctgggcgacagagcgagactctgtctcaaagagaaagaaaaaaaaaaagactctgtggaggtcatggagtgagaggtggctggggcagttacaagtaaagggggagaagacaggatggttttgagaaatggaagagcaaatggaggagaggaaatcactgcctctttcccaccagccattcttttttttttttttctggagacagagtctcactctgtcgcccaggctagactgcagtggcatgatctcggtgcactgcaaccttttcctcccgggttcaagcaattctcctgtctcagcctcccaagtagctgggactacaggtgcacaccgccacgtctggctcattttgtgtattttagcagagacagggtttcactatattgcccaggcccagtctcaaactcctgagctcaggcaatctgcccgcctcggcctcccaaatcccaccagccattctgacagaggagacatggcatgtgataccgtgtctggccatggatgggccagacataagctatcttgtttaattttcattaatgataataacagctaaccttaattgagcagctactctgttccaggcactgtgctaggtgctagttgccttatgtatactaactcaatccttgcaaacaatgtgatgaggtacccaaactgcctgggctcagatctcagctgtggcaagttactctcattttactgatgagaaacaaacaggaacttccccagtttggctcccgggcatctgcttggcaccacagctgccttgcctgtgttcctaatgtacagaaagtgacacacacaggtctgccacatgggaagtgctcagtgagcagagctctgccttcagaggacacgctctgagtcctactttgtgtcaaacactggagtggacaccaggggtactaaccagagaagcctacagtccctggcctcaggggcccatagtctagagagaggagcagggatgaaaacgagtgaattaagtacaggaagaaacaaagctaggcatggtggaatgcgcccgcagtcccagctacacaggaggctgaggtgggaggatcacctgagcccatgagtttgagaccagcatgggcaatgtagtaagactctgtcttttttttgtttttgtttttgtttgagatggagtcttgctctgttgcccaggctgcagtgcagcggtgccatcttggttcactgcaacgtctgcctcctgggtttaagcgattcttgtgcctcagcctcctaagtagctgggattacagatgcacgccaccacacccagctaattattgtatttttagtagagatggtttttcaccgtgttggccaggctggtctcgaattcctgacctcagcctcccaaagtgctgggattacaggcatgacccagcacgcccagcctcctatctcttactatatatatagtatatatatagagagagaaacaagtgcacaagaagtctgtgtgagatccagaggtggcatggccgtctatcccatccagtcaggtctccaagaacaccccactgcccaccagactcttgtcaaggaaggcttccagaaagaggcaatgcctgggctgcttggtacaatctctattttactgataaggaaactagttaagagaagactggggatttgtccagacacagaaccaggattcaaaagcctaggcaggtctcttgaagtacagagcccttggccaatgcaggacttggcgctgcctctggtctgatgaaggaggcacaggcctgtccttggggagctcctagtctcttaagaccatggacatgttctgtctccattgggatgccaggcagtcatccctcccacacacgtgtacatactcttcaccttcaaagattcagggacacacacacacacatcaggagaccctggaccacatacagagcaaccacctcagaatgaaactggacacagactttttctcacccttcaaggccccacccgactcagacatccttccctgatcaaaccttccccaaatccctgaggcagcgggtggactcctcctctgatctcccaagtccttgcatattgtcaccacagcacttccaactctgggtgcatgtggatctatggatctatgactagactatgagcttttgggaacagggatccattttatttacattagtatccccagcacctggcacagtacctggcattttgtaatgctccctaagagtttgctaaattaatatgtgaataggaaagtgaacagacaaaggaacaaggaccagttttctaagtgccctcccatggaggaaggcagctcaaagaacaacagggcaacacaggccagcatatgacggggctaagggcttgccagtgggctgggaagcagggtgggctcaggaggagggaagggttggaaaggacacaacatgaggccaggacagggagcaggcccaggcaaccagcaaaggtgaaacagagcactcaggagcctgggcgagcgaggctcagcaaggaagacagtaggcatgggtgtggaagcggggctggcagagcgcaaaggctgggccagaccacctggacagcagagaagctgatgagaggaagaactttccacaggaaaggttttttcagaatgaggcaggcctccccaggacccatccctaagatttgagaatttcataaacaactagagatcaatctaagacaccagtatttaaacaaatgctgtggggcgcagtggctcatgatggtaatcccagcactttgggaggccgaggcaggtggatcacctgaggtcaggagttcaagacaaccctggccaacatggtgaaaccccgtctctactaaaaatacacaaattagctgggcattgtggtgggcgcttgtaattccagctactcaggaggctgaggcaggagaatcatttgaacccaggaggcagaggttgcagtgagccgagatggcgccactgcactccagtctgggcaacaagagcgaaactccatctcaaaaaaaaaaaacaaaaaaaaacccgactcatgctgccaaaatgtgaaacttacaaggttttcccagaggcacccgctgcctgaaggtgaaccatggaagttcacgtgcgcccacctgcctctaacctgcttcccccttgcgctctctctctctgtctcccttctacccaggccagagccatggcccacccacccctccaaccaccccgaagacagagctgcagtcgggcaaggcagacccgaagcgggacgggcgctccatgggggagggcgggaagcctcacatcgacttcggcaacgtggacattggtgagatcagccacgaggtaatgtccaacatggagacctttgatgtggctgagttggaccagtacctgccgcccaatgggcacccaggccacgtgagcagctactcagcagccggctatgggctgggcagtgccctggccgtggccagtggacactccgcctggatctccaagccaccaggcgtggctctgcccacggtctcaccacctggtgtggatgccaaagcccaggtgaagacagagaccgcggggccccaggggcccccacactacaccgaccagccatccacctcacagatcgcctacacctccctcagcctgccccactatggctcagccttcccctccatctcccgcccccagtttgactactctgaccatcagccctcaggaccctattatggccactcgggccaggcctctggcctctactcggccttctcctatatggggccctcgcagcggcccctctacacggccatctctgaccccagcccctcagggccccagtcccacagccccacacactgggagcagccagtatatacgacactgtcccggccctaaagggggccctgtcgccaccaccccccgcccagcccctgcccccagcctgtgtgccctgttccttgcccacctcaggcctggtggtggcagtggaggaggctgaggaggctgaagaggctgacaggtcggggggctttctgtctggctcactgccctgatgacccacccgccccatccaggctccagcagcaaagccccaggagaacaggctggacagaggagaaggaggttgactgttgcacccacactgaaagatgaggggctgcaccttcccccaggaatgaccctctatcccaggacctgagaagggcctgctcaccctcctcggggaggggaagcaccagggttggtggcatcggaggccttaccactcctatgactcctgttttctctctcacagatagtgagggtctgacatgcccatgccacctatgccacagtgcctaagggctaggccacccagagactgtgcccagagctggccgtgtctcccactcaggggctgagagtagctttgaggagcctcattggggagtggggggttcgagggacttagtggagttctcatcccttcaatgccccctccctttctgaaggcaggaaggagttggcacagaggccccctgatccaattctgtgccaataacctcattctttgtctgagaaacagcccccagtcctcctccactacaacctccatgaccttgagacgcatcccaggaggtgacgaggcaggggctccaggaaaggaatcagagacaattcacagagcctccctccctgggctccttgccagctccctcttcccttactaggctctatggcccctgctcagtcagccccactccctgggcttcccagagagtgacagctgctcaggccctaacccttggctccaggagacacagggcccagcacccaggttgctgtcggcaggctgaagacactagaatcctgacctgtacattctgcccttgcctcttaccccttgcctcccagtggtatttgaataaagtatgtagctatatctgcccctattttcctgttctgcagccccccaaatccacatgtaactcattactgtctcctgttatttatctcagtagtcccctctcctagccactctagcccctattaactctgcattaagcattccacataataaaattaaaggttccggttacctgcttggtgagcctgacctggcctgtctcttcatctcttatccctgtactggtgcttcctcaaatgctttctggaagtagctaggagtagaatgcaaaggatagatcatcaaaggtctctctctcccacctccctccctctttccccacccccttcccctcccccctcctctctctctcccccctcccttctctcctctctttctctctctctctcccccctccccctctcctttctctctctctcccccctcccactctcctctctctctttctgtctctctccctgctaagaaagtgggaacaatggagagtgttaggacagctggcatcccagtggggtccatctgagctcagggactgaagcctcagatgggaacttctccccagcccggcggctatgccccacactgcaggggggccactcactcttaactggctcagctagaactcactgccttgcaagcagcccctctgctcacccagcactcagcagacgggagtttgcaaagaattcaagagacaggtatctgaagaggaggaggtgggctgagggtgacaccgtgctgcctgcagtcagaggcctgtccttcaggatgtgtggataggccctgtgttgctgcatccccccacttgccacctcccccagcacacacacagcagcccacgccaggatctagccaagccttcacagcaggtgcccatgtccaagtccagaccaaggatgtcagacagtctactccttaagcgcctactccctaagagctctttcctcagcagaagtccaaactgcacccagaggccaggaccactccacctcacaagcacacaactccaaagactctttgccatcttgctccactgatgaacaactccgatggttggaagttcttcctcatacccagctcataacagcttatatccagctgccatttactaagtgctccaccaagggttttatgtcattcaggccagtgaaggggtaggtccgatcgttatctcaattttccagatggggaaactgaagtttgcgaggctgatgctaagaagtgctggtgccagaatctgaacccagctctgactccaaggcttgcatttttaaccatcatcccctccacctgcctgtggtttgcagcccctgcttctgctttgtatctggagcaatgcatcttccactgctccagactgggcatcctcagctcccttccttccatctgcggtctccagcccctagtcaggaccaggggagaggcagggcaccaagaagtagcccagtccccagggtggccaaaatccctccatctaggacctgcatcatggaagctcttcaagcaacctccccaaaactgctggttcccgtgaagctggatggtaaccgaaaccccgatcttttagacaatatccattgcaaagtcatatccaaattgtatgtatgctgtttttgttttgttttagataaaagcaggactttacactgatctttaacagatctcaccttgttgggtttgacccatttccccacctgtattaaactttttagaacttagctctcctttagagctttatgtatctgcaaacttgaatagcctcattcaagtcactaataaaggtcgaaatgaagagggacacctgtgtacagcattaaacgcctctctccactgtcagtcctattatctccactcttttttttttttttttttttttttagatggagtcttgctctgttgccaggctggagtgcaatgttgcaatcttggctccctgcaacttctgtctcctgggttcaagtgcttcccctgcctcagcctcccgagtagctgggactacaggtgtgcaccaccacg

SEQ ID NO: 16819 - DNA, 76399 bp, Human
  misc_feature (1)...(76399): n = A,T,C or G
agtcaagctgaaactcttaagcaaattttaaatcttactttaaggaacaatttcctcacctgtaaaatggggacacgaggatatgatggaagtgaagtcactttgtaactggtaaagctctgtacagatattagttaagatggttaatttcattaacctgtgaagattcttaactaaaccttgcgcaagttgcattggctgccctgtctaggcactaatatctttagacggactaaggaggaaacacactttttttttttttgagacagagtctggctctgtcacccaggctggagtacagtggcatgatcttggctcactgcaacctctgcctcctgggttcaagcaattctcctgcctcagcctcctgagcagctgggactacagactatggccagcacacccagctaattatttgtatttttagtagagatggggtttcaccatgttggtcaggctggtctcaaactcctgacctcaagtgatccacccgcctcagcctcccaaactgctgggattataggcgtgagccaccgcacccggcctacacgcttcttttcacaagaatgacacccgcaactatacttcccacgtaaatggagagcagtctggcagattcatctagacctagggttgggtgattattagggaaagaaaaggtccaaccaagccagtgggctgaagagaggacatgacctgctcagtccgaagcagatgtgtgactaaagtctagtctcctggcttctctgcaaaatacctcattatcggcattattaaccctaacaactgccatttattgaaatcccactatgtgcacgaatggggaccaatttacttctagatattacaacaatcttgtattactgtgcccacttcctggatgatgggtctgaggttcacagagatcatttgcccaagttcctactgaaagtgctaaggtatttcctgagactggctcagggtgtgttgccagacaacaatgcacacatttttaacacaatactaaacttagtatattatacttatgttaaaaatttcggagccgggcgtggtggctcacgcctgtaatcccagcacttcgggaggctgaggcgggcagatcacttgaggtcaggagttcgagaccagcctggccaacatggtgaaaccccgtctctactaaaaatacaaaaaattagctgggcgtagtggcgggcgcctgcaatctcagctacgcgggaggctgacgcaggagaatcgcttgaatccgggaggcggaggttgcagtgagcgagatcgtgccactgcactccagcctggtcgacagagcgagacttgtctcaaaaaaaaaaaaaaaaaaggacatgtggtaattcccctagggaatttggccttagttgtgaaaaataaaaaagctataatcaatttctgttctatcggaaaaaaatgtattggctgtttagctgaaattcaaatgtaacttaacatcccgtattttttatatgctacatctggcaaccctggcttgaggctacctggcaaaaatcaaaacaggttcctccttgttatgccctatgcctctgttgcctttatttttatctttacgagcaatcattaacagtaacttcagactccaggctctggtcgctttaggaggcggaaggcggactagggtaggactcctggccctcatcaacaggactgccaagaagccgggcaccttctgccccgcacaaacatggccgcgcctcgccgccgaggattggctcccgccgaaagctcgtcctcctggctaagggagccccttccattgggcagttaaaaaaaatggcggaccccgcctcccgccgtcctcgggcgcgggggcggagcctagaggaggcctgggacagggccaccagtgattggcggagagcggtggtcaggccatcacgtggcccgaggcccgtttgtttgcggaagtaggaggaagtagaagtgctgagtaagccgaggtgagtgacctcgcgggtgggcggggcctgggggtccgttccccaacttcctcggcgctccggactcccaagtctccgccggaccctcctttggatattcctcgtgtctccgattctgaggcatgtcctccattaacccttatgtgactccctgagtgcccccaccttccatcttttcatccccctgcgtccccaattcccatcccgagaccgcccgtgtctcatctcgaacttgtggaccccagggaccccagcttcgaccctgagtttctcccctgaaccccagtctcctccgtgtgtctccctcagtatccctaacttcccgagtcaatccatctcttctctttccccgaccctcagtgcctctttaggccccattggccgtcctaattttccttcctgtgctcctctaagtgctcacttgattccccacttcacgtccgtctccacctttcgtggtgcctctactcatttctcactccctgcttctcctgcctttcctccctgctttttttccttgcctttcctctctcgcgtgcctccagacctgcccccgacatgctccctccttcccctcagcctggccaccccagagtctcccacccctaatcctgtgtccacctcctgctcccacagatgacttggaagctggtgacagggagcatgtgaccagggtgatcatgggactgggtcggggcaagcctgtgggtgtgggacagggagggcacagggcaaggggacctgtggccgtatttttaatgggctacccacatgaccccaacgaatacctccccctagcttctgggtctttccctcacctgcctcttacccgcccaacaggatgtcaggcaggttcggtttggcaacgttgaggctgcacccttgggctgaatgcattgtttttgaatgcattgtttttgttagagtttctgcctggagtttggaacctgttttctgtccaagtttcagtttcctcatctgtgacaggggaactgtacctcctgccctcgtaagtctgccatgaggttcaaaatttgaatgagaaaatgtagaaggtaaagctttataaccagtatggccctgtacaaatacatgattttactgttgggtcataggcagaattgaaaggagtggaaagggaaagggctagaatgagaagacaaggagagaaggatgagcaggaggtcccttgtctttcagtgtatcatttggcagtgtttgttcatcacctcttgtgagtcaggctcttctgtatatgttctcttcaccattcattcagtcatcgtttatctaacaaatatttacggactgtctgatgttctaggctacccttggtgtggccaatgatattctcacttcacatgagaaaaagagggcgcatgagttgcttgaggtcacaccgatgaggttgaagctggaatctgacaccagagcctgtgtgattgtcctgatgtgtaaggtttgctactgtttaggacacttcttgttccttccgtggattactttcttgttacatgagagactccccaaaagggagtttccctcttactcagcagaatgacatcactaagagatacagaaaggagaaatttaaatactctgtgtgtgtgtgtgtgtgtgtgtgtgtgtgtgtgtgtgtgtctgcagacatctattgggtgtgtgtgctgggggaagtaggtaggcaaggagtaaggggccgtagtgaagagtgtgttacaaacttcactttgtagagggtggctccctgggagaatatgttctgtgtctttcacagtggattttgatagggtcatgtcttaaatgcctcttctcgttttcggatggtgatctcatccagtcttatttctttaagtgccgtctctattctgtcagcccacaaatttatatccccagtccagtccagacctttccctggaatgacatactcaaatctagttgcttactcagcacctcaaacttaggcttttcaaacttgaagtatttatttattgatttatttattttttgagacagagtctcactctgtcacccaggctggaatgcaatggcacgatctcggctcactgcaacctccacctcctgattctcctgcctcagcctcccaagtagctgggattacaagcatgcgccatcatgcccaactaatttttgtatttttgtagaggcggggtttcaccgtgttggccaggctggtctcgaactcctgatctcaagtgatccacctgccttggcctcccaaagtggtgggattacaggtgtgagccaccgcgccaggcctcaaacttaagagtttagaattgagctcctgttagttctgccctccatccctgaccccactcttcaccaaaacatgtccctcccactctctttctcatcttaggacataggagtattgttcattcagttgctcaggtcaaagctgtgagattatctatgatgcctctctgtttcttaccccacacccagccagagtgatcttgttaaaatgttgtttctttgcagtggcctctcctctcatggcacatgcctggccccctgttgcctctctgatgtcactggcttccttgcttttcctggaactcgctaaacatgttccagccccatggcctttgcacacgctctctttgcctagctattcatatgactttcatctctctccatcaggtatttatttaagatcaatttcttggtgaagacttctctcctcacccaatctaaaatttcactctccacctcagcacttcctatccccattctctggtttttctcctcagtagttaattgtcatctaaaacctttgtaaatatttacctgtttatcttctttattattagtagctctgtctaaaatataagttccaggatgtcagggattttgtggggttttttttggttggttggttgttttggttttgagacagggtctcactctgttgcccaggctggagcgcagtggtgcgatctcagctcactgcagcctccgcctcctgggtttgagtgattctcccacctcagtctcccaggaagctggaattacaggtgcacgccaccacacccagctaatttttgtattttttggtagagatggggtttcactatgttggccaggccggtcttgaactcttgacctcaagtgatccacccgcctcggcctcccaaagttctgggattactggtgtgagccaccgcgcccggccttgttttgttttaagacagggtctcactgtcgctcaggctggattgcagtggcacaatcacagctcactgcagcctcgacctgctagacttaagcaatccccccacctcagccaccttagtagctgggacttacaggcatgagagataccatgcctgggtaattgttaagtttttgtagaggtgaggtctcactatattacccaggctggtctcaaagtcctgagcttaagtgatcctccttccttggcctcctaaagtgctgggattacaggagtgaactgccgtgcctgaccagtctgttttgtttacgattgtatcctcagcggttagaacaatgcctgccacaatccatctcagtaaatatttgtggagtgagtcataacatgggccacactgtaccgtgccaccagcccaaagatctcttaaagtcacccctgtctcatgtgcttgggagctccagtgacagtttcggggcagtttgcttccagctgtggtccagccaagccgagtgaatgaaagagatgctttttccttttgtgaaaggacgttttgctctggctcacgtgagcagcagtgcattttgagacgagggccttggcttttggaatctaagagcctgttgagcaagcctcgctcagccaccttctttcagctttctcctgaaggcagtttgaggattaagagcctgatgctctggattccacctaattgggttcagatcctggcaaactgtgtaacctgtgccccagtttcctgtgtaatgtggagagacctggaccttttcttacaggtgtttggagggttaaatgtggcaattcggccgggcgcagtggctcatgcctgtaaccccagcactttgggaggtggaggtgggcggatcaccggaggtcaggagttcaagaccagcctggttaacatggtgaaaccccgtttctactaaaaatacaaaaaattagccgagtgtggtggtgcgcgcctgtaatcccagctagtctggagactgaggcaggagaatcgcttgaacccgggaggcagaggttgcagtgagccaagatcacgccattgcactccagcttgggcaacaagagtgaaactctgtctcaaaaaaaaaaaaaaaaaaaaagtggcaatttacccgaaactgtggtgaagcgtctggcgccctgtgggtgctgggcagcagtgggtgctgatggggtgtgaggggatgggatcaagccctttcccactaacttaggaaagaggttggagtgagctggggtcagagggaacatttgcggggacattttgccgggaggctgccttggaggttcagaggctcagatgacccctgtgttcattcagtgttttctcacccatggattgagcacctgctgtgtggccagccctttgcctagtgctgttcaagagtcagaggacataggcaggcaatcccccaccacaacctgccaccccatttcctctcttggggccttgatttctccacatgccaaacagggagaatgattgcaccttccttgtttcttttttttttttttttgagacagtctcactttgtcatccaagctttagtgcagtggcatgatctcggctcactgcagcctctgcctctcgggttcaaagattctcctgcttcagcctcccaagtagctgtgattataggcacccaccatcacgccaggctaattttttttgtagttttagtagagatggggtttttttctcacacgttggccaggctggtcttgaacttctgacctcaggtgatctgcccatctcaccctcccaaagtgctgggattacaggtgtgagccaccgcgcccggctgtgccttccctgtttctttgtgagcttggaggtggatcacaagtgtgaaaccctttgccaaccgtgaggcatggtggccttgtgagaggacggaggccggtgtgtggtggcatgctcccgtgctgtgtggcacagacggagctacaggaaggaagttggggcagcttggcactctgagtggaccctgagtttccagcctgctctgtcttgactgggtgggaggagggtgctcaggagggtgtcactgctgccaggttctgctgccaggaccatccaacagttgttccaatcatgggacatcctgtcgtcagcagctggggctcgtgaggcctgatttccacctcgggcagttctgtgtgtgctcctggaatcccccacgtggccaagcctgtgaggtctgcttcctggcctgctgcctgtgggttcctgtcacgcacctctcgggcagctgtccggctcctctgctctcggcttagtcaagaaggaagcagaaggcttggagtctttcctgcttggactaggagtgagctcagcctaagtgccctgactatatataaagctgaactttccagaccgaagcctggggatggatcagtccgatcacttagggccgctcctgaaggagtgcaggtgctagatacaggttctcccggtggaggagcgaaccccttgtgggccgttagctactggtgggatttgagcatgatatttccctatccgttgtggagaggagcatggcagctcagagtgggtgggaacagtgtgtggtccctgttatcaccttcaagggaataaagtgtgtctgggggcttcagaggtgctggccccatgggcttataggtggttcattcattcattctcattcattcattcaccaaacttattaaacacccactgtgagtcaggaacatcatgccaggtgcttagggaaacaaatcaaagcgggttgggtgagcagcccaagccaacagatgcacccccattctcacatggtgtgtgttcctgtgggctgggccctgggtggtgtggggtgctggggagaagaggaaggcacaccaggctgcagggcggaggtgcgggtatgaattttcagaggagatggcacctgagctgtatcttcatggataagaagagatttgttcatttgtcctttgtggagcacacattcaggttaagaaagtggggaggatgggctacgccgatggagcgtatgtgtggtatccccaagtgcactgagacacgagtttgacgtgttctgggaagatcgatggtgcggcgtggctggagtagaggtgagggatgagttggaggggtgagttgggccagctctcatggatgctggagtctgggctttccctgggaggtcatggggcgccactggccagggtcagcagggagacctgcagctggatttgcatcgtacagtgggcatggaggggtgtcaggctgggttgggaaccgtgcaggctggaagggcactctggtgctctgagcattcagagggggcagctgggccttgaaggatgagcaggggctccagcaggaactggagagcgcattccagggaggacgcaagtgcaggcccctttcactacagaaaagcagttttcacacagaccttccaaaggggaggagaggggactgcctgggcctggcagctgcggcaggtagcagcaatcagagggcagggaccgctcctcccgtgcctgagacctgcccagggtccttcagggaattcgtagctgaggaggaaccagatttttgggactgagttctccctcaccacccgctctgagccaccctcttggtcccttgtcctctactgcacttcttccggggcttggctcctcgtcatgagaggagcttccctgggcatggcgaggggcgtgactgacatagcagccctggacaagtggctccaggtgacctgtgttcacgttgatcacagcactaaccacggcccctcctctcagcaccttcccctctcgagccgtccagtcccagtgaaaatgctcaccgttcatgggtgggctgagcaagcccctgatctctgccttcctccgtgttctgatctgcttcatctgctgtgaaggcctctcgccatttcccccgctggcaaactcctgttcttcctggaaagttcagctaaaaagtcatcccctttaggggtccttccctcaggggaccgtgcacttggcgagacagggactggtcttgggtctctctgttgactgttttatgaacccaggtagtcacttccagggaactcatcagagatgctaccattggctccaatctccctctgttcccactcgaggttttttgtttcttcgtttgtttttctttctttctttctttttttttgagacagagtctcgctctcgcccaggctggagtgcagtgacatgatctcggctcactgcaagctccgcctcccgggttcacgccattctcctgcctcagcctcccgaatagctgggactacaggcacccgccaccacgcccagctaattttttttgtatttttagtagagacggggtttcaccatgttagccaggatggtctcaatctcctgatttcgtgatccgcccgccttaacctcccaaagtgctgggattacaggcgtgagccactgcgcccagcccgtttgtttttgttttttggtggacatcaactttaatttgccctttgttttgttttgtttttgaggcagggtcttgctctgtctcccaggctggagtgcagtagtgcaatcttggctcactgcagtctcgacctcaagaggatcaagcaatcctcttgccttagcctcccgagtagctgggaccacaggcgcacaccaccatgcccagctaattttattttatattttgtagagacagggttttgccatgttccccaggctggtctcaaattcctgggctcaagcaatccgtctgcctcagcctcccaaaatgctggaattacaggcacgagccactgtgcccggccttaatttgccctttgaacatgtacaattcagggcctctctgggcctcagtttcttgatctctgagatgggaagatgggataataatacttgttcctcccgtccttcagctcctccaggggaccctcacaccagcacactctctgtcagtcttccctcaatgaacccagcaggcaagcttggttttgacagaggatgggtgagcagagataaggaaaacggccagaaatatctggcttccctcagcaggggcaccaaaattggtacctggaaattgcctggcttggacaggcagaattgtcactgtcaacccccaccaccaaaggtcttgggtctttgtctttctgcttgtggtgtttgagagagctgcttgacacagccgaggtgcggtctgtgtcaggtgacctgggcatcctgggggtgcagggagaagcccaggtaaggaggaggaggggccggtcatcagtggggaaaagtgattgtctaccccacgggaaggtcaagggtaggacgctgtgagaagccagggggagagatgaagtgaggcatgatgcggggggccctcatccaccatccccctcttgcagctgtgctgggaagagcctaggctccagggtccaaggtggcagggacagaaggaagcacgtgtgagcactttctccctgctggcccgccttcctggttggcaatgccgtgagtgttccaggatgtggccccgtggctgtcatttcctttcttccacctagtgataacaatggccactgtttgtgtgcccacagtcggcctgtgtcccagacaccttccctccattgcgtcatctcgtcctcctgcctaccctgaaggctggatgccagccaagcctgtcgtttctgtggccatgctgtcgtgggtgtgtggggggcatcccctagccccaggctctggtggggggtacacaggctgggccattgacgaaggggtgtgtggaatctttctttgatttcactgcacccctggtgactttctccctcaatctgaggctcatgggtgctggatgctcttgactctctgcccttcctgggcgcacccctccgcgtccctgtgggcccgtcctcggggtagcctctctgcgctcttccaggccaggcctgagtcccacaggtccccatcttcccggctgcagcccccagaggctcagcctatactgctacttcctttgaaaactataatcgctttacatagcatctggaaaatagggaaaaggaaaaaacaaaagcccataaacccagcaccctcatctactcaatggcatgttttctgtcagtctatcttggtttgttttctatcaggctttgttttttctatgcataatatttactcagttaaatttttgttttgacaaactttctgtgagccaagcttgtggacggagatgaaaagacgagcagctgcctttgagaaactcagactctgggccagcccatctgggtgccagctttcactgctccacccactagctgggtgaccctgggcccgtgactttacccctctgttctttggtgttctcatatgtaaaatgaggataataatagtaaccagttcatagagtggttgtcagacagaatgattaatgtacgtaaagctttcaggatggtgccagcaagatgcacaggagtgtttggtaggaggatgacgaagcttaccgtctggcaggaggggcagttgtaacatgctgggctgtgatagtacagatgtgtttaaagtgagggagagcccagagcaaggagagagaacctggcatctggtgatggtgtatcaagaacattttaggccagacacggtgactcacacctgtaatcccagcactttgagaggctgaggcaggcagatcgcttgaacccgggcgttcgagaccagcctgagcaacgtggtaagaccctgtctttataatttttttttttttttttctgagacggagtcttcactctgtcacctaggctggagtgcggtggtgctatcttggctcactgcaacctccacctcccgggctcaagtgattctcctgcctcagtctcccaagtagctgggattataggtgcccaccaccatgcccagctaatttttttatatttttagtagagacggagtttcaccatgttggtcaggctggtctcaaattcctgacctcaagtgatctgccctcctcagcctcccagagtgctgggattacgggcatgagccaccatgcctggcctctataaaaattgtttggaagaaattacctaggcctggtgatacacacctgtagtcctagctactcaggaggctgaggtggaaggaggtagaggctgcagtgagccatgattgagccactgtactccagcctgggcaacagagccagaccctgtttcaaaacaacaacaacaaaaacatttttaaggaggaggctgagaaccacgagaaccaagcttggatttgaagaaggatcagggctttctcagacagaaaaggagaggaagaacattccagatagacatcattgagagatggcactgagccttgtaatgggacactgcgaacttttcttcagttgttatgatctttttttttttttttttgagacggagtttcgctcttgttgcccaggctggagtgcaatggcgccatctcagctcaccgcaacctccgcctcccaggttcaagcgattcttctgcctcagcctcccaagtagctgggattacaggcatgcgccaccatgcctggctaattttttgtatttttagtagagacggggtttctccatgttggtcaggctggtctcaaactcctgacctcaggtgatccgcccgagtcggcctcccaaagtgctgggattacaggcgtgaaccaccgtgccttgttggtataattattagtattgatcttttttccttttcatgtgcctcttagtgggccccttgcttttgtcttccttctgtccccagggttgatcctgtgctcagcacataggccagggaagaatgtggctgtgacccagtgtccactcagatgtcctctctcccccagggcacccatactctgtccttagtgtcttttgtctggtgacatcttggcacagaggcagagggcggcctccgtctgattggcgcctggctttggtgacagtaccttaggaaggcagtgtattttctgggaacctaggaaataacaaggtatctaattccatcatcaacactggggacaatttccatggcagaaactatgactctgaatatgcagcgtaaagttaccacccagacactgctgctcctgagtctcgaatggcatcttctgcaggggctcccccacctgcccctgcagaaggtgcagttcgttcatttccaaggagcttgcttttgtgtgctgtctctcggagctctttgggaaacctgtggtagcaggaaacaaaggatttagaccaatgccgatgatccccttgctccgatagagtgtgacatgatgctggtcaccttttggtatctaggaggggggacattgattttgtttgcggaagtgaaatgatccatgctggcctctttttttttttttttttttgagacagagtcaccctatcgcccaggctggagtgcagtggcgcgatctcagctcactgcaacctctgcctcccgggttcaagtgattctcctgcctcagcttcccgggcagctgggactacaggcgcctgccaccacatctggctaatttttgtatttttagtagaggcagggtttcgccatgttggccaggctggtctcgaatttctgacctcaaatgatccgcccgcctcagcctctcgaagtgctgggattacatgcctgagccactgtgtctggtccatactagcctctttgagtgctgaaaggttatctctgtaacttatttagtgagaaccctccatttgcccagggcattactgcctataatgtatgttcacatgtgctatctcctttggtcaataccacacactacaggtgaggaaactgagtctctgctgggacactgggtcaggaagcaggcagttaaggtcacctgtgcacagtggcagcacagggggacagccttctaggtagccagcctggcctgagggttctgtcacttttacctcccactcagtgttgtttctctttctttcccctccttttaagatccctccaggcccaggatctggggacaacgctggtggggagtgatctgggtgtctgtgcaggaaaccgctgcactgggtgagatgggcatgggagactgtgcctggctgaccagagacctcgttttcttccagacagagggggaagacggtggggcctccccacctgccccgcagaagatgcagttctttggccgcctggtcaataccttcagtggcgtcaccaacttgttctctaacccattccgggtgaaggaggtggctgtggccgactacacctcgagtgaccgagttcgggaggaagggcagctgattctgttccagaacactcccaaccgcacctgggactgcgtcctggtcaaccccaggaactcacagagtggattccggtgggtgatgctcagcgggaacatacttctctcctttcactcccccacgtctcggattggaggtcttattggccgagaagcagtttctttgagtctctgtctgaggggtctggagaggggtgggagagaggggagactgtactcttggaccagagggaagggcttccgagactccacacttctggcccatcagtgtcccagcacgaggctgaggatggaagcctgggttgtttctggcctggaggctcgacctatatggacaaagggaagaaggaaggacagggagactgagagtgtccacatcagataaggcccatggggagaacctttagccctggctctttatttttggttttggtttttgttttttgagacagtcttgctctgttgcccaggctggagtgcagtggcgcaatctcggctcactgcaacctctgcctcccaggttcaagcgattctcctgcctcagcctcctgagtagctgggattacaggcacccaccaccacgcccagctgatttttgtatttttagcagagacggggtttcatcatattggccaggctggtctcaaactcctgacctcaggtgatctgcccaccttggcctcccaaagtgctgggattgcaggcgtgagccactgcacctggcctagccctggctctttaagggcatggccgttctcataggggctgcccagggtttgcttaggaaggctggacagagctgttgcctcttggggcatgctgggactcccctgggcctgaagagaaggctcaaaagccaggacaggcctgagggaaccgggccaacggcagagctggttgggaaaaggggagaagcagccaaggttccaaatgcaggccccagcagtgcttggcagactggcatctagttgggctcagacagatatccctgtttccgctcacctatccatctggctgtcctgtcagccatccattcaacatgcaccaagcacctccagtgtctccagagtcctgggcttcgggccagtcctggctggcctgtgagatgacaaacatgtcctgtgtctttaaggaacgtacagtctggtgggggaggtccggtgcaaacaggcgtcataagcacccccttgaggagtgctgtgacagagggagagcctaggaaacagtgtggatcacaaggaggtgattgagagctactctgcgtctggaagagtgaggaggagcctgtgtggcagaacaaaatggataaggtcgttccagccgtgcagaagtgtggaggtgtgagcctgcaggcaggtggctctggttggatcccaggtgcatgcagggctttggtgagagtgaggctgaaggaagcagctggggactcattctgactaaagaggcatggcaggaggggtctctgaaagtgtcaggctgggggccaggggctgccaccaacagaagagcaaggcaggtatcagggccccatccaatcaggtgagaattcagagcctggctccacaaggaacctgaggcagaggcacccacagcaggtgcttgggctaaatgcagctcagtggccagtgcaggcaccagttttaatacagtggggccattccagattctgagtgcagatggggctgagcagaccgccttccagctggactcgatcaggactgaccctggacggggcaggcttgcacttgtagcttcagagctccactgcaggcacagctgaccagggcagcgggtccactccttggagagctggacagccccacttttgaggtacacggccctggggataccactaatctccacgtaccaataatcaccaagttctgtcagttgtaaaatcccttgacaggattccagatttgtctcagccagcttaagccccagtgtgggcagacctccatcccaggaggatttagtcctttgtcagcagcttcttagctacacgtaagctattctgtggtactttatagtttacaggattttttgttttcttttttttttttttttgagacagagtctcgctctgtcacccaggctggagtacagtgacgcgatctcggcttactgcaagctccgcctcccaggttcacgccattctcctgcctcagcctcccaagtagctgggactacaggcacccgccaccacgcctggctaatattttgtatttttagtagagatggggtttcaccatgttagccaggatggtctcaatctcctgacctcgtgatccgcctgcctcggcctcccaaagtgctgggattacaattttacaggatgtttttaagtatgttgggttagcacattctctgccaatccgtggaggtgggcaaggaaggcagtattccattttatgcatgagaaaatagccttgggatgataagtgattcatcccacttatacacaggaagcagtgaagaaacagaatcagtgtcttctggttcccaattcatttctctgtgctgctgtgttgtttccatgtatgtatgtatgtatttatttttttgagacgttaagtcttgctctgttgcccaggctggagtgcagtggcatgatcttggcttacagcaacctctgcctcctgggttcaagctattcttctgcctcagcctcccgagtagctgagactacaggtgcgtgccaccatacctggctaatttttgtgttttttagtagagacagggtttcactgtgttagccaggatggtcttgaactcctgacctcgtgatctgcctgccttggcctcccaaagtgctgggattacaggcatgagtcaccatgcccggctttgtttgtcttatttctaaattttattgatttatttattttcacagtcatagctctggagtcttttttatcttctcccctctaacctgctcccacccgaacctttccatttcagcagatagcatcattgcaacgggctgtgccagatccagccatcacatccacctttccagccaaagggagggtggaagggcaggatgcagaaggtcaatctccccctcctcagggacatttcatggaagttgcacgcattggccagaacccggtcacatggccacagctaactgcaaaggatgctgggaagtgttgcctgtgttgcagacagccacgtgccagtcgaaaatcagaggttctttctccctccgtcttgctgctggctcgcttctccagaccacagtcattgtgcacgtgtctcctgctgctccggctgtggcctgcactcctctcatcctcttccaagctgctgtcacagcgctgtttccagagggcaaatctgattggtcactcccctgctttactccccaagggcttcctgttttcttttatttttatttttattttcattttttgagatggagtctcgctctgtcgctcaggctggagtgcagtggcacaatgtcagctcactgcaagatctgcctcctgggttcatgccattctcctgcctcagcctcccaagtagctgggactacaggcgcccgccaccacgcccagttaattttttttgtatttttagtagagacggggtttcaccatctactcttagccaggatggtctcgatctcctgaccttgtgatctgcccgcctcagcctcccaaagtgctgggattacaggagtgagccaccgcgcccggccagcttcctgttttcttaacacatcaggtgcttaatgacttaaaagggcccagtgtgatcaagtttctgcctctgtgttctcagctcatgccgccttgtgctcctggcctttgcccaggctcttgctgtggcctggaatactcccctttctttgcctgccttccttcctcttgccctcccctgacctgcaggctggattaggagtttctgctgggcatcccatggcacccgtccctgcactggggatcctgctttcctggtaggccacagaccttgtgaggggagggactgtgtctgttgggttcatgacagtgtgcccagcccccagcaggtgcctggcgtagatcaggtttgtggaacaaatgaatgtgatatattaatttagctttagagtattcattgagggctgctgtgtgccaggccctctgtgccacctgggtggagggtggaggactgttgcattgagggcagttgaaggagtgagctgggaagtgggaggtggaggatggggactgggatgcagggtttgaggttatcaggggtcccagaagcagtaatgccaaggcctaggctgtgacctggagtgagggctgcgatggggtggggtggggtcgaggctgtggaggagggtcatcagggcactgctggagccctggggttctccagggccgggggtggtcattgcagtgttctcccagctcctctcaacaccctgcggtctgtggagagcaggcctggtgcactggacttgcctctggccagggctgagtttctgccttctaaacgatcttcctcctgtgttgccctagaggcctctggactgtcctgagtacttgacgcgtgttagagtgagcatgggctgctagccttccgctccaggtggaggagtttctgttgttcttttgctgctgttgctgcagtgagctgccaggctgagcttctggatggacctgggggatggaattaggagcttctgaattcttgggttgtataacctaaggccggagagtcccacagcactgctgctgggcggagagactggaccctgctgatacagacagcgacagcagcaggagcatctgcagtttcccagcaggtcctgcatgcctgggcttggcactagtctaagtagtaactcatgttatcctcacgacagtcccacgaggtggggtcattactgacctcctattacagatgaggaaacagaggcttgcagaatttgagatcacacagctggtcagcgtagcgattattcagaccctgtcacctggctccagaacccactcgtttacctttcttacatcagggctgctttgtagtgtggcgagctgagtggagctccacccgcctgggctgatcctggcccttcctgcctgacctatggtgcgggggccctggctctccccgtgtgagcccccaggggtcacttgtaatatgcctgtgtacactatgatagcatagatacttctgttcctggtacagattaatcatttacggctggcattggacttgtaacagatgacatttgatgaaatcaaccagcctctcactggtatctcagcagaaacagggctgtacctcccaggcatcctgggaaggatgatagaagtgtgtgatctgtgcttccctaccgggagctgacttttgaggctctctggactgggactttgccataaaactgcttatcagaaacctcagataagtggagtgccctgtgtcctggccacgtactctggggccagctcctccatccattcagtcctcccacatcccatcttcaccaagcagagtggaaagcggcaggtctctgcgagaaaaggaggctctgtacccagccttcagtgagataactttagagtggggccttgtattccctacacaggccttgtccccgacacggcctctttgcccttgcttctccttctgctaagaatgctccttcccaactccttggctggacacacggctcctgctctgtgggcctgtcctgttcccactcagagcctcagcaccccccatgtggccaagacacagcccctcttgccttaggttgccgtgggtctgtttccacatctgtttcccctccagactgcagggctcctgagggacagggcctggggccaagtctcctctgcgttcctgatgcctggtggtgtgccacgctctccgtgggtgcacggtaaatatctgccgagtggctagatgtatccatggttgctgaaggccaagtgtgttgaccagagggcgtgggaaaggctccactggggtggctggggtagagatagaccttaaggggtccagaagactccaccagctggagggaaaggccctacagagacaaggtactaggaaaggcccagaggacagaggaggggccctgtggggagcctgtgggcaggaagggcctgtgctgggctttgaaactggggactcaggtactgctctagcgtgagggtccttggcattttttttggtccaggaccccctgaggtccctggggaatgagaacaggctcacacagccactttcaagaggtttgcaggtcccctgaggcttagccacagacccctcccaccccagcagagacacagcagaggcttctgagtggaggccaggtggcttcagcctggggttctagaagggagggaagagacacacccccgtgtgtcctccagagcctcagccttctccctgaatctcccctttgcctcctcactgtaacccacacctggctctccttgaaggacccgcttgccccgcagcctcctgagagttttctctcccagtccctctcccactgggcctggaggtggggtagggtcctccttgcccccagccttgaatcttctgtcaccctacaataccacttgctgtcaccccggtgataggtatctacgagcctggggtgctcccccacatcctcaaagatgtgagcccctgactcagcgttgcctctggttcctgaccctccacattcacatgaccacgcgctggcctttatcatcgccagtgacagcagctctcccgtaaatacaagtttcaagcaccccactttccagtctctgccttctgtctttccagttcattccctctagtcctccacccacacagtgcttttccccattgacagggaattgctcctggccgcttttcccagccccatcccgttcatgtgccttgctttgtacccagcatggactccatggcctgtcattgtcactccttcacctatacttcctgcctccttgcttctctctctcttcgtcatcctggcatcaccaccccagaactgcttggtttcagttctccaccatggctaggggaacatacctttttgctgactgctctcactttctttttttttttttttcttttttttttttttgacacagagtctcgctctgttgcccaggctggagtgcagtggcacactctcagctcactgcaacctccacctccggggttcaagcagttctctctgcctcagcctcctgagtagctggtattataggcacccgccaccacacccggctaatttttgtattttttttagtacagacagggttttgccatggtggccaggctggtcttgaactcctgacctcaggtgatatgcctgccttggcctcccaaagtgctgggattacaggcatgaaccaccctgcccggccctattgctctcactttgaaatcacgacatgagccacagtgagcctatgatgtggtttgacgtctttctgcatttctctgttcacccctctcccagaaggcatgcctccttccctcccctcagcctgcagccccttcccctccacgcttactctcagctgatagccctgctgctgtctcgctgagaaaatagaaatagccagaggagaattccctctaccccatgcacacacctctgtccccgcctactccacattccctgttgtcagcaccgatgtgtttagctgagggtggtccccccattcaaggccatcatctcctgtcatctacttcttgacaccatttgaacaattatctcccctctttcctacataacactttccccttttctactatatattttttgctatggattgaatgtatccccccgaaatcatatgttgaagccccaatccctcgtgtgatggtattaggaggtagagcactatgggggtgattaggtcatgaggatggagccctcatgaatgggattagtgcccttagacgaagaggcaagaaagagatgatctgtctctgccatgtgagggcacaacgagaagatagccgtctgcaaaccaggaagtgaaccctcatcaggaactctatcagccagcaccttgatcatagacttcctagcctctagaactgtgagaaataaaggttgtttaagcctcccagtctgtagttttctgttataatgtcctgacctaagttattttccatcgctatacaatgggttatttttttctttaaaaaaaaattatttcttgactctactttttcctccagagactgcttatattccactgtcttcattcttctcctcctgttttctctctttaaacttttcaaaaatagcaaaatataacacatatagagaaaatgatatacagctcagtgatttatcacaaacacctgtgtaaccaccactcgaatctagagataggacattacagcaccccagaagccctccttttgtcccctcttcccaaagaagggtaaccaataacttgccttttatgataaaggctttttttttttgagatggagtctcactgtgttgcccaggttggagtgcggtggcgcaatctctgcttactgcaagctctgcctcctgggttcacgccattctcctgcctcagcctcctgagtagctgggactacaggtgcccgccaccacgcccggctaattttttgtattttagtagagacgaggtttcaccgtgttagccaggatggtcttgatctcctgacctcgtgatccacctgcctcagcctcccaaagtgctgggattacaggcgtgagccaccgcccccggccaagataaaggcttttctatctggcttctttgttagcattttgttggcgagattgatacgttttgtgtgcagctgtctgtcattttcattgcaatagaattccattgtctactatatcacagttttagttactcattctactactgatgaaaatttgggttatttctagtttttttggtgcatacatgcatacatttctggtagacatacctagaagtgaactggctgcattatgggccataacttgtcttcaacgttagtaaataataccgcccgtctgttttccaagcagcagtaaatggcactttctgttacttcctatcttctgttacttggtactgtcaggttttaaaattttagtcattctgtcgggtgtctagtagtatgttattgtggttttattttgcatttgcctgattgcaaatgaagttgagcactttttgatacagtgattaaccatttggatatcctcttcagtgaagtatcagctcaattctcttgactatttaaaaaataaagttgtttatctttttcttacagagttttaggaggagttttttggtacatgtgcagtccaaatacacaccttttgtcagtgatacgtgttcagctgcacacacggtgttttgcctttttattcttttaatggtatctattgataaacatgagttcttagttttaatgaagtcaaatttgttcatcttctttacggtgtactttttgtgtcttgtttaaggaagtccttctctatcttaaagctttgagaagcattccttctttctcctattttctaaaaattgttgaagatctccttccttccttccttccttccttccttccttcctttcatctatctctctctcacccaggccaaacttcagtggcatgatcatggctcactgcagcctcaacttcccaggctcaagtgatcctcctgcctcagcctcctgagtagccaggactacaggcacgcaccaccatacctggctaattttaaaaattttttgtagagacacggtctcatcaagttacccaggctggtcttgaactcctgggctcaaacaatcctcccacctcagcctcccaaagtgctgggattacaggcatgagtcacatgtctagcctgtattctttctttcttaaatgtttggaagaattcatgggtaaaaccatgtgaccctggagtttatttgtgggaagcttttaaaacatggattcgatttctttaacaaatataggactatgagattttcatctcatgtcggtttgggtatgttgtgttttcaaggaatttttctattttatcgaagttgtcaaatttgtctgcaggtccccttatttcctttttaatgtatggaggatctgaagggatggtactttgtgttttctctatttcttgtttggttttgctagtgatttgccaatttaaaaaatctttccaaagaaccaacttttggctttgtttattttttgaaaacctgagtagctgggattacaggcgcccaccaccacacccggctaattttttttatttttagtagaggtggggtttcaccatattggccaggctggtctcgaactcctgacctcagatgatccacccgcctcggcctcccaaagtgctgggattacaagtgtgagccagtgtgcctggcaagccgctttttaaatggcaccaatcccattcatgagggcagagccctgatgatcgaattacctcctaatggccccatttcttaatactatcacactgagaattaagttttaacataagaattttaggaagacacaaacattcagaccatggaacatatataaaacagttgtcctaccaactaacagaatacacattcttttcaagaacacctatataaaaattatagacactgacctatgctggccataaagcaaatatgaacaaatttcagatacctgaagagatttagactatgttctccaactacagtgcaattaagctagaaatcaatagcaaaaatgtaactataaatgagcccgtatgtttgaattttaagcaagatatatgtaaattatctatggttcaaaaaagaagtcacagtgaaatttagaaaatatcttgacgtggcgggttgcagtggctcacgcctgtaatcccagcactgtgggaggccaaggcgggtggatcacctgaggtaaggagtttgagaccagcctggccaacatggtgaaaccctgtctctactaaaaatacaaaacattagccaggcgtggtggtgggcacctgtggtcacagctacttgggaggctgaagcgggagaatcacttgaacccgggaggcagaggttgcagtgagccgagattgcaccactgcactccagcctgggcaacatgagtgaaacttcatctcaaaaaaaaaaaaaaaagaaaagaaaaagaaaatatcttgacccaatgatgatgcaaatactacgtatcaaacttgtaggatgaacttccacttctggccatgacagaggagcctgtatcagactagccttcctatttatatatttatttttgagatggggtgtcgctctgttgcccaggctggagtgcggtggtgcaatctcagctcactgcaacctccacctcctgagttcaagtaattctcctgtcccagccttccaagtagctggaattacaggcgcccaccaccacacccagctagttttttatatttttagtagagacggggtttcaccatgttggccaggctggtctcgacacctgacctcaggtgatccacctgcccctgcctcccaaagtgccgggattacaggtgtgagccactgcgcctggccgtgagtgacctttttaatgtgttgttgaatttgatttgctggtattttgttgagaagttttgcatcaatatccatcagggatactggcctgtagttttctttttttatatgtctttgtctggttttggtgtcagggcaatactggcctcatagaatgagtttggaagttttctctcctctgtttttcataatagtttgagtagggttggtattagtttttgtttaaatgtttggtaaaattaagcagtgaagccactgggtcccaggcttttctttgctgggagacttttcattacagctttgatctcattacttgttattggtctatttaggttttggatttcttcacggttccatcttggtaggttgtgtatgcctaggaatttatccatttcttctagggttttcaatttattggcatataattgttcacagtaacctctaataatcctttgagtttctgtgatattggttgtaatatctcttttgtcatttctgatttttttgtttgggttttctctctttttttgttagtctagttaaagatttattgattttgtttatcttttcaaaaaactttattttgttgatcttttgtattgttttgtttcaatttcatttatttctgctatgatctttattatttcttttcttctactaattttgggtttggtttgctcttttctagttctttaagagacatcattagattattttgaagtttttctacttacttgatgtaggtgcttataggtacaactttcctcttagtacttctttccctgtatctcacaggttttgatatgttgtgtttccattatcatttgtttcaggatgtttttaaatttccttcttaatttcttcattgaccattcaagagcatattatttcatttccatgtgttcgtatggtgtgcaaaataccttgtttttgatttgtagttttatttcattgtgatcacagaagatacttgatatgatttcaaatttaaaaagtaatttggctgggagaagtggctcatgcttgtaatcccagcgctttgggaggccgaggcaggcagatcacgaggtcaggagatcgagaccatcctggctaacacagtgaaaccccgtctctactaaaaatacaaaaaattagccaggcatggtggcaggtgcctgtagtcccagctactcaggaggctgaggcaggagaatggtgtgaacccgggaggcagagctggtagtgagccgagatcgcgccgctgcactccagcctgggtgacagagcaagactctgtctcaaaaaaaaaataataacaataataataatttaagacttgttttgtggcctaccatatggtctatccttgagaatgatccatatgctgaggagaagaatgtgtattctgcagccgttggatgaaatgttctgtaaatatctaataggttcatctgatctatactgcagactaaggctggtgtttctttgttgattttctgtctggatgaactgtctaatgctgaaagtggagtattgaagtctccagctattattgtattgaggtctatctctctctttagctctaagaatacttcctttatatatctgggtgttccagtgttgagtgcatatgtatttaaaattgttacattatcttgctgaattgacccttttatataatgaccttctttgtctctttttatagtttttgtcttgaagtctgttttgcctcatagaatagcatagctattcctgctcttatttggtttccatttgcatggaatatctttctccatccctttagtttcagtctatgtgtgtctttacaggtaaagtgtgtttcatgtaggcaacagatcactgggtcttgtttttctatccgttctgccactctgtgtcttttgattggagagtttagtccatttatgttcaatgttattactgacaagtaaggacttactcctgccactttattaattattttcttgttgctttgtgatcttctttctttccttcctgttctccttttagtgaaggtgattttctctggtggtatgttttaatttcttgctttttatttttttgtgtgtatctgctgtatgttttttgatttgaggttaacatgaggcttgcaaataatatcttataacctaatattttaaactgatgacaccttaacactgattgcataaacagacaaacaagcaaagagaaaactaataaaaactctacattttaactttgtccccccactttttaacttattgtactgtttatgtctgaaaagttgtagttattatttttgattggttcctcttttagtctttctactcaagatatgagtggtctacatatgacagtgttataatattctatatgtttctgtgtacttgctattaccattaagttctgtactttcaagtgatttcttattgctcattaatgtccttttctttcagattgaaaaactccctttagcatttagcagtatgtgaactgcatttttcaagtccagaatttctgcttgattcttttttttttttttgagatggagtcttgctctgtcgcccaggctggagtgcagtggcgcgatttccgctcactgcaagctctgcctcccgggttcacaccattcttctgcctcagcctcccgagtagctgggattacaggcgcccgccaccacgcctggctaattttttgtatttttagtagagatgggatttcaccatgttagccaggatagtctcgatctcctgaccttgtgatccgcctgccttggccttccgaagtgctgggattacaggcgtgagccactgtgcccagcctgcttgattcttttaaattatttcaatctctttgctaagtttatctgttaggattctgaattccttctctgtgttagcttgaatttcactgagttccctcaaaacagctattttgaattctctgtctgaaaggtcacatatctctgtctctccagaattggccactggtaccttaattagttcatttggtgaggtcatgttttcctgtatggtcttgatgcttgtgatgttcgtcagtgtctgggcattgaagttaggtatttattgtagtctttgcagtctgggcttgtttgtatctgttcttcttaggaagactttccaggtaataaaagggacttgggtattgtgatctaagtttttggtcactgcagccatatctgcattagggggcaccccaagcctactaatactatggctcttgcagactcgtaaaggtaccacttgggtggtcttggataagatctggaagaattctctggattaccaggcagaggctcttgttctcttcccttactttctcccctaaaagtggagtctctctctctgtgctgggccgcctggagctaggagaggggtgacacaggcacctctgtggccactatcactaggactatgctggctcagacctgaagccagcacagcactgggtctcacccaaggcctacagtctccactgcctggctactgcctacgtttgcttaaggcactagggctctacagtcagcaggtggtgaagccagtgagattatgtccttcccttcaaggcagcaagttccccctacccccatcctgggaaggtccttagatgccatctgggaggcagggcctgcagtcagaaaccttagtaatctccccagtgctctattctattacagcctggctgatacccaagccataaggcaaagtccttcctgctcttccctcccctttccacaagcagagaagtctctctccatggccaccactgccccagccctgtggcagtgctgccaggccactgccaacgttcattcagggcctaagggctcttgaagcaactgaacactgccaggcctgggactctccctttagggtagtgggctcccctctgacccagggcaggtccagaactgccaccccacagccaacacttagaatctgggaccccaagagccctcttggtgctctgccacactgtagctgagctggtacctaggctgatttttgctttttatgaaggtacttttttgtgtgtatagttcaatttggttttcctccagggaggacaattggtggaggtttctatttgggcatcttttttttttttttttgagacggagttttgctctttcacccaggctggagtgcagtggcgcgatctcggctcactgcaacctctgcctcctgggttcaagcgattctccagcctcagcctccccagtagctgggattacaggtgcctgccaccatgcttggctactttttttttcaattaaaaagtaaactttaatgtcgaaaatgcaaacttggggaaggcagaaagatcacacacaaggctgtcgcttcacacttggaaggttgcacggcggccaggagaggcactcctcacttcccagacagggcgggggccgggcagaggcgctcctcacttgccagacggggcggcggccacatgcctggctaatttttgtatttttagtagggacggggattctccgtgttggccaggctggtctcaaactcctgacttcaggtgatccacgcacctcggcctcccaaagtgctgggattacaggcatgagccaccgcgcccagccctatttggccatcttgctttgcctccaccttcatttgataacagaacacccccatgtaaccaccaccacaatcaagatataagacatttctgttattctccaaatttccttcaccctcctttatagtccatggcacccaccccatccctgggcaacacctatgtgcttcctttttttttttccccgcaggaggacgtcttcctatacctatgtgcattccatcactgctgcttttaatcatatagcgtgtagtcttatgagtctgactttttcacttagcataatgcttttgcaatttgtgattgagcgttttcatatgattctgttttttctgtctcttagcttggaagttatacactttttagtagtaactgttgggagatcgttctccaagagtctctctcatatttccatacatcctgctagcagagacattgactacctgtttttgtctgtttagtgttgctataaaggaatacctaagtctgagtattatacatagaaaagaggttttatttgtctcatggctcctcaggccatacaagaaacatggtgccagcatcttaccagtgtcacatggcaagaaaggaagtgaggaagagaaaataagttgttaactggttgttaaaaagtgccaggcacgggccaggcacagtggctcgtgcctgtaatcccagcactttgggtggccaaggcgagtggatcacctgaggtcgggagttttgagaccagcctgaccaacatggagaaaccctgtctctactaaaaaaaatacaaaaaaattagctgggcatggtggtgcatgcctgtaatcctagctactcgggaggctgaggcaggagaatttcttgaatccaggaggtggaggttgcagtgagccaagatcacctgggcgacaagagcgaaactctgtctcaaagaaaaaaaaagtgccaggctctttttaacaaccagttcttacaggaactaatagagtgaaaactcactcacccccaccccacagggagggcattcattcatgagggatccacccctatgacccaaacacctcccattagccccccacctccaacattggaatcaaaatttaacatgaggtttggggggcagaaatccaaattatagcactacctttgttccaggctaccttcaaaggatgtttatacagcaaacagccttggaaaatagagttagggtctccttgtagagcacagggtaagtttgcttacttttcagcataatcaagattgtgtcttcttctggagcaaaactttgacaacaacaagcggggcaaagtctgaaaccttttgcacatcttgacagaaccttagagattacgagatttatctctgccttactcaaggtccattagtatcttccagaacaataagttggtcttagaatcctttagctatgtattcccttccaggcttcgatgctgtgtgctgttgttttatttagtttttattttaaacccaacaagacgctataccatcaatacttatttagatccccccacatatttaacttgccatggtgcttcattctttcatgcctctttaagcatccatctaggatcgtgttcattccacatgaagagaaagcttttggcccagcacgatggctcacacctgtaatcccagcactttgggaagcctaggcgggaggatcgcttgagcccaggatttccagaccagcctgggctacgtggcaaaaccctgtctctactgaaaatacaaaaaattagccaggtgtggtggttcacgtccctgctactcgggaggctgaggtgggaggattacttaaacctgggaggttgaggctgcagtgagcgttgattgcaccactgcactccagcgtgggtgacaggagtgagaccatgtctccaaaaaaaaaaaagaaggaaagaaaaagcttttgtatttcctttcgtgtaggtctgctaatgacaaagtctctgggttttttgtttgactagagaaatgttttaattttaaccttattcttgaaggttttgtttttgttttcattttgttttgtgtgctaagtacagaattctcattggcatttatttatttagagacagagtcttgctctgtggcccaggctagagtacagtggcacgatctccgcctcccaggttcaagcgattctcctccctcaacctcctgagtagctggggctacaggcatgcaccactacacctgactaatttttgtatttttagtagagacggggtttcaccgtgttgcccaggctgatctcaaactcctgagctcaagtgatttgcctgccttggcctcccaaagtgctgggattataggcatgagccgccgtgcctggccagcatttattttcttttcagctctttaaggaagtcattccattatctctgggttccattgttgagaagccagctgtcattctaatggttgccctttgaagataactttttttcctctgctattttaaatatttcctccttgtattttattttcaacaggtgtaatgtggcacatatatcagcaattgttatgttacatacaatacatattgtgcaacatatgtatcattatcagttattgctgtgtaacaaactactccagaacacagtggcttataaaaggaatcatttatttagtccttaaatctgcaatttgagcagagctcagtgggaaagcctcagctttactttatatggcaccatataaggtaactcgcaactggcaagttggtgctggctgttggctggtagttcattcagggctcagggcccaggaccaagagtcgtcaccatggcttgcttcagcctccttgaggcatgatggctgggtcccaagagaagagaaatagaaacttccagtctcttaaggcattggtctggaagctgggacggcatcacttttgccatattctgttggtaacgcagttacatcgccagattaaagggtaaagagatacaaattcccactgctcagtgcaaggaatatcagtgattttagggggccctgttttaaaacccctacaaggtgctaagcgtggatttctggggctttcttgttttttgtttttttctatgtgtttttttttttttttttggtggtggggtcagggagggcttatagggtatgttaaatcagcagaataattttatttatttatttggagatggagtttcactcttttgcctaagctggagtgaagtagcgtgatcagagatggagtttcactcttttgcctaagctggagtgaagtagcgtgatctcggctcactgcaacctccgccccgctggttcaagcaattcccctgccttagcctcccaagtagctgggattataggcacccactgccacgcccggctaatttttatatttttagtagacatggggtttcgccatggctagtctggaattcctgacctcaggtgatccacccaccttggcctcccaaagtggtgggattacaggtatgagccactgtgcctgacctataatgttttttaaaaatcagttttggaaagtttgcagacattaacttttcaaatgtagcttccatttgattctttttctactctgcctctgatcctccacttatgtatgtatgctagatcttttattagatagtctgtgtctcttatgtactctactatattttgtattcttctgtctctccatgctttattctgtttactctttcctgattatattttttaattttgtaatttccatttgatgcttttttgatcattcaaaactcttcaccaaaattctaaatttccttttttaacctctcgaatgttatcacagttactttaaagtctattttggataacttaaatatttacagtcccctcacagatatgtttcttttgtatattgtttctgttggttttctttcatgtcttatctccacatatgcctggtgagttttgattatgtgttggtcattgtatttgcaagtatgctcgtagaaataatctggaatggccgggcgcagtggctcatgcctgtaatcccagcactttgggaggctgaggcaggtggatcacgagatcaggagatcaagaccatcctggctaacatggtgaaaccccatctctactaaaaatacaaaaaattagctgagcatggtggcacgttcctgtaatccctgctactcgggaggctgaggcaggagaatcacttgaaccaggaggcagaggttgcagtgagccgagatcacgccactgcactccagcctgggtgacagagcgagactccgtctcaaaaaaaaaaaaaaaaaaaaaaaaagaaataatctagagcctagtttgatgtttccttacaaagaatgaatttatttttgcttctcccattgcaactaggataacctcagtctagtttctggaactgaaatcacttgaggctgaactgtggtctctgtgagagcgtgtctgtgtatggctcacccttattcctaggctacgtagttctttaggaccctaacccaaagtaagagatgttcatcagggctctcctcttggcagacgcctgggctccagtccctgtgtcctgagccccatgaggctgttactggtgctgctcgtctgcccatcctctccagtaacagccacctgaacactgcaattcctgggtttccatcattccttccagcctggtgagtcatcagtgtcttttgaggtatccagtgcctgccagcagatgttttttaataatttgtccagcatttctggctgtcctcagtaggtggtctgtttcacattccctagtctgctgttaatggaaagtggaagttctgagagagaatcatcgttcccgtcagcattcaaatgcctgattacactttccccattcgctatcctttcctttatttgctcctcaccacagcaaaactcctcaaaaatatctatctttgcaatcttcagattctcacattgtgtccttaaacccactttaatcaggccttggttccctccattccactaaaagtaatgttgtcaaggtcgtgcatgcctccgtgatgctaattccagtgatgagttttcagttgtcattctctgacatatcggcaacacttgatgtggagtaccctgatgttgagaggctggtgagatgaaggaaaaacccagccaagggcaatgaggaatggcttccttccgcctcctccttccctatctttgttgtggtttttgttgtttctgtaacactgattacgttatagtttatttaatgtacttccttattctatgtttttactttagtcattttgttgatctcctccataataacataggctcgggccaagcacagtggctcacgcctgtaatcccagcactttgggagaccaagatgggtggatcacttgaggtgaggagttcgagaccagcctggccaacatggcgaaaccctgtgcctactaaaaatacaaaaattagctgggcgtggtagcaagcgcctgtaatcccagctactagggaggctgaagcaggagaattgcaggagaatcacttgaacccagggggcagaggttgcagtgagctgagatcgcgccactgcactccagcctgggtaacagagtgagactctgtctcaaaaaaaaaaaaaaaaaaaaggcttcaggagggcagagcattttatgcaattgttcattaattgacccctccatttggcacagatcacatgcccagtagttaactgttaatcaacgcactctctgtggaacaacaggctggtcccgttgagccaacactctctgggcactgccttcactagactctggctggctgctgcgcttgtagaggtatgcaagacaaaaccttttggtatgttaaaagccctggtcagaactttaagtaaccatcactgacatataatggttatggttttgaaagtgcttttatagtggtttttcatctgtcctcacagcacctctgggaggtaggtaggacaggtacagttagtctcatgtttcaaatggggctcagagagggaaaaggatttcccaagatcacacagcaccttagtagcaaaacttggactcaacctcaacacttaaaaatgaacaaagctggccgggcgcagtggctcatgcctgtaatcctagcactttgggaggcccaggcaggcaggtcacctgaggccaggagtttaagatcagcctggccaacatgacaaaactctgtctcttctaaaaatacaaaaaattagccgggcatggtggcgggtgcctgtaatcccagctactcaggaggctgaggcaggagaatcacttgaacctgggagatggaggctgcagtgagccgagatcgtgccattgtactccagcctgggcaacaagaatgaaactccatctcaaaaaaaaaaaaaagaaaagaaaagaaaaagaaaagtttccctttttttaaatatctcattttaatgactgcataatagtttattacatagttataccataatttatataatattttgttgctgtacatttaggttaaacaatacttacttagttcctactatgaagaggggccaagtactcgaggctggagctctcacatgtggcaatgaaattagaaagtggatatggcagggctgtggtaaaataaaatataaaaataataaatgatattaccaaagaaaaggaaagtttttcaaaataaaggaaaatctagacaagcatagtggctcacacctgtaatcccagtacttttggaggctgaggcaggaggaacacttgaggccaggagttcaagaccagcctgggcaacatagcaagaccccctgtcaacaaaaataaaaaaaaattaggccaggcacagtggctcacggtggctagtgcctgaaatcctagcactttgagaggctgaggggggtggattgcctgagctcaggagttcgagaccagcctgggcaacatggccaaaccccatctctactaaaaacacaaaaaattagccaggtgtggcagcacacgcctttaatcccagctactctggagactgaggtaggagaattgcttgaacccgggaggtgaaggtcgcagtgaggtgagattacaacactgcactccagcctgggtgacaaaatgagactctatctcaaaaaaaaaaaaaattagctgggcatggtggtgcatgcctgtaatcccagctactcaggaactaaggtaggaggatcccttcagcccaggaattcgaagatgcagtgagtcatgatcacaccaccgcaccccagcctgggttacagagcaagaccttgtctctaaaaaacaaagaaagtctaacctaaacgccattatgtcatttacatgtgtataggggtgtgtgtgtgtgtgtgtgtgtgtgtgtgtgtgtgtgtgtgtgtgtgtgtgtgtttgcttgggaggggagtcgggctggagctggccaggccgcagcctggggaccttctgattccagcagggatgtgggccgagggtcccgccttactcatttcgggtcttgctcctctgtcctggctctacagactcttccagctggagttggaggctgacgccctagtgaatttccatcagtattcttcccagctgctacccttctatgagagctcccctcaggtcctgcacactgaggtcctgcagcacctgaccgacctcatccgtaaccaccccagctggtcagtggcccacctggctgtggagctagggatccgcgagtgcttccatcacagccgtatcatcaggtgagcaagggaacaagaccatttggacaacgtgtgtgtacctgcttgtgtgggcagtgggggccgcaggcctcggttcccctccatagtttgacttaaaaaggagcagggcctggcatggtcgctcactaacgcagtcccagcactttgggaggctgaggagggaggatcacttgagactaggagttcaagaccagcctggcaaaatagcaagaccttgtctctacgaaaaaattaaaaaattagcatgtgtctatactcctagctacttgggatgctgaggcaggaggattgcttgagcccaggagttagagtttacagtgagctatgattgcaccactgcacttcagcctgggtgacagaatgagaccttgtctctaggaaaaaaaaaaaaaaaaaaaaaaaggtgctgcgttgctaccagattaaaatgtaagaaggacaatgtaatgtttccagagtccggagtgctcaccaggtgccaggtctgtgggagctgatttctacccaccatgaaattgaattttcccaacccccacaaggtatcgtcattttattttactttattttattttattttattttattttattttattttattttatgttacgttatgttattttattttgagacggagtcttattctgtcacccaggctggagtgcagtggcgcgatcttggctcactgcaccctctgcctcctgggttcaggtgattctcctgcctcagcctccggaatagctgggattacagtaatgtgccatcatgcccgggtaattttttttttttttttttttttttttgagacggagtctcgctctgtcgcccaggctggagtgcagtggcgcgatctcggctcactgcaagctccgcctcccgggttcacgccattctcctgcctcagcctcccgcgtagctgggactacaggcgcccgccaccacgcccggctaatttttttgtgttttttagtagagacggggtttcaccatgttggccaggttggtctcgaactcctaacctcaggtgatctgccctccttggcctcccaaagtgccgggattacaggcgtgagccaccatgcccggcccaggtatcatcattctagagagagctaacaggacttgtgcaggtcactcagccagagagggtgaaagaggggcttggatccttggtgtctgcccaggctgctcttctggaagctgaaggcctccttttgtgaatccattcagccagcagatggagcagctgttgcccctggtgagggcactgtccccacccttgcacagggcaccagttggccatcttgtgcagaggtagccacacctcctctgagtctctatcctagatagctcagttaagctcccaggcccagaactcaaaacctcactgctggccgggcgtggtggctcacacctgtaatcccagcactttgtgaggccgaggcgggtgtatcacttgaggtcaggagtttgagaccagcctggccaacgtggtgaaaccccgtctctactaaaaatacaaaaaattagcaaggcgtggtggcgcacgcctgtaatcccagctactcgggaggctgaggcaggagaattgcttgaacccagaggcggaggttgcagtgagccgagattgtgtcactgcattacagcctgggcaacaagagtgaaactccacctcaaaaaaacaaaacaaaacaaaaaccctcactgcactttagtttccaggcgtgcttttggacagcactgtctcatctcaccatcactctgtccatttcctggggcaggcacagcagcttgtgtcgataaggatattgacgcccagaaaggttaagtgaattgcctgaggctagtgagatatccgtgttctgtgaccctttcctgtgccaccaccctgcccacttcctgctggtgtggccctggggcccatctcttgtacgagtgagcaaactgaacagaaacctgatacaggtcacatcagatataattacattcaaatcagcccaactagctgagtggcgggaatgctcttgagctcaaataaaccagaaagtccgagtttccgagtgcacttccctgcatgtgcacttaggtccccctgccaccttgtaccacacctgctcacctctgctcaccctggccctctcctgcagctgtgccaattgcgcggagaacgaggagggctgcacacccctgcacctggcctgccgcaagggtgatggggagatcctggtggagctggtgcagtactgccacactcagatggatgtcaccgactacaagggagagaccgtcttccattatgctgtccagggtgacaattctcaggtgctgcaggtgagcagggggaggggcagggtgactggtactgatacctcccggtgtccacggttccctttgggcccctaggctcaggtgtcactctcaggcctctcactgtcccccattggtccttgaggcctgagctccttcatggagggtgcagacccctccctggctcttccctcccagcccttttccaggagccacgtcctcagtctctttgcttgataaacctggggacggcctccaacccagcaaaataaaccccaaaaaaggcccagctccagtcagttagttcagttccacttttcctgagcacaaactgtgagccagatgcctgcctggaggggctcgtgggccagcgggacctgggcttaaccttttgcaagcttgtccaatctgtggccctgcaggctgcatgcagcccaggacggctttgaatgtggcccaacacaaattcacaaactttcttaaaacattatgagatccatgcatggaccttttttttagatcagctgttgttagcgttcatgtattttatgtgtgacccaagacaattcttctgatgtggcccagggaggccaaaatattggacaaccctattttacaggaattcaaaccaagcaaaccaaactgtctccagttcctgtaggcatttgtgccagaggccctcctgttaacgtttttgattacctgggcaaaagatgtgattttttaattgtgggcaagcagatggggtgatactattaaatagctatttcatatattagattgaacagaaaaggcaggatgttggattatgttttattgtctagaattagaaaattcttctaaagatcatgttctctctgccttggcatcagaatgcaactacgttataccagaaaatgtggattcctttttttttttttttttttttttttttgagacagagtttccctatgtctcccaggctagagtgcagtggtgcgatctcggctcactgcaacctccacctcctgggttgaagtgatgctcgtgcctcagcttcctgagtagctgggattacaggcatgtgccaccatgcctgggtagtttccgtatttttagtagggatggggttttgccatgttgcccaggctggtctccaactcctggccttaagtgatccacctgcctcagcctcccaaaatgccgggattacaggtgtgagccactgtgcccggcccagaaaatgtggattcatatcttatgcttcttgctctcagggaagggaattctccacccactgttgaactccactttcaccgagaatcctctgcgcacccagcatggtgccgcgcagaccctgcctccatgcgggggtgtgcacacccgcttctcgatagtcatgcacgactgcagctgtcctttatccggtgctgattggtgcctgaccttgaactgagtgttgtatgtgttccagttaattcttagaatacactcatggggtggaggtcattattcccctttcctctccgaagaaactgaggttcagtgttgttaattaagaagcgtgcccagggagggccacaaagctgagagagtggggcttgaccttacattggcctcgatgccagccctttgctcttcctgctgtgtctctggcctgccttcaggtccagtgggactgctgtgaggtgaccctggtgtcacatgggtacactgtggttgtaatgaacctcatggggacagcactgagccaaaagtgagacagtaaaaccctcctagcactttcttttttttgagacagcatctagctctgtcgcccaggctggagtgcagtggtgtgattgtggctcactgcagcctcaacctcctggactcaggtgatcctcccacctcagcctcctgagcagctgggactacaggctcgtgccaccacatgggctaattttttttttttttgagacggagtcttgctctgtcgcccaggctggagtgcagtggcgcgatcttggctcactgcaagctctgcctcccgggttcatgccatcctcctgcctcagcctccagagtagctgggactacaggcgcccgccaccacacccggctaattttttttgtatttttagtagagacagggtttcaccgtgttcgccaggatggtcttggtctcctgaccttgtgatccgcctgcctcggcctcccaaagtgctgggattacaggcgtgagccaccacacccaggccacgccagctaatttttaaaatttttttggtaaagatggggtctccctatgttgccgaggctggtatcacactcttggtctcaagtgatcctctcacctcccagtgtgttggaattacaagcatgagccactgcgcctggcccctggctctctttttaatactgctgttctttcattgaaaacatagtacctgcatgtagaaaaaaatcagtcaggacagaatgaaaagcaagaatcattcccacctggacccccagtgcccatcctgagatacagctaccttttaagttccttgactcagaaatgtttcatgtgagccacagtcatgccaggtcgaccccttccctcccatccacactggcacttggctttcctggtgcttctctttacgttctttttttttagacagagtttttgctctattgcccaggctagagtgcaatgatgcaatctcagctcactgcaacctctgcctcctgggttcaagcgattctctttcctcaggttcctgagtagctgggattacaggtgcctgccaccatgcccggctaatttttgtatcgttagaagagacgacatttcaccatgttggccaggctggtctcaaactcttgacctcaggtgatccacccaccttggcctcccaaagtgctaggattacaggcatgagccactgcgcccggcctctttacgttcttatcagcatcctatggagtcaaacttcccttcctctttcatcagctccttggaaggaacgcagtggctggcctgaaccaggtgaataaccaagggctgaccccgctgcacctggcctgccagctggggaagcaggagatggtccgcgtgctgctgctgtgcaatgctcggtgcaacatcatgggccccaacggctaccccatccactcggccatgaagttctctcagaaggggtaagacctcctcccctccccatctgctggcctgctgggctccagctctcctgtcacctgtcccgtgcctgaggcaagcagtatccaccatagatcttagcatctccagcctcagagcagaggccccgggttcacaagcctcattaggccccgcctggcccaaagaaggtgctccatcattgtatcatgggtaggaatctcggttcacaagttcagctgtgcaaggaggagactttaaaatttttctggctgggcgcggtgtctcacgcctgtaatcccaacactttgggaggctgaggtgggcagatcacctgaggtcgggagttcgagaccagcctgaccaacatgaagaaaccccatctctactaaaaaatacaaaattagctgggcgtggtgacacatgcctgtaatcccagctacttggaaggctgaggcaggagaatcggttgaacccgggaggcggaggttgcagtgagccgagatcgcaccgttgcactccagcctgggcaataagagcgaaactgtctcaaaaaataaataaataaataaataaataaataaataaaaataaatttatttaatgtaccttaattcctaggagtgaatctccctctataaaactggagacaaccaatcttagccctctttggggtctcctctttccagctcccctccaggtggtgctccagttctggagtctgatgcaaccccaaggcccacctggcccctcctctaacccagcccagcctgatctgaacagccccccgatggcttcagtgctccttggtttcttgtgtgcccagctcaaagcctgggaaatgcttggtaaggtggccgagtgcccgtccacctagatgcctctttcctttctggctggtggcacgttgggaggcaggtacaggctcatgttttgggagcctgggaacccctggtgtcaggaaaattgtcttcaaaggggtaggggatgagataaaaagataaatgaatatctcaaatctcaaaatactatctaggccaggcgcggtggctcacacctgtaatcccagcagtttgggaggccaaggtgggtggatcacctgaagtcaggagttcgagaccagcctgaccaatatggtgaaaccctgtctctactaaaaatacaaaaattagccaggtgtggtggtgtgtgcctgtagtcccagctactcaggaggctgagacaggagaattgtttgaaactgggaggcagaggttgcagtgattcgagattgtgccacagcactccagccagggcgacagaacaagactccatctcaagaaaaaaaatactatctaacaggaacaacatctagaatgaatgaatgagccaatgagtccttcgatcctggcactgtgctaaagcaccagcctcaccgaaatgaataagccactccaggacaggagacaccccagccacccagaatctcatagcgcagtgccagacaagcagtgagaaggcatggacgggcagcactcaggcagggaggctggcacttgtgcctgtcctcaggttgttccttcctctgggagctgcatccaccttgctagccccatggggcattgctagcccttctaagggctggaccaagcctggacaaaccctcctttccttgaatctcccaagcacagccagaatgagctagagctttcagaaatacttgaccaaacagagaagataccaacacccccagccccgcagtcaggttccccatttgcaggttgtgacctgagtggacaccaggtgatgctcttctctacccagagggctggcacatggccccactcttgcttgtctccagccaccctgagctgtactgggcaggagctgtaattgaccagttttctctctcttcaaacaacctcagccctcaccggtccctctgtccccacacaggccatcctgggtgggtccagcgtcccatcacataagaggatctttgcacagaagacaaaggaagaggctcctaccttgagtggagcagggagatcccttatcgacttggcagccagcacagccctactccaagaatcccacggcctcagtgttactgacaagtggttccctcacagctcagactaggagctccctcgctgtttttctttttcttttcttttctttgttttgtttttgagacagagtttcactctgtcacccaggctggagtgcaatggcatgatcttggctcactgcaacctctgcctcccaggttcaactgattctcctgcctcagcctcccaaggagctgggattacaggtgtgcgccactatgcccagctaatttttgtatttttagtagagatggggtttcatcatgttgaccaggctagtcttgaactcctgacctcaggtgatctacttgcctcgccctcccaacatgctgggattacaggcgtgagccaccgcgcctggccacctctgctgtttttcaatgcagctgacctttcccacaaagctcggtttgtgcctgcggttctcagatggttaagcccctgctgaggaagggaaacagataatcccagacagtgagatggaggctgagactgaggatgcctgggggctgcactaggagctcagagacggcatcaggcagctggagttcagggaaggtttgggggcagcagagcccgagccaagccatggacactagccggagctggccactcgggtgaagacttggggggctccagagggcccagggaaagaagctgggcctgactccatgtgcctagtgctgagcaccaagcgctggcataagggctgtagggagctgggcagcataaatcctgggcctgtgctgggcacccctaataatagagaacagcagctgaacactaacgctgtcccagccaccggcttagccttcatgtgggctatttcactatagcccagagagctgatgtattttattccccctctaaagctgagggccaagtgtggtggctcatgcctctaatcccagcactttgggaggctgaggcaggaggatcgcttgagcctaggagtttgaggctacagtgagctatgatcatgccattgccctccagcctgggtgacaaagggaaatcctgtctcaaacaaacaaacaaaaaacagatgaggaaaccagggcttagagagattaagtaatttgctcaaagtcaggcagtcagtaagtgccagacctgggaattaaacccatgtgggctgtcctagtaattgcactaaaaaaaaaaaaaaaaaaaagctttattgagatatagttcctattccatacaatccacctattgaaagtatacaatgattctgatatattatgtttattttttccaactgtgatagattatatataacataaaatttgccattttaaccacttttgttttttgtttttgagacagagtttcgctctcgttgctcaggctggagtgcaatggtgtgatctcggcttaccgttacctccacctcccgggttcaagtgattctcctgcctcagcctcccgagtagtagctgggattacaggcatgcaccaccatgcccagttaattttgtattttttagtagagacagggtttctccatgttggtcaggctggtctcgaactcccgacctcaggtgatccacccaccttggcctcccaaagtgctgggattacaggcgtgagccaccacacccggcccattttaaccacttttaagtgtacaattcggtggttttaatcacatttacaatgttgtccaaccattacccctttctaaaacttttcttatcacctcaaacagaaactgtaaccattaataactcccgattctcccctccccacagcccccgataagtcccatatcctctctgtctctcagaacttgcctgttctagaacctcgtatcagtgaaatcatacagcgtttgtccttttgtgcctggcttatttcacttagcatgatgtcttcaaggctcatccatgttgcagcacgtatcagaatttcctttctttttaaggcagaatactattttgtttatccattcagtccttcactgatagacgcctgggttgtttccaccttttgtctgttgtgaagaatgctgctgtgtacatgggtctgcaaatgtccattcaagtccctgcattccgtcctttgatacttccgacctcaggtgatccgcctgcctcagcctcccaaagtgttgggattacaggcgtgagacaccgcgcccagccagaaaaattttaaagtcttctccttgcacagctgaacttgtgaaccgagattcctacccatgatacaatgatggagcactttctttgggccaggcggggcctaatgaggcttgtgaacccggggcctctgctctgaggctggagatgctaagatctctggtggacactgcttgcctcaggcaccgagtagaaagcaattgtgctctttcccactctgtcatactgcttcctatagcatgcaggtcactgtgtgactcactgacagtgtggtaaggaggtggagggtggctgtgtgccaggcacagaactgggctctgaaatgcctggtcttccttacaccccagccactcctctcagcactctctccatgttgctcagcttctggaggccaccagtgaggaagctggggcttgacttcaagcccatctgactctaaagccagtaccagggagggtgatcattgctggtggcagcatcaggaaggcttcctggaggagggggttagttgtgccttgaggggctcagtacagccttaaccatggtgagtgtgctggttgggtttgctgaactttgtttgcagtgatgctctctgtaagcagtagatgaagctccaagtcctggcttcatcccacgccacgcagaccctagcttctgctcaccaaccggggcccctctctcaccaggtgtgcggagatgatcatcagcatggacagcagccagatccacagcaaagacccccgttacggagccagccccctccactgggccaagaacgcagaggtgagtggatcctgaggtgggtgggtggggcagggggccgggccccgcaggtcctcagggccctcaggaagcaggttcccgagaggaccctgaggctagcacttgggggctgaccttgcagtgggtgtgcaggcagagaagtccatgaagagctgggatcctggcagggctctgctgctctctggctgggcggggggatccgccctgtgcctcagtttcctcatccatgaattctgctttggcgatgtgatgaagtcagcaaggcagtgtgtgacaaaactcggcacaaattgtaaagtgcttcccaaatagaaggtggcgtgatgatgattgtattattagtcaggattctctagagggccagaactaacaggagatatatatatagagagagaggggggtttatttttttattttattttttttgagacggagtctcgctctgtcgcccaggctggagtgcagtggcacaatcttggctcactgcaagctctgcctcccaggttcatgccattctcctgcctcagcctcctgagtagctgggactacaggcgcccgccaccacacccggctaatttttttgtatttttagtagagacgaggtttcaccgtgttagccaggatggtctcgatctcctgacctcgtgatctgcctgccttggcctcccaaagtgctgggattataggcgtgagccaccgtgcctggcctaaagggggatttattaaggagcattaactcacacgatcacaaggtcccacaataggccatcgcaagctgaggagcaaggaagccagtccaagtcccagagctgaaggacttggagtctgatgtttgagggcaggaagcatccagcacgggagaaagatgtaggctgggaggctaagccagtctagccttttcacatttttttctgcctgctttatattctggccgtgctggcagctgattagatggtgcccacccagattaagggtaggtctgccttcccctactgactcaaatgttaatctccgttagcagcaccctctcagacacacccagggtcaatactttacatccttcaatccaatcaagttgacactcattattaaccatcaagatgatgatgatgatgatggatgatgatggtggtggtggtggtgctgggcctagctgcacacacagggagcctggctgggcatctcctctgagttcttcccctaagctaagctctgtcctcctgggaggatggaggcctctggtctcatcaccaggaagcacagcttgacagagaatgggatgccccagagttcatggcctacttctcaatgtgatgggccaggagggagggcactgccagcctcagggtacctctgcattccaggagccggacaccgagtcaggcccttccgtgtaggtttggtcactcattgtcatcacatgctgtgaggtggggacttgcattcccatcttcacagaagccctgaagtgcacatggctacagtgacccatccaagcgcaggcagctgggatgagtgaagctgggctttgggctcaggtctgtgactccaaagccaggctcccctccctgttcccaaggctctgccagggatgtgcattgccaaggcccagtgagaggtgatacctttgcagggttccagggagggatgcagggagcggggtgcttcaggacaggccccagaggagcctttgcaaggagagtgggttctgttggcactaggaaaggaccagaagcctcttaaaacagtcagcacatctttggctttttgtccctagtcttgggatgctgatgggatgggaggcagtctaggcccccctagaactggggcctgcccctggaatcctcttgctagcgctttccaacatcccagtacctgtaggcctctcagagcagaagtggcagtgcccacgtgtcccggggtgcggcagctccccgagtgcctgtgctaactcagcctgaccgtctcccgcagatggcccgcatgctgctgaaacggggctgcaacgtgaacagcaccagctccgcggggaacacggccctgcacgtggcggtgatgcgcaaccgcttcgactgtgccatagtgctgctgacccacggggccaacgcggatgcccgcggagagcacggcaacaccccgctgcacctggccatgtcggtgagcccaggaccgcgtgtcctgccctgtggggccccggtgggaatgcaggagggctgtccggactggagccctcctccccactgtctccctcctatcgtcagctgctccaaatcatcttcccacccaaagctcagttcagaccctgactcctccctcaggaagccttccaagtccccctctcagcccaaaataacaccacctcctgtgtgctgtggtaccttttccacctgtgcccccatttggcacttgcatggcacgagagggaaaaatgacagctctggccatagactggccctgagcaagccatgtcacctgtcagcctcgatttcctcatctggaaaatggtggtgtcaatacttatctggaagagttgtggaaaagttatggtggacacttggtcaccctctacagaatgtctaagtgacacacgcagtacctggcccgagtgagcatcctgcttcccttcactggtccgcgtgttgctctcatcttccctgggaggctgtaagatcctggcaggcaaagcctgagtgtgcagcccagcagcctgtggcaggtgccaggcatattcgttggtttattatagaacacagttcctgccctcaaagcccttactgtctggttacacatctagagtatgaacatattaaacctagcagaggaggacgttactgtgttacagacatatgtgtgtgcatgtattcttttttttcgagatggagtctcgcactgtcgcccaggctggagtgcagtggcgcgatctcggctcaccacaacctccgcctcccaggttcaagcgattctcctgcctcagcctcccaagtagctgggactgcaggcacgtgccaccatgcccagctaatttttgtatttttagtagagacggggtttcaccacgttggccaggctggtctcgaactcctgtgttggccaggctggtctcaaactcctgacctcatgatccacccgccttggcaccccaaagtgctgggattacaggcgtgagccaccgcgccccaccgtgtgcacgttttctatagcaataccgtatgtacagaagtctgtttactgagtctcagtgacagaacatgagagacccccgggactctaaaagctgattcaggacacattcagagacatcctgttttataccaaaggtcaaaacttggaagagatgttgttgcccaaaaggctgaaactataaatagtttcatttttgaaactgtggacatttttagcactgggtgggcccttggaatgatctaactcagcagttctcaagttttttggcctatttgatccctttatactctgaaaaattattgaggatcacaaagattttttaatcatctggattttctttatctatatttaccattttagaaatttaaagtgtgaaaatttcaaaatattaattcatttaaaaataacaataataaatatatatgcctactatgtacccacaaaaattaaaattaaaaattttttaaaaaacttaaaaaataactggccagctgcagtggctcgtgtacaccagcactttgggaggccaagatggtcagatcacctgaggccaggagttcgagaccagcctggccaacatggcgaaagcccatctctactaaaaatgcaaaattagctgggtgtgagacctctgaaagggtatcacgtgttcacaggggtccccaggtcttactttaagaactgctgatagactttggtcatcttcatcccatcttcacagtttttggcatattcatcaaccacctttacaattatgtacttaatcacctcttcaaattggcttacttttatttatttattttgagacagagtttcgcttttgttgcccaggctggagtgcaatggcacgatcttggctcaccgcaacctctgcctcctgggttcaagcgattctcctgcctcagcttcccgagtagctgggattacgttcatgcgccaccacacctggctaattttgtatttttagtagagacggggtttctccatgttggtcaggctggtcttgaactcctgacctcaggtgttccacctgcctcagcctcccaaactgctgggattacaagcgtgagccaccgtgcccggcctggcttacttttaaactgacttaaatttattttgagagaaatgttgcatcactaccataaatggccatccatccatccagtgccaaccataaaaggtaaccaatgcagggcgcggtggctcacgcctgtaatcccagcattttgggaggccgaggtgggcgaatcacgaggtcaggagttcaagaccagcctggccaacatggtgaaaccctgtctctactaaaaatacaaaaaattagctgggcgtagtggtgggcacctgtaataccagctactctggaggctgaggcaggagaattgcttgaactcggtaggtagaggttgcagtgagctgagatcacgccactgcactccagcctgggtgacagagtgagactccgtctcaaaaaaaacaaaacaaaacagtaacaacaacaaaaaatcacagttaatgctgaaaacacacacatatctgtagccatagaagtcctaatagaatgtgaagaactgtttggaaaaccccattctagacccacagcttcattctctaggcagggaaatcgggtcccaagaagaggaaggtgacaaggccagagcccacagttccaggtggccagtgtgtcctctgaaaccatgccatgctctgcgcccctgcccggcctccaggtgtggaaatgtgtgacgttcttcgtggggacactcccccgaaggctgccattaggggcacgtgtgttcggttacccctcagggatgacaccctggactgggtgggcaagatggccttccctgccctcacccaccctctccttgctactcctgaaagccatcagcagctgacctactgtgtccccatggctcctgggtcggggtcacagatgcactgcatctttggaggcggagctggcagagcaggggcgagtcacttctagtttctgcctgggttcttacaccctcccctgtgggtgcttttaagcctgtttgtcaggtccccagccatcaaatggcagactttggactaccagattgacttgggtgggggtgaggagggttccagtgtctccccgtgctgaggagaggcccgctgggtgagttgacaggttggggctggcagccaggggcccctttgttcttcacttccccggcagttgcacgtcttatcctctctccatctccaacagaaagacaacgtggagatgatcaaggccctcatcgtgttcggagcagaagtggacaccccgaatgactttggggagactcctacattcctagcctccaaaatcggcagacgtatgtgctctgcactctggggctggagtggggtgagggttgggtggatacagggaccgaggaggagggaagtcccaggcatcaggtgccagcatcctgtgctgacccgccctgctcagagctgccaggagcacctcgtactcagagagggggcttccttacccaagcacaagggccctgagcagtagatgcaggcccaccacggggcttgctataccagcatcctctcccgtgcagcgccccccacctcagggagctaagattcccagcaggggtggggacaggagagccagcagcagccttctttccccaccgttggggaattcactgatggaaccactggctagaatgaccaagggtgcatgcactacactgcacgagctctgggcatgcctgtgtgggcagagtgcatggccatgtgctgcacgctcgcacagtgagccttagcttcagagctggacagagcagatcctcctcaccagaggcctggagcccgctctggagggtttcagcagctgtgggggtcactgtgggcaggtacctgatggcagcagtgtgtgtgtgccagtgcacacgtgtgtgtctgcatgcaccgcatctatgacctccttttcagcaatcccatccatcaaatggagtaggtgccccctggctggctcattagtccctttggaaccctgaactatcacttagcatttttgagaatcactgaatgtggccatgggattcctgctttcttggctggagtagaaggaaagaaggggttcccacaggcatcgggcagggtgacactgacctcctcctcccatatcctccttccctggccttaggaagctgcttgggatgtaccagcctgggggcagcactccctgtcagggtgggctgaggcctctggagcagcccacgtgcccagggcctgggagctgggacaggggacggagtgtggaaaggaggggcctctcctttgcatgttgacatcatttctgatcctgtgccatctccccttccccaaaccatgacaagttgtcaccaggaaggcgatcttgactctgctgagaaccgtgggggccgaatactgcttcccacccatccacggggtccccgcggagcagggctctgcagcgccacatcatcccttctccctggaaagagctcagcccccaccgatcagcctaaacaacctaggtaggcctcgcctcccgactccctcttctccagctggttcccaggcccctggatcacagcaggccccaccaaagcaacaggatccctaggacggaagtcactaaaggaagccggggaggatggggccggagttgtcagcctctaggcagccagcaacccacagatcccagaggcctagggtgtccctggctgatgtcccatgctccgttgcccctgagaggatgtgtcctgcacacagtctcaggcctgggcatttccagtggcacccatgaggtggctgctgttactgccctcctgtccccagggcgttcagggtgggcagtgaggagtgctgtcgggggactgggggcccgggccctctggcttcacctgtccctctggcttcacctctatcacactgtttgaatctcggttgggcctgagacctgtgtgcccccttcctggccccgtggtgactttcagacgttgaatgtggccaggcagccagcatctgccccggtgcattccttggtgcccagggagacatccccagactagacaggacccttctctggactttctgtgggctggcccactcagggacctccattgtttgggagcggggtcccctgaacagagggcagccaggagccagtccttggtgagccagacttcactgtggaggcggcagcaccttcagccagggtagcccgaccaagcctggaactctggagaggcaccgtgactgtggcttctagtcctggctccacctctctctcccctcccaggaactccccctccacctcccatctttatctctcaattttgcaggcagtcacccaagccaggccggatggtgggcctggggtgcggcgtcagatgggtaacgccctgggcctggagaggccaccgagcctagccatgcggcattagctctagctctcactccctaatccgtccttcttagctgcgcacacaccacacgccccctcccctgcaccctgtccccggcctctctcagccactcttctgcttcccttgttcactgtggagccgtgtgccctggggagggggagacaccgcttcgcagccctcggttctgctttgctgcttctagactctgcacagtggtggggggctgtcagagttggggtcacgcgggctgctgcaccaggcacctggggactgggctgcttgtcaggaggggcagctagtcagttgggtggacgtcaggcaggccttggacacaaaggaagacatggacagagtggatggtgggcctgatcccggaggccactgggatttccagacctgggatcaggacgagggatgtctcctttcatccatggacttaaaccccgaggaacgtcctgactcagccttttgactaaatgaccttgggtgaattatggaccctcttagagcctcacctgtcaatagggaataagaattcttaggccccaggtggttattgcagcatcggctccgatgcaagaagaagcactttgtctgaagaggacacgcaagggtattcatgccttggggtttcaagaggaagagattgaggggaacctgggagctggctgggcagggtggggagcccttcccagagcagtgggcccccctttccactccagcccatttctctcctgtggcctgtggctcagctttctcctgggacagagtccttcctgtggggaagggacagatgacagggggagtggggggatgagggcgtggccgtgggcgaggcacagcccaggtttgatctagggacctctggggtagcagggcttggggacccacctgaccacagcatgccctgctctgtgcctcacagaactacaggatctcatgcacatctcacgggcccggaagccagcgttcatcctgggctccatgagggacgagaagcggacgtaagtggatcgagatcgggggcagagcggggaacgtgtgcgctttcctgcccctcacccaccccctgttgtgggctcagggctttactctctgcaccctcacagccggcgaagtggctctgctcctagtcttatagttctcagcagagacagaacatggagagcctgtgtcgctcgttcattaatgctgggcggtgcaggctctggagaccagcccagggtgccaggcttcttggacttggtggggctggcgcagtgttctggcctccctccctgatctccttatggctagaagagggggagatgcctgggtcccccctggggagatctcagcagctgcttcccactgctcctactggcttccttaaccacctcccactgcagaatagtggcgtgggctgccttccccagcacctgctgtatacctagtcccattgtaagaggcgggcctgggtgacaggatgcaaagagaagacgcccaggccttgcccttcaggcataatcccgggtgcttgaactcagtgccagctggcacggcaaggtaccaggacaaatgcgtttccagccactgtgctgtcgccacctcccttgattgctgcagttgattcatttattctttattagtctctcatgttcctaatagccttcccagggaggaatttgtaaccttgttttacagatgcagaacctgagcccctgagaggtgaagtgacttgctcaaggtcacacggagtgagtgtcagggtggcaactcacagccgggtcttccgaacccacgtcctttgtgctaccgcaggctctctctgggttctctgtggactctatacctagtgccagccctctgcagggaaagctctcttctcagaatcagaggcagctccactcccagggccaggcagtgatcgtgcagctctgtgggtcctctcacttcgcactcacttccatgctaccctgttgtgtgccctggaggttcccctgccccatcagcattccctcccctgtgccccctgcatgctcttgcacgcgggcacacgcacacacacacgcacacatgcacgcacacacacccacatgcacatgcctgcgggttgcccacatgcatgtgttgcccacatgcaaacacatggacacgcacacacatgcacacatgcaaacacacgtgcatgcacacacatacacatgcgcacacatacacatgcatgcatgcacatggacacccacacacatgcacacacatgtacacacatgcatgtacatacacacacctgtgcaggggctgaggtgaggcagctgcacctgagggggggacccacatttcccaagggaggaaaagcagattccccagattctggagcctcagaaccctgcctggagcggggctgaggcaagagtcaggagacccctcggtagctccccacttgggccttccaagctacagagccctgcgccctctgggttgatctctgtcgccagccccgcatcttcgggagtttgctttggcctccagcaacagtgtagtctctcccctgccacctctaggcttgctgtggggctgggtacctggtccaggaaaagacccctagaggtgggacccgggcctcctccatttatcagccctcttgggcacctcctgcatccccttgacacacagcgctgcccagagcagaggcggcttctgccctggtggagcttccaggtcagcgcaggagagagtaaaagaaagattgcgaatggaatggaagcagcctccaccaggaagcaggtggagcagcaggcgggctgtgagggagggtctcgatggcatcagggcaggcttctctcagcttcatcaagctgagatgggaagatgagaagatcagaggaaggttccagactgaaccaaccacaaaggcattcccccagggcatggccaatgaggacaggcaggatgtggggagacgtgtcagggcgcgctggagagcatgtgactcaggaggcggcagacctgggtccaggtccagtccgcatccatatgacttggttcccgtcacctaacctctgagctacactccctccgtcactcaaaaatatgcacagagagtaggcgcagtggctcctgcctgtagtcccagctactcgggaggatcacttgagctcagaaggttgaggctgccgtgaactgtgattgcaccaccacacaccagcctgggtgacagagtgagaccctgtctctataaataaataaataaataaataaggctgggcacggtggctcgtgcctgtaatcccagcactttgggaggccgagacaggcggatcacatgaggtcgggagttcaagaccagcctggccaacatggagaaaccccgtctctattaaaaatacaaaattagctgggtgtggtggcgggcacctgtgatcccagctactcgggaggttgaggcaggagaatcgtttgaacccgggaggcagaggttgcggtgagccgagatcgcgttattgcactccagcctgggcaacaagagtgaaactccgtctctaaataaataagcacagggatgtcagggagggtctgcctcagaggcgtttgggacaatgacatgagctaatgctggtagcacccctcccatagcccctggcatgaacctctcccttcctccctgccccctcctcccctgcttcttccaccttgtgtggaggccctgatactctgtcactgcccattcctggcctggctgtagggtccccgcccctccttccccagccttatttaattccaacagactttatcaggcacctgctttggatcaggcctgatactgaccaaaatcaggtgtcccaagttggggagactggccgagatcctgctgggatggcgcctggtcagtgatgctatcccccgaccttcctttccctttctctgttgcactctccagcccctgaaatactagacatttgttcctttactgccctcacccccaccctcgctgtcctgcataggacagaagttcctcgggtccgtctgggtctgtctgccaggacacagctgcaggggacaagggctatgagggtggatgtaaagtactgggctgtggcaggaccctcctctctcccactgctgttcccactgcagccacgaccacctgctgtgcctggatggaggaggagtgaaaggcctcatcatcatccagctcctcatcgccatcgagaaggcctcgggtgtggccaccaaggacctgtttgactgggtggcgggcaccagcactggaggcatcctggccctggccattctgcacagtgagggcggcccctggggatggggccaggcggggctgagacctgtgtcctcaaggggccgagtttgtcttcagggctttgcaaaaagagagtggaggagtagaggagggctataagcactttgaggaggcaggggcggggctgcaggtgctgaggtcccaggctggaaggagaagggctgggcccatgggcttgggtttggggatcccccgccctctggccacagagggtagagctggctgtgtgaaattttggcataggaagcgtttcctatcgactgccttaacccctcctcccctcacccctgcaaagcaggcaccaggggccacacagcctgctgcacataaggaatcccattcccagggtgcacgcagcaggcagtctcaggaatgaggagccactgagcctcaggatgccagagccctcgcctgcacacttcattttactgggaaattttactgggaaattaagttcccaggtggggagggatgacgtgaagtcacatagctcatccatggggtcgctgggctggagcacagtcccctagactcccagcctggcacctcctaggccacagggcactgtgtagtctcctttcactgccgctttgcgaaggcgcctggcttgctggacagatagccgggtggtcagtgttgtgacggctcctctgtggagctgtctgagcttctaggtgctgacaggtggggaggggcactgccagatcagggtcctcagctccccccaaccccctggacattgtcctgggactcaacatgtctgactggtgcccctgcccctgtgctggtcagattccattttctccagagcgcccccacatctggatcctggtcatgcaaagtcttggaggtgcccggggaggactccccaccctagggtgggtatcagggcctgtgggccaggcctgtgttggatgctggggatgcagagctgagccaggcataccccagcctcaggagcagggggctcagccagtccaggaggtgctggggacagagtcccatgggcggaggaggagagtcatctgtcaagttgccgggacgttagtgtccacggcggtttattgactggtatttcatttccttttgatgattctcaccatagccctgcggggtgagcagatggggaaactgagaaccagagaggatcagccagtgaattgggcagtcaggactgggtctccagcagtgtgcccagctctctaccccagcctcagggtcccagcatcccctctctggtcttccacagggtccaagggcgggcacgaggtctgagcaggcagactgggcagagtcctagcttcttctccaaaagggccacgtccttcttcagggaccatttcttccccatccggggtcttgagactcccaggggccatggaggggatttgagaggtctcctggctgatcctccggtgtgggcagatggcctcctttcagctaccctctgcttgtacatccctggccctggggaactcactgcctcacgggggaagtggggcagcttctccttcctggaggtgcagccggccccttggccctgtctgttctgaaggctcaaaggacagggctattccttgttttctgtgacaaacaacgtgggtctagcttttataagcttttactcttgaggggctcttctttaaggaaaataatacaaaatcatgaatacaagatgaagtgcagagccgtggggcttcagtggtttttgagtctctccgttgcccaggctggagtgcagtggtgcatcttggctcactgcaacctccgctcccgggttcaagcgattctcctgcctctcagcctcccgagtagctgggactacaggcgcccgccaccacacctggcgaatttttgtatttttaatagacggggtttcaccatgttgggcaggctggtctcaaactcctgacctcaagtgatccacctgcctcagcctcccaaagtgctgggattacaggcgcgagccaccatgtccagccggaaggaggtttctctctgtctgtctgggaggttgcaaaggaagggcccagaatttgggtttgcttaggcctcggtaaacccgcttcctcctgccacctcctgcgttcaggcgctctgcaggctgttctacgggagccctgcgtgtggccgctgcatctccccgcctctgacccctttgttcctaggtaagtccatggcctacatgcgcggcatgtactttcgcatgaaggatgaggtgttccggggctccaggccctacgagtcggggcccctggaggagttcctgaagcgggagtttggggagcacaccaagatgacggacgtcaggaaacccaagtaagccctggcgcactggggccgtggccgcagctgtgcccactgtggctgttccctggggacagagggctccctgtcctgctgagggagggggaagagcgccccacgcttgaggggagcagagggaacccccttcccagggaggcagagggctggggtgtggctctcacttgggcatgcagacacctgctgagcgcaggaggggcgtggcctggtgggcctggctctgccctgcctggctctgccctgcccggctctgccctgccggctctgccctgcctggctctgccctgcccggccaggggtctggggcttgcctggagagagcctgggccacccttctctgagaccacctgggcagaggctgggtttttgctgcccaggcaaaaggaacccactggcctttcaaatgacacggctaaacattttctcacatttcagacagcactcgctcccaggatcggactactaggttataatcagagggcttcagtcttacctttaatttaaggcctacaagacttgaactaatttaagtcagactgaaggagaaagtcacatttccaggaaacatttgtttgggaagcccaaatcctaggactaagcaatgcatcccgttcggggctggatgaatggtgtgttccaagaggagtgttttgagcatttctgagtgattttttcatattttgaaagtgagtgtcccccagtcttaggggcccggcatcccctctgcggtcttccctagggtccaaggccagggaccttcaatcttttttcccactctgtggcttgtctttctgctctgtggtgtttctaggtttttgttttttgttttttgttttggttttggttttggtggcccatgttcttaatgaggtagataatatttataaatatttttcttcttgtagtttgtgattttttcctttctttctttcttttttttgaaacagggtcttgctgtggggcccatgctggagtatattgctgtgaacacggcttactgcagcctcgacctcctgggttcaagcagtcctcccatctcagccgcctgagtgcctgggactactagcatgtgccaacacatgtattttttgtagagatggggtttcaccatgttgtccaggctagtcttgaactcctgagctgaggcgatcctcccgccttggtttcccattacaggcatcagccaccatgcccagcctagtttgtgctttttatttctcgttcataaacccctttgctgcccccaagcagcacacgattctcctgtgtcgagctggaaagctctctagatctgccttttacattgaggtcttttatcaacctggaattgatttttgtatgagggtgaaatccaagatccaatttaatgttttccacgtgattggccaatttttcccagccccatctgtgaagtctgtccttccctccgcttcctcagcagtgggtcaagcatccctctgctcttggatctgctccaggctgtgttttgttccactggttggaaagctgtctctgtgcccggaccacagagcataaaaaactaccgctgtgtggtgagtcctggtgtctgggtggcagatcctccaccttggccttcttcaaaaacatcatggctattcttgggggcagtagagagaagtggatacaagcatagaccctgaagtttctacctcttctcaaaaataggaatatgccaggcatggtggctcaagcctgtaatcccagctctttgggaggctgaggcaggaggatcacttgaggccaggaggtcgagaccagcctgggcaacatagtgagaccctcatctctacaaaaaatttaaaactaacaattagctgggcatggtggcactatggctgtagtcccagctaattgagaggctgaggtgggaggatcacttgagccccggaggctgaggctacagtgggctgtgatcccatcactgcactccagcctgggcaatagagtgagaccctgtcttaagacaaaaaaaaaaaaacaaaaacaaacaaactcacaaactataaaaagaaaaaatatttataaattctactccattaagaacatgggtccatccaaataaataaataaaacaaaaacaccataaagggagtaaaaagacaagccacagagtgggagaaaagatttcgaatccatacatccatcaaaggactcattttcaaaatatgaaaagatcattcagaaatgctcaaaatagtaaccaccattttactttctcttcctatgagtttaactgctccaggtactgttaagtaaaatttttaggggataattgatttggaccaggattctgtaccaggcccaacagaagaaacgaatatggagtcattcatgccaagtgaacctagttagcttaggcgtatacccatgtaacaaatagctgagttctggttagctacaacagctaagctttaatcaatcatagatggccacctgattcaaacaaggcaaaccaattaagctccacacctcactttggttttcagcccatcaacactgcctgaccacgttgcaggccagagttctttgaacctattctggttttgtggcctgcctgactctcagttcatcaataaaagccaattaacatctttaaatttgttgcaattttatctttgaccgtaccttatgtaagtggaatcatacagtatttgtctttttgtgactggcttatttctttctttttttttttttttgagatggagtcttgctctatcacccaggctggagtgcagtggcgcgatctcggctcactgcaatttctgcttcccaggttcaagtgattctcctgcctcagcctccggagtagctgggattataggcgtgcaccaccatgcccggctaattttttgtattttagtagagacagggtttcaccatgttggccaggccagtctcaaactcctaacctcgtgatccacccacctcggcctcccaaagtgctgggattacaggggtgagccaccgtgcccggccatgactggcttatttcacttggcatccatgttgtagcgtgtgtcagaatttccttcctttttaaggctgaaaaactccattgtctgttggatacacgttttgcttctccattcatccattgatggatattttagttgtaaattgactgctgtcaatgtcggatgtgcaaatacctgtttgaggcctactctctcttactggtgccttctctagagagaattctgatgggttcagtttgatcatattttgtttaagatttttggccaggcgcagtggctcacgcttgtaatcccagcactttgggaggccgaggtgggcggatcatgaggtcaggagatcaagaccacagtgaaaccccatctctactaaaaatacaaaaaattagccgggcgtggtggcgggcgcctgtagtcccagctactcagagaggctgaggcaggagaatggcgtgaacccgggaggcagatcttgcagtgagccgagattgcgccactgtactacagcctgggcaacagagtgagactccgtctcaaaaaaaagatttttgtgtccacgctcgtgggcgaacttgacccgttttttcctattttgggttttgaggaaatatttcctctttttatttttcttggaagagttagtataatagtttattttgaatttatggtagaacttgatagtaaattcttctaggcctggagtttgcttggtgggaggatttttgatgatggaattaatttctatagtggttgtgagactgaccactcggggtttctaaatacctttttgagttagttttggttaagtgaggtttttctaggaatgtgtccatttcatctaaatctttaagcttattggcttagagttgttcaaaatattctgtttttttttttttttttttttttttgagacggagtttcactcttatcgcccaggctggagtgcaatgacgtgatctcggctcactgcaacctctgcctcctgggttcaagcaattctcttgcttcagcctcccaagtagctgggattacaggcatgcgcaaccacacctaatttttgtattattagtagagacggggtttccccatgttggccaggctggtctcgaactcctgacctcaggtgatccacctgcctcggcctcccaaagtgctgggattacagacatgagccaccatgcccagccgattctcctttttctaacgtctgcagtgtgtgttggtgcggcccccttttctttcctgattttgataacagataacagccatgttttatcagtcttgcaacaggtttttccattggattagcctttcaaaaaaaccaacttttgctgaattgtgcccccaaggttggaccaatctgacactcctccagcactgccggagagagcctgttttgcggggatggtgcggggagaagcccacctatcccgaacagaggttggagtgggcactctgctacccaaggccctggggtgtgaattgtggggaaagggaaaggtggatgggcgggtggctcagccgtcctcctgcctcatttctctccagggtgatgctgacagggacactgtctgaccggcagccggctgaactccacctcttccggaactacgatgctccagaaactgtccgggagcctcgtttcaaccagaacgttaacctcaggcctccagctcagccctcaggtttaaaccatgtttgatgcatccatgggaagcgactggcccgagaggctgtggggtggtgggtgggagtcgtgcacttgccatcaggcaccctcaccgtgccaccagcccacccgctgcactggtctttattggctgaggacagggattgcgggggagctgtcaggcccctggcaggttagaaaagtccctggaaagtcctcagctgtacctgccttccaccaggacgaactagccagagagtgtggcttcgtgggtcctgcttctgaagagttcccagcctcccctcttcccgcacccccagcccccaacacgcacaccctgagatctggagtgcatgggttttatgccagtcccttgtgccactgggccgccctccttccccgcccctagaccagctggtgtggcgggcggcccgaagcagcggggcagctcctacttacttccgacccaatgggcgcttcctggacggtgggctgctggccaacaaccccacgctggatgccatgaccgagatccatgagtacaatcaggacctgatccgcaaggtgagtgccgtaggccagagggcctggacccactgctccctggagccaatcctgtgtcagcaaaccatgctagggaccgacccccaggacagcaggtggcttttacacacgcactcattcatatgtgcacacagggcaaattgatctcactggaacctgttccatgggtgggatctgcctgaagcactgtgctaagggggatctgaggaccactgtgctctaagtgtgcatgagtggggagggcggcatgcataccatgaacgtgccactcgagccagcctggggacaggacacatgcttgcccttgagctcacctctgtggatagacagtcccacaggaatgcctgtccccacgggttgccggtgctgtggtggaggaccgtgaggcctctgctaaaaggcctgggggctcggaaagggctccatggaacaggggacccatcctgaggcccttggggacagagcagtgcagaatcagtgatctggaggaagagcagcagccctctctctgcagaggtacagcagaggctggcaggacccagcatgctaggggaggccctgtggcgtggcgggcggtgggtgaccggggtgggcgagcgcggtggctgagctcagaccctggagccagggcgcctctgggggtccccgttctgcctgcactcactgcagctacctaatggggccatcatagcgcctgcctggggaggctgcgaggccttggcatgctgttgtctgtgaaatgttcacagcactgccgggagcctgagctgcatccttgctgctgtggtttcccgaagccccagggcgtcctgggcagcgcagcagaggctctgggcagacagagaagcgccctctaggggccagatcgggcagggcgggcttcctgcaggcggcagagaccgtcagactgtcagacactagccagtctaactctcctattgcgtgcggatggggagcctgggacccagagtgggaggcatcacccaagatcatccagcaaatcggcagcagagcttgttcggaagcaaataagagaggcagcggccgggcgcagcggctcacgcctgtaatcccagcactttgggaggccgaggcaagtggatcatgaggtcaggagatcgagaccatcctggctaacacggtgaaaccctgtctctactaaaaatacaaaaaaattagccaggcgggcatagtggcaggagcctgtagtcccagctactcgggatgctgaggcaggagaatggtgtgaacccaggaggcggagcttgcagtgagccgagatcgcgccactgcactccagactgggagacagagcgagactccgtctcaaaaaaaaaaaaaaaaaggcagcacccagggctcaggttcaagccttagcccctacttccctaccacgtggcccctgcagctgcttcccggcctgagcttcgctgagagccctcatttgcaaactgggtgatcagtgccctctccacagactggctggagattaaatgaagtaatgatgcaaatacctggcaaatcaccaacaccaaggaacaccgtctgcctttcctcccctggccacgacttgacttgggccagcatcagatggggtgggcgggatccttcttgcagctggtgtatgtgtggtcctgttggtacacagatgctgtcctgagcagatggcatgtgatgcccgcaccagccgttctggggtcacgtgcaagaggctggctggaaatcatgccaggcatgctcttgccaccagagacctcttgccctgttctcatgtgccccagagcccagtcttgggcctccccttgacgctccccttcgtgccccctacctgtggaaggtctcttctgactgcccctgtcctgttcccaacagggtcaggccaacaaggtgaagaaactctccatcgttgtctccctggggacagggaggtccccacaagtgcctgtgacctgtgtggatgtcttccgtcccagcaacccctgggagctggccaagactgtttttggggccaaggaactgggcaagatggtggtggactgtgtgagtgtgggcccctcccccaggccacttccctcagggtctgtagcccaggtcgatggcttcccctcatcctgtggggcctttggtgttggaggagacagcagggctctgtccatcgcctttagccagctggagggagagagagtccacagttcagagtctcagtgcggggcagggaccctcagtgaccaccagcaggggggttttcaaacgctttttagctgcggatccctttctgcaaacatagcgcagtgtagaagcccagaatggacaaaggctccagagcgggctgggcgctcaccctgtaatcccagcactttgggaggccaaggcaggcggaccacttgagcacagcagtttgagaccagcctgagcaatataatgagactttgtctctaccaaaaaattaaaaactannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgtgtgagtgtgggcccctcccccaggccacttccctcagggtctgtagcccaggtcgatggcttcccctcatcctgtggggcctttggtgttggaggagacagcagggctctgtccatcgcctttagccagctggagggagagagagtccacagttcagagtctcagtgcggggcagggaccctcagtgaccaccagcaggggggttttcaaacgctttttagctgcggatccctttctgcaaacatagcgcagtgtagaagcccagaatggacaaaggctccagagcgggctgggcgctcaccctgtaatcccagcactttgggaggccaaggcaggcggaccacttgagcacagcagtttgagaccagcctgagcaatataatgagactttgtctctaccaaaaaattaaaaactagctggacatggtggtgtgtgcctgtggtcccagctactcaggaggctgaggtgggaggattgcttaagcccaagaggcagaggctgcagtgagctgtgatcatgccactgcactccagcctgagcaacagaaggagaccttgtctcaaaaagaaagaaagaaagagagagagagagagagaggagggagggagggaaacttcagggagaggggacatggaggcctgtcgactcagccgctaccctttcccccactcatcatccctgaaagggcactgctgagacctctgcccctctgattgcacagctgggacagtccctgcagtcccaggaaggggttttgcccgagccgctctgctgctgtgtggctcagcctgactcgaaagagcctggggctccccaggctggggctccgagagtgcagggcagggccgggcggggtgcgggccgggcggggtgtgggcccggcactcaccaaggctgcttctcaccagtgcacggatccagacgggcgggctgtggaccgggcacgggcctggtgcgagatggtcggcatccagtacttcaggtgagggctcagccgccccagcccttggccccgtgccctggcgtggtcggactcaccgaccttcccctcccagccctagtgtggactttcccttccccaagggtctgctctgttccccaagcccaccctggtcctagctggcgtcccctgcccagcctgagcatcctagggtgaccccctcctccctggcccgaacagattgaacccccagctggggacggacatcatgctggatgaggtcagtgacacagtgctggtcaacgccctctgggagaccgaggtctacatctatgagcaccgcgaggagttccagaagctcatccagctgctgctctcaccctgagggtccccagcctctcaccggccccagctgacctcgtccattcagcccctgccaggccaagcccagccactgccctcccgggcagatctgggcccaggcacctctgagtccatagaccaggcctgggagaatgccaagctgcctgcccgaggctggtcctgaaggcctgtctcccactaaccccgccttccagcactttctgtcattccaggctgggaaagtctagagccccctttggcccctttccctgactgtcaaggacaactgactcccccatcagctcaaacattaagggtacccgggcacaaccgtacccctgcccccagccccagcctccctgagggcctgccgggctgcctctgccccagcccccagcaagggcactcccaggcttcctggtgggtgcagcccactccctctgccctctgctccgttccctgggggctgggactaaagaaatgggtgtcccccaccccatcagctgggaaagcccaggccgcaggagtgggatgcccgttggactttgcccctcacactggcccagcccctcacactgccccaccccgagaaccctcagctctcaaaggtcactcctgggagtttcttcttcccaatggaagtggcttaagagccaaaactgaaataaatcatttggattcaagttcacctgtgttgtgtgtgcagtggtgtgagatccacctgttcccctgacccccggctcccctcggccttgacccttggccttgaccggacttttcctttgtacccggacactctgttttccaggatccctgggcagggacacctcctctttcctctaggcctcccctaaaccggcccttagggtatgcagaggcagctgccaggcccacatacccccggcaggcccaaggagggccacaatcttcaacttcatcttggaggaccagggagagccccatttgtcacccagagaggccggggactccgcgtggacaggcagcgcgtgtgcagggccgaggtctgcccagggctgggcaactccagcgtttgtgctgctcctgctccggcaagtggaggagctgggcgggccagagcggctgtgggagccaagctcagagggcgtggccccactgtgagccgcaggcctgaggacagtgagaagtaaagcggcgttcccctccaggggctgctgctgctgggtctggcagagagagtcctgggggagggcatcgggcagcgcccgcccagtaaggtgggcaatgcctggtataggcaggtgggagggcggggccccccagggttggggtccttgaggagggggtgacccaggagggggctcatccacatgggcacttgtatcagcccacagctccaaggggtgaataattgaagggcaggtcacacgagcctgcccggcacaggatgccttccctgccggatctggttacgccccagatcacattctgacatcccgagttggtgaataattaagctgccactcctctgaggcaggcctccatctccaggtccctctccgaggcttcctcgctgccagctgagtcgtgggcacctgagggactacctaccactgctcccggctgtgccatcgccaccagctcccagcctcctgctcagacccgggacagcccctccatggcccccgagatggaccagttctacaggtccaccatggccatctacaaggtgagcacatgggtggccaagccaggcctgagcccctcctcccagggcacagaaatcaggcccgctctggaggacggagggccagccggggctacagatgtcctggaaagggaagcctggagccaggctgggccaggggtgggtacgggggtaaggatccccgagagcactcagccatacagcgggaacccccaactcccagatgctggacaaggcaggagggagcccaaggcccagggtggggagagttgagtctggatgagaagggcctggctgcccggcctgggaataaagaaagaccctccctctctctctctgtctctccctctctctctctctctctctctctctctccctctctctctccctctctctgtctctctctctctctgtctctctgtctctgtctctctgtctctgtgtctctgtctctccctgtctctgtctctctcatttctgagcccctcagacttcctacttcacccccggggggttgttgcagccgccacagacatttattgagcgcctcctgtgtgcaggaccctttcacctggaggcctcacaccacccacctgtgaggtggaaaatgaccaccctgcttgatagatgagaaaactgagaccaaagaggttaaacagctcattcaaggtcacggagggaggaagaggtgctgctgggatttgaaccgagacccaagtccaagtccaggcccaagtccaggcccgtcttcaccatccggggagctctctgcccggccccagcccgaggaggcccacactaatccagccacagccttgcccatggggggctgttctcggaggagggcgagagctgcccttgccccgggggtgactgttggcagccccaggcgtgtagcccggcaaggcctggacacagggcagggctgagccgtgcccagtggggaccacagcaggcgggccagcttctgcccagcgggaggaggagaaccttccaggtgca

SEQ ID NO: 16820 - DNA, 22287 bp, Human
tgcaatggcgcgatctcggttcactgcaatctccgccacctgggtccaagcgattctcctgcctcagtctcctgagtagctgggattacaggtgcataccaccatgcctggctaatttttgcatttttggtagagacggggtttcaccatgttggccaggctggtccagatatatgatctagatcttataccaactcctgatctcatgatccacactcctcagcctcccaaagtgctgggattacaggcgtgagccaccgcgcccagcctctccttttaatcttgactttcacaaatacctggtggcaggtgtcatttccccattctacacgtacctgaggctcagagtgagacagcgactcacccaagatctcccagctacaaaatggcagagcctgggcctgagctagcatggtcatgggctggaagagccacaatccatgttaaggcacctgggtttggagactgctgccttttttttttttgaaacggagtctctctctgtcgcccaggctggagtgcaatggcctgatctcggctcactacaacctccctctcctattttcaagcgattctcctgcctcaggctcccaaatagctggaattacaggtgtgcgccaccgcacctggccttagactgctgctttttgaaaccaaaattctggcctggaaacagagcttggttttcccagccccagccctgccgctatgataccagaggaagaggcttcccagggcctccgtttccttgcctgcacaatgtggctggcaagatttggtcttctctcacagggtggtggtgagctttcaaatcctgtgaaagtgatctgacaggagagcagtggacacgtgggaaggctgttattgtcacggcattctgcacatctgtccggactcaattagccacctaaggagagagtagggcggggcttccaccggccgtgggatatgtggataatcatccttctgtatctttcttccatggctcctggggcagctggggaagcaagctggatgggcctggccccatgctgccggatgaggtggatgcctggctgtggctctgggagagccaacctcccccagggaacccactttacacaatagcagtggcagcagaggctggcgaggagacaagattcggactctggggagcactgatagcatttcccgagcctcaggtacatgcggaccgtgaccctccctgggaccccaggggggctgctcctcaggactaaggaaggaggagggggtgtgagaaacctttcaccatataccatagaaagcatttacctcaatggccttggtttacatatggggaaactgaggcacataaagggaagggagcatgtccagtctgtccttaatagcaagacccactgaatacacctctcctggctctctgtttagtgtttggacgttcaaagatccctagactaggcggcgggagtttcagggccacgatccagatcttacaccaactgtgtgtggccccgcacaaaatcactccccgctctttggcacttaagttggcgaaactgggatgggctgggacctcaaagggccattctagtaggggagtcacaggcccaggtggtgaaggggtgaaagggcatgatgtcttggggtttatagtccactgagcctcgccggaggtaaccccggctcagggatgctttcgttgccatggcaaccgccgggccggcgcgggcccctgagtgcagctgaggaagctgggacaaaccctgcccttcccaagatggcggcggcggcagggcaaagggcggggttagacgctgtcagcctgtccagaccgttcctctgttttcgcttgttcctactaacagcgagcttccgccaatacttgttctcgttcttggttccgagcgtcccgggagccgggaagggaaggattgtctgcagggattggagcaaatatccagtggggggaaagccgggacttccgcgtcttgccggaagtgacgtgacaatcgcggccaccgccaggtggaacggcaggtgggttcaggtaccagcctggccgggacccggctgtgggaccaacgcttccggtgagcgacagaggcagctccccagggcctggagacccgtggggcggactctgggatctgagcctatcgccctggcctggagcccccctttgtacctagtaagaatcacctacccagccccccacccggagactgtcccatcccactccagaggggaagaggagggcactgctgtcccgtatgagggtggtggagggaggggtggcgttggcatttaggcacttgggttccttaaatcctatgctcctttctctcccggatccagttccccattcccctaccgagctgggcagttagccagcccactccaactctcggaaccatgtttgcagacttggattatgacatcgaagaggataaactgtgagtattttattcccccaagttccagcagtataggagccccaagttcctcatttccctggacttcccagtcccacagacccttgcttctcagcggtggatcagttgttgtactgaagcagcaatggaccctgctctcccaggagctcactatttgtagggggctgtggacagttaaagggataatcacagctcagtgccataagggcactattagcatgacttggtgacaagaagagcaaagcagatggagcagtgcttctgctgggatggtcaaggaaagcttcatggaggacgtagcaattgaaccaggttttgaaggttgaataggaatattgtagacacccttccttcccaacataggttgttagtaggacagattttcccattagaatatatcctctttcagatcaaggagtgggtgcaatgcctttctctatgctcagcacttagtaagggacttgacgtcagtaggttgttagcgaatgttttttgaatgaataagtgaatcagcgtgagtacttatcataaaacaccagtcaatgctaatttatagtggaaaccgagaggtaatcgagcagttgagaggtgggaggtggacagtttaatagaggaagactccctggagtaggtggccatcatactacatagatgcctgataaggtgacaaggacagaacctggctcaaatctcagagatcgaataaatgaaagggaagggggacctatttttatggagtgcctgctatggactgggttgctgttagtgccctccatgcatggttagaagaactctgataagggtgctcatccacattttatggatgaggaaattgagatgcacagaggctgacttacccaagtcccatagctggccaggcacggtggctcacgcctgtaatcccagcactttgggaggctgaggcaggcggatcaactgaggtcaggagttcaagaccagcctggccaacatggtgaaaccccgtctctactaaaaatacaaaaaaatcagccaggcgtggtggcaggcacctgtagtcccagctacttgggcgactgaggcaggagaatcacttgaacccgggaggcggaggttgcagtgagccgagattgcgccattgcactctagcctgggcaacaagagtaagactccatctcaaaaaaaaaccaagttccacagctgataaatggcagagctggggtttgatcccacatctgcttaactccaagagctgtgcatgttccagcacaaaatgttgttttgtccaagggagggagagaaaaagctgggcagccagtggagcccctcaggagttttagagggcccacccgctccagtcatccttctgccaggagagtcagcctagcttgctttcctttctagcggaatcccgactgtgcctgggaaggtgaccctgcagaaggatgctcagaacctgatcgggatcagcattggaggaggggcccagtactgtccctgcctctatatcgtccaggtattgggcgctttggaggggggcacaaggtacatccctacttgggcatgacaaaggcaggttcatttctccacactgcatagctgactccttctcattcttgaggtctgaccctctcagaggggctttctgaccacctgcgctgcgttgctctgccctgtcttctcccctgtgtcgctctgtttttttccttctcggcacttattacttgttatttgccctctgtctagtagagtagactctttgcactgagggcagtgtcctggtttgctttttcactgcagtaagcaccaggtacagtgcctggcacatagtggacatgcaatagaaattgactattgaatcaacaaaaccatcagccttgcgtactagccaaaatgaagtgtcataggaacacgatgaaataatggcctgagttcaaatgcaagcttctttcctacttactagcaagttacttaacctctttgggcctcagtttcatcacctagaaagcggggatttaaaacatgtagacacaatcatctctgggttcttgtgagaagtcaacaaaacgacctaacacactagaagttaagaaacgtgcattggccaggcatagtggctcacacctgtaatcccagcactttgggaggccgaggtgggtggatcacgaggtcaggagttcgagaccagcctggccaacatggtgaaaccccgtctctactaaaatacaaaaattagctgggcgtggtggtgcacgcctgtacttccagctacttgggaggctgaagtaggagaatcgcttgaacctggaaagtagaggttgcagtgagctgagatcacgccactgcattccgtgcattccagcctgggtgaccgagtgagaccctgtttcaaaaaaaagaaagaaccatgcattaagcagtagctgctgctattttccaggtagctgtacattttcccagatgctctgccagtggtgaggaacactcttgtgtctcttgcagaggaagctgcactggtgatattctgtccactgtaactcaggagtggtgacaggcctgctgtggggcctccttcactgtgtggctcatccaagtcagtgaccttgctgtagccttgggaatacctgttctaaccctctcactggtggcagatgggaaactggcctctgtgaggatcttgctcaggagtcgcttgtaggcctcgaagacagattcccaggatcgacctggtcttgcttctgctcacagtgctgcctccttcatgagccattcggcctcctgtgacccaggaggcattagcaagacctcccccaggcctggcctcctggccgtgtgtctgctcagcctctcgccacctccctctacctacctcaggtgcaagtttgcttagaatgaacagacatcataaaatagtataattgattttttttttttttttgagacagagtctcactgtgttgcccaggctggagtgcagtggcgtgatctcagctcactgcaacctctgcctcctggattcaaacgattctcatgcctcagcctcccgagtagctggtattacaggtgtgcgccatcatgcccagctaattttcgtatttgtaggagagagaggttttagctatgttggccggcctggtctcgaactcctggcctcaagcgatccacccacctcagcctcccaaagtgctaggattacaggcatgaaccaccagccaataaaataatagaactggccgggtgcggtggctcacacctgtaatcccagcactttgggaggctgaggtgggcagatcacctgaggtgaaaacttccagacaagcttggccaacatggtgaaaccctgtctctactaaaatacaaaaattagccaggcatgatggcgggttcctgtaatcccagctacttgggaggctgagacaggagaatcgcttgaacccgggagatggtggttgcagtaagccgagatcgtgccattgcactccagcctgggcagctgagtgagactccgtctcaaaaataataataatcatcatcatcatagaattgatttttttaaattcaattttgtttttatcaaagtgccatatgacttgcctctaccaagtcaagagcattaaaagccctgtatcaaataatagcaatccactgcccttcccctgggcacctcacccggctttctctgtctcttcatgcatgggcttccatttttctcaatagtctcactctgtcgcccaggctggagtgcagtggtgcaagcatgggtcactgcagccttgatttccccagactcagatgattctcccacttgagcctccaagtagctgggattacaggcacgtgccaccaaacctggctaatttttgtgtattttttgtagagacggtgttttgccatgttgcccaggcttgtctcaaactcttgggttcaagtgatccacccgcctcagcctcccaaagtgctgggattacaggcgtgagccaccgtgctcagcctatcctgttgtttcttgatctatcacctgtaaatatctattgactttgcctcgtctggtagatgagaatttagttcttcccatgaccagtctgtttcctctcatcccacctttccaacatagttatttttctatttttggctaaattaatattagtacaacggagattttgttcgggaaatcttttccagatgcctcctaggctctgttgtaggcactagggataaaagaataagaaagcaaagatcctactcttgcggagccctcattctagtcaaaacaactctatgtttaactttctgaggaatctatgtttcttttcttaattcagcctgttcttgtgttttgagagggtgggggtaatttcctgttttgtttttttcatttgcactctccttgttttctcagtatgttttccacaatttcccatcttttttttttttttttaaattaagtcttgctctgttgccaggctggagtgcaatggcgtgatcttggctcactgcaacctccagcccccgggttcaagtgattcccctgcctcagcctccgaagtagctgggattacaggcacgtgccaccacgcctggctaattcttgtatttttagtagagacggggtttcaccatgttggtcaggctggtctcgaactcctgacttcaagtgatccacctgcctcgacctcccaaagtgctgggattacaggcgtgagccaccatgcccggccccattttcttcagtctgttttccgccctgtagtctctcccccttgtgccctccccctgcccctgccccttctctttggattcccccatcttgggggtccctttcctggtttactccctgatctcccatggagaatatcctcctgtagctttctgagaaagggcacgtgggatgtcaattttttgagacctcgggtctgtcttttttggtcattgtggttcccatattcctttcagttgacattttggctcattcgattcaagaatgaacgtcaaggttgacagtaattcctgtgtggaagtgtgatggccttgtcacattgtcctttgctgtcacatggctattgccattcttattggtgatcctttatttgtgatgtgttttatttctgatctgtgagaactttgaggactttctttttgtccctggtgttgggaggagtcgtgatggtagctgcaggcacaggcttttgtttattgtgccagatcctcagagggcgtcatcgggaacaccatgtccttcttgtcatgtatctcgatgatgacatcctgctttctgtattctctgttctgcttttttctatttttttattgtggtaaaatttaccatcttaactttttttttttttgagacaggatcttgctctgtcgcccaggctggagtgcaggggtgcgatcatggctcactgcagcctcaacctcctgggctcaagcgatcctcccacctcagacccccgagtagctgggactacaggcacgcgccaccatgcctggctcatttttgtattttttttgtagagacagagttttgccatattgcccaggcgatcttcccacctcggtttcccaaaatgctgggattacaggtgcgcaccaccgtgcccagcccttggtctatttttgaattaggttgtttggtttttgttgttgagttttaagaattctctacaaagcacaatcggctaagaggaaaaaaagaaaaaagagttttaggaattctgcatatattctggatattaatcccttatcaaaaatgtgatttgcaaatattttctcccattctgtgggttgcctttcttttcttctcttctctgttctttttttttttttttttcgagacagtgtctcactctgttgcccaagctggagtacagtgacgggatctcagctcactgcagcctctgtttcccaggctcaagcgatcctcccacctcagcctcccaagtagctgggactacaggcgtacaccaccatgcccagctaattttcgtgttttttgtagagacaaggttttgccacattgcccagactggatggtgtattttgatgcaccagttttaaaatttttatgaagttcaatttgtttattttttgttacttggatcttaggtgtcacatccaagaaattactgtaaactccaatgtcgtgaaggttttggactaggcatttttctgagttttatagttttaacttttacatttaggtctttgaacaattttgagttaattattattattattattatcttcgagacagagtctcgttctgttgctcaggctggagtgcagtgacatgatctcggcttactacaacctccacttcccaggttcaagcgattctcctgcctcagccttctgagtagctgggactgcaggcgcctgccaccatgcccagctaatttttgtatttttagtagagatggggtttcgccatgttggccaggttactctcgaattcctgacctcaggtgatctgcctgccttggcctcccagagtgttggaattacaggtgtgagccactgcgcctggccttgagttaatttttgtatgtggtgttaagtagtgtcaacttcatttttcacataccattgttgaaatgactgtccttccccattgaatgttcttgacacccttgtcaaaaatcatttgatgccgccgggcacggtggctcacacctgtaatcccagcactttgggaggccaaagcaggtggatcacctgaggtcgggagtttgagaccagcctgaccaacatggagaaaccctgtctctactaaagatacgaaattagccgggcgtggtagcgcatgcctgtaaccccagctactcgggaggctgaggcaggagaattgcttgaacccgggaggcggaggttgcggtgagcgagatggcgctattgcactccagcctgggcaacaagagcgaaacgccgactcaaaaaaaagaaatcatttgactatgtatttgaggcaggagaattgctggagcccaggagttcagtgccacagtgagctgtgatcacgccactgcactccagcccgggtggtgagacgctttctcaaaaaacgagagcagagggtagagtggaagacagagccaggcagtggtcaggtgtcttcccaggttccatcttagccctccctttcttcccccaccactctccttatgcacccacaggtatttgacaacaccccagcagccttggacggcacagtggcagctggcgatgagatcaccggtgtcaatggcaggtcaatcaaagggaaaactaaggtggaggtggcgaagatgattcaggaggtgaaggtaagggctgctgcagagcaggtgtccagaggcagcaacacatgtttctgagacctccaggctgccagaggtcccagcaggcctggaagggggtatcagccctcaccgcccccttccttgtcatgtgcagggtcagggtcacactccagcctccctcatccatccctcattcattcaataaatactaatcgtgctccaggacttgtgctgaaccttggcaagagagtgggcagcaagaccacaaggtccccatgagctcccagggagctgacagacttggaaccacccctcaggcaagcccatgtgtccccagtcagtgccagagctgaagctaaaagtccaaggtgatcctccctgggtcagtagacacccaataatgtcagccgggtcacgctgggcctgtgagggctaggagggaaagaagagtgccctttccccatcctgtaggaactttcggtcccacacagcctcctgggctcatagacacccagagacccccctcccaggccagctgatcttctgctctacagaccagagtcacacactgcctgccccgctttcccccacccctgccgctccaggactggaatggcaggcggcatcccggcctctcctgaagcgagcatgcagcccctttgccatttcctagcgaagtggctgctagctagtctcaggaaaccaatactgtgaaagaactgatgtgcaggcagtgcacagccatggggtgatttgaaagtctcgggggcaagggtccccactgtgagttcagcttggccaagggtggcagctacctccctcagccccacttccatcctccgggttctggcactcctgatagtccgccttcctgccttaacccaggccagccgctgctccatcctctctcccctttatcctcctgtcctgctcctgagtagtccgtgcttctctccttccttgctgtaggaagagtcccatcctgcacattctcctattccagcccctttagccataggacaaatcagggcctggggctggggctcagagctctgttgtaaaaaaaggaagcagcaaggttcattgagaccccacagctgccactccacgtggtctgggtatcactgcctcaggtatgacctgttaggcagaggagctgatcatgggaacaggtgcagggggtctcgttctggccgagttgggttgtgtgtgccccatttggcagcccttcccccctccgcatctcctccccatctccactcgccaggtccctccctgtcctctcaggcttggtcataccagcacctcaggttgcccatgaggacaagagctctttgtatttgcacacagccatgacagggatgcagcattggcccagctcccctgtttgggtgctgggcagggattactctcccatcttacaggtgtccacaggcggggagtgacctgcttgtggtcacacagctgaactggagcccgggcccgactcccactgcagcccgcttgccgttggcctacagctgctccctgtggggtggcccctgagcacgcctgtgtttcattctgcgggagcagttcacaccccacctctgactctgattgcatctgctcattttggtttccctttgggacttgattttaaaatcctgttttatatttggatgaatgtggtcccaagttcaagggcttttggtttgcaaggatgagagtgaacacagcgccctcccgtgctcaggcaagtcctcttgggagaagcctttgtctcctgagcagtcgttagaaagtggtttgtgtaattccctgattcgcatcagccttgcggggctggggctgcccctgcccctccccttggtgccccagcaccaggcacagagcaagtgctcagatgtgctgttcgatgagtagagggattcctggggatggggtgttttggggtggaggagggaataatcagtgtagggaaatgacacggcaaaggcttggagtgtggtttgcgtggggagggaagaaggagagcctgacctggccgaagcacaagacatcagagaccgccaggctgtgggcccggtgccggccctgtccccactgattccccagggcttggatgtagagtaggaagggaggggcctgggatcagacagggtcacaaggtggggccatgtcacagcgctcagcctggcccttactggggcttaggattctttttttttttttttttttttgagacagaatctcattctgtcatccaggctggagtgcaatggtgtgatctcagctcactgcaacctccgcctcccaggttcaagtgattctttgcctcagcctcctgagcagctgggattacaggcacgcgccactacgcccagctaatttttgtatttttaatagagatggggttttgccatgttgcccaagctggtctcaaactcctgacctcaagtgatctgcctgcctcagcctcccaaattgttgggattacaggtgtgagccaccgcacccggccttgggctcaggagtctcagtccagaacagtcttggcggggaaggggctcagggtgtggagcctcgctcactagtctgtgtgtgctgctcttccagggggaggtgaccatccactacaacaagctgcaggcggaccccaagcagggcatgtccctggacattggtaagctggtcagagcagttacgggtgtccagcagcctccctggatgggccctggcccaaaggagaagtgccacagccagccctgccctcccctttatgacaggagaatccagagttacatggctgtgggctctgacctctgaccaagcaaatctgaaaggcctgggaggcctcccggtgctctccctgcgtctgttcttgtactctgtccctggtttctcactcccccgcgtttcacccctacctccctgcttctgccatctcctctggggacttgctaccctagggttgtcctttgcaggccagcgcctcggcttccatggcccagggcctcactcttcataaagggagagcagcctaaccctggcctggcgcctcatgccctctagcacagcgcactcctccctggcctctcctgccatcagctcccagggggactctggatctgaactggacctcaggcattgggcagagggtctgcgccctgggacaagttccctcctgttagaggggctgagcctcggttctgtagaaactttaagactcaagagctggacagcagcttcgagtcctctggaccggccgcttcacattatggatcaaagcctgagacccagagagggcgctgcagcccctggtgagcgcacacctaggtctcagctctggagcccagcaatccccttcatacaccctagggccagaggccaaggggctaagggcaggctggatctatctgggagctccctccgaaaccctctggttccaacacaggactaagtccccttcctaggactaagctggtcagatgcagtaactgagtctggggtccgagcttcatggtcattgatggtgcccattactttcacataaccagcccaggggcccctcttctccccctcccctttatgtgacaccctaggtcctgatgtgacacagaggaggggaagaggcctccttggcttccattagcctgtgctgagcccgggcagcactgggctctcagcaaccagcagctgatgttgcgtagcaggccctgggcgaagcgcttcatgtttaactgcccaggctgccagcacctctgtgaagcagagggaatagggcaggggcctaggacctccccactggacattccccacttcacagccacccccagcagcccttctgccccctgtggggtgctccctgtgcatggaggtaaggctgggggcagggatggcctctgggcagccacagactcaccaggtcctttgtcccccgctcagtgttgaagaaagtcaagcaccggctggtggagaacatgagttcagggaccgcagatgctctgggcctgagccgggccatcctgtgcaatggtgagtcccttcccacccagctggggccccggggactcaagcccaggctgagaagagtggggggcaccatggctgcccaccaagctgctgtgggtcccgcgggtctgaccctggcctctgcccgtggaactgagaagtcaccatctctgtacccccagaggcctctccagctcccggagggtccacagctgtcagctgggctgtcttagccagtgcccctcaggtcacagatgggaaaatagacttagtgtggggaggtgcctctgcccctgccctcagccccttacccctcaccccagcactctcgcggcccacctcctgcctcctttgtccaggaggtggtgctgctgcccttgcctctgcaggtcctcccttcgtggtggctgcgcaggcgaggggggaggcgtgtacatgcacatttacacacgcatgcacacatgcgcacacactttccctccctggggtggccagcgaaacactcagtccccctcctaccgtcgccagtccgagtttaaaaatagcagcagctctgcagtgtgcctgtggggtagatataaatacttctagaaattgtaggctcagctgggcacactgggctttattggctaaggaagtgggggtggggactgagcttgttccaaatggtgtacaaaagtggcggctgctattttcagcctcctggtgccgtgcctataaatccctgttactgtagttaccagccgttgagatgaaattagaactggttgttgtgtttttccccccaaaccttgcaatttccctggccttaaatagggtttctaaaattgaagctgtcatgatgtcccatgacccagctaaaaacaacaacacgatgcttacatggctcctttcctgccgctggccaggtgctaaggctctggggaacccaggcctggaggccaccgggtggccaaagcctccccaagacctctgaattgctcccttccttccccgacagcctgtcgcactgccacctccctgcccagagaggcctgaacacagcctccgctcctcccctcttctgctaaaaaaccctgacccaggtcaacacaggaggctggggagcagagagcacctgactgccccacctctcccctgcagccctcaccatcacactgctgtccatcgcccggccactgggctggcttctctgctgggctttcagccttgagagcaagacttggctcaaagtgagcctgacatggtggctggcacacagtgggtgctcaagaaacactaagccaatgactgatcaccaaggcctcttcccagtgtgagctctctcagccttcctgaatttccccctccctccccaagttgcgttttcccttctgagccatctgtgtgcttgggaggcagagaccatgtccttcctgcgctagaggcctggctgctccatctccattcctatggcccctgccagccttcctccccagctgtcagcaggctttgtgttagaagtgtgggagctttgcctgctaggcacggaccctccgctggccatgaggagggcctagtcatttacaaaacacctttgaacccagctgacccgagctgccaaatccccctccctgggacccctgatctttcccttcctggttctcctctggggttgcctctcccctccccagcatggccctgggcctcctgtggcttgctgagcccactgacctcccctcttctttgaatcccgacagatgggcttgtcaagaggctagaggagctggagcggaccgctgagctatacaaaggtgggtggggggtggcctcgtcctggcactagctctaccccagggagcatgctctcagcagagtggcaacaggggtgctggcactaggaatgccagcctacaaaatactaggaccatgggcattaagagttcttaagaatatatacttcttctgaatttaaaaataactcaggggcctggtgcagtggctcacgcctgtaatcccagcactttgggaggctgaggtgggcggatcacttaaggtcaggagtttgagaccagcccggccaacatggtgaaacgccatctctactgaaaatacaaaaattagccaggcatgatggtgtgtgcctataatcagtactcgagaggctgaggcatgagaatcgcttgaaccagggaggcagaggttgcagtgagccaagatcacaccaccgcactctagtctgggcaatagagcaagaccctatctcaaaaaaaacaaaacctgatactcataaaaattcagagaatagcacttgtaaacatagcgagagtcccccggaatcccacactgtcccagggctaaagcccacagcaggctgtgtacccctgcatcttacaaaatgctggcgcccctgtctgatggggctcctcacgggttgggtcggactgagcttttacccctgggctgtggttgggcggtggggaaaggccatgtatcagggcctagcagaggccttgggtggcatgggcaattggaggccttgccctgggccagtgtggtccccgccatgcgtccccattccgcatcactcggtctctcccacagggatgacggaacacaccaagaacctcctacgggccttttatgagctgtcgcagactcaccggggtaatggcatcccccaaagctgtggtgtgaccctgggcaatccctggggcctctcactcccatgctgaggtgggtcagacccacagcgcctgacctcaggctccctctgggctgggcctggtcccaggtgctgggatttgcgatgggcctgcggggaacatctagatcagctggtctcttaagggccgcaacgatgaacaggccccaccctgtctcctcacactgccactggcagtacacaaggcccttgcttatttatatttctgacaacctgtaactctgggcaggccgactgcagctgaccccagctactgcagaaaatgaagcccagacaaaggagagggccacactgctcccaagtggtggagctgttgttccaatccaggtgtctagactcggaccagtgttctgcctcaggcggcgccacctccacaaaccttgacccagtcttctctcactggtccctctggggaatgagggccaactcccttggtgtgtacactcaggactctagggggcacagaccagctcttggaggtgtcaatccagtttcctccaggtgtagactcagctccttcagggggtttagaccagctctcttggaggtgtagcccctgtgcagacattggcttccagcctgccaggccccctgccctgcttctccccaacaaacccctggcttctcttagggggccaagtaggggcagccttcaaggcaaacttgtcctgcagcctttggggacgtgttctccgtgatcggggtgcgggagccccagccagctgcgagcgaggcttttgtgaagttcgccgatgcccaccgcagcatcgagaagttcggcattcggcttctgaaaaccatcaagccggtaggtcctattgagcatgtgtgtgtctggcgtgtgagggtggggaggggagagtgtggcatgcagagaaggtcgtatgctggagtcctgtgcctgggtacagcctctggctcagtcacccacacagtggactgtgggtgagtcactgtgcccccttgggccttgccattgacctctgggctggcttctgaccctggctcgccactgagtcacagcttgccctaggcctggcactagtcttctcatccttgagagggacaaggcatcagggagcaccatctggctctgatagtcgagtccaccaacaagggtgacgcatcagtgccattcattgtcaccctggcacacccctgccgtgacagcctcagcatccacccaccctcttccagatgctgacggatctgaacacgtacctcaacaaagccatcccggacactcgcctcaccatcaagaagtacctggacgtgaagtttgagtacctggtgagtagtccaggtgcccaggctgctagggcaagcgcccaccctggagatctgccccacttcagtcagccatgctgcggccagcgaggccagccagagctgacagcatgtctgctccaggtgtgggcccagaggcccagggaggtgcagccaaagccctgctgcgcctgcacaaagaagcatctgagagcctggggcgggcatggctctcgctgtgtgcactctgaccccttgggatttgttgcctttaaacaatgggttagactaggtgagtgagcataaaatgggtgtcagtgaacgttcgtgagttttacatttaattattctacagtcaaaggaattgagagaaaatgctctattaagcaagccaaggttcctttgctgcaggacttatcagagcctttgctaggctgatgtgcagtgtgaattttcaagggtcttcctaagctcctttaacgacagacccctttttccccagagcatctcttgggccttgagtttggtcaactcggccgcctaagcctcaggccctgtcatccctcagcacctgccgctgcccgctctgggactccctgaacacctgcgccagcctctcctgctgcgtgtgggtgatgggggtggagctggggacctggggtgggggtagtagccactctgacagcctcacctgtcccacacagtcgtactgcctgaaggtgaaggagatggatgacgaggaatacagctgcattgtgagtgttggagggggtggggggcttgtacttccccccacctggtctgccagggatagcaggtggctcaggccaacccgggagagaccggggggacttggctggactctcgttcctggagatttagggccatcttcccagtcccgctcgctgggcctcggggtgctgggcacccggccgggaaccactccctcagtctgggggactcttggagggaaatcggattttcttcactcctatgaggcgcttttaagtgtttgatttttctgctgtcgggatccatttcgtggccagtgttcattgaatgtggcagaggtttgggtttggttttttcctctcttcaaagctatcactgagtgcttctgagaaacactgaagtctcagaaatgaggtctcaggaatgaagaacagccgtggctttgaaagcacagtgcggtgcgaggccgtccctgagcaggcactcctgtcccacccccgccccaggccctaggcgagcccctttaccgggtgagcaccggcaactatgagtaccgcctgatcctgcgctgccgccaggaggcgcgcgcccgcttctcccagatgcgcaaggatgtgctggagaagatggagctgctggaccagaagcacggtgagcgccgccctcctccccgtccgctctccatttcagaggtgggaaaactgaggcccagaggggtactctcagggccaggccacggcccagatgtaaagcccctccaggagcccagccatctgcccagagcctggcctgggtggagctggcctgtgcgcgtgggctccgtgggctgccatccatgatccatttaccctgcagcctcctgcgttccctgaactgggagcggggaggccccgggctgggcggcccctgcctccgccccttgccaggtcatgaggggtcagggaagtgcccgagtgggaagcccaggggaggcgagaggtgggccgggtgggctgggagagtctcctccctgaggcaggcagccagagcccactgcagcctgtcccccgacctcccaccccagtccaggacatcgtgttccagctgcagcgcctcgtgtccaccatgtccaagtactacaacgactgctacgcagtgctgcgggatgccgacgtcttccccatcgaggtagacctggcgcacaccacattggcctatggcctcaaccaggaggagttcacagatggggaggaggaggaggaggaggaagacacggcagctggggagccgtccagggatacacgaggggctgctgggcccttggacaagggtggaagctggtgtgactcctgagtgccccgcggctgtggtgccgggggcagggtgcgtgggaggacggagcctgggagcggggcggggccgccgcgcaagggggcgacgcataaaggcctgctggcttggggcgcctgcctccctgctcctctgtcctcgcacagcgaacctgggctcctgcccaggacaggcaccagggtcatggcctgggacctggacactggcccctccaccctccctcccctcccggctccccggccagagggagagcttggtctctggacctgccttaggaaggagagggagggcaggaaggaaaagaaaggacttggaggtggcaggagtccgagccctgctccttgtgggcgctcacactgcccccggagcctgctgggagtggggccagccgtggacagctgaggttggggtcaatgcctcctgggcacccttgcctcgccccagaccggcccgtccagtccccatcacacctcggcggcctttatttattctgttcccccagctcggccacttctctgaaggagggctgggttctgggcctgtatcgaataaacacaaacctggatggcgcagtggtcgcagtggcttcagaccctccttgtctgcccctcccctccaccgtctattgacagcgcccttgctatgcaccatttatgcctcactgaagtgttgcagggctagcactgtggtcccctcacagctggtgatttgaggctcagagaaagatcttgcccaaggccacgccctgtgtggggacacagtgggttttaactcagatctgtcctgaaggcctgactttgccacctgcctccaaagctttctgctttgtggaaccttttgtatctcaccccccgcccccttcccccgcccccaatctgtgacctttctgtgcttccgacaggaaataaacctctgggggagagaagggcagacatggagccagggcgactgagcccccaagtaggggagggtggtgaggggtaagtgctgactccaggcgcgcctgtgctgcccgggtggtggggaaaggcgtgtggggagaggtgctcgggggctgtgggaagaggggcgtggggagaggccatggggagtgtctgcagagtggcagaaacagggtggccacttctcctgcttctcctggccagcctcggcctggtgtaatcagtcatagtggcccttgtcactctaacgtgttcctgtttggacgatgaatatggccatcctgagaatgcgagggggcaacagggtgtgcgaggtgggctgagtccaggatggaaaaagggtttctgcatcagctttgagcatgcattgctgggcagaaacccaaatgggaggcttggcaggggtgggacatggaggaggggctggctgtcaccaggagcccacctgggtccccgcagagccatcagacagaccacactgcctccctgaagggggcagccagagtggaggccaagagcacaggctggaactgacagcctgggttcgttcctgacctccctgggcctcaatttccctatctgaagtgtggcacctaccttattggcttgttaggagattaaatgaacatctggagagggcttagaacagggcttggcacagagcaagcactcttaaatcttaaataaagtcagacgggccgggagcggtggctcacgcctgtaatcccagcactttgggaggccaaggcgggcggatcacgaggtcaggagatcgagaccatcctggctaacacggtgaaacctcgtctccactaaaaatacaaaaaattagccaggcgtggtggcgggggcctgtagtcccagctgctggggaggctgagacaggagaatggtgtgaacctgggaggcagagcttgcagtgagccgagattgtgccactgcactccagcctgggcaacagagcgagactccatttcaaaaaaataaataaaaaataataataataaagtcaaacgcagtcactgctctagtggtgcaggggaagccacaggccatataagtagaagccggccaggcatctgtggggctccccagaccttcctggggcctagatggaaaatgagggccagcagggaccagtggggaggggtcactatgggccgggctggaaggtgaggggagtttgcggagggaaggcggcttcctctgcaggggcctgttcaccacgctcatgattcggagggaggcaaagaaaggaggggtgtgatgtatgggaggaggataaatgcatagagggaatacatcgcgtcttgccagattcgtgcacctggatccaagtgcaggaggtcagatgtcaaagtgtgagggagatcgtgggacgctccgtggggagaaggcaggtgctgggatcagcagatgacctggctgccagcacagtgtccacagcaaaagcccctggccctggacacccaagtttatcctctagtgggagagatgccctctgggaaggtgaggggacatggccacctcgtggaaggcagcagggcccatggtgttactgagcgcctggtcccaccctccccaggaccccaggggacggagtcgtatgctcagcctccagtgagcaagga

SEQ ID NO: 16821 - DNA, 43717 bp, Human
  misc_feature (1)...(43717): n = A,T,C or G
tctggaccctctaggctcagaaacactggaattgcaagagctgatttctgggctcctgctttcagcttctctgatctaattcttgtagcctaaattgcttcctgaactgaccctgccggaaacccgtggtgctaatgctgctcctcggtgactctgccagaagcctgaagcccggaagctggctctgtgagctcctcccctctctccctcagacctccaaggcagggagaatgggtgggagggggcagggctgctggcctccgtgggcagaggggcagccagagaagttaagtggttggcctgaggtcacacagcagcactccagcaggcccagtatggatatgggggcagaaggtgaagtggcttgggtgcagagcaggggacaactgctctcagctcccttggcaggtggggggacaatggcccccttgccctccctgctgtccatctgtgcccatgctcactgcccgcgctcgcctctttcctttcctgtctctcccttccctctttccctccacatgaggccccagtgaggctccagctcagccacggtgtgtggggagaccctaagtgagagcggcagggtcatacagccaaggcggtggcactaaagtcagaggatctgggttcccgtccggacaccaggtttccaggggagcttgggcaggtcacctcacctcactgagccgcagttgtattttgtgaaagctggcagccgtgtgcccaccggcactgttggcaggcagtacacatgcacctctggccagggaaatggggcgtctcttgggaccactgggtgtcttggccccttccccctcactcctcttcccactggcatgcttggcgggctcctcagccttcagttaatgggttgactccttccaggaggtgcagcagcactgtgtaattcccatcactgagatgagaaaacgggctcagagagttcacatgaccagttcaacgtcacccagcaggagggtggtaccactggggctggcactcacaccagtcttgatctcagatatcactcccacagccagcctgccttgccttggtttccctcagggctgggctggaaattgtggcctttaccccaaaaggattgcactgttaccctgggcaggccccaggaagagtagatcggggactgtggagctgcaccgcagcccagatggagtttgagggatgggggcgtggatcataaatggggtggtcactcaggtgcttggccgtccgagcatctctcagcgcacctgatatgcaggccctgccagccgctgttccttgccctgccctgccctccactcccagaggccttccctgaccatgttggtccagtctgtgtcccttgcacttggtcagcacattggtgcaaagttcagggtgcttggctgggcccacctgggcccctggggaatggagggagggttaaggagccatgggcctgctctctacagaattagagacgcctattcccaagatgctgtgaggaaggcagcatggtgcggggaggaccggagagaatgaatgaatgatgctgagaggggtacctggggcaaggttttcccacaccaggcagaaatgtgccactctctagaggtggggagggaaacccagaggcacacgctgctttcctgtgggagacacaccagccagggagctggcagggctggccactggtctgattccgtctgaggaggtgtagggaaggctggtcaaacaaaggaaggcagggaggtaggtgcggtgtgggccaggcctgagctctgtgtggcctgtgggcctggtatcgcctctgagcttcagaaacgagagaatccagtctatggagtcaggccggtcggtgtctgtcccactctgctgtataccagctgtgtgaccttgggtaggctccacgcctcgctgagccttccgtgcctgtgccatggggctgatgatgtccgcttcacagggcacatcagggacccagggactctgtgagtgaccgtcttcttgccttcctgtccaggtgttccccctcccctccctggggcagcagccaccatgttctcgtgtgtgaagccctatgaggaccagaactactcagccctgaggcgggactgccggcgcaggaaggtgctcttcgaggaccccctcttccccgccactgacgactcactctactataagggcacgccggggcccgccgtcaggtggaagcgacccaaggtcagtgtctggtcccagctggagctgggtgagcgggcccaggcccacccacaaggctgggcctgcagggacatcggggtggtgggaggaggcatccctggccccaggctgctgagaaagtgagggtgctgaaacggtgggatttgatccggatggggagcttggagaatgggctgtaatcctgtggccaccactggattggttgaggcccagccaggccttcaccctctcagggcctccacttcctcacaggaaaaatggggcagtaacctcagccccgctgagggtcatttttggaataaaaatggggtgatgtggatatgaccatttttgataaaatgtagattgacatccaaatgtaaggaatttactttcctgattgttatcatcatgattttgaaatagtcatttgtggtagaaatgaaaagtatttattatgatgattaatcaataataataataattgtaaaaagatagtagtacctacctcatagagtggttgtgagaattaaaagaggtaatgcatgcaaaattccactcacagcctggcagccagtacgggaccatggatactgataatgatgaacaggtggcgtctctccgaccactccttttggtccctgaggctagagtgtgttacacagaaatgtttggcctcctggtgtgatttcatccccttgaaccccgattcctgggtgtgagggtgggctggggaggggttcgctgcttgtctgtgggtcctgcagaatggggtccctggtggcctgggtggaggggaggctgcaggaggttactctccctggcctccagggctgtgctagtgacactgagggtcgtcccctcacaatgcgggagaccatgctgctgtctcaaggatgctccaggctgggaggaggctgtgactcccgcagcccagtaatcagaggaggtgtcttggaggtgaagggtgatgaggtttttgcccaaagggccaggtgggaaaaggcagagggaatagaaactcacaggtgggagcccctcaggctcatgtgggcctgtggagagccatgcctggggtggcagatctggggccaagatgctcgaccttgctctgtgagtagtgaggtcccgcgaaggcaaaggctttcagcagcctgtaacagggtcagatttgcattttccaaagttcctcctgatcccctgggctttttgggaaaatgaaatgtagttttctagtttccctcccaggctatgatctcgagtcccttctgactgaaaataccctgtagatgtccttggactgggactcttgagtggcagagaaactgaggccaagagaggaaggtgcgtgtcctagatcacccatgagctgctagcaggggtagttgaagagtcctgcctccctgcaccccaccttcctggcaccagataaagggcccctggtgcccttgacctcagtcccaagagctgtaacagaatctctggccctgtactgactctctggaaggcccaggagcctcctggcctggccacaagagttctgcctcttgggccccctctcccacgccttcctctcttcctttgtcaagtaggtggggagggaggccttggcctcaaagggcctttgtgaggccttggctgtgggggaggagggctgggcactcgagctcttcgccctcctcccactccatcccctggctacccccgtcctgactccctcctgccctctggccattgcccagacattttaggtccgtggctccgaaaagaggctggtgaggcctggcgggagcaggctgggcttgctgcggtgagaggaggagacgccaggttggcccgcttggtactctcctgctgcgtgacccaggggagtcagctgccctttctgagcccctttccttgtgggttcaggagccatgccacacctcctcctctcgttgccttcctcgctggctcacttggtgccctgccctttctagacacgcagagctgccctgccctggatgtgggggcaggtgacagagagcgtatggtggctggtgttcagagagctgtgtgagtggggcccaaggggcagcagtgatggggactcagaccaggctggggtggatggtccacggcactgcctggatttcctaaaccatgtgtgtaggcactgcctactggctagccacaagcctgcaggacaggcagcccctgccccactaacgggatgggaggtttgtggagcaggaagtcaagcaggcttggctcagcttgcttggcgggcccagcccagtgggttatcattaacgcccagctgcttgccagtgagagggaactttggcctcaggcagccttgtttcgatggagtcttacctgtgaccgcctgtttacaaatgagaagtcgtgctgcatgcccgtccatcccctccagctccttctctgagttggtccttatagtggctgctctgttcttagagggtctcctcagccagcctcccagcctcgctgcctctcaaatggaatgcagaggctagtttttgagccacagtgaacttggctgcagccttggccctaccttactagaagtgtgaccttgaacaagtcactcctgcttgggcctcagtttcctcatctgtaattggggaaggataattcttgctggtcacagtttctggaaaccgaaatgacttgaggtatctgtggtgtcatacacatgggaggcaggtgacaaactggttcccctctcttgctcgtcttctccttggcaactttttgttggggacctagagccaccttggttgggacatcccatctcctattgactctgcaggtgggaccaggccttgtcctcttgggtgccgacctgggcacctgccttcagcccacacccttcacccacaggctcgctatgtttttgttctttccagtacagtggccattcgccggcccctcacaggcctggctggggagatgcacggagaatggagaatgtccccaggcctgggagctcagggtgtccgtcctcctcgctcagggcccgggacctggtaggcggcctcctgtcaccctgtgggggcaacatcccctcatccagcatgctgtctctcccacatctgggtatgagcctggaggtcctttggtggaatgcacaggggacaaggtggggtgggggagggggactaatgaacagacactggttttggaacctgcagaattcccctagtgcagtctcgggggccccagcctcagcccagtcccggggactcttgcccatcaagccatttcctggagatggccctactcctcggctccctgaacataaggccttttcatgccacagaacagtcagtttgcagcaaggcctggcagcgggggcacacccagccgaactgcccaggaatgacccccttctgggcatgtgctcagagatggggttcagtggggtcagggagagctttcagaggccttgaagggtgcggactgccatggaggagaaggaggtagggctgggggagggcaagtcttctgcagaggggatgggctgtaggctacaactccctttccagtcccagatggaagtcccgtgtccttcccagacctgtttcccactgtctagttcattcattctgtgatcctagattccaggagggtggtgactagggtgaagctggatggacaaagagtgggggaggaggacggatgtggagggagcctctgcagatatagcccaggtgccatggatccagtctgctgccttgccttgccttgtacaccaggaatagaaacctgaatttcttgttgtgccacgaagggagaagggaggtgggctgggctgtggcctgtcaggtagagttggtctaacaggctgggatgggctgagcaggggagcggtgactgcaggtgcagaatgctgtcctagagctgtgttgcctggagaaatggtcaacccccagccctcaggggtagcccctgtacagcccaatcctgtgcaccactttgtcccccctccctcccagggacctgtctgtagccccagtggaacctgccaagctttgctaagcctagaagtgggcaaagtcaggcctgggccctgcttaggagctcacaggctggtggtggggaccctaaggaaacctagagagtgtggacagggatggaagggagcacaggtggctggcaccagataaagggcccctggcacccgaggaccatttcggaggcagtgtctgcctcaggacacttcgggtccccatttccctcctgaacctccctgcttaccagcactctccatgcctgctctgccagcatcactgcctccaggcagcctcctctgttttctctctggctcctgctgtcacagctctgctcacatggggggtcagggcctggctccttctcaagatccctgcctgtgggcagagaccttccctgactcactctatgacctatgtccagccagtggcccaggaaaagtggaaggacaaacactaggcttgagaagcctggccccatggtggcagaggtgagggcctgggcttccccaaacccttggtctcattgctatctagtgagacaccccctaagctgggttaggacaggtgcagggagacaggtgaaggaaggatggctttgtcacccataaaacctagcccacctgagaccagcctggccaacatagtgaaaccctgtctctactaaaaatagaaaaattagctgggtgttggtggcaggtgcctgtagtcccagctactctagaggctaaggcaggagaatcgtttgaacccaggaggcgaaggttgcagtgagccaagatcgcaccattgcattccagcctgggcgacagggcaagactcccatctaaaaaaaacaaacaaaaacaaacaaacaaacaaaaaacctagtctacctggagactgcagccagactgcctgaatttgaatctcatttcacctcttcttgtgtggccctgggcaagtgacttaacctttctgtgccttggtttcctcatccgtaaaaaggggatgccaacagtgcccatctcacagggttgttttgcacagtgcctgccacatagcaggtgcccagtcattgtgagatatttctattattgttcctttacaggtgccccaaggtggcccctggattccagagcagactccaggtgccaccaacctcaggtggtttctgttggttagagctggtgaccctgagcctctcctggcagtgggaacatgcctggctgccttccgctctgtctgctccttcccaggctgcacgattgcccccaggttcctgctctgccacagcaagtcagggtgatggaatctgggaatcgtgactcccaagctcggtctgtctctcaaggactggagaagtgtctggggccagagccctgatctggggcccagatctggttggatctgcacctcgggtctgccccagctgtggtgcttagtgttgggagaccctggttgggagcccagcagacctagggcatcccatcggatccgtccacttacttgccttgtcaccttggacatcactgcgctgtcctgggctcagcctcctcctctctgggatggggcagttgtgtgtctgtcttaggacactggctgggaggatctgaagtggagggacacctgagtcacttcctgctgtaaaccctggtgatgccaggtggtagctgtttctctttccatggcatgatgtggctggggtcctccgtatatggaagcccctctcccttcccggtcttgcctgccctcctggcctcagggaacagatgctaagtcatagctccctctgggtcagaggatgggctggatgtggggtgtggtccagggctgggagggaagacaggagggcagcggggaggagagggaaagtcccttcttcctgcctgtgcttcctgacggggtgccgttggggatggatgagaccaggcggcctcactgggtttcctagacctgtgctctgcagaagccgccgtgcaggttggccgtggtgcaccctgtagtgccaactggaaggaggggccaggtctcaggagctgctcatgcccttgggggaattctagccctttctctgaccctctaaaactctggttcttccgggcagaggggacagcagggtccccatcttggtgggaactaggagccctcttccccattctcccttgcaactgctctgctccacgatctgtagagtccctacacagccctgctgggatgaccatttatctcctctgcacaggtgaggcccaaagttgcacagcagggagcagacattcaaattcggtcttcctgcctctgccaccctctgctggccgcctgtggtaggaccgcagaagctcttgggatggaactagctcaggagcgcctgctggagtggaggcaggcagagggctgctgccatctgcccatgctgtgtggcggggacatggtattacacctccctgggcctcagtttccttatctgtaaaaggggatattgcccacttctcagtgccttggtgaggatggattgtggtgtcagcaggatgcctggtacatgaaaggcatgtctcagtgtttgcctgtccccaccctccaccatacccacagccactggggagcagtggcttcctcagctcagtgaggcgatgggagaggaagaggggcctgctctgttccctgggccagggctagggatcaggccaggccccacccccagctcaggccttggggagggatgattacagctgagggaacacagggtgagctgacccttcctggttgcatctcttggtgctggagccacccatagaggtctgggcatagcttcctagcacctgaaaattgaaggagactttcattcgctttgggtcaggccctgggcttgatactttacatacactgattcctcctcgcaaagtagaaattattggccatgcacattggctcaagcctgtcatcccagcactttgggaggctgaggcgggaagattgcttgagctcaggagtttgagaccagcctgggcaacatagtgagacctcatctctacaaaaaatttaagagttagctgagtgtggtgtgtgggcctacggtcccagctattcgtgaggcttaggccagaggatcgcttgagcctaggaggttgaggctgcagtgagctgtgattgtgactgcactccagtttgggtgacagacgagaccatgcctcaaaaagacaaaaacaaaaacaaaaaaccccaaaatccaacaacataaagcaattgttgtttctattgtataaatcagaaagccgaggctcagagagctcgccagattgccgattgaggagctggaattcagtctccagtctgaagccaaagcccatgcttttccctttcacagcactgcctcagggggcttttaaggaaaatacccccacagcaagaagaggtggaaagcccaggccagagctccttgggcagggtcaggtgcagagggcacctggtactggagcccccctgggctgcctctctcttggcaggcagagcaaggggcttccagaaattaggaagggctgagcctgagagcagccagttgctcatggatcattcccgggtcagcggctgccctggccggattccctggctgcgtctcatggagcagcctcttgggccgtgcccaccagtctctgtagaaaataaaaatggaggctgggtgcagtggcttatgcctgtaattccagcactttgggaggccgaggccagcagatcaggagtttgagaccagcctggccaacatggagaaaccctgtctctactaaaaatataaaaattagctgggcgtggtggtgggtgcctgtaatcccagctactcaggaaggtgaggcaggagaattgcttgaacccaggagctggaggttgcagtgagctgaggttgcactactgcattccatgcactccagcctgggcaaaagagcgagactgtctctaaagaaaaaaagaaagaaaaaaggaaaaaaaggagtttttgctccacttgagcatttgcttgctgtgtgcctttgacaagtcacagtccatctctgaacctccattcctcacccatacaatggaatgacaactcctcgctccttgggtggcgtgaagacctgatgagattatgcgaggcaagtgccatgcggggcctggcccaccgctccccactggcccctcgctttgtgctccccagctgggatatgggtgtttgtcccatgcccgcacccccaccccacttgaacctgctgtacccctgtgggctggcgggggtgggcactcaggctgctggtgctagagaaggaagggaatggagctcttgctggttagggaggggcgcagcgggtaggaggaaggcagtgccccgggtccagcgctctgacgtcttcccacaggttcttcatcagcaaacctttagcggaagagcactctctggccaggaaggggagagggcatcccaggcaggaccgcggggtggggggcaagcggggagcagatgggccctatggggccccaagtctgtggtgggaggcaggtgaatcaccatgctgatgatcacacagcaagtctgtgtctgtcacgtctgtgtctgtcatgtctcctgccatggggggcatccgcatgctcctccgcccctcacgctctctcctcgccttctccgcagggcatctgcgaggacccccgcctctttgtggatggcatcagctcccacgacctgcaccagggccaggtgggcaactgctggtttgtggcagcctgctcgtcacttgcctcccgggagtcgctgtggcaaaaggtgaggcctcgggcagagtgggcagggtgctggggagtgtgaacgcagcctgtggccctcactgccagacaggcggaacctgattgtggcagatgagactttcaaaagcctgtgccagggatggggtgggggcccccagtactggccgagcgtcggaattgccatccctcacccttcagctgggcacccccaggggcaggtgctgggaatccgtcaggctcccaaggtcattctgatgtgtcccccccaacactgttggggacacttggcagattaatacacacctgtgaaatgtggaagctgtgtgcatcacatttagtgtgcagacaccactgatggggctcaggagacccctgacagacacagacctgctgtgtgactcagctggttgctgtcctcctctgggcctgacttttcccagttgttcagcaagggtggtttggtgatccccagcttcatgactcccagttccaagctgctggtgttctggaccagggccaaagggtttgggtgggaaagaatgggctctggtcctgcaacccaacctcctatcccagcacagttccaagctgctggtgttctggaccagggccaaagggtttgggttggaaagaataggctctggtcctgcaacccaacctcctatcccagcacttggcagcagggccttagattccgtgcacaggaggcagggaggctggagtggaggcagaccctggctccctgaagaattattggcagggactgcagggggactctggtcattgccccttgctcatccctgcccttctgccatcccttgggaggggctggcagtggggctgaggagcactggacatctgcatctcccaggcttggcagtgagcctcagcacttggtagctttggagctggcctcaggttactcatcagcaaaatgaggacaatcggagtagctgtctctcggggagtggtgaggataggaccagatgctgcactcaacatgccttgtgcggcatcgtgcttggccaaaggtggctgtgcctaccagcattatgataattaatatcatagaacatacaggtactcctgtgcaagacagagtttttcctcatcctctgaggtatcccttggccatcagagggagcagtgcccttgggcaaggctgagactctggtaggtgtcttgctcttgagtctgcagaacggggatgtgacctctcaaagccactccagggtgggcatccctggggcctagccccagtagtcctgcagggtaggagcagctgcctgctgtagggcccctggggccttggcagaggccatggttgcggcgtgtggatgtgggtattcgaggggcacctgagccaggagggctttcgagagccacccgttggctcatttcaattctacgcctcaaggcccagagagggctggggcctggttctgtgctctgggtgtagggccagtcctcactctccagcttccaggctcccacccccttctctgagctcagaacaaggtccccctgccttagagcccacccccccactagatgagggctcagtcaggggctgaaggggcacatgggcattctgtagggctgccccccacctcccactttgccctgcaattgcctgtttatctttcacctcccccgtgaggtgagctccccacaggcagaactggcccaacgtatatgtccctgctgagcccactagggacctggagtagagaaggctcaggagagttttgggaacagagctcctttccaaattgttggactcagctaccacccagcagccccacggtcggccttgctcccccagacctcccagggccttgtggtgctgggcctgactccagtctccccaggagaggccatctgtctggccgtttgtaggtgggagcctatgtgtcctgccctgggcttgggcccaagtggttcctggtgcagctccacctctcaacagtgaagaacaggcccaggactgcaggcaggaggcctgtcattgaggcctgtgtttatctgtgggccaaaggttcctattgcagggagttggggcacctggcctggctggtctgggaggctgccagggccaggaggctgatctcctacagcagcttgggtcccagggaggccagggcgggtctgggcgctcctggctaattgcactttgcctcctgtgctgctgtggtgctatgggtcccggaaggaggctcggggccctgcggagctcattactgcgccttccgtccctcgtccctgttgactgggctctgtttgttgtcacccctcactttctgggcctgttgccctgcagggcctccttgttttctccatggaagggcagtgggggggctgccgagcctgagctgcacccctgccctccccacctcacacttggggattctgagcctcagacacactgagcatcacatcctcgacacacacgcccccaacacacacgcccccacagcaagccacccttacccctcacaggattcgaagccagcctgacctggatttgattctggccgggtctcctgctagctgttttcgtcctcagtgtaaattgacctttccagtgcccagggtcgtggaggattaaaggggccggaggaaggcaaacccttgccttttgcgctctctgcacttgttactttccctccccagccccctcttagatggcccacctgtttctctgttctgtcagacatctcttggcctcctgccctgctcctacgggatccctgatgggggcattttagcttccccgacttgatggtacattccctgagggcagggcagtggacttcaggtgaccaggttttaggaacttgaaatcaggttgcgacagtttggctgaacatttgccattggtcctggcctggcctaagccaagatctgctgtgagctcacctctctggagcctggagcagccacaggggcagacctgatgcctgctctgagccacagagccgggcctgggcccaggaggagtcaggcagctcctggccaaaaaaaagcatggaagtgaccagagtcccagtcgaatgcctgggtgtctctaggagggagtgttggggtgagcaaccctgggtggggcctgggaggggccagtggaggcatttaaaaatgcctcccacagccaggcgcggtggctcacgcctgtaatctgagcactttgggaggctgaggtgggcggatcacgaggtcaggagatcaagaccaccctggctaacatggtgaaaccccgtctctactaaaaatacaaaaaattagccaggcgtggtggtgggcgcctgtagtcccagctacttgggaggctgaggcaggagaatggcgtgaacctgggaggtggagcttgcagtgagccaagatcatgccactgcactccagcctgggctacagagcgagactccatctcaaaaaaaaaaattaaaaagtgcctcccactatgtccctgaccgggttatattagcagttcctgctctttagttatcaagcagttcccttagtgcacatggatggagcaccagctatgccctgagaaccatagtaggtactggggacgaaaggcttgaaaaagtacaaggatgtacaaagtcacttaaggctttcattcatcagacacgatcagtgttaaggggtttcctgtgtttccttctagtttttttttttttttttttttttttttttattgataattcttgggtgtttctcacagagggggatttggcagggtcatgggacaatagtggagggaaggtcagcagataaacaagtgaacaaaggtctctggttttcctagacagaggacccttcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatctttcttagtgtagaacaaaatgaaaagtctccccatgtctacttctttctacacagacacggcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcactccagcctgggcaccattgagcactgagtgaacgagactccgtctgcaatcccggcacctcgggaggccaaggctggcggatcactcgcggttaggggctggagaccggcccggccaacacagcgaaaccccgtctccaccaaaaccagtcaggcgtggtggcgcgtgcctgcaatcgcaggcacttggcaggctgaggcaggagaatcaggcagggaggttgcagtgagccgagatggcagcagtacagtccagcttcggctccacatgagagggagaccgtggggagagggagagggagacggagagggagagggagagggagacggagagggagacggagagggagagggagagggagagggagttccttctagttttttttccacttggtgttaaagaggattttgcttgttttggtttttttttgagttggagtttcgctcttgtcacccaggctagagtgcaatggtgcgatcacggctcaccgtaacctccacctcccgggttcaagtgattttcctgcctcagcctcctgagtagctgggattacaggcgcctgccaccatacccggctaatttttgtatttttagtagagatggggtttcaccacgttggccaggctggtctcaaactcttgacctcaggtgatccacccgcctcggcctcccaaggtgctgggattacaggcgtgagccactgtgcccagccttgttttgtttttttatatgcatttttgcaattacatctgcaagtttagagcttgcttttctcctctgtattcattgctacatccagccttgggtgggtcctcccaaggtgtccgatggctgagcagaggtctgtggacatcagtgggccctgtccccagctgcagcctcctgcatcctgcctgctcccttgcccacaagcctcagtccaccccctctgcctcctcccctccctcttccattccttttccccccaggccttcccttggctcccaccgctcgtccctcccgcccagtctgtgagactcaagctcccgtcacaactgccccccaccttcggcctccagaaggtcggtgcccctctgctcagaccctccccaggggtcttgtgcccctaaatcctcatcagtagaagttgatcacacccacctcatcccatccctcaggatccagaaataggggatcctccttcccagtgctgcccggaccacagcgtccccatacaagcacttggctccttcactggactcccaccctcagcccactgtgttgctgtctccaccagccagctgccctggccagtcacctgggcacaaagggcttggttcctgccattttccagcccattctaccccaagaactgctgtgtcccaggctttactgtgtccatgtggctaacgtcctgccctctcgctttgcccttttacccttgtcttagttctccatctcctttctatcagccttcaccttcagccgcctcagtcacctgctgccatgccacagcccgggcccggaactgctctccctggaggtcttcagccaaaggcccagtctctctgacctcaccttccagccatcttgctcacttcattttggccctggccagtacctgtgtactgtctccccacctgcccaccttcctcttggccttgggcttgtgtcccgtggtccatcacatcacctgtcccttgtcagtgtcattcactcattcatccgttcattcattcattcattcgatcattcgttcattcattcaacaagcatttctgaggcctctgtgtggcaggccccgttctggttgctggcctagagtaatgacaagacacacttcctaccctctcaggactgtgtgtcacaggcaaaaactgagcaactcaacaaataaaaagcagaatgtggtgctgggaaggttagaaacagctcccccatgtggaggaaagggaagcctcccatggtagttccttagccaagttgttcccctctcccctgcccctccagctacaaagcaaaaggttctgtgaggatcaggcagtttgacatctagctgtatggttctctcaaatacccttgggggaatttctgccaatgacccccagaactgaccccagggcttgcagtgtggttttaacaggaccgggtattctgtctcccttggtgcccctctgctgttcaggtagcccaggatcccactgattgattagccaccatctcacaattgaccgtgcttgtggtccactagacccttcagattgttttccgttgtgataccttggccttgactctgtcctcttttctgtgtgtggcgtgttgtggcgacggccgctccccaactcccatccccactctctccccaactccggctccactcacactccagttctttcatttccccagtataaaggctgagcttctggttccgccccgggccctggggatataaacatttgccagattcttcctcggcccctgggggaaactgaggattaattcaggtggagtaagtggtgggatttgggtagaagtgaagccttgtcctgttgtggccatggtgcagggctgcggcacagccagccatcagtgtcatccgggtcagtaatgctcaaggcacagtccctggcccagcagcatgtcacctgggaggtggttaggaatgcagattctcaggcccacagagccctgataaaccaggagttctgggagggggtccagcaatctgtgtgttaagtcctgagagtgagtctgatgctcactcaagtcttgagaaccacgggtctgggtgagagatacggtagctgggctgagatcctgtcaatgggactggaggggaagggtcccggggtgtttgggaagcagaatcgacaggctttggtgattgggtgtggaggagtgagagggaggcgggcgtcaggggtagctccaaggtttaacttaggtgacttcagatctccaatcaccaagccctctctggtcctgccttctccacctgctcctgcgggtcttgcatcttctcctgtgtacctccagtgaggagtggtccccaccaccctccccatcagtgcacttacgaagtgctctcatcttcacaaacaagccagcacccagcccagccctggtagtcagggcggttgccacagcaattgacatcagcgacctggtccccaaggaacctgccaccttccgcctgcctgcagggcctgcattatcgcttctgcggggactggagtggaggcagatggggactcccacccctgacacacaccccattttgagaactgagtggggctgggaagagccagtggcaaagggaggggaagagggaagggcagaaagtaggtggggcccccctttggtggcctcttctctccacggccccaggctccagcccacttgggtccttggcgttggtggcagcagcacttgggccatggcggaggacaggccgcagcagccgcagctggacatgccgctggtcctggaccagggcctgaccaggcagatgcggctacgcgtggagagcctgaagcagcgcggggagaagcgccaggatggggagaagctgctgcagccagcggagtctgtgtaccgcctcaacttcacccagcagcagcggctacagttcgagcgctggaatgtcgtgctggacaagccgggcaaggtcaccatcacaggcacctcgcagaactggacgcctgacctcaccaacctcatgacacgccagctgctggaccccactgccatcttctggcgcaaggaggactcggatgccatagattggaatgaggccgacgccctggagtttggggagcgcctgtcggacctggccaagatccgcaaggtcatgtacttcctcgtcacctttggcgagggtgtggagcccgccaacctcaaggcctccgtggtttttaaccagctctgacagcagctgccagctgctgctctcctctagcccacctgtgctctcccctgcccctgccactttcccccctgtatttttggggccattattctcgctgctcagcctgtcctctgcttgcccagaggccccctgagtcccacacctttcctcctctgcttctccctggggccagcactccagctcacaggaagaagattctgaggctccatagcctagaagctggactggctgctgcattgctatagacgatagaggcctactaggggccagtgtgcatggacagtgaggccagggccatctgccttctctctgcttcattgtgggagagagagactgagaaagaccaagagagacacagagacagagattgaaaaacccagcatccacttcctccagagtcagggagacagagatgatggggcgtctccacggggagtccagcaagccggcattcactgctccctggccttggtgccctttgccggagcctgtgtctgggctgctggtcccataacacgtcgacaaccctcaggatatggggcagggttgctgcaggggtggatttgggcagtggagagtggctggcaccctggaggctgtgtaggcccagctgtggctcttctgggcctgacttcagggtggagaagtgaagggggaggttacacagagatctgtctctacgcacacatatccatgagacagagtgtgctgtattcatatggatgtattctagaggtctattcctaccctaggaacaagtgcagttttagattatctgttcatcattgctgctggttcaaggatggctcttaacaggggcctggtccggatgaccttggcctgggggcttgctgagctaggagactgcagttcagatagtgaaacagggagtggattagtaaagggggttccctttgccttgagggaagttggagctggagagagtggattctccagggcctcaggtatcccctgctggggagtcaggctctttagagcttgcaggtcagggaaggcaagtgcttcgtcctgacatagcatctgttggcatttcttgggcttcttcaatgcagctgaggggggcagggcgaaggcgtggtgggcagttacgacggctgatagtcccaagtgggctgcaggcggcagtggtgtgacggcagaatggtaacctctggggtcattggatgcaactcactcaccaaacagatggggaaactgaggcacaattttcatcagattcagttctgactcttagcctcattccccttcgcattgcgcagtcccagagagcccccccttttgggggagtgcctgacctgcacctaacatcagccaagtacagctaagccactgtccccagcaccctgacttaaggccagccctgtgttttgtcctcagccagtcagggatgtgtccaagacatttcccctcatgaagcaaagctgtcaaggaacttgcggctctggaacagatgcactgagggccagagggtcagggccatcccctgtggctggggctgccgggagggtgagccccacctcggaggtgtgcaggctggagcagcatgctggagctgagattctgtgggtgagagagtgggagagtgtctgtgggctgagcactggtcctttctgactcacagctctggggcccattccgggacaggcttgaagaagtctcggccattgcctgccctgctgagcacgaggggaggccagaaccgtgtgcagtggccctgcccttctgcttgagctcttcctgcagctctggggaccctcttagtcccgactgcctgtctccccagcctatctgtcccggggcctgagtccctctgctgtgcccgctgcaggtccccaataaagcctgtgccctggcctcggtggtgtgcagtgtctcgccatcagcccccatccctttcacaatccctcacggccccgagcacttgctccctggccacttcccacactcccccagcccttgccaccttccaaggaggaggcctggaataatcaggggcttcaccgaatctcctgaggctggccaggagcctccggccctgactgtttctctggtagccccagagctgcctccgtgttgggtgtgcagagagctgtgctgagggaggtgccatctgggcgccgccgagggcttggggtaggaaggcaccaaaccaggtgcaatctcgagtctccctgccttgcagggccactgggcagggggtggatggaagggcagagtttgagaggtggggtgaggtccggcctgtgcctgggtttagtctggcttctgtcactgatgtgctgtgtgtcctcaggcagctcccaaccccctcccagactcaggccttccagagtgaacagcttggttctgtgaaggtccttccagccccaccctccaggaattgtcaaacctgtgctgggctagactgacatgggcaagatgtagccccaaggccacgtgacttcagtgcctcacttgatccttcctcacagctctgttccctcatcaccactctgaagcgcactcatttttggacagggacaactgaggcccagaggaggcggcctcctgcccaggtcacagagggcgtggaggggctggaagcaggtgtgggtgggccaggctcttggcctgtggacctttggccccatgacactggtccctgggatggaccggggagatgggccccacccacctgagaacccaggctcgggttgggctggcttctttcctggagaccaagtcaagccctgccttgggggtctcaccagtggttttgttttggaatgagccctgcttcaaaatccaaccccaccactctcctgggtcacacagcccctttcatgcccgcctcagagtagctgctgccccctggtttccctttcacacacccctcacagcatgcgcagaacccttccccagccccgcacccaacccccacccccggtctctcaggggtctctgcctccctgacaccccctccccaagcttgccttccagccactcctggagttgcccgagacagaggaatccagcctcccaccctcaggacagcagtagaagcctggctctatccccagagtgcaggaatggcaaatgacccattttccctggaaaccacagggaaagaaacctgcctttccctgagctctgtgcccagagaggcagctagtgtggtgagcgacctagccagccccgccctgccagctggatggccttgggcaacctctgagcttgttcctcatctgtgagttggggccagcaatggcacctctctcgaggctgttgtgagggtgaaatgggcgagtgtccaccaagtgctcgagcttcccggagcctgcacacagtcaccctccctccctgagtttgcccatggttactgccccatcaccatagacacacggtctcctctctcagttatccgtgggtgggggtacaggagaacctgtggagagctgaagtgagttgcctgaggcatcctaggccagtgccgatggcagcaggcgcagggcggaggggtgggcaggaacctggcctggctctgtggtccgagagagcggccatgggggagtgtgtcctcctccgtcaccatcgccacctcagagcggcccagcagagaccattagccttcacatgattgctggggagctggaggcccgggggaagggggactcccccaaggctgggggtccctgcccggtctcagccaccccatgaacaggacctgccgtggccactctgtggtgcatcgacaccctggtctccggtggagagcagcagggctctgctctcccaagaaggcagggggtgcccaccactttcctgccctcctgcagtcatggcatctgaaacggggagtttgagagtcttggaatcagaagctgagagctgaggaatctcagatactcaggaccagggacccactagttttgaggactcacaaaggcccgtggcttaccttacccagcttgggttatacaggaaacctccctgtagcccccattccacagccctggcggcgtggctcagaaacgctccgcactggccctctggggtcccaggcagaaatgtgaaaagctccctgcctgtgccccacatctgcacacaccacctccacacacgcacacacttgcaggcagatcctgagcagcttccctccctgggctgccgaccccctccttctccactctgtcgcacagctgggcagagagtcctgtctgccactacccggggaagatttaagagcagccacttgggtctaggtgggagtctccagggacaatccaggagccagggatgctgtggtgcacccatgggtgggacccggaggtttctgggcccattctgccgtgggtggccgttggtggatcacatcccagggggttatcagggaggcggcagatcctgccagtccttgccttgctgccaggtcagcccaagtcagtaaagcctcgtaagcatgcagtaggtgatggggagcttctcctttctcctcttgggaaggaggttgaccaggtcatctcagttccctcccagccctgaggttttcagactgttgtgtgaaggcacacatgtgtacaccaacacagatgacccctcatgtgtgcacagctctctacagtttatgaaagagctccaaggctgtctcctttagttctcataacagccctggaggtagtgtaggtagatgaggagactgagactcagaggtggccccgttgaaagtgaagtcactgccatgcaccgcagtgggtaatgtggtattaagtagtgtgtacaggtcaccagccggtcaaggctgccctgtgaccagtgtgggggattttcctcccaggaagactccagccagctttggagctgggccaggccctgtgctgggtgctggagatctgagaattagtcagacttggcccctgtccccaaggagctcctcccagtgggcagggaaaagagagccatgctggggtgccaggaaaggggctgcctgactgttgggggggtgctcagcagaaggtgcctcaaagctgctgctcagctggcccctaagagacaagggaaggaggcagagggagccacatgtgcgtgggggaggtggcttgaagtggcatgggtgtttggtggttgtggtagatgggacccgaaggagggagcgttggagggatgaggctgagagcgtggactgccgggccaggtggctggtgtccgtggtgatggggaatttctactgtagacagcgagagggtagcgagcacagcctgatggactcctcgcacccatcccttcactttgacacttgccagcctatggctagtcttatttcctctacacacccctgcactttgcccagacagcatctcatttcatctgtaaatatttccggatgcatctctgaaagataagggctcaaaaaaaaaaaaccataataccaacttataaaataatctcttaatatcatcaaatatccagtaattgttctaatttctaatttgtgctataaatatgcataggttttacggtttgtttgaatgagatccaaacagaagtccataattgcaattggttgattgctctttcatcttttattttttcctagtaaattatctatcaaagaaatggggccgtttgtcctgtagggtttcccatggtgtgggttttgttgactgtgtctttttggtggtgtttgacatgttctctgtcccctgcgtttctgtaacctgggacttagctccagaagctcatacggtttaggaacaatttttttctttctttgtcacagctgcatcatggaagatgttgtgtacttcattcgggggcacatcatggctagttatctttcttttttgtgatgttagaaaccatcagtgaccactgcctaaattcattcattcttcagtgattgtaaaatgctggtggtctaatatcatcagtcctttctcatttatgagcaggaagtctcttccagttcaagacttccctccatctactatttggttaccatctggtacagtttgtctacagagacaggataaatttcctgtaattttccagtttcaaaaaaaaatgagttgattccctacccacctccgatagtgactaattgtttttgtaagtatcattctgatctcatgaattggaacatatttgatgtgttttaatccattgctgtttttgcccttattgatgctcaaattagcccatctttggccatcaggaacctcttcaggttggttcctgaatcctttgacatggccccgggagtctgtgctggcttccttggtttccggcgtggcgtgggagggtttttggtgtgcgagcgcatctatttagacagtctccctcctgctcagcatcctggctgacagcagagcagctgaggggtgagaaggctggcttggggcccaccccgtgccaggtgcaggggcggtgaagcaggaggggaaatggaggcccttggggatcccagactctgggtctccaggccctggagcctcattagcagcttcttgagccacagagggctcagagccaagcctcgagtttgactaatgatcctcccgaggtcctagcagcctgtgagggctgcccttcctcccagccatggagtccagagcattcagaacagggcaggagcagaaggagggggtgaaggtgatgggccaggcctgtgttctcagcttaggactccctgtcactctgtgcgcttgggcagatcttgtttctttctggacctcagtcttcccatttgtgcagtgggaatggtaaccctcaccttgtatggaaccgctcttttttttttttttgagacagagtcttgctctgttgcccagctcactgcaacctccgcctcccaggttcaagcgattctcatgagtcagcctcctgaatggctaggattacaggcacgcaccaccacgcccagctaatttttgtattcttttttagtagagacagagttttaccatgttggccaggctggtatcgaactggcctcaagtgatccacctgccttggcctcccatgagacgtgtttttgatacagctgtctgtcctgaaagcaaagtggggagagagtgccaggagtcagggcatttttacttagaaagggcacagagttgacagaaaagtgggggtgaggaggtgggggaaaggaacagccagtgttgagcccttgctgggttccagacagtgaggttgggaagtcctgggtttgaaccctgcctccctcgcttgagcctgtgggcagccttctgccagcaccttccggtagtattgcctcaaaagcctgtcctgaggctcaggggtgctagtgtgagcagcctggccctgtgcctggcacccaacagggctccattagggcagtagtacctctcgctgcagttagcattttcattttcttggtctcacatgtcccattagggagcatttccctttgccaacatcccttttgatggtaagagttttgtttgttgatgcaaacaaaagtgtccttaatgagcatgcagtggggagcagcttttggctgaagtctgtacactcaggtgagtgccggcctcctggtgtgcctctggttcctccgcctgggtgccccccatacctggagtggttttcttctagaaagagctgcttatggtcctgatggggctcagctccacttggtcccgtgcccagcagggccaggggtcattcaccctgacttgacagggtgaggggttttcccttctctgcccagattgtggctattgtcctcatctgcttgggggacgcctgtagcagcactgcggatgctgctgagtagggtctggcactcccttctggtatagccccgcctgcaccctgtgtagcctcagcactttgcctgggtgcctcctcctctccccagactgggagccttttgagggaagggaccatgtgattcacctggttgtcagtgtccagcttggggctggttgcagagtggtccacagtgccaaggagctcatttttcagaggcagacagatctgggtttgaatcctggcttcaaaccaaggttggtctgcctccaaagcatgtgtgtattttctagctgggtgaccctggacgagttacgtgccctctctgggccacagtattgtcatctgtgaagtagggctggataatagtcatctactcagaggttattgtgataattaaatggagataagtcatggtagtcacaggcatttcccagatgcgtcataagtaataaaatcaatgtctcagtgtccccagtcaatgtctttgaattcattcattcagtcaatgcatgtttactaaacatactctctgggtcaggccctgggctaggtgctgggtgcatagcagtgactgagacctatatggccctgcccccagagaactgacattcccagtgtaacatcagagctcaaagtcacagagttacttaattataacttggtaaaggtaagtatctcagatgagagctgccaagggccatgagactgagataggggtcctggcctaatctgaatagtcagggaggcttcctggagaaagaggatggacactaaaggacaaatggaagtctactgagtaatgaggagaaggaagaacctggagcagggagcaggggtgggggctgctgtgggggaggcagagaaatgaggctgggggagtgcattgagagtttgtgtcttattttctagggaagtgacaggactgggttggtctatgtggggcgagagtagatgtagctgcagacactgctacagttgtccctgggcgaggagatgggggattgggccagggtggtgccagtaggatggagaggaggagatggatttcaggagaatggaggcgctcagattgggctgactggatggagggagggaaagcaaagcagccagtggggctgccagccttggggtgggctggatgggtggatggtggcgctggtcactaggcaggagctggtggtagatgtggacggaagtctcggggaaggttgcagggaggcatgagaaagaggaaagctcacacactctgagaacaacagctggaaggaggccgagggagcctccaagcctcgcggagatgggaacctgagcctggagatggggaggattcatccgggtctcacgaaggcttgtggcagagttggaatccgaacccagtattcctttacattccgattcgctggaagcacacgcccccatttcctcaggaagccggacatcccctcactgtgttcccccatcctatcccccctccccctacccaggtcatcccagactggaaggagcaggaatgggaccccgaaaagcccaacgcctacgcgggcatcttccacttccacttctggcgcttcggggaatgggtggacgtggtcatcgatgaccggctgcccacagtcaacaaccagctcatctactgccactccaactcccgcaatgagttttggtgcgccctagtggagaaggcctatgccaagtaggtgccagcagcaggcaggtgggtgggaggcccagacgggggtggcaccggatgggctcctcgtggtattccgttagccagggctttaggcacagagaagtgaggggctggtgcaggcacgcagcaggctcaaccgccaggcctgagggcatagtcagctgagcctgtgctgggtggggtggaggcctgggccctgtaaggagaggaatgttggttactcccattttagggggagaagactgaggcccaggcaacatcctgtaggtagctgggggcagaggcagcactcacatttaggaccattctcgaaggttcatgctgccatgccctgcctggggccttggttggggaagtggtaactgagctggggcctggttgtgcagggtgggccacgtgcctgccttccccgcctgctgggcctccctcttgtccaccatccgcctctgcctggctgactgtccattctgtctttgctgacccctccttctgctccgtgccttctgcttctgtgtccccagtgcccaacacagagcccagcatagaatgggcacaagcaaagttttgctgagctgtggggaaccctggggaagagtgactcgcgcaggccgttgcagggcagggatacgcctaggccaggagggaggagggaggaggggcagtggggtcagaggccagcctcgccagctctaggtgagccactctctggttcctcctgctaggcccatttgtcaatcttgctgaaaaaatgtgtgtgtaggggcaggagcaaggagagagagagatagaaaacaagagaaagggggagagaggaaaaggaaagacaaaaactcccaacatcaaaaacccaagaaaacacattggcaggttccactttcaatcctaagaaaggaaagccagccccctggtggccactgagtctccaccacctggatgcaggcttgtcttccccactccacaggagtcgacccagtggccttggttgttttttgttttttgaaaaaacacagtttcattgtggtaaaatagacaaaacataatgcttctcattttaaccatatggaaacatacaattcagtggcattcattatgatcacagtgctatgggccatcaccactatctatccccagaaccttctcatcattcccagcaggaggtctatacccatccgacagtaactccttcccctccccctgaccattgttggcactttggaaaagagttgcttttttttttttggacagctgattttttaagattgagccactaaggcttaggggaatttaagccttatatgttggcccgagtgttaagaactgggttccggtgttggctccgccgtggcctgctgcgtgactgtaacaggttgtttgacccctctgagtttcaaaaacctcccctatgaggtaaaggatgcagcctggctggggagcatgagctgggaagtctttccacattgcttcccagactggcaggctgttaccaggccctggatggaggcaacacagcagacgcactggtggacttcacgggtggtgtttctgagcccatcgacctgaccgagggtgactttgccaacgatgagactaagaggaaccagctctttgagcgcatgttaaaggtgcacagccggggcggcctcatcagtgcctccatcaaggtgagaacacggcagtccccagaggcgacccctccccttcaccctcgctgactgagatgggagacaactgtgacatcccacgctcaggtcagctcctacgtattcagaccctcagcctcgtgggggaggggagaagttggaaggtgcaaccccctgcccagaccctctaggctgtgaaaagcctttcccgcactgttcaaccaaaacttcttttctgatcctcttgggttatgaacgtctgtgcatctgagggtggtcctgatttcattacttgctcgtgttttggatgagaaagctgaggcccagtgaaagccaagttcaaacccaactttagcagaccctgtgctgtgctggtaaactgcctccagcaaagtaaaaagccccggtttgtagcatttgctaattactgtggtgtaaatactcccaccatggctgatttccaactacccacatttaacaaccagctattaacaatattcctggccgggcatggtggcacatgcctgtaatcccagctactcgggaggctgaggcaggagaattgcttgaacccgggaggcagaaattgtggtgagccaagatcgcgccattgcactccagcctgggcaacaagagcaaaactccatccaaaaaaaaaacaaaaaacaaaacaatgttcctgaatatttaacaattcctggaatatttaacaatttaaatattcccgaatatttaacaacagctgagccagtgcacgtgggccccagcattcccctgggctgacccactatgggcaccttcctttactgagactgctgcccatgggggttttaaagctctgtgaacacagcactgccccatgactgcaattcccatcccatcctgtaggtcccgtgcagcctcctagccctccagcacctgagtccctggtctgggttccagtgtggccctgcctctctgagcaactgtgtccctccacaggcagtgacagcagctgacatggaggcccgcctggcgtgcggcctggtaaagggccacgcatacgccgtcactgatgtgcgcaaggtgcgcctgggccacggcctactggccttcttcaagtcagagaagttggacatgatccgcctgcgcaacccctggggcgagcgggagtggaacgggccctggagtgacacgtgaggcctggggatgggggtgcaggcacagggcatgagggcttggacaaggacgggtgggcttcttggaggagttggcactggggctgggccttgaaggatctgggggaggatgacactaggaacgaagaagggagaattactttgcagtggttgtatggggtgatggattgagcacaagaaaggcctggggctggaggccatcaggggtgtagagaccagcttggtgagtgggtgcgggaggggagcagggagggaggccacagccctgagcaaatgggggactcctctgtgcttggcttatggccctggtaaggccaagatgggagtggagcccaggtgctaagtgaaggagccctcttcactgggggtcgcaccccccttccccccagtctgcagctttactttcagacctcccagcccctgtcatggtggcagctcacggtcccttgtgggaggagacaggcagggcttcctggagaggggctgggcatggcctcagtgcccctggccacaccgtgccgctggaggcctggtgcaagactgcccctcgtgcctcctcgcctttgccagacagattctggtggggctgcctcttagacagctccctttctcctccccggccctgacaccccagctcggaggagtggcagaaagtgagcaagagtgagcgggagaagatgggtgtgaccgtgcaggacgacggtgagttctggtgagtgtgtatgtgccctgggcgtccggggctgagggggcttcccacgggcctggcggggagcaccaggtggggagtcaggagccaggcctctcctgcatgccccatcatcaatttgctgtgtggccttggacaagtcacaccatctcagagcctgtttcctcctctgtaaaattagttgggcagtaccaggccctttcatccccacagtcccctctgccgaactgaggggtcctggagccgctgtggcacccagaccgagcctttggcatgcaggtcagggagccgtctaagaggtgggcccaccaggatctccccggcaagggtaaggaggcatgaagcacagtccagcaccagcagtatggtgtggccaggggcactggggctatgcccagcccctctccaggaagccctgccctcagcctgcctccaggggccctctggcagcctgatttctgaaattaggtagcagaggctcctagaggaactagcttctaagctgagacttgaggtacagagtaggccttggtgggcaaggaagaggacgtggctcagaggtgagagaacacagctgtgtttgagaagggagctaagcaggtacatgggtgagctgggaagatgacagcagctcagcttaaagagcccagtaattggctgggtacagtggctcatgtctataatcccagcactttgggaggtcaaggtagaaggattgcttgagtccaggagtttgagaccagcctgggcagcatagtgggaccccatctctacaaaaatgaaaaattagctgggtgtgatgatgtacccctgtagtctcagctactctagaggctgagaggggaggattgcttgagcccaggaggttgagtttatagtgagccatgatcgcaccactgcactccatcctgggctaaagagcaagaccctgtttcaaaaacaaaaagaaaaaccccagtagtaataaaagttcatcctgcattcatccagcctgcatgagtcctgaatgtgggctaggctcagtgtcacccttcagcagaacctgatatggaaactcagtcccttcctggaggggtattggcatcctgtgtgtgctggattctgtcagggcccccaggcagactgggggcagatggcagtggtcctggcacccaatgatgaacccttctgcaggtgtcaggtcagctgctgcaggaggccacccaggccactttgccagtcttgctcaggagtcagcagataaaaacacggcagagctccttgcctttagaaagagtttcttccaaaggcctttctcttacatgttcacggttaattcactgccccctgcccccaccagctccctggaggcgttcacagtgtgcagtgaccatagcaacaccctggccaccgcagcaggctcaccatggggttcccaccatccacttactcaggcctctcaacagccatggaagatcctggatgcagatgtgctttataaactgtacagggcagcagacagtagttattaacaccattcacaatagtaacagccagcgtttgccagtgcgtgctctgtcagccgaaagttgcactgcctgctttgattgcattacctaattccttcactagctctgagatgggcacctgctgttagattcagcctcattttacaggtgaggaaacaggtcaaaagagaggttaagggtctgtgcaatgccatgcctgtgcccttgtgtgggcttagctcccctctcaaagccagctgtgttctctcacctctgggccatatggacatattaggttgttgggctggggggccaagagcctggggaggtgtgggggaggtaccctgctcagcccctccccacatccaggatgaccttcgaggacgtgtgccggtacttcacggacatcatcaagtgccgcgtgatcaacacatcccacctgagcatccacaagacgtgggaggaggcccggctgcatggcgcctggacgctgcatgaggacccgcgacagaaccgcggtggcggctgcatcaaccacaaggacaccttcttccagaacccacaggtgggcgttctcaggaacccccaccctgccctgtagcagctgcggggtgccttgccactgtcctgccagggactcctgcatgaccttgggtaatccctgtccttccttgggcctcagcaaacctgtctgtacagtgggggttagatgggcacatccgtcccatctgggggtcatgaagcccccagcctcacaatctaacctgcagatggtaaaaatgaggaaaccgcggctctgagggacatttgggtgtcttgttctgagctacagggacacttagaggctgagccagggactcagccccttgtttccacaacagcacaattctgtcccttctgggaacttggctgggctgggcttccccacggggcctctccccacagcctcctcagtctgacccgtggcgctgcttagccctggtgcttggtgtgcctctgttgagcaccacctgtgtgccaggctctgtgcagagtggccaccctggcattgagtttccccagccttcatgcagggtagccattgcaggcattggtaggcccacctcacagcagagggaccaaggcgcagagaggtgctgtgactggtccaggctctggagtctgagcttccgggagccagccagcccatgcctggtgtggtctcattgcagtgtctctctctctccttggccacacctgcagtacatcttcgaagtcaagaagccagaagatgaagtcctgatctgcatccagcagcggccaaagcggtctacgcgccgggagggcaagggtgagaacctggccattggctttgacatctacaaggtgaggccagccgggtcccctgccgtgggtggggagagggagggagctggagtttggactgcccatgcctgaggaagaacgctctagaacaccttggtcactgccgctgccctggctgccgtggcagacattgtgaggatgccgtggcatgggccccacttgaatattcacagagggcccagcctgcccagccttggcttctgtgggagctctcagcctgatttctttctgcctaagacccacaggcctgggatgtttggtggatgaggaaggggaagattactggtggttggggccgggccctgggaggctctgggcatctactgggcccccactgctcctccctcaggcctcagggccccttgcagccccttagccttcctgcattggaggccttgctgggcaccaggaggaggcatccttgagcatagccaggtggggtcacctatggccgcaccgcctggcctggaacctgaggccttccacgtgttgtgatgcccagtgtgtggtgacagtcagcatggcgggaccccatgtgcctgtcagaccttgagaacggaatgaagccaccgggccctgcagaggctgggtacatgctgagtccttggcatctgatgtgcctggccacgccgtggcactttgtttatactcttgtgctggtacattcattgcatgctagtgtcttgtgacatattgttgtgactttgccatgtgacgatcttcactagtgtgaccagaacacttttttcaggattgtcaggcaggtcctggcagctggtgatggcatttcgtggacaggtgctgtgacctctgcagatcctgatacttggttgtgctgttggagtcagaaaccccactgacattgttaccagggggattcctattgccctctattttttttgtttgtttgttttacagagggtcttgctctgtaacccagaccagagggcagtggtgctgtcatagctcattacagtctcaaactcctggactcaaacgatcctcccacctcagtctccctagtagttgggactataggtgaacaccaccatgcctggctaatttttaagttttttgtagagctggggtctcgctttgttgcccatgctgaccttgaacgtccagcttcaagtgttcctcccaccttggcctcccaaagcgctgggattacaggcatgagccactgcgcccagcctcctttaatagtttttattgagatataattcacagagcatgcaattcagccatgtaaagtatacaatctaatgacttttgtgtgatcagagtttatgcaaccatcaccacaatcaactgtagaacattttcatctccccaaaagaaacccactccctttaaccaccaccacccattcccattgacctcttcccttcagccctgggcaaacacgaatccgcttctgttattatagatttgcctgttccggacatttcatataaagggattccatcgtcccttccatggtggtgagggggaggcggggtgggccagggtgttgtagggtgtgtctccgcgtggcccagcccctcccgcctcctgcaggtggaggagaaccgccagtaccgcatgcacagcctgcagcacaaggccgccagctccatctacatcaactcacgcagcgtcttcctgcgcaccgaccagcccgagggccgctatgtcatcatccccacaaccttcgagccaggccacactggcgagttcctgctccgagtcttcactgatgtgccctccaactgccggtacttgggggctggcttgaggccagtgtgggtgggagtgacattcacactgggccaaccaggaacctgcagcctcagagatgctcagtgtctctgggcctccagccactctgggctgataccagtgcccatctccttcccttctcttcccttgttcccctgtcccagcatccctggccatgactaggaacagcttcttgtatgtgcactgcactctacagttgacaaagaagctttcactcatcttgatcttcctgcatccctgagtgggaggcctgactcccgcactttaccagtgagattcaggggccgaggttagaagggttgtctgaggtcatgcagccagcggtggagatgggctgggccacccagcctgcctggttccagggttgggtcttgtcaccacaatttcctgtcccatgggggtggctctgggctccagtggactgctgaagctctctcagtccttgctggggcatagaccctgtgcgtcccgcactgccctccactgtgatacacagcccaggctcggtgtcccctgaaggacaggtgagctctgcccacgtgccagagccaggaggcagcttgtggcatgtggagtcagacggctcagggtcctgccggcccaggctccccagctttccagctgtttgggcaagcccttcacctgggtgagcctgctgcttcctcagctgtgacatgggcaccataatagcctttgcggggctttgcagggattaggaatcacccataacgccagcagggggcttggcacacagcaggtgctcagtaaggtgcctttcccctggggaaggatggggtacccttgatagggatagagaaggcaggaagcccacagggcttggagctggggactgcccatggggatttgctcaggactaaatgaaatcaagtttgggctaaatactgcttctcttcccttcccacttcctgaaccccctcttcacccctgtcttcctggcccttctccatcactcccctctcccctgccgccccatatcagggagctgcgcctggatgagcccccacacacctgctggagctccctctgtggctacccccagctggtgacccaggtacatgtcctgggagctgctggcctcaaggactccccaacaggtgagctctcccagggagagtcccccggccctcctgccagttgtcccatggcctctctccaccagcacggataccagcctcagagctctcctgctctcagaggcactgcaggcctggccatttctggggtgatgcctgatgctgggcacatagagaggaaaaggtttaccttctgctctcaggaggcttccagctgggagggaggcctcaggaaaggcttcctggagggagtggcctttttctaggctgagaaggtattaagatacaaagcctgatgaaagggggtaagggagaaaggtgctccgggcagagggagcagtgtgggtaaagctctggaggctggagatggccagtgtgcccctgctggccggcctgtctctggaaacgaaggggccctgaggtgggtcaggctccagtctctccatctgaataactgagccgggtgggcatctcacctgtagatatctgtggccctgccacagcccccacccccaccctcaccccatctcccactccctctccctaggggctaactcttatgtgatcatcaagtgtgagggagacaaagtccgctcggctgtgcagaagggcacctccacaccagagtacaatgtgaaaggcatcttctaccgcaagaagctgagccagcccatcactgtacaggtgagccccctggtccagaggccacctcctgggctcctagcctgaggcttccccactcagggggacaagcccaggtggaagaccctctgacgaggacccaggcatgctgggctctagctgtctgtctatccctgacccctggtgtggctttgggagctctcttgccactccaaggtccctctgtaggtgggtgaattggattagttggtgtggtcctgagacccagcagggtccatctcctggctggggacagcagtcatctctgctgacctcaccctcagctttgggaactatccctcccatttccccgtggggggcccacctggaaagtggcgttgagccactgtgtggtgcgtgtggctgtttcccaagagccttgggcaggggatagaaagccagtgtcctccccatggcttccttctcctctcaggctgatgtggcctggggatgatgattctgaactcaatactagggagctctctggcccccaggccttgatcagcatctctctcagtgagacagcatctgtaaacaaacatttgggtccccctgggggagccactgtggcttatccaagttttcttaacactgagtcccactggatcaaatcacagacctgtatgtctcagggctggaaagacccctaggggcagctgactcaaccttcatattaaagatggggaaactagggcagtgggtgtaccgcttgtccaagttcacccaagatcaacagcggagctaataacagatttcactttatgcatgggagggagcttagctagctgaggagcctgaggctctggaaggggcaccaccttgcccgtagttcatggggaggcagacagcccagggcccccgatcctcagccaggcttgcacttcaaggccctgccaccaccaccagcaccccccatagacctatattgctggtcttggaggtagcccgcccctcccatgatcctctgtctcttcccaggtctggaaccaccgagtgctgaaggatgaatttctgggccaggtgcacctaaaggctgacccggacaacctccaggccctgcataccctccacctccgggaccgaaatagccggcagcccagcaacctgccaggcactgtggccgtgcacattctcagcagcacctccctcatggctgtctgacacctgcccacctacctggctctgaccgttcccaccaccatctgcatgtccccactgggcctgagtctagcctgggagccaggatactggggtccttttcccactcttccactgacttgctgtgtgaccttaggaagtctctgcccctctctcagcctcagtgtcccgagggccccgaagcattccattctcgtggaggagtttccttgctgagatttcaaatagtcctccccacctcaactgtcaccactgctaagggactctatccattgagcacattttcctaaggccctgctgtctgccgaggagcgccaagaagatgtcacttgtttacacacgaactgccacatccccaagctccgttcttgcccctcgtgtcctaggcccaacccagcctcccagacctcactttccccatcagcaatacctggtgttctcccaccttgaaaggactcttggctcctgccgggttcctgctcaggctggaattgggaaaatatgcaggtgacatttgttcattctctaatcccatcctctcacccatccatttcctcactcagtggagatttgccaaatgaataaacgacacctttgaggccccaggtgaagcggggccctactccggcctctgccttgggcctcgcctctgtcctcaggtcctctcagaggcagatacctaggggagctgctgctgcctgctcattctagcttccgattccattcccagcccctgcgttaaggtccctggagaggtggcgtcagtgggggtgaggaagggcatcttcctgactcctctgcccagtgctggaaggagcatgcctgggttagtgggccaggggccaggcagctgggggcctttggggaccagaaggggagatgtgctcccagagcctctctgctgtaagaccccagcttttcctggaagatgggactctggggtgtgtggtgctcaccagagtcaggccacccactgggctcggcaggagatagggagccccatcacctgaccacagccccccaccaacattcccccaaaatgcagcctaggaggccgcagtgctcttcttcctgcccagaccaaaatgttccttttagtcctcaatgttttatattctttttgttttgaaaatctcaattttaatcaggggttttaaaagaaaattgaaagcctgaacctccatttttcttcttggctccagttttgctggtcctctggagaactcttcgtgagcactggtgccgtgacccacttgggatctctgctgtgcccttctcgggcttccagaccaggtgtagcaaatgaaaaagtgcagttaattcaagaacaggaatccctgtgtccttgctgggatttccttttgggaacctgactttccgactccagatcctgctgtctggatcagtgttctggctggaggtgctggattctctgattttgcctcctcactctgtgtctggctttgctcctgggtcttggccctgggccatatgaggggccaggaaatgaacgacaaggaggataagagtgttctttcttgaaagccgggacttcccctcaagaacctgggcctggggccgggactctgcatgactgggagcaagtcacttaaacctcctgtgcctcgatttcccccttctacaaagtggggccaatgattcttgtgtgtcagcactgttactaccgagtgctgagtaagggcaaaataatacccctttctctatgtatctctgtatgcacacgcactatatatatatatatatatatatatacattcatgtaatcaccacttctcgatgtctatttcaaatcaaggctcctgagtagggggtgaagtgagccagcttgcacctcaggctaacacataggactttgctcagccatgtcccctgggatacaggggcacaccaggaccaagtggcagacctgtgggcttcagcctcggggccggggcatgcctgccaccccctgacaaaaacaggttccacagtgctacccttgcttcctgccccttgaggtgggccaggctggctcctggctatgcagggatctctggtccccaggagaccttgggggccaggcaggtaaggatcaggggtgataggggagagcaattactttgttcactgtatgcacccgcgggggcctgggagtccccatttgcaggtgggtagggcctccagcccacaccacccagacctaggcttccctcttctcaggatccaccacagggttaggggacaggaagcctgttctattctcaataaatcttacaaaattccaaaaagactttcctgtgtccctctgtccccctggggggaagggacaatgg

SEQ ID NO: 16822 - DNA, 73818 bp, Human
  misc_feature (1)...(73818): n = A,T,C or G
aagagtagtgtgttctaaggttactgacagctcctggataaaggattgaggaaaaaactggatgtggggggatcagttctttattagaaattgttaaaaaaaaaaactcctatagattttattcatagtattttaagtaattgatgcctaaagcggtagtattcaaatctgactggcattgggatcactaattttcaaaatacagaattaggtcttaactcagccgttctaaatcaaaatttatggaggccaagccaggatatctatatttctaaaagctcttggtaattattgtgctggttttttgaacccattattctctaaagcactgttgtgtttaactccaaagagcttatattttaaatagtcatggttaaatgtataatttctactgcagcatggaagactaatgagcaatatttttaactctggatacattcatatgtatccattgtcaaggacgtttatttaagataataacattttcattaaaactattgataacatgtgataggaaatcccccccatctttatttatttagagacagagtctccctctgtcacccaggctggagtacagtggtgcgatcttggttcactgcagcctttgcctcccatgttcaggtgattctcctgcctcagcctccctagtagctgggattacaggcacccaccaccacgcctggctaatttttgtatttttagtggagagggggtttcaacatattggccaggctggtctcaaactcctgacctcaagtgatccgcctgcctttgcctcccaaagtgctgggattacaggcatgagccaccgcgcttgtcctatcccctatcttttagattttattctactgtttctcagaagtagtggagattttgccagtaaattctgcaccatataggacaggatggttactgcattgaccattttatatttagaagaagaaagccaagcacagtggctctcgcctgtaattccagctgcttgggagactgaggtgggaggattgattgagacctggagtttgagaccagcctgggcaacatagggagactcttgtctccaaaaaaattttttttaattagatgggcatggtggcgcatgcctgtagtcccagctactctggaggctgagtggggaggatctcttgagccctggagtttgaggctgcagtgagctatgattgtaccactgcactccagcctggggtaacagagcaagaatcccatctctctctctctctctctctctctctctttttttttttaaagaacaaggtagaatttcagaggagggaaacactggagagattatatagtctcaggggttagcaaacttttgctgtaaagggcaagatagtaaataatgtaagtttgtggacatacaatctctgttgcaactactgaactctgccagcatcaggtaaaaaaaaaaagccatagacaatttataaatgaatgggtgtggctgtgttccaataaaactatctacaaaaacagcagctttcctgacccttgatacagtccattcccaagagggaaagtgtaacttgtctaaggttataaaattagaggttggcagagaactcactatgtggaatgctgttagcagttttatttaatcttcacatagatgaataaatgaaacctaagaggttgaagaatttctctaaagttagtaagtggtactgggattcacacttagtttttgctaggccaaatttctgctttcaactacatcataatggttttccgtgctttgcaatgtctcagaatgggaatgcaaagaaaagcaagatattgtgatttttcattagtgcttggcatatagtaggcatttacatcagtgagtgttagcaatatcatggtgtgcagtggaaggacttgagctagaccctgaaggaagggctgtataattttgattctttgcaattttttaacatgtatttccttttggtcaaaaataataaaagagttatattgttcttatttctgattctagtagctgctgctggtggtgacaatgtcaaataacggcctagacattcaagacaaacccccagcccctccgatgagaaataccagcactatgattggagccggcagcaaagatgctggaaccctaaaccatggttctaaacctctgcctccaaacccagaggagaagaaaaagaaggaccgattttaccgatccattttacctggagataaaagtatagtatttgattttcttctcatcatttatatgctttaaaaaaattattttgggtaacctggataaaagatctgttgtctttgacttaattttcctttaatgttttctttctggttaaatatttccctttctccctacagtggctgaagcaaaatggaaaatagacctatttttatactctattaactatatctgagcaaaactgtaagagaataattatgctcttgccagatttgggacaatctgaagtgatttatttatttttaaattcttaaactgtttatgaagccacaaaatgtaagaaaaattgaaatgtctttatttggaatttttttccccccgagttagtttcaattggaaatgttttctttccaaaatcttgattgccttttctttattccagcttcctggtcccactttcaggtttggggactacgtatcagtaagaatggcaagtaacagctgagaaaaggatgcagagataactagcattcagcatgagtttactatgaataaattatcctgggcagcctcatttcctttttattgataaaacttctgttaatagaagagtaatcatatgatgaatagtggtgattttaacactgattttaacactgttgatttaatagtgtatatgaaaaagtcaccaagatcctcgtagacaaggttgtaaaataaaggttttggtgtccacaacaaaagatgacttttgtttggtaccaaaaatgttgatttaagtggctgttgctctgaagtaaagttctccttatatttgtgggccctgttcttatggcatgctaaagatactggctttctgtgtgtaagtagttaccatgagcttctggtttagatggagctgggtcaccacttaccagctttctgatcttaggcatgtcagttaactgctttgacctttatttagtttcctattttaaaagtgagatatcatttcacagggttgttgtgaagactacatacaaagttcctaatagagtaccttccacacagaaggtatttgaatgttagttctctgtctctttactcctttgtctctgtctctttactcctttgttgatgaatagaaactgggaggcatagctggtagactacatggtaaaatcagaactgagattctgaaacagtagggcagatacaacaagcacaatggtagattgcggaaaatatctcatgttgtagaaaaatataattgcctaactacggatcaggggagatggtagatggtagtgtcattagcccaatagggaacatagaaagaaggaacaaattaggagtgttggtgattggagagcagggaagatgattattttggacacattgcatttgtagtgtctttatatagatatgtcttataagcagatctcatgtattgtaaatgtcgtacaagtgaaatgagaaataataaggacttttaatgagtacattgggcttatatcgttatgtgtatgagtccttctacttcaccttcacttccctttgggtttggtggctttgggtagaaaagaaggccaggcacaggggctcatgcctgtaatcccaacactttgggaggccgaggtgggaggattgcttgagctcaggagtttgagactagcccgggcaaaataggaagaccttgtctctactaaaaaaaaaaaaaaaaaaggagtcgggcatggtggcgtgtgcctgtagtaacagctgcttgggaggctgaggcaggaggattgcttgagcctgggaatttgaatctgcagtgagctgtgatcatgccactgcactccagcctgggtgacagagtgagatcctgtcttaaaaaaataaaataggccgggtgtggtggctcatgcctgtaatcccagcactttgggaggctgaggcgggtggatcacctgaagtcagaagttcaagatcagcctggccaacatggtgaaaccccatctctactaaaatacaaaaaatcagctgggcatgctggcaggcgcctataatcccagctactcaggaggctgaggctgggagtatcacttgaacccgggaggcggaggttgcagtgagccaaggttgcgccattgcactccagcctaggcaacaagagctaaactccatctcacaaaaaataaataaataaaataaaagatatgggtaaggtgcttaaccttgatttcctgactaattcattcatatagtagctgccaacttccttggtacaagggctatgatctgagacagtgttaaatgccctgcagtcttcttccacatatgtagccactttgtttatccctcaatttagatgtgtatttatttttaatattgtatcttatcaaccagtgttcttgatctctataaataggctttcagcccaagtgtctacatgtagtgaaagaggactttttaaattaaaaagtttaaattgttcttgctgactcaaactagaaaggtaataagattctcatccagtaggcatcatcaaaactaaaaacatttatgtttcaaagggcatcatccggaaagcaaaaaggtaacacacagaaaggagaaaaatttcccaaattacatattttataatggatgtgtatctaaaatatgtgaagaagaactattgcaagtcaacaaccgaaagacaagtaattttaaaatgggcaaaatatctaaatagacatatctccaaagaacatatacaaatggccaagaagcacatgaaaggattctcaaatcattagccatcagggaaatgcaaatcaaaaccacaatgagataccacttcacactcactaggatggctataataaaaaagataataacaagtgttagtgaggatgtggagaaattgcaaccctcataattgctggtgggaatgtaaaatggtgcagcctctgtggaaaacagtctggcagttcctcaaaagattaaacatagagttaccagcagtacatgaatgtttatagcagcattcataatagccaaaaagcagaaacaacccaaataccccatcagctgatgaatagataaataataaaatgtggaatatccatacaatgaaatatttggtaacaaagacatgaagttctgatccgtgccatgacatggatgacccttgaaaatgctgtgttaagtgaaagaagccagttacaaaggatcacatatagtatgattctatttgtaggaaatgtccagcattggtaaattcatagatagaaagtagattagcggttgccttgggctgcagagagggagaggcaattaaaactaggagatgattactaagaggggtggggtttctttttgtagtgatgaaatgttctaaaattgattttggtgatacctgtccagctctctgaatatattaaaagccattgaattttacacttcatgggtgaattgtttggtaagtgaattacatctcaataaagctgatttttaaaaaagaagattccagtctgaaacagcagatggaagcagagccttcagacatcattggaacctggagggacaatcttatgtgctaaatgggaaagtgggggtctagatattgggattatagtattggttcttccataaattggctgtctgatttgggtcaattatttctctgtagacgtcagtgccttcatctagaaaaggagagagagcagtaggcatgtgcagtttcttttagctttagaatcctataactggccaggcacggtggctcatgcctgtaatcccaccactttgggaggccgaggcgggtggatcacgaggtcaggagatggagaccatcctggctaacacggtgaaaccccgtctctactagaaatacaaaaaataagccgggcgtggtggcgggtgcctgtagtcccagctgctggggaggctgaggcaggagaatggcgtgaacccaggaggcggagcttgcagtgagccaagattgcgccactgcacttcagcctgggcgacagagcgagactccgtctcaaaaaacaaaataaaataaaatagaatcctataattacataaatgtgatgttgcaaaggcgtggttagatcaggcttgtctatataggtgaaaagaaactaggccattgtaaagtactttattcaatgatacagctgtagaaaatcctaggctaaatctaagtaaccttaggctaaatctgatctgaaaatacatctcatagcctcaagatcaaaactgcatctctgcaggctgaaaacatagaggtagaaaacatacagagttataagaagttcttgcaaaatgatctaactatctttcatcctttggttacagattttctatatttgccctgggcacataggtttcatccctttgctttaagacccttgatggctataactaatgcatacatcaaaatgaaagaagtctgaggtgtttttcttttgtttggagcctttgatcaaccagtaagctactcaacttagtcctataaggatacacagcagtgttggtagtctttgaagtggtatatgcccttcatgtagtatttgagcatttataccagctgcatagagttatgtctggaactggacttataacacagattgagtccagccactgacatttgttaactctgatttattttttaaatttcattccaatatcctcacttcccattcatcctatatcattagtaggcttttgtcatttgacatagtagatataaaagcattttctaaactaaaatgcaatacaaataggaggtttgttttttaaaaatggaaacctcatttattgttttatttgatacctacaacaactcatttttagttggggaggctaaggcttagagaaaagtaagttgctcaaggtctcacaagtggaaagtgggagagctgagtatggaactaagtcttcctaaattatctgttccattgtaacataactatctctcttagttgttctcaaccctgattacatgttggactcacttatggtgcttttaaaaaatacagggcggggtgcaagtggctcacgcctgtaaccccagaagtttgggaggccgaggcgggcggatcacttgaggtcaggagttctagaccagcctggccaacatggcaaaaccctgtctctactaaaaatacagaaattagccggttgtggtggcaggcacctgtaatcccaactactcaggaggctgaggcaggagaatcgcttgaatctgggcggcagaggttgcagtgagccaagatcatgctactgcactccagcctgggtaacagagtgaaactccattacaaaaaaaaaaaaaaaaaggctgggcgtggtggctcacacctttaaccccagcactttgggaggccaaggcgggtggatcacttgaggccaggagctcaagactagcctggccaacatggtgaaaccctgtgtctactaaaaatacaaaaattagctggacgtggtagtgggcacctgtaattccagctacacagaaggctgaggcaggagaattgcttgaacccaggaggcagaggttgcagtgagctgagatcacaccactgtactccagcatgggtgacagagcaaaattctgtctcaaaaataattaattaattaattaatactgatacctgcattccacccagacctttggagtcagaatttctagaggagttgtcttgggtctctagagagatttttgggagatgagaaagaagaatgatctgtaggctgtagtaatggttgagatttgagctgccagtgggtagaatgtctttgggcattacctaatgctgacctctctagcatggcctcagtatgtgcctgggggatgcataaatgattggaaagagaagctgtaattgagggcctgtaataggtgatgctgagttgcagaattccatgtgggaaagcctggttcctgtggttaggatctggagcctttggtttattctaagaagtctttcagcatttagtttgaaatctttttctggctgcattttcacaagcaaagtggaattctctgagcttgggaagagtttagcaaagttaattttaacattggactatgtcagtgtttatctctccaagtttggaacgttttactgccttgagctcagattagctcagtggagccaatgagaggtgctgcttaaaaatcatttttttaaaaaaggccagtgatttgtgctgaaactttgatggctataccaagacatgggattttgcagtgtcagcctcatttcccatgctatcagaaagccaagtggtctaggtcaaagatagggttaaagttgggatgggtgaggttggaagcttcttttcccgctttattttctcaatcccaagatctctagatacatgaaatcaagatgattctttcctctttctcacctcaaccacagtttctctgtcttaatgaatgggctgagaaacctaacagttttttatattaatgacaactcatgtttgtaaagttctttagtttacaaagcacatatatttcctgtaacttaaagaattcttttttttttgagacagtcacgctctgttgtccgggctagagtgcagtggcgcgatctcagctcactgcaacctccacctcctgggttcaagcaattctccctgcctcagcctcccgagtagctgggattataggcacctgccaccacgcctggctaatttttgtattttttagtagaggcggggtttcaccatgttggccaggctggtcttgaactcctgacctcaggtgattcacccgccacggctgcccaaagtgctgggattacaggcatgggccactgcgcccagccaagaattcttaacatcgttgtaggaatccttatttagatataagtcttctgtcagttatatatgttacaaatatcttctgtgctcttagcttttattagattaagtaaattcccctgtaatcttagacagatgcttggcatgatgtgagatagaattttaatgtggtcaaatttattaattatttcctttctaatgctttgtggttctatttttgaaatctttacctactcagagacatgaaggtttttctattgagttttctgtattcacgtacatgagcacatgatctgtaaattgtaatagttctttttctttctttgtaatccttctccttttacttctttttcttgcctaattgcactggttaataccttcagtactatgatgaatagaagtggtgaggaggaatacccttctcctgtttttaatctcaggaaaagctttcagcattttagaattgagtataatgtttgctccagtttttggtaattaccttttattagattaagtaaattcccttgtaatcctagtttgctaagagtttctaatcatgattgatatcacatttcagcaaatgcttttttctgcattaattgaattgattatatatattttcttctttattttcttaatatagtaaattacattcacttttttttaaaaaattgagatataattcacatgccatacaagtcaccatcttaaaatgtacaattccgtggtttttagtatattcataagattgtacaaccattacaactaattccaatacattttcatcactccagaaagaaacctcatactcattgcagtcgttcctcacttctcccttctcccctggcaaccactaatctactctgtgtctatggatttgcctattctggacatttcatataaatggaattacacagtatattgccctttgtgactggcttctttcacttagcataatgttttcaaggttcatccatgttgtagcatggatcaggacttcatttctcttcatggctgaataatagtatatggatgtactgcattttatctattcgtcacttgagggacatttgggttgccttcactttttgactgttatgaataagctaatgtgaacattcacatacaagtttttgtgtagacataagttttcatcagattcctgcagacatacttctagtcatcataaaaaatttgcaactgcagcagtagtcccagggatactatatccctgggatatgggaccatcaggatcctaggtttgctttattttctccattgtgtcttccctcagtccgaagctcttagtgccttcctgcctgcagtcatgtgctttgtgaatctggtaagagtttatgaaatttggttgacttgctgagcaggtggaaagatggaagaaagatcacactgcttacttcttttggcctctgcttattctgtttcttttggaaatgccctttcccatctcggtctggctaacccctgttcatcctttatgacttctttcaggtattatcttctccagaagagtggtttattacttaccttcttctgtacacagagcatgcaccattgtcctattttgcagattgaagacttgaaactcagactttccctgggtcacccagtgagttactggcaaaaataatactgaatccttcctctgagattctttccactaacagaaatttcttttaattccctgacctcagctgtttagctcctgggtttgtggtgatgagccagtgagacagtgactggcagagcttggtgaagggctgtacacaggtgaaggggatgattgttacttccaagaagggattaattgggttccaggtggctctgggactgtatgacttctccatttctctcctgtattcctgcctcttgaatcctgttttctgctggtgatccccaactggtgaatactcagtctaaatattacacagtaccaggccgggcgtggtggctcatgcctgtaataccagcactttgggaggccaaggtgggtggatcacccgagttcaggagttcgagaccagcctggcaacatggtgaaaccctgtctctactgcaaatacaacaagtaactgggtatggtggcgggtgcctgtaatctcagctacttgggaggctgaggcagggagaattgcttgaaccggggaggtggaggttgcagtgagctgagatcacgccattgtactccagcctgggcaacaagagtgagactctgtctcaaaaaaaaaaaaaaaaaaaattacacagtacccaagctaaatcctgccacctagatttccccgttccttttacttctctcctctcccacttcaaccaagtcattgctattcttgtactccgcgtctaatctatgttaaactgttatttcagttagtagttgataccagtcaaatctcagtagggatcaggggtataataaagagtgaaagacttgatcaggtagactacagtcctgtgctctgtgaatcaggacaagtcaacttacatccctgggcctctttcctcagggaatgggatcatggtctctagagtcactccctaatattttctttctttatttttttgagacacagcctcactctgtcacccaggctggagtgcagtggtacaatttcagttcacttcaacctctgcctcctggttcaagctattctcatgcttcagcctcctgagtagctgggattacacgcatgtgtctccacgcccagctaatttttgcatttttagtagagatggagtttcaccatgttggccaggctggtcttgaactcctgacctcaagtgatccgcctgcttcagcctcccaaagtgctgggattacagacgtgagccaccgtgcccggccattccctaatattttctagagtgttcttcaactaagtaagccatgtgctgtattgaaattcagaagtacagggattgtaattggaagtggtaattttggtcctcaagaagcttacattttggatttttaaactagcaaggaattatataagataggaaatgactagatgcttggtggtgtagcagactcagtgtcttgggaattaacaggaagaagaaaggtcaggaaatccttcctggaaaaagtgggacctgagccagtctttaaaagattgctgagatagggagaaggagaagagagcattccaaacaaggagaagaaaaagcaagcaaaaagttggaggtgggaatatgtgaggtatattcaaaggttgcagggtaaagagtgctcagtagaagcagagctgactttagcattaccctgtgtgttcatgtattaaatgatttcatttctctggaactcttttctgtaaaccactcatgctttgagctaactttctttttgggtctcctttaccaaagtttcttatgcatttgacagttcatgcctgtgatgtattatatagtatatcaattatatataatagaaataatgtataaacatgcatagatatagaaaataaaaattgaaataaaacacaaatataattgtacttccctaagtgactagatcagagggaatttagaaacagaaagtagttccaaagccctgccacatgttccagtgcattctggctatgagaaagacagatggacttacgtcataaaggactgcttgacttggggccctggtataccccttagccttctctttctcaaagcagctgcttctgagagggaaattgccaagtgcataaatagcttaaaccctagcacttggcatgtaggcaaatggttctcattaagatactgaagaatgaacgtttggaatcagacctgggttcaaatcccagctctcagtagctgtatgagtaaattactcagtttcctcatctgtaaaatgacagtagtagtatttatctcataggattgtaagaatgacggtagtaatatctatcttgtaggattgtaagaatgaagaaaaatactatattgacatcatggtttgtatacatggcaagttcttaatgtcatttcttcttactacactgaagtatgttttcttgattcaacttgaaattttttaggggaggtaaaatagaatgtgaagagccttggctttgatgccagactttttggattttaattacttaatgattgtaggcaagtctgctcccaaattttctaatctacaagtaaaacttacctcaggattgtggtgattgtattagatgatatgtatgaaatacctatttaaaactgtgggatgccatctcaggaaggaatcttaactgcagagctttgagaaagcatagtttcttgttttcatagattcacagaatgtaggtgcttgagggacccttaagatcatctagctcatcctctcccttgtttagatgagaaagcagagatcctggtctctctttctctctctctctctacacacacacacacacacacacacacacacacacacactctgtggtgaggtagaggtgaaactggcttgaactctagacctttttgttttttccttctcattttgctaccttttatcagggttttgctgggtctgtggaggtgttagaacttcagaatttcttttggttagtgtgttgagctcccagacagcagggttttaaaataaggttcacaggtgctgggtaacaagtgttgtgaaagtcaggccagagctgctgaaatgaacatttattcctgccctggagagaatttttgtgtcttaggcagattctttaaactccttgcccagttgagttaaatgtctggtcattttttcctttcttcacttactgtctgagcacctactttgtccaggtgtgtgctagcctctgggaagctgtgattaatttgacatggcctctgcacttagaattcagtctggtatggaagataaacacttataatagtcaattactattacatatattgggtgctgtgggaacagagagggtaaagaaccacccagcctagagatcaaggagggcttcacaaaaaagatgacttactctatatcaactggctagttactggtaaaaccagaactgttaactctgacagacgatctttttgcctctccctttattttattgttttttgtttttttgagacagggcctcactctgtcacccaggctggaatgcagtggcgtgatctcagctcactgcaacctctacatcctgggctcaaatgatcctcttgcctcagcttcacaagtagctggcattacaggcatgcaccaccatgtctagctaatttttgtatttttgcagagacagggttttgccatgttgcctaggctggtcttgaactcctggactcaagcaatctgcctgccttggcctcccaaagtgctgggattacaggcatgaaccaccgtgcccggccacctcccgtactttagttcaacaagaaattaagtctttaaacatgcattgagtatctgctccaatccagatccgtaactgagctcttctacatatgtgaaatattaatagatagactttgccctctcaaggagactacagctcaataaagagctaaaataagcctaaaaacaataatgttcctgttttttatttccttttgcctgtttctcttgcagcaaataaaaagaaagagaaagagcggccagagatttctctcccttcagattttgaacacacaattcatgtcggttttgatgctgtcacaggggagtttacggtaagtcctgggtcacagaaaggtctttagtcttttagagttctggctgtgcactgttagattcaaccctttctcatcttcctgatgcttctatctttgcctgagaccctgattacaattttctcacgttcatgagtgggacactttcatcgccaaaattgtatccagagaagcctttccatctccgttccttaaataataaacctctgttaaatggtaggcttggtagcaggctctgtgtggggcactgatcatgcaggaacaacatcctatcctaccatcctggaggtatagcctggtgaaggagcagacatcttaagaaatgactaattcaatgagaaagatattataaaagaggcttgtgtaaactctgagagtatagagagaaaggaatgactaataaatgcatcttttgctgctagcaagtgtcaaagttagctctgatgttctttcaggctcccctgtgactgtgccttcctgttagtcttgcatgtctctcttacagggaatgccagagcagtgggcccgcttgcttcagacatcaaatatcactaagtcggagcagaagaaaaacccgcaggctgttctggatgtgttggagttttacaactcgaagaagacatccaacagccagaaatacatgagctttacaggtatgagaactgcgtccagggcagtctcagcaagagatggttttaatctgggtgggaaagctcacatgcctattggtctgggatgagagaagaaagtagtggaaagagtggaagtggcactttaacgtggaattttggaatttgacagccaagatgatggactttgcatcaaacttgagtcttcactctgtcactgcacacgtttttttaaaaatagcatggtattatatagagagaacacaggttttgtgctagaaggtctagattctgacctttactaggttctaccagtcacttcatttctttgcatctcaaaatgggaattcctatctcaagaggctgtagtgagaaatggttgggcgcagtgcctcacgcctgtaatcccaacactttgggaggccaaggcaagaggatcgcttgaggtcaggagttcgagaccagtctgggcaacgtggcaaaaccctgtctctacaaaaaatacaaaaattagccgggtgtggtggtgcatccctgtggtcccagctacttgggaagctgaggagaagggatcacttgagcctgggaggtggagttgcagtgagcaaggatcacaccactacactccagcctgggcaacagagtgagaccctgtctcaaaaaaaagaggttatagtgagaaataagtgagctgattgatgtgagagttctttataagttgtaaaacatcaccatagaaatgtagctatcattgtcatcattattgttaatattattattagttatttaataacattaatgtatgtcttcctcagggaactaatttttattagttaaatgaaaaacaggccaataaagaataagtttctttagatgtaccctcggtagaagggactatatttttcagagtgtttttaatagcagaattgggattagaacccaggtctcctaattcctgtaacatcaccttttgaatttactacttgcccctaataatgttatttggaggctctccttccacagcggaccagctttccattgttttgcaggtgtgagaaccaaagaaggcctttctaatatgctaaattaatagtgggctaatcttttaatttctaggctctttactcatgttgcctccttcaaatggcagtattgttgggaaggtgagaaccaggatgaactagtgaattttgaaggatgctttccccagccagtatctggcttgtttcaagggcacagatggtggagatgacaggctgcagcttcactcatgctgctatggtggtgcccaggagagggccatgcatgtgcccagcagtatttccttcctctcgtctggccccgctgagtctgtctcacttactccattgagggactgagtcatttcaaggaggaattgggctggagggctactgagtgggaaagttttctagtcaggaaattagagtttgtgtttaaggaacttgtcatggaaacatcaggttagaggctgtctttgaaaacctcagtggccaagtctttgcaaggatctttcctgcatgtatgtatgtaaatatgtgctagtggcatgtaaatgtgtatgtaaacagagacatagccctgtgggtttgcatatatttggaattaaagcctacttaagtattcatgaacaaagataaagtccactcaggtattcatgaacgaacatatgtataaatataaacattcaggtaattatgtgtatgttcattcgtgcatgcacatatgaataatattgagtgtatatgtacagatacgtgtgtacatctacttttgtatgtataaatttgtgcacatgtatatatatgtatgcaagaattttaattttctataagttgaagactagggccaactctaggcaaaattgcatatttggtataggtttttttaagtgtcatatctctcctttccctatttaccatcctcttatactattagttatgataatactacctcatttgtatatgctcacatgtgaattacctcatgtgattcttttgctggagtcctgtggtgtgatcttggctcactgcagcctgtgcctcctgggctcaggtgattctcctgcctcagcctcctgagtaactgggactgcaggcatgcaccaccacccccagctaatttttgtgttttaatagagacagttcaccatgttggccaggctggtctggaactcctgacctcaagtgacctgctcaccttggcttcccacagttctgggattactggtgtgagccactgagcctggctccctcatgtgattcttatgatggccttagattggcagggcaaggactattatgctcattttatatactcaaagaaattaattaggctcagagaagttaaatgacataccccaagtgactcagctgatacatgatggaaatgtattttaagttgggcctttaactcctttgctgcctataaccgaagcacaatcttccatgctaatttttttgtcaagtatttctattttttcaacacttaatttttttttttttttttttgagatggagtctcactctgtcacccaggctggagtgcagcagcgcgatctcggctcactgcaacatctgcctcctgggttcacgcaattcttctgcctcagcctcccaggtagctgggactacaggtgcacgccactatgcctggctaatttttgtatttgtagtagagatggggtttcaccatattggccaggctggtcttgacctattgacctcgtgatccacccaccttggcctcccaaagtgctgggattacaggcgtgagccatgtgcctggcaacacttaattttttatacctgttagtagctaatgtaatagggaaaaagtagactagattgacaactcaactgggtcttagccctattttgccactgacttacgtgaccttgaaccaatctttttccttttctgcacctcattttactcatctgtaaaatgaaagtgctggaagcactttctgttccatcattctgtgctttggaatttgattttgatatatagaagttcatcacctttaaagggagtgtttacttatttttatatgacataacaagtatgcctattaccaaaatacccaatcttcaaaaatactagcagtacgtaaagttgggggtagtgcagtgaaggcatagtgttgtactctgccaaagttgatagtctatagtcttttggacaagaaaaaacaaacgaattatgtttaaagtatatcctgaatttatttctccagaatactgctagctattctggatttgttataagaacaagttgtcagagcttgccttatttcctgctttgtgggttcatgatttgctgtagtgtcaaagaagctgtatctagcacttttttacatgatggaattggaattgtacattctctgggcttggttcttggtgaggaatatattggatttggtagaatatttcccctccttaattctattagtggtgaattggcagtcagtttttcttggacccaggggaattaaagaacaaaactgaagacattacctggtctttaaacttactttcttcctaagatctccattgggtctctctttcaaattttatgaagtctaagataccactgattgtaagatgtacaattatttgcataccaatcaaagaaaataaagctgccaattaaaccataacatgctttagaaagtaggacacacctctgtttcagagacgttaatgtgaaaaaatgtacatctcagaatcagtgaaacatggtaattgcttcattgagggagcttgattctattcttggaaaacaagaccctacctttaattagacttgacaggatcaatacctctcttttcctcaaccttagtccttttgtccttgtgggcagtagatatggatatagaaggatcctttatgaaagctgaaactggagactggccatgttttggcatggatgactcaggatggtgctatggattctttccttttcttttagaatgcagattttcttggccatttaagcctgacagtgatatagctgatgatgtggatacagttctagcgtagtatttagaatgagaccagaattcaaatctaattcctctctttaacctgtgtgtaccctgggcaaataacagtcatgtgccacaacaacagaccgcatatacaatggtggtctgataattaatattataagggagttgaaaaattcttatcacctagtgattcctgaagtttaaaataaatttagcatagcctaagtgtacactggtaatgtcctacttaggccttcacatttactcatcactcactcactgactcacccagagcaacttccagtcctgcaggctctatttatggtaagtgctcatataggtgtatccttttatttaccttgtaaaccatattttttattgtaccttttctatgtttagatatacaaatacttaccgttgtgttacagttgcctgcagtaacgtgctgtacaggtttgtagcctagaaagcaataggctatacaatatagcccaggtatgtagcaggctataccgtctaggtttgtgtaagtacactctatgatgttcacataatgaccaaattacctgatgacacatttcacagaacataccccattgctaagccacacccaactgtacttaacatctctgaacttgtttccaaatcaataaaagtagatataataatagtactcagagccataatgaggattaaagaaggtgatatgtataatgcatttagcatgatatctagcctgtagtaccagtcatactattactattctctgaatctggcacgtgcttgaccagatagacttcttttgctgtccagaaaaatttaactgtaactgttattgactaagtcccttgtttttcttcctgtgcagataagtcagctgaggattacaattcttctaatgccttggtaagtctttatttactctattttgatgtgggcagatgtggaggtaaggatcaagacagtgtggtagaggcagagcctgagctgggaggcactcatattagtcactcctgcacccttggcctcagaattcctatctatccaataaagaaattagatataataaatagggggtatccctttcagctttaatgtcctagaaattctttctttgtgataatttttttatttttaatttttatggattcataatagtcgtaaaatgttctagaaattctaattttggaaccagaaggtatggctttagactcagttttaatttgtagctttgaaccttgggaaagtcagtttgcctctttgagcttcaatttcttcatcaataaaatgaggatgatacactgtgccctcacctggacatgtcttcagatacctacacttagaagaaaatttcctctttggtctatggagtctgcaaaaccaagattagtactaattgttgaagggagcagattttattcatttaaagtcattcattctgtcctctgaagttgtaatgaatgctttgacactcaaatggatgttatagaaatcatgaagaattggctggagagtaaactagatgatctctctgtctctcttaacttacaaattctatttcccagggcacttacggataaaatgtgatgttgatgtatttgaaagggtcctataaatagtaaaatgtgatgcatataagagaatactgctttttttttttttttttttttaaagagacgaggttttgctctgttgcccaggcgggagtgcaatggtgtgatcatagctcagtgtaaactcaaactcctgggctcaaatgatgctcctgccccagccctctgaatagctgggactacaggtataagccatcacactcagcttattgagtgtgatgtcaaattgtcagacagacaattttttaaaagttttggtagagatgtggttctcattatgtgttctcaaactcctggcttcaagtgatcctcctgcctcgacctcccaaagtgttaggattacaggtgtgagccaccacacctggttgctatttattttttacatctgatgttgtctcttgtacataggtggttatgccatattgatttactaaacatttgcaaaagccctagtttatcctatgccaagtccggtgtgaataagtgacattacagagatggtcagacatgtcccagtacctaagaacctcccagtcttgaggttgaagacctcaagcagccagttcttcatgattcctgtttgtgcttgaaggcacagacagacaattatagtgcagcatgctaaccttcatgaagccaggggctgtctctgacttgttaattgttatatccttggcatctggcaagtcttggcatttggtaaacatttactgaatgaaaggttggatgtgtcagagaaagcttcctgatggtaaagtctgagctgaatgagttagttatctagagcagggattaaggggaaatgcgggtattccacacagaaagagaatagcatgtatgtgggcaaggaagttcatgaggcatacttgcacagggaactgcgaagtggttatgactagaatgtgaatagtgaaggaagtagaggtgggtgatgaggaggattggtaagcaggacagatcatgtaggagtttgacttatcttaaaggtgatgagacgcttaaagaacttaagcagaagagtggttaagttctaacacaataccgagtcaccatcaaaatactttgaaccatgcttccaccagtggggactggtttattcggagtcatttttacacatattgattataaaaaacaatattcacacgttcagtgccttgcaacctgttggatcctttcttactgactctctgaatcctcacaggagcttactgaggtaagttattatccttgtagatgataaaactgaaatggaaaagagttaatggcaataggcatctgattcccagcctatactgctttcccctgatttgtgctgcctttcatcaaatagaagagatgtgattaaaagatgggaaagaatttgcaaatataggatctttgaatagtaaattattaaagaagaggctttaagccgaattgtgctttgtggctcaaatgtctttatgcttttgtaggaagagtgatagctatcaatattgagtgcctgcgatgcacggtgttaaaaactttatgtaagcatgattagcctcacaattacttatgtacaaagtattgtcatctccatttcataggcagaaaaacagagtttcctgaagacttataattagaaccacattacaactgagtcttgtgaatctcagtttagggttcttttcactgtggcaaggaacaaaaaaagatgtcattgaggtcttataaaggagactgcagtaaagctgtagctatgttgtttgttattgaggaggaagagccctggggttcatgccatatggcagggaggataacacctgcttggtaaaaacttgtactggtttagtatctacaattaaaaccactaaggctgtcaaggacattgttctcccctagttcagaacatttgtccagcactagctcagtgctctatatatccttactagttttacatggaggatatgttttgtattatggtagcatgtcattattttccatgttggtttcaaacagatgattccacttgtgaaataatcaaatataattgctgcctaagaaattaagactcagaaagattaagtgactcactccctacgtttgaatgagttagtagtagaaaccagcacaaaattctgctctcctgagcattcatgtattcactcataccctaaatattgacttagtatcttctttatgccaaaatacaagtgacacaaaaatgaacgtgcactgtcttaatccttgagaaaaaaaattaatgacagactggggagataagggctgcaagagaggcatgaataatgtacaatagggttatatttgatggagtgatttattctgctctgaagtacaaggaagtttgcagagttcttgggccttaaagctttgttcgtttaacaaacataatcttaaagtcccttttagctctaaattctgttatctgtggttcactggtctgagatctgactctaagattccatggcattttaatgcctgattctcatttataaaatgaatagttaccacatgataagttctttgggtgctgagaagtcaaggactagtaagatctctgctcttggtctcacaatttttgtgatgaatcagaacatgtaaacaaggatttataatatagtgttaagtaagcatcaggtaatgataccaggcagagaaaaaggcagtgctttcctgtctgatggacagcatgaacaaaagttgggttaaggatccagtatgttaggccagagagcttggactttgtgctggagctgagggactattttaagtagaagattgatgtagttggatatgtgatgtctaaactaacatcttagatttctttggaaattggatcaagatagtaaactgaattcatgtgcccatctctcttgctatctcaaatttcttaatttcagaaaagatttcttaaaaaccaaattaaaagcaatgctctgaaacaaaagcatgacataaatcaactgttgtgaggaattcatggaagatagaaagcagaaaaggtcagattgatcagagcagaagaagccacagcttaaagtatgtgtaagagaagatgcctaggaaaatgaaagtagctccagagaaaatgggctgaaagaatatatacaagaagcaggaaagagtcatgggtcatcttcaagggtaaattaatttaattctacctttgaaacagtaggggcagcctcctccttacagtgaacaaaaggcagcaggtgcatttgattctaagctaaaatcagctaattttctgaagaaagtaaactgcctacttgaggaaagctcttgctgtgggtataggggcctcagagagaaacagaggaacctgagttaactgcaaaattctaccgcagatataaagaaaaggaaacaggagaagtagctctgcagtgaaggaaaatacattaaagttttccatcccaagagtaaatttctcatacttttgatacctgggaggaggggaatctctacttttccatgcctacataccctaaagtaacacttgccaataaccatctatctataactcacaaacagatcgtatcagacctcccattcagagtaggacagtggaaaaacagacttacataagtttcagaaaaactaatgctaattacatacactaatctatccttcacttataaatatgaatgaatagctaaggatctgcagacatttgagagaaacacaacattaaagagaggaaccaagataaggaaggaaaattagccccagaggaagtagataagtcaggaaataacttttaaaaaaatctagtattttcagagaggatctgtagatgtttcatctacaaaaacaccctgctattagagcaatcagaggaggaaagaatgttcttagtattaaaaacataagacataaatttatggctgggtgcggtgctcacacctgtaatcccagcactttgggaggctgaggcaggtggatcacctgaggtcaggagttcaagaccagcctggccaacatggtgaaaccccatctctactaaaaatataaaaattagctaggtgtgggggtatatgcctgtaatcccagctacttgggaggctgaggcaggataatcacttgaacctgggaggcagaggttgcagtgagctgagattatgccactgccctccaacctgggtgacgaagcgagactccatctcaaaaaaaaaaaaaaaaaaaagaaatgtataaggtttaaacaacaaatgcatataagtgaatagggaattaataatataaaatataaaagatagaaaatttgagaataaatgacaatagagggttggtcagggggattcaagcataagcagagaacagaggcagtagagtaaaaaaataaagaaaaaatagaagaaaaaattcccagctgaagaaaggcatgagtcttcagatgaagggcctgttaatgaccaagtcagataattgaaaagagatccaagaataaagagaaaaatcttaaaagcctccaaagagaatatagttcatgtccaaaggaacattagcatcagacatctcattagaaatagtggaaaaaacagcagtatcttcagagggatgaggcaaattgtttagaaccaagaattttgtacctaatcaaactaacatttaactataaggtgtcaatataaaggtatgtttggacatgtgaagatcaaggtttaccacccacagatcacttctgaaaggctaaataccaaatagtaacatcaattacctctggggttaatggtgattaagaatactcacttaaaagtatttttaccggccaggcgcggtggctcacgcctgtaatacaaaaaaattagctgggcttggtgttgtgtgcctgtaatcccagctactcaggaggccgaggcaaaagaatcacttgaaccagggaggcagacgttgcagtgagccgagatcatgccactgcactccagcctgggccgcagagtgggactgtatctcaaaaaaaaaataaataaaaaatatttttatccaggtatttgattaaaaagtcaagtaggacttgtaataagtagctctcattctgggatcttccttcaccattgtcttggcaatccctttgcatttttgtgttggtattcctattttttctatgccacgcctacattattttttgtttacttttgaatttggtggagcatatcctctagtagctttaagaaagtaaatggaaagtaaacatttaataatacctttcaggtctcaaaatggggcgttctctatgctaccctcacgtttaattaatacttcagctgcttatagaattgcaggttacacatattttttcatcagaatttggaaaacattacacttttgtcatctagctttcggtactgctaagtccaaagccattttatttatccttctctgtatgtgaccaatctttttttctactcagaaagcttgtagggtcgtctttgtcaccattgcttagaaatttcacaattatattcctatttacatctatttatactgcagggagctttgtgaactctttcggcctggaaactctgccctcagttctaggaaattgcttgaattattttgttgatgatttcttccccttgcttcttttgttatctcttcatggaacctccatcatttagatcttggacctttttgtttgtttgtttgttttgagacggagtctcgttctgtcaccaggctggagtgcagcggcgtgatctcagctcactgcaacctccgcttcccggttcaagcaattcctctgcctcagcttccctagtagctgggactgcaggcacgcaccaccatgccaggctaatttttttttgtatattagtagagacggggtttcaccatgttggccaggatgatttcgatctcctgaggttgtgatctgcccgcctcagcctcccagagtgctgggattacaggcgtgagccaccacgcccagccctagatcttggacctcttaaactaattctccattttttaaaggattttctctcttttccttgcgttggtttttattctgaagaattaggagacttcctcaacttcatctttcagtcaatttaatttttcatttctattctcatgtttaattttcaatcacttttttattttaagaaaatatatagcattcttgtttccagaattgatatattttcttatctctaaggaaggtaatgataggctttctttggatgttttttccttcctgtttagtctgttttttccaggtggccctttgcctcatttgttttggtttcacacttttatgttagaggttttccttgcgtattcagaggtctgctcatatttatgattggggtagtaaaaagctcactagaattttaagctcattggtggtggacaattcaatacttttaataaatttatagagttgtgccgccatcacctgaaaaagttccctagtgcccttttaccattcattcaaactcccatgctcagccctaggaaaccactgatctgcttctggtctttataaatttgtctttctagacattttatataaataaactcatacaacatgtagtcttttgtgttttgcttcttttacttagctttgaactttatgttgtaacatgtatcagtatggtgtatttcatttcttgttatgtccaaatcatattcccttgtatggatacactacattttatttatcttctcatcagttgatgtgtacttgggttgttcctactttttggtcattatgaataatgcagttatgaacattcacatacaaggttttgtgtggtctcatttcttcagagtatataccaaggaatggaactgctggggcatgtggttaactttatgtttaaccttttgaggaactgccagacttttttccacagtgctggcaccattttatattcccactagcaattaatgagggttccagtttctgcctatctttgcctgtccctgttgttgtctgtctttttattgtagtcattttagtgggtgtgaagtggtatctcattgtgattttattggatttcctaatggataatgatgttgagcatcttttcatgtgcttattggccatttatatacaatctacttcacattaacagtaactgaaatccagtaaaatatgtaaactttgccccagtatattttcattccctgccccttctttattctattactgccattctttcatatacatgaatgtgtatgaatctgtatgtgtatatgtgtgtgtgcacgtgtacgtactgtatatattggaagcctaacaattgctttatacaattatgttttttaaagaagtcaatggaagaaataacaaaaagtatttttttagagtcttccatgttaatctacatatttaccgtttcctctgctctccattattacttgtggatttgagttactatttggtattacttcgtttcagtctgatgggcttctttgagtatttcttgtaaatcaggtctgatagcaataaattctctttctctttgttaatctggaatgtctttatttcgtcttcattttgaaggatagttttgttgggtatagatttcttgactggcaatttttaaaaatttcagctgtttgaatatgtcatcccactgccttttgacctccattttttctgatcagaagtttttgttttgatttttaaaatactctgatcagcagtcagctgttaattatactgactggccttgtacatgatgtcagttttctctggttgctttaaatattttcatgttgactttagcttttggcagtctgactgtgcgtttaggtgttatttttttttttttctttttctttttctgagacggagtctcgctctgtcgcccaggctggagtacagtggtgcgatcttggttcactgcaacctctgcctcctgagttcaggcgattctcttgcctcagccgcccgagtagctgggatttcaggtgcatgccaccacagccagctaatttttgtatttttagtagagatggggtttcaccatattggccaggctggtcccaaactcctgacctcaagtgatccgcctgcctcagcctcccaaagtgctgggattacaggcatgagccaccgctcccagccaggtgtgaatctttttgtgttttcctactttgggatttatcgaggttcttggatctgtagtttaatgtttttatcaaatttaggaagttttatccttatttctttaaatattttttctgtgtcttttttttttcttcctcagagactctcattatatgtatgctggtgtgctttatgttgttccacagctctttgatgctctgtttttttctttaatttttttttacctcagttctttatattagataattgctatgggtccattttcttttttctttttcttttttttttttttttttgagacagagtcttgctctgtcacccaggctggagtgcagtggcacaatctcagctcactgcaacctctgcctcctgagttcaagcgattctcctgcctcaccctcttgagtaactgggacaacaggcacgtgccaccgcacccagctaattttatttttatatttttagtagagatggggtttcaccatattggccaggctggtctcgaactcctgacttcgtgatccgcccaccttggcctcccaaagtgctaggattacaggtgtgagccaccgctccccacctccattttcaaattcattgattcttctgccatatagaatcccttgtttagctctctggtgagtttttcatttgttattttattcttcaactgtagtatttccatttggttcatttgaagtaatgtctactgagaatttcactcgttgttaggctttcttaaaactctttaaacatggtttcttttagttttttgaatgtatttatatctgagttgaaatctttattctctaaagccaacatttggggacattcagagttcctgttgattgcttttttccccctaggtcgtgctttcctgtttctttccatgtcttataatttcttgttgaaaattcaatatttagataatattctgtaccaattctggatactgatagccccctcccccaaaaaagttgctagcttttttatttgttggttttgtattatcttactagggataaatctgtgaaatagtctctgtctgtggtcattgatgtcattgctcagtgtttgttgtttttttgtttgtttttgtggtggttttgttgttgttgttttgttttgttgcagcctggctttccagagattgcttctatgtttgcttagctgaatctttagccaatgatttgacacagatggtgctcaaaaacttcaactctgtaaggcttctttcctctgttgatggatctatgtgtaggtaggggagtacatttactgtttaggcctttttcaagtctgttccagcttttactttatgttgggctcttttgaatcttttatgtgtatgcacatagccaggcatgtgtgactagcatgaggcttttctagcgtctgctgtgcctgtgaacagccttagccagaaattagtttgccctactcaggactgtagcttcaggctaatagagctgaatagttgaccctctgccgctaccacctttggaagtcacttccaatgacagtgccactgggcctgggcattgcccatatctccagcacaaagtgaatgttcttggactatgcagttataccctggtctgccctgatggaacccccacacttctggagttggggctcggatggatgggaacatcccttgcccagaatgccagagattctatttttaacccaaagttcaggagtttatcagtcataagcacttctcaatattttgttgacctttgttggatttccagggaactgaaatggtttttgtcaattttgtccagatttatagttgcttgttggggagaggatttgccagtcttctctctctgccatacctggcagtctgcttataatatttttaaaaagataaaggacagattattctgggctgtaataaaagatgcattagagaaggcaagactggggtcccaaaaagcaatgaggaagacttgtaaaggattggtaaaggtaagagaatatggtgcctaagtgaaagcagtggttatgaggctaaggaacagaaggtttaatggaaagaactttttgaatcctgatacggtttattttcctttttatcatactgcttctcatggagggagtggggaaaggattttatgtttagtcaggtatcaatccttggtctccctatcccaaggaaaagtatcaagttgatcttgtagggtgagcatagtcttcctactgggacagaatgcttagtgagcacaccctggctaccatctcatctcctctctgggttgggttgtcacatttcagtggccattttcaatctgtttgcattatatcattccgagctgcccagagccttgagttttgattccagtacctagtcattttcttcttcactattttccttgaccttaaaacttctatttgatcaggcagcagccacccaaaatttccttaggatatagtcttatccttgactgtcttagctgaaccttggagccttcccaaggtggtttttaactggcctgttaaaaacctgacctgttgagagctggttttgatcatgttgaagatataataaagcaaacaagcttttataggatatgaaaaaaaccatcagacccactaatttttactgtagaatgtaggctaatggtttaagtcagttaatagtacagttcttcgccattttggcatcttccttcacaatcctgttcccattatctccactttttcaattactgagtgccccatcatttagatatttcattccagtttatactactattggataagacatattcatttagcaatcctatactgagcactttctaatcatctggccaacatcattatcatagctaatatttgagtattttaaaaatgaattttacatagctttatctcatttaacctcacactaacactaaagtaagtactaatacaggctgtatttcataactgaggaaagtgagagaattaatatcttacgcagaactcatagtttgtaagtgataaaggcgtgatttgatcctaagctagttgattccaaaatgttggtttttaagtattattctatcctgcctgataaaacagacagttcaacataaaaccttaattggagagaattataaagtagccagtgatattgtgttagtaattctaatgaagaagaaaaagaaaaaagaaaatcaaactaaaaattggtatcagtggaaaagtacataaagtatattccaacagaggacgtttgagatctgtcactagaagaacaattgaggaagttgcaagaagaacgaacttacaaagtagttacaaagaagtttccagtgtatttattccttattgtcaactggttatatgctaagaatatacacctttaagcaaatgcccaaattgcaaggatataatccagggtactattcatacatttctgtaataaagaaaacccaaaccggtggataaatttatatagaaacacctttaaaatattgttgaacaattgatgctatctgaagttagtaaccttaaattagtaacattagtaatcttaaattagtaacatttgtgttctacagtgttttggttctagtatcttgttttcaaaaaagtagacagtatcacagattatatttaatattcttgcctatttgcagtagaaaacttgcctgtgatgaatatttttgtatttaaggcagtggagatggtatattagtatatatgtatgaacatatgatgaataaaagtgctattcatacaacatttcaggaagtaataaatttggtactctttctaaaagctttgagtactctatcagactatactttaaaagaactgagaaccaagaacccttgagtttgttagagttataggtgcaaattttctttggtgcttttcactattttgttataaaataggaatttgtattttattgccattgattaaaaaaaccttttctctaatttgtgagaaacatcttaataaagcactttaaaaagaaaaaaaatgtatagattacatcactgttctactcacagtcctccagtggtttcttattctaggtctaaactccagagtttttattaccgcctctctgactttacataatctgattcccagctaactttctgaccttgtttctttccttacttccccttactaactttgttacacccacataggtagaattcctaagggttgtgggaacataccaagcatgtttctgtctcagagtctttaacttcttccatctgctaggaatatccttttctcagagagccccgtggcttgctcccttaattcattcaggtcactgttatatgacatcttattagagaggcttgcctgtgcctatcgtatctaaaatagtatctccccaccttgtcaaccaatctctgctcctatatggagcagacactttggtgattgttttttactctattctcttctagaatgtaagtcatagaaccagggactttatctgttttattctttatgtagccccagagcctagaatggagtctggcacacagtgaatggatggatggatggatggctatatgggtagatggatgatgaattggaatgtctggcttttgtttgaaacagagatttgtggttattagacataatgataatttaattgattccttacatctctctagctctttaccattttcagtgattttatgctcactttgcctcatttaatccattcagtggccttctgaggtaggcagagagctgtagtcattacccctgttttataaattaaaaatgtgagacttaacttagacccttgcccaaggacacagggctaagaagtaaaaatctgggtaataacctagacctttctctctctgacagatgttaatatcactgcccaaagctatcacctatggaaaacagaatcttttactgaggaaggtgttgaaatccccttctctacagttttataaagcaaacaaacctagtgtttacagtatacatcaggggagctccagggctacctgatgatgaagagccttgctgagtcaactgtattcccacattaggtttttagttaaattttgttgagtggaatagtggggagaaaataaattagagcagaaaaatatcgaaatacatattttgacagggaaaggacctctattgagttttggaacttaaagcgatttaaggtcatctttcaaattataacactcctcttccttcacattcctcaggtgattaaacttcaaaccaagaggacagatttattgcctatggtcaccacaactgcttatatatgcccggcactgtcagtttttaacttatgctttgtgctggaggccctgttaaaatctatgccagtttttcttactttagtatgtcaaatgtggtaaaagacagtctcccacagtcagtacctctagtatattattccttagttcttccatttatcccgttattctgactctggaccttcctcttaggaggctccaggtgtcaggcaggaggggctctcatcctgtctatctcctataccagatggtcactactttaggacatggaccatctttttcatctttgtacatttatgtcaacagtacctatcacagtcttactgagcacaaagtaggtgctctgaaaatacctgaaactgttgaattatatcagtatatattaaaagatccccattgcctctccagttctttgctgatcaaatgatagaatcatttggtatctatcaaaaatctcatattttggaggcattttgtctcttaattctgtgtaataaacagtaatggtatgctatttttgcctggacctgccctaaaacctgccactcttggcccagctctcttatagtttgcatggggaaatcaggttgtcacagattgtaagcagatctaattagtggtaagttccattccagggtagggcagaaacttagggaaatagtatccagtctggggagaaattcattgttctctttagataacatgatcctgatgctgatgttctttatcttcaggttgaggtgaggacccctggtaatgtaatgggttcaggagatttttgcaaagagaggaaaagggcagggcaaaagcctgtttagactgccatttaccatatcaggagagagtaagaaattatagtgatgaattttgaaaaattagaaacttttgatctcttccctacatttcatactttatttcctgttcagtgtggagagaaaaattcatagaataagaaggtactgtgagcttgtcttcaggggttgggttgggggagaggcaggtagaaaagctgtaagctagcttcccattcacagctaggctttgagtgggagaaggaagccccaagggactgagtggatagtgatggctaaaagaagagggagaaacagattgagcttctgagactagctacacaaaggtgagagcttggaggctaatgtgtatttcagaagggatatcaggatggggtttctcgtgggaggtttggtgatcctgatagttaagttccatggcagctggaccagatgcatcttgcttttcttctttgcacagaatgtgaaggctgtgtctgagactcctgcagtgccaccagtttcagaagatgaggatgatgatgatgatgatgctaccccaccaccagtgattgctccacgcccagagcacacaaaatctgtgagtctttggggacctggccagttttgtgatttattagagtaagtggggagagggaggagttggtgctgatacctagaagtttaatattctggtaggcgtccttagattttggagctggtgaaatcactgaactaccttgactaaaggtactttctgtatgattaaagacaaaaaatcatgtgtttatttatcattggtttgcagatagtcccaaagtgtcctaggtaattgatgtttataccagtccagtctcggttctccacagataggacaggaagatatataggattgatgctacttagtgcaggactaacataaattattccagtctccagggaagcaacaaattgtcttgctacagatcttttcttctctgttaaatgtgcagtgttcagcctcttagagcattattgataatattgaaagacccaagagaatatataaatacattagtgctattaatatgctgggcatcaggagtgcattttgatgccggatgttggcagtgatttctatttaacttcctttgaggttcctgcatctctgagaatagccatggtccctctaaccttgctttgaaacatctagtccctgtgccttttacttaatttggcatcactgagcactgacctaccatcagatgatactctactagtgtttctttgtttaggtcttttactaagatgagagctccataatgaaggaaccatctagcacttctgtgatcatgaaagaaaaaaaaaagggctacctctggaatacagcattcagggaggtgttcaaacagaaattggttgaatgactattggagatgctgtggaggaaattcaaaggaattatatgacctattaggatgagaacttacaaacagaatctgtggaatcatctctgtaggtcacaaagttacctcaagggaaaatgcgcttcaaaattggagagtcgttaacactgatatggttttttttggtttgtagacatgttcatttaaaacatttttttccccactaaaccatgaacacctcaaaaagtagaggaaatccatatgtatgtatttctagtgcttaacatagttcttggcacctgcagaggtgggtaaatatcagaggacagtaaatattgaattaattaattaattgatcttcatagcatttctttctaaaaaggtattggtaattcctaatttatagaagaagcagctgagatttggagaggtgaattgatctgcccagtctcttagtaaacaaaagagccaggatttgaaagcaggtaattaaccccaactccaggttgttttccaccatagcacagtggtatttttgtgtgtacaaacctgtgctaggagccagagaaggagactattaaagaaggaaaaggcaaggtttctgtcttcaaagagatatatcaggacaggcaaaagaggacaaggcatggaagtacaggtttaggtgcctgggatatagtttgtctacaggtacaagaatagaaaattgagaaatcattatgctagagtagtaatcaggaaggaagccattgcctctgatctcagcgtcttggcttattgctgttcccactactggaatgttctctcccatttccacctattaaaagcctgtccagtcaaaaggtagcatggtcaagcagtccaaggtgcaggatgtagttggctttagtctctgtggagccatgggtttgagtcccactgttgccaatggctttgcatcatcgcagataaatgatcatcatagataaatgatcctctatctttgtagaaacctatccgtccttcaggatccagttgcaggatcctgtttgtttatttattccatcaaatatttacctgaatgcttgctttcttttagtaagtggttagatggaggaactcacggatgaatgacccacattccctgtccttatactgtttatggactatgcaaaagataattgtgatatttttatgataaaatctgttaaataccttgaagcatctcctggggaaaggaagtataatttatgatcacttctgaacctcagtagtatatagcttgcttatttctttataacatgtatcactttctgccttgtagttatgattttctcacctcctttataagaatgagaggttggggcagcattttgtacagggtgaggcaacaaatagattctcagtaaatgtttgttatgtaaatgaatgaataggacatttaatatttttaaaaggtaaaatttgagtgcttaatgtctgctggggatgagtctgattacctcacatattaatcagtttactcctacagcaaccccaaaagatagttatcattattatcaccattttatagatgaggaaactgaaacacagagaagttaagtaacctgcccaaagtcatgcagaaggtaagaataataagagttgggatttaagttcaggcagtcaggttccagagtccatgttctaaatcatcacactctactacctcttgatgaagaacaaaagtagttccttccctgcaagggttcaggatgtaaggagggagtaactcaatagaagttggtgttgtactagtaatgcaaagtgctatttgcattactacaggatatgtcttttaacttggggaagcataaaatattacaaatgaaggggattcttacctaatagaattgtcttcaactaatttcttttgttacagaatatttcttttagcttggggaatacaggatatttcttttagcttggggaagcataaaatattacagatgaaggggattcttatctaatagaattgtctttaactaatttcttttgatagttgtctagcctctattgaatatctttagtgctgagactctcacttcttttgtttacagtgagagtaaggaaggccattttacccagaatgggtgggcctgggcacagaggaggagtaatatagattttgacataagagaaaggatgagtttattggggtttgctctgtggatgttctaacctcacatctaggagaggttcccctatgctaacaaaggctggtcttgccaaaattttgcactaataatgcaggtatacacacggtctgtgattgaaccacttcctgtcactccaactcgggacgtggctacatctcccatttcacctactgaaaataacaccactccaccagatgctttgacccggaatactgagaagcagaagaagaagcctaaaatgtctgatgaggagatcttggagaaattacgtaaggaatttgtagctttctgaacctttcttcgttttatgactggtcaagcacagagatttgctggtcgtaggcttggtccatgcagctggctggccatgcttggtaccttaggcacagactgcttctcctcaccctgcccctgaacctcccttccctgtctcacagccctggttggatactatgttaggatggagatgtggtgagagtgtggatagcttactttgagggcagggcatccctcacccctaggcatgtattatagcgaagacaaatagtttttctctaatgaatagcctagaatgccatgttgagaaagactgaggacctagtggaaaagggcactgtgatcaattattgatgttttgccattgacctaggagaagacgcatctgccatcttggttgtaggaaaagagggaagggaagttaacattttatgaacctatagtatgtatcaaatgacaagcaaaatattttcttgattttttttaaatttaattctcttattaaccctgtgaagaaaagcattatgatcctaatttttgcaatgaagatatctgaggctcagggaggctaaatatcctgcccaaaatcacgcagctaaaaagtgacatggctgaggttagaacacagtttttgttcctgtaagtagagcatactgcctcttgctgtcaagtggaaacttccattttactttctttagctgccagaaatgggggtatgttagggtagcttatttctgtgtttcagtaaactgcagaagaattcatgttagaaggaagaactaggttgatctgtgggcttggaagaatcatttgacaagggctttaatttattcactgtatctacttacttccaaaaaggatttgatgtgaccgatttggcgacgtctgcaaactggcattgctttgtggttctctagttcttcctgattaattcctatatgactttaaaacaaattttcactgttttaaaaattgcccttttctggatccctcataaaatgacaaagtaagaaaagccacttacctagtcatctgtttactcctgtatgtagtcttgttctctaaaccagagttttttgttttgttttgttttaacaataacacttagaattatgacttagaattaagacttggcctgggagttaggacacttgagttgaagcttctgctcagccactgacttgtgtcttaggcaattttctactgttctctaaacctcatttttctcatttttaaaatagggatgttaatacttgtctcatttgcaaatcaaatgaggtaatatatgtgaaaagtaccaattcctagtaattgggtattaatggagagcacattggaccgggagactaaaaatgaaactcctaatcttagctctgacaccaatttgctgtgtgaccttgggggggaagtatcttcttcccttctgtgggcctcaatttctccatctctaaaatacaagttataaaacccagtggaaaacctctatgtcgttgcacttgaaatattctttgttgtaaacctcttctctactttatctctctggcttttacttaaagtggaaatcagtccatatatcacctttctgaagtttttccagtcttttttttgtgtgtgtgtgcctctttctgtacccctttggcttttatcacagcaattattatattttcatggaactttatgcttacttatctgtctcctccatgaaattgaccttcttgagagcagggactgccttgactgtgtcatatctcttcattcctaacacaacatatggcttggtgcgtattaaatgagtaaatatttactgaatggattaattaaaaaatgaatgacttttaggagtttagaaatggaatagcttactatgaatcaaagcagtcaaggtgatgaaacttttggttgagacttatgggggaaaagctgagggcctgtttagcatgctttttggctattggaggtagttctttaacccttgccagctacaggggttggggaaatgtggaaccttttttgtatcttgatttgggaaaaaatgattcatggtctctgtttctttcaaaggaagcatagtgagtgtgggcgatcctaagaagaaatatacacggtttgagaagattggacaagggttagtaggggcattttctttccctggagaaatgactttaaagtgtgtgtgccggcatatatgattttgctttttttttgcctctcataaaccttgttcttctttctccactttacccctcacccatctggagttgttatgtgagactgacttgagatttggcagaattatgcttaatatgagagagatgccattagctgaccatgttgctaaaaatacccctgcagtgacagtgagagaacggttttttttcttagcacaaaaccaacttcccaaattacaactctgcttttccggatgaaccctgtttgtcctagtgctgagatccaccagcactaatataaaatggaagacccaaaactataaatccttctactactgtgataggacctgtttttctaggtagatgccagaatttatccttcttgcattcatccttctctgtatcttatatgctgccctcagtgtaatgaattcagcaagtcttaactgagttcctattgtgtgcaaggcactatgaattcagagacaatctctgcttccaaggacctcaagtcaacagaaaaagataggcaaacaattgtatagtcatatgttgcctaacaaaggggatatgttctgagaagtgcatccttaggcagttttgtcatgtgagcgtcatagagtgaacacaaaactaaatagtatagcctactacacacctaggctatatggtatagcctcttgctcctaggctacaagcctgtacagcatgttactgtactgaatactgtaggcaattataacacaatggtggttgtatatctaaacatagaaaagatacggtaaaaatacagcataaaagataaaaaaaaggtatatttatgtagggcacttaacatggatggagcttgtaggactggaagttgctctaggtgagtcagtgagtggtgagtgaatgtcgaggcctaggacattactgtgtacgctactgtagactttataaaccctgtacacttagactgtacatttattaaaaaacaaagtaattgtgctatgacgttacaactgctacagtgttactgggtgataggaatttttcagctccatcataatcttatgggaccaccatcatatgcggtccatcgttgactgaaacgtcgttatgtgacacatgactgtcttgtgtttttaaagtgtttggctgttattttgagtgaaagaagctagatatgaaaaagcagatactgtctcatttgatttatatgaaattcaagaacaggcaaaagtaatatatgataatagaagtcagaatagtggttatttctgggaggaggatgtagagtgggaataggcatgaaggaatcttcgggggtaatgactgtagtgtcttttgaaagtggccattattttgagtgaaaaaagccagatataaaagagcagatactatgtcattctatttatatgaaattcaagaacaagcaaaactaatgtatgataatagaagtcagaacagtgtagttatttctgggaggaggatgttgagtaggaatagtcatgagggaatctttgggggtgatcttggtagtgaacacatgggtgtgtacatatataaaaatcaagttgtacacttaagatttgtgcaaattaagttatacctctctataaaaaaaaaatgagatttctaaagacccaccaaaagagataaaattaaaaagaaactgaaaaagaaaaatgtctggctctcagtgttagtggaatgaaagcattgttgctaatgatgtcattgaaattttctttttttttttaaattatacacccaagaatttctgaaaataaaagattgcataatatagggaggttctgtttatacagcattctacagttcacatctgttatttgcatttattgtttaatcctcagaacaactctgggcttgagtggatcttatttttttctagttccagtgtttttcaaaatagacatacttttgtgagtttgaactggtgtaaggtatttaacaccttgagaaaaaaattattttgcttacctcagagtaatgtgggatggtatttcctttaggtagtgaaattgagatattaagaatgtagcagaaatgtacatggacaagcataggcaagtcaggtttcttctctggactggagtttcttcctgtaaatttaaggaagacagattgtgaattgaggaccttttacctccagaacttttgtgactttttttttttttttagttactgatatatgagacctataaataggcaacatctgcataatgttctttccttgcttacttgacaggtctgttagtgctaagggaagaatgaaatattaattaagcacttatgctgatgtttccacattgcataatttttaaaatataactgtcacaccaatatgatgaattggtaatattgtaatttttgcttgcttttatttctcctttaagacctgaagattattattcttttggacttggaattcatatgtctaattatatgtctattcaagttagaaataggtattaagcagtgggcctaagtagctttctacaactttgtaatcatggagacagtcccctgaggcttgggcatgtttgtcctttaagaatattacatctagtaggatcaggaagggatggggataggaagacagataccagctttataacagaagatagctaggggcaggataatcaggcagtgaagaaataactgcctgtacaagtcatccaatccttattttatagccagtatgttatagtcacagtttctaggcatgtagctagggtcccaactaaagagtgatgattagggagctggtgaccatagtttctagctgcaaggcatgcttacacatgacttttccccctggattgacctggaattataatctcagggcttgcctaggaagcagtcttgtaatagagcagaattttaattttcttcaaattgcatcatatgtacctaacatatggcatgtacaggtacaaatatgtgttacaaattacttacctacaaatacacagggtttatggtcttaagcataaaatgagggttttagttattttgaatggatttagttattttgaatgaattattactttcctagcattatttctgcatttcttccccccttctctgtctgtatatatgaatgtgtatatacttaacatacatatgtgtacacacatgtgtcaagtggggtcattcttaccttgggggtggggcagaggtaccctcagatcttctgggagcatgtatgtttgaaagagtatatttaatatcattttatgtttgaaaaatgaaaactaaaaaccacttttataatacaaactacagaaaacaaaattcacatatcctgttgatggaataaatgattgaaaaccattattttattttaaaggatccaagtgtatcctgtaatatcagagtgggaagggtactttgagattagattattcagtgtggttcttcaagtttttatagttttttactatttatagttttttaaagtaaattttcactaaagatagcatacataagtgtacaactcaatgaattttcaaaaagtgaacacgcctatgtaaccagtacccagattaagaaaaagaacattaccgacaccctggaagtccatattcctttttgataaataaataagatatgctggcccacccccaaacacattctgaaattctccgcagggcccctttctccccacctgtcacccccccagttgaaaatcatagatctaatcttatcccttttatagatgaagagtttgaagccacaagaaattagagccacgtgccaagggtgatggaggagaggagagaagcaagcaggaacaggaaattaatatatattgagcatctgttatatgatatgcagttggctaagtactttacatgaactaatcaatttaaattatcttgtattctcttatgtccactttacaaatgaggaaagtgaagctcaaagaagttaaataactttcttaagatcctacctagtaggtactaggtagaagtaccaggttggaattcaggtctcctggccactagagcctacattctctgtactacctcttatagcttcttaaatgtgagaatggatgctgcagggagaggattatttttactgctcttgtttttgacactcacagattgtgtgtagaactgcatttgacaaatatcactttattgaacactgtgtttttttccctctttctccgccaccttactgttcagtgcttcaggcaccgtgtacacagcaatggatgtggccacaggacaggaggtgagtatccaccacccactgttgctcctttagttctgtttctttttatttgggattaatttttagcccttgttaggtcaacaggaacagttctaggtttttttttttttttttgggatggggtctcactctgtcatccaggctggagtgcagtggcgtgatctctgctcactgcagcctccgcctactaggttcaagcagttctccagcctcagcctcctgagtagctgggattataggaacctgccaccatgcctggctaatttttgtattttttagtagaggtgaggtttcaccatgttagccaggctgctctcgaactcctgaccttaggtgatcttcctgcctcggcctcccaaagggctaggattacaggcatgagccagtgtgcccagctggaacatatctagtttcttactgtagcatacaaaagccaaatagcaggataacattatgaaacttaaggtttggactaaggtgaaatagttagatggagggaagtggatggatttgagagataacttagcaggtaggttcaacaggattagatgattgaatgtgaacattacttacaagtgggtgatattattcaaggagaaaggaaaaagaaattggatactgcctgattgccaagtggatagttgcttacataactttggggcttgggggagaaatctgatctacaggagatttaaaccatgtctcttgactcctaatctactggtgctacctttactttccactgaacagtgaaatcctcatttatttggaggcagctttttgtccctctcatttcattaagccatgagaactatagctaaagcctgctgacccaaggtcttatattcagtagaagaaagatatgaagggaatatagagtacttgaggtttccttgcattttaatatttggttgcagagtaggagtgtcagccaatgaactgtggatggcagctgccccagagaagttcttacttcaaagagtaccagtacacaataattgagagaggcacctcctcttccaatgaaaatagagttgggcttctgtgagggaggctgctagaaacgtgcttctatatttttggtggttgaaaccacgtggcaccctggagaagtcatggttaataggggtagcacatatctcactaggctcttgtgagtttttacaagtgttaaagccaaatattaaggctccacctagggtaagccaagttttaaaaatcattattatggttaaggatttattcattattctttgatgtgagaatccaaagacctagatgcttataagcctttagctacttatataaccttgggcaagtcatttgacctctctgagcctgaattttatatatttataaaatgtgcataataaaatgtccacgaaagtgttgaaagaattcagtaaagcaatacatgtgaaaatgcattataaactttatgaactacatattcatatttattcatttttactcatatacatgtgtatgtattccacaaagcatttgctttatgccacaccttatgctaagaattctgtgaaagttcacagacattaaaatcatatgtaaatgtaagagaccataatttcctttgtgtacatataaaagccttgtaatattgacacgaatctgccttaaagtaaaaataatggtgaggaaggaaggataatattatcatggcattttaatgatggtgaatatgatgcagagattaaaataaagaaggctataccaatcctgaaaagaactctatgaggtaggtaatattatttcttctttactgctgaggaatttgaggctcagggtgtatagataacttttttttgcaaagttgtactgtcagcaattaccagggactggattagaatctttgactcctaatcctgtgtgttttgggccgcaagagcacaacagagctgaggttagatactagagtcccttctggcctctcaggcctcacagtccttgatgggaggcaggtaggtgatgatggtggttcctggaagccctggaggctggctgtgtgagaagctggccagaggaaagagaaatttaaattcattgtatgcgtgtcttgtggttacaaaactatgaatggaagggagtccatcagggtggctaatgcagtgtggtcaggaaggcttcatttcctgccccagggagaataaatctttattggagtccatgggatgctctcagtctttgtgagttcttgcttattgggggttatccagctgagaagggcagacctagtgtctcacatataggaagaatgttagtgctgggaagtcttccagttaacatatccaacaattatttttcaagtgtgtttttagagagaatgtgtacaatagaaagaacagactggaagaggctttggagtcacatggacctgtaggcattgattatgaccttagaattttcttatgagtcttagcctcaattttcttactgaaaatgcagatcatgattcttactttgtagggttgtgtgtggttaggttttactgtgataatataagtacggcatctagcacagagcctggcacacagttggtatttgataaacagtagcggtgggagagtagttgctgtgccaagtacttattaaatgctgttattactgtgattaccatttttgttattgtctaaatttattgcttaaattatttacttatatgtgagtaatgcattggccattgtctcacttggtattcaaaacaatcctgaaaagaggggaatcaaggttgagattatcttcaatgtattgatgaagagactgaggctcagagagcttgtgattggtcaaggtcagtaagtgacagtcagatcctgagcttaagtcctcagagttcaagtccagttctttttctgttacaggaatgctatctcctagcctatataggtggggcttaggtgaaggacacttagcctagcccatagttagtagctattgaaaaggactcctggccaggcgcggttgctcatgcctgtaatcccagcactttgggaggctgaggcaggcagattacgagatcaggagttcgagaccagcctggccaacgtggtgaaaccctgtttctactaaaaataccaaaattagctgggtgcgatggcagatgcctgtaatcccagctacacgggaggctgaggcaggagaatcacttgaaccctgggggcagaggttgcagtgagcagagattgccattgcactccagcctgggcaacagagcaagactctgtattaaaagaaaaagtaaaaagaaaaggactcccatgtccttccctagcctccatgttagcctctttctgcctctcctcccctgctgctgccagcagtgaccactgtgtggttcgtaagcagtgtcccatcctccaagatggcatgagtaactcaaaagacattcttctggctccagtccttaatgtgcgttataagggctaactatacttaatatctttagatcaacatgttgcttttcaaacgttaggaaaaactaatgctcagctgttatagacagctgcagccagaccagaagcctgacctaacaggaaaccccactccaaagcaatttttccttacttgaggtagggaatggaggtggtcagatttttttacagaattacttctattctaaatgattaacctggtctctgcaagagactgtccattcttgacttgaagaaataatagagtcagggatttgtcacataaaagtttgaatcattccttctttatacttcttgctgcttctagaaagacaacttagttctgttagatgttcgtgttcttgtccactaagcaggaaaaaggaaaaatatctctagagaatgaacacttagaaaataatttaaagtatacttctatgggatagaggagcccattgccatttttttttttgtttttatttaaaaacaaagtactttccaacctactgatttctctcttgccatcttcctttctacagacatttgttgagcaccaactctgtgtgtaaaggcctgtgtttggcattgagggttctgggctttcaatcaagccctcaaacctctcaatacacacaaacatacacactaatcattatacatgatagcaagttgtaagttccataagagagggataaatatgatcttatagggctttaaagaagggaaaaggcatattgggtttggagaatgaagtttcctttggcctgatacaaaaagagtaagtagcttttgaatgtatggaaatgatacaggctgttccagatgaagagaagattctgaacaaaggaagggggactagataccagggagaacatggagtgttctccatgaacactctcctctgtgaaggaatagagttggaagtaaagtaggggccagatcatgagaactttgaatgttgtactgagaagcatttctaggcaaccaggagccatgtaagtttttgaacaaggttatcaaatgtgtactgtgggggaaaattaatctggctacatgtacaggataacttgacatcccttttgagggttctaatcctgattttgctattgaatagctatgtatgcaagtcacatcctctctgaaacacagtttccccgtctgttgaatcattagtaatatttagcacacaaggtgtctttgaagattaaatgaaataacaaatttgagaacaccttataatagtaccttacacatagaaggaattgataccaagtaccttagaaactaacgtataccatatattcatgttgtctggaaatttgtttttatttctgtagatagagctctcatcctccttttctcttctttcttaacctgatcaactctgatttatctttctacgccaggttcagaaagtcacttccccctttatgaagcctctatacctagccagattgaaagcattcttggcttttgccgtattttatgtttcgctagcattttgtatgagcctctgttatagcatctcttttctgttgtgactttttaaaagtatttttctacaccaaagtttgattctgaaactttgatgtgtatcacagtgacctggaggactttttacatcacagagcttctgatttagtagatttggggtgggacccgaggtttttatttccaacaagctcccagatgatgatgatgctggcttgagacctcactttgaagaccactggtctacatagacaaactgtgaattactcgagggctaagactgtatcttactcatctttgtttcctgagtacttaaggtctggtacttagcaggtgctcaataaatgggaatgactatggttgcacattgaatatactcttgatttcaggtggccattaagcagatgaatcttcagcagcagcccaagaaagagctgattattaatgagatcctggtcatgagggaaaacaagaacccaaacattgtgaattacttggacaggtatggagtggtgggtcccatcagagggaaagggcctttgggactgattggtggtgaagctgttagagaagagggcagtgccagccctcagaactgcctccatttatgagtcttctgtgatgctgagctctctgtatgtgaccctgtgtaatgctggacaccttttttgctgggaaatccttctgtgttaggctgaactctaccaccgtgtagcttctaacagttgatcctcgtactgtttgttttgcctaagggaaacctaccaacccatctgcctgagtcaaacatctaggtccttaactcattttacatcccaaatctttccttattctgctcatcctcctgaataacttgttgtttgtttatgttctcttaaaatgcagtgtgcagaactagatgtttcatttgagatctgaccactatggagagagtgggactctttctaaactcaacacagcttaatgatttcattcttgttttatcttttaggttgtctgctttgactcccagtaagtttgcagtcaactaaaatttctgattttttttttttttttacataagcttgcattaaactggaaatgtggaactttttcactatcttcattaagtcccatttttattattttagcccatcattccagcccatcaaaatttttttgcaaaatagtaatagtggttgtatataatatttgtattgtgctttactttgtaccaagcactttcatgaacagtatctcattgtgaggtagggtttttttatccatattttacagacaaggaaactgaggtttatagacgttaataacttgtccaagagtagtaagccataaaacagcaaagcagtgttttgaatttgaatattcctagcaccaatatctagcacctttctattatatcatgttcttttctccgatacctgaaaaaaaaaaaaaagttaagcttcttgcccagggttcagagacatcgtaggtggaggtgaaattggactaaatcttggactctaatttctttacctcttatattgcatgaccagctacctcttcctgttactggtagatttcataagggcgccttcttgttctgcatctaaaacactagtaagcttcagtttccttaaagaagaaaagagttgaactttgacattcccaacactataaagaataaagccttcttctttgagatggctgtgtctccttaatgtgggtcttgactggctctgaagaatcctctgaaagttagtaccttatcatctctttcagaacttattatacagagaatatagctcatgcaaactactgaaggcgacaggggtattagattttggttcaggatatggaaaaatgaaagctgtcagtaagggtatggcctgtctcacaaaatggtgagttccccatcagtggatgcatctacatgataaaacgatgttattgaaggaatttgtgttctgggagtaggattaagagacttatagatttgtttattaatcatatctttaccagtattcccagagacttttactctggaaattagaagtaaataatgctatctttgccctcaaatagttcctggtctggtatagaaaaaaaaaaaatacctctgtaaggtcatggaagaggacattaacctgagcattcagtgaaggtgttgcaaatgagggtctgtggtttttgtgagatgtcccagaggggaactccatcacatatggatgaactcatgggcagaaccctcatgatgtaatcaccttccaaaggccccacctcctaataacattagtgattagattttcaacatataaattttgagggacacaaacattcagaccatagcagttcaaatccccatagtcttctctctcaaaagagattgttgaagaaacacttagtctgtcatgtttattagtcaggacattaaaaaattataaatcagaacacagagttttatggaaagagctgtcgattagtagtcaaaaaaataggattcaaatcttacccttgcttgattgcatttgttaaaatcttccaacagtctccacatctgtccagcagtattcccaatatcaggatgaagataagatgataccacacagttcaagccaatgcaagaaatgtttttttccaatccagcttctttgtccaagactggcagaagactttagggctctaggctcgccttgtttttatttgtctgattctatagtaaggaaacattgaccaaataggctaagtgacctttttatttatcgtgtaatagggttgagtgatccaactcctgagtgaaactatcacttctaactcatgtcagcccataatctctctggggatatcttactaaatggtagtcttggcttatcagaaggctttggctccataagcccttgctaaattcattccattcttgaaccacagacactcaaagtagaggtcaattgtcagcataatgactatgtatacaacactttgcagcttttaaggggctcctataaacattatttcgtttaatatttatagttatcttttattttttcagtgatttatttagtaaatattggcatctgctgtgctggactctgaggatagagtcttgaacaagacccaatacttggtctcatagatctcagatctggtaggactctctgggaggtttagtagctctctcttctttgggtaacatggactctaaatcctatctttgtcaaatgtttggatgcttctagaggtgtgggaatcatgtcagtctttctaattttaggatgtcttcctttgtgttgtgatgaaatataattttattgtatcacttcaagctagagatcttagttctgccctttggggcttcacagaacatgtatacttggttttctccaggagcatccttgagagattcaaagttagtgattctgttccccagattctgcttttccccaaagtaaagaaccttttactttactttgtgctaagacgtagtttcactctgtgtatatgcttagcctttgaaacccagtgctatggctcagtgtactctgattgttctctctcaccctttatctgtattcctgcagttacctcgtgggagatgagctgtgggttgttatggaatacttggctggaggctccttgacagatgtggtgacagaaacttgcatggatgaaggccaaattgcagctgtgtgccgtgaggtaaggccaagggccaagcagtcttgggtagaaagctgcctccatattcctgtctcctgaagttccctgtacagtgagatctcagcctgggctctgtggaattggtagaaattagtgctgacactgctatcattcctgtattgtacctgtgtttgtcatttctatcaccatgattttttttttaacgataactttattctacccattgtagaaaaattataaagtactagaaagtatatattgtaaaaagtcactcataattccagtcttagagataaccacttgcctaagcacgttataatatattcctttatctcttttatctgggcatatatttcaatcatttttattctgctttcttgctttatttatgtgctataaggaaaataaaacagagtaagaaggtagtgatggaggaagtactattttagacaagacagtcagggaaggttttgctatagatttgagtaaacatctgaatgatatataaaagcaagccagcaaaaatctagggtaaaatacttccaggaaaataaaaaaagaaaacaaagctcaaatagatactccctttctcctcattgctattaaatgtctagaattgataatacgctgatgtaggaggaagaaaagccctccagaaagcctggacagtgtcctcagggaataaccacatttcatttccattagagcaaaaagatgaagggaatattcagagacattgaggatattgggtgttttgctgatgacagactggactttctgatggcccaataatgcaaaagtaattgcggtttttgccattacttaaaaaaaaaaaaataccaaaaccacaattgcttttgcaccaacctagtagaaaagttaggaaattaggggaagcatagaagatgagatgaggttcagaattttgtggagatgagtataatagtatgatgggggtttgatggtgcaagagctgaaggcatactgctgaaattatgtagttatatatttaatcagtgttaagaaaaataaaatgtgaaatcaatactgccctagaaaataatggtcccctttgcaaacaactttgggatctagaatgttcacaagtaattggaattaattaatggaattaataccaggctgggattcttaggggttctgactttttttttgttccactactaatgcagtatttcgtaaccttcttttcattatctccttcttaaggaggctttttcctaatcatactccctgccatgaaattgtaatatcacagatatatagctaagctgtttgggtcataaaccattgtaatacctaagatttttttcaccccacccccttaccctcaggaacgaagtttcactagttgagaatacatgcatatgtatactttgggaaatcattttgcctcattattaatctgtaaaatggaaattgcaacattcacactatatataccttaggggtgctatatggatcaaaaagcacttggaaaaaaatgttaatgttgtataatagatggtattactattcttcagttctaatagagatcatcttctccttttaaaaaatctttattgagatataattcacccatttagagtatataattcactagtttttagtatattcatagagttgtacagccaccatcataatgaattttagatcctttttatcaccccaaagaggaaattaatatccattaacagtcactccccatgtcccctgccctgactctcccagccctatgtaaccactaatctattttctacctctgtagtttccctgtactgggcattttatataaatggaatcatgtaatatttgctcttttgtaattggcttcttttacttagctagcattatgtttcaaagattcatccattttgtagcatgtatcagtacctcattcctttttattgccaagtaatagaatggacatttgggttgtttctgttttcggctgttataaaaaataaaaaattactctatgaacacttatataccagtttttgtgtggaggtatgttctcattctcttggatatataactacaggtggattgctggtcatatggcaactctatactcaacttttgaggaactgccaaactgtttccgtagtagctgtactgttttacgttcctgccagcaatgtatgagggttccagtttctcaagataattctttttcatcataatttctgacatcctgagacctgtttctccacccttctaagaagagcagctcttacattttcagggaaaatccaattctggatattgttttattcttactttagccattggtatattcttagaaagtaaagtattaggttaggaccatttaaatagtattttcctgttcacttatatctttagtgttttttaattggtagaagtttctaaaaaattagttttgggtcaatgaaatcaaattattgatttagtagaaaagctgagatgatctcatctgattcccaaattttatagatggaagtccagaattatatagtcaatggggtagcagcagaaccaggcattttaattgtaccattgtgtctctttattactcattctgcctgctaagtataggtgttttccaagattcttctctttctcctttaccctttgccgggttcaaccatttttataacttaaacaaaaatcatctcttcccaaatgacttgtaaatatttaccataatttatcataaattaagttgcctaccagacatttgtcttcagatgtcaaattcagcatatccaaaatagtacaaaatatctcctcaccaaaataagattatcctgctaacttactgcttctagtatcacttccatatgtctgcttcctcaaatatgacccttatttgttgttttcctctggtctgtcattataagatcctttccatttttcttcagtaatttctcttgggccttaggtcctttaccaaggatctaattagaaaaaaaattacattggaggaactcctttacttaaaaaaactgttttaaggtgaaaggcagcatggagtgttaaaagaatgtttagctaggagatggaagacttgtttctagatctggctctgcgattgatttggggcaagtccttttactcactggggccttacttcctttattttaaagtgaagaggttgaattagtggattttctattaagtcttctgtattatatgtatgtcctttctttctccccctgcccacaccacttcaatagtgtctgcaggctctggagttcttgcattcgaaccaggtcattcacagagacatcaagagtgacaatattctgttgggaatggatggctctgtcaagctaagtaagtaggagccttaggaatgataatacttctctgcctgtggggccctgtctcctgtgagatggtcatcatataatagtaactacgacactcaccaaagggtctttatgatttcatgggatatgagggctgttttatattttctgtattaatcataggatatcatttcattattttttcattcatttatacatttaacaacaaccacaaaaaactttgctgaatggttactctgtgctaggtcctgtgatgggcactgagagtaaattttccctaccttctcaatctagtatggaaaacgtgtaatagataattagaaaaaagagttttgtataatttctttcattcagttattcagcaaacttttattgaatgtccagtacatgctggtccttctagggatatgaggacaagtaagaggacataatccatactctcaaaggcttcctaatttaaataaatttataattgcaatataatgtaaaaaccatggcaggtagagcattttgttcaaaggtgtaaagaccagtagaccagacaaacaggctgtgtcatgggtggatgggcagtttatggaaggactgctagcagccctgggtctggggcataaaaacagggccatgcctagtcataggtgattggggtttaaatcaaggactcgtgcccaaggaataagacaaggacctagtcgccagatttgggattatgggaatggtttttcaagaacaaagcagaattgggatgagcaatcaagaccaaaatgggcagcttggactttaacactaagtcccctggtttgaggagaagtaggaggccagagatggtgtttcttatattccttctatttctcttcagggttcaataggaaataggctaggagctagacatgaaggtggtagtcaagtgactttggagagacaaaggatagcagagctggaagccaggcggatcttgtcacctatgtgtaggtacacagtcaacacttactgaagtgagtgtatatcctaaatgtatgttctttctcttatttttcttttctagctgactttggattctgtgcacagataaccccagagcagagcaaacggagcaccatggtaggaaccccatactggatggcaccagaggttgtgacacgaaaggcctatgggcccaaggttgacatctggtccctgggcatcatggccatcgaaatgattgaaggggagcctccatacctcaatgaaaaccctctgagagtgagtgttaccagttctatttcaagttatttgggctgttgtctctagtcccaggaaataagaatccagggtgttctctgtggttttcaacctggagatcccttttctggatacaactagtcactgttgaacttaaagtataaatggccaaagaaaaggaatattagaagtcactcattcatttattcaacaattatttgagtccctgtcaagtgcaagaaactattctaatgaaaataaaataaattaatatgtagtaacagatggtaaatgctgtgagaaaaagcaaagtaagggagttaacagagtaatggaggaacaggtgtgctattttagagtagagagggaagttctctcttataagttattttattctgcagagttgggaagtcattagagggttttgagctgaggagtaatgtgatctgatttatgttttaaacagatcattttggccgcttttatggaaaatagactgcgagagactgttgtaatagttcagagtggtggtgtcttggtaggagtggaagtgagaagtggtcagattcaggaaattaaaggactagctgacaagatgaactgaatattagagaaagaggaatcagcaatgactacaagatttctggtctgaattgctgaaaaaattcagttgccatctgttgaaatggtgaagagcatacttaagttgggtaataaagagttggttttgaatgtgctgatttgaagtgttaattggacatttaagtggagctggagtagagtttggcttaagagtctggagttcaagggtgagaagtcaggactataaacataaatttattagtagataatatatagttggtatatatagtaggtagatgagatcactcacctagggaatgagtacagttaaagaaaagagatttgagtactgagctctaggttattccactgtttacaggttggaagaactagcaaagtagaccaaggagtggcctttctagtgtgagagaacagagaagtgtcttggaggtgaagtgtcctggagatgaagagaacagtgtgcttcccgaaggaggaggagggtagattatgtgtcaaatgtgattgataggttaagatgagactgagaaatgaacattggatttgccaatgtagaggttcttaatgaccttaataatcagttatcagtagagagatggggatgaaagtctaattaaattcatgaaagtggaagaagaggacattgagatggcatgtataaacaggtttttttttctcttaaaggaattttgctgggaagggtaacaaaaatggagcactatcttaaaatggagtcaagggagggtttttctaaaagatgatgtctgtgtgctaatgggaatgatttagtggagaggaggaaaatggtcatgtacaagaaggaagtgacaaccatagaagtgatatccttaagtcgatgagaggggttcgatcaagtactgaagtaaaggacattagattagcatggacaatttatcccttgtaacagagcatctcaacacaggtgcaaataggttggtaatcttggtgtgggcaaatgtgaaatttattctgattgcttttattttctcatttattcccacctcccatccagtgcaggaattccctgtgcactgttgctggtaggtggtcatctacatgctcatgtcatccttgaatatctctgattattggaaattgcttcagtgcaccaaactgaaactaccttctgtagtttctatcctttgatcccagctttgcctctgactccacatacaacatactcttccctcccttagaacggccttgcagatatttgaagatgataattgctgggatatgttggaaataagacagaatgatcctagacataggcatatttttttatttttttatttttattttatttttttttttgagatggagtctcactctgtcacctaggctggagtgcaatggtgtgatctcagctcaccgcaacctccacctcccaggttcaagcgattctcctgcctcagcctcctgagtagctgggattacaggcacctgccaccatgcccagctaagttttgtatttttagtagagaccacatttcgccatattggtcaggctgttctcgatggtctcgaactcctgacctcaggtgatccacccacctcagcctcccaaagtgctgggattacaggagtgagccaccacgcccggccctagacatatctttttatgtttccggaccctatctgtgaagtgaagatgataagtcttgccctattacccagagttaattgtggccattaaattagacagtgcttatgtaagtactctttgaattaagtgctgagtgcttgtaaagatttagtcttactgtttttctttacctttcccaggagacgcttcatttaggggactagggtggcaacagttttcacttacatttaatattcctttcctgctagaagagatcagttcttggatgactgaggtgaaggcaccaggaataatttctgccagcagctgggcagatgtttaactcaacaggctaaatggataataaacccttcagatgtgtaagcaagaataataataaagccaggcacagtgactcacgcctgtaatcccagcactttgggaggttgaggcaggaggatcacttgagtctaggagtttgagaccagccaggccaacatggtaaaaccccgtctctactgaaaatacgaaaagcagtcgggtgtagtggctggtgcctgtaatcccagctacttgggaggctgagtcaggagaattgcttgaacctgggaggtggaggttgcagtgagccaagatcgtgccactgcactccagcctgggcgacagagcaagactccatctcaaaaaaaaaaaaaaaaaaaaagaagaagaagaataaacccttaggtctgtaacatatttcataagtttacaaagtactttcaaatacactatcttattttatttttacagacatgtgagatgggcattatcatcatccctactttacagacagggaagttgtacatagtcccatggcctttaaatgttcaacctgatccttaggtcatactctttccagtatatatacacagctgctactttgcatcctagagcataaagcagctgaccatatttctagaacttgtatatggggaacaagagagagcctcatttggagctcaaggtgattcaccatttttattgccaggccttgtacctcattgccaccaatgggaccccagaacttcagaacccagagaagctgtcagctatcttccgggactttctgaaccgctgtctcgagatggatgtggagaagagaggttcagctaaagagctgctacaggtaactgtccttatgcagggaagcacctaattcagggaatcactaaaccaggccttttttacttcatgtttgtaaggtactggatattatagaactaggcttctcttctaccacttcctacactcactctgttcctactgcccttttatccctgggcctttgctcatttattttcttagcctttctcagcctgttaaaactctacacgttctcctaggctcagtttacaatctattttctgagcacctattgagctttgcttgtagcttttttgcttgcttccttccttcctttcctttcttcttcctttccctttccttcccttcctttcccttcccttcccttcccttccccttcccttcctttccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggcttgtagagtttctgctgagagatcagcttttagtctgatgggcttccctttgtgggtaacccgacctttcctctctggctgcccttaacattttttccttcatttcaactttggtgaatctgacaattatgtgtcttggagttgctcttctcgaggagtatctttgtggcattctctgtatttcctgaatttgaatgttggcctgccttgctagattggggaagttctcctggataatatactgcagagtgttttccaacttggttccattctccccgtcactttcaggtataccaatcagacgtagatttggccttttcacatagtcccatatttcttggaggctttgttcgtttctttttattcttttttctctaaacttctcttctcgcttcatttcattcatttcgtcttccatcactgataccctttcttccagttgatcgcatcggctcctgaggcttctgcattcgtcacgtagctctcgtgccttggttttcagctccatcaggtcctttaaggacttgtctgcattgattattcttgttatccattcatcttattttttttcaaagcttttaacttctttgccattgattcgaatttcctcctgtagctcagagtagtctgatcatctgaggccttctttcaactcgtcagagtcattctccatccagctttgttccgttgctggtgaggagctgcgttcctttggaggaggagaggcgctctgatttttagagtttccagtttttctgctctgttttttcgagacaggatctctctctgttgcccaggctggagtgcatggcgcaatcatggctcactgtagcctcaacctccccaggttctgctgatcttcccacttcagcctccagagtagctgggactataggcgtgcaccaccatacctgcctaatttttctattttttgtaaagacagggttttgccatgttgctcaggctgggctcaaacgatctgcccaccacagtctcccaaagtgctggaattacaggcatggcatcagccaccatgcccatccatggaacataagtttagaagataattagtgagtgtggcttttggagtctttacactttattcattggaaatcctcagataatggcaatgatactctacttattgagagtgagattttgccagtttgtggggaaacccggagtcaggggtttactaggccttttatactcctgcctgcctaatcctgataattttatatggttgcaaaaattgcctttagcaggccgcatcatttgtatttaacatatatgtttcaagtacaatttcttataactagtgttcttttattgtattgcccactagtgatctaatagtaagtatcacatgcaactttatgaaggcatgcactgtcatttgctttcgtattatgaagcccagaagtgacagagcagggcagggcagggcagggcatactgccctgtgttaattatgaatctctttcctattggattataacctctattttgttaatccctgagtctcatgttttacctaggacttgactcaggataggtactcaaaatatatttattgaattgaatgaaattactggaagaacccacattggaatatcaccctctggaacatacttagcatgtctttgtaattgaggttactgattatggcatactggcctattagttatgagatctgggttctgccaagtataacccattagtctctagtatctgttggaactaaaagtctcttagtacaatgtaggaccccttttgctgttcatgagagttgtattctggaaactgtgggcactgggaaatgtgtaaatactatatgctaagcctgcgattagtaaagataccattcttaattaaataccaaattatagttcttgaaaggttagtgacctctaaagttttcttcctgatatagtaatataactagtaataaatgggttatattgaatctttaccatattttaggcactaaacactttatatatttaggcactaagcactttatatattgtcctttacaacaactctgtgagtcataggttctattctcatttttacaggtgagaaaactgaggtttcaagtgtttagtaacttttccatgatagctggtaagtagcagatccaggatttcagcctgtttggctctcaagtgtgtatgctcttggccactgctcttaataggctcaaagagtatcacaactggaagcccttagggctcatctagtctgttttgtttattagacagagaaggaaactgaggcctcccaattcgatgttggatcatgctgctctcaacttaggggaattgcagaaacatgtgatctgagaaagctggctttttaacttgttggtgtacattgtaaatattgaaaaccatgactttgagaatcacaaatcataaaagcttcacatctgtttctcctgtgagaacacacttatagacagaaatacatagaatgatatatattggaattcatatcttcatgatttagctaggatcttttattcctttcatagtaatagtacgttcttgttctcagtagctctttatactatctctgtcccaacagaagttgcagcaattctcagcaaagaatattagtatatatgtttctctctctttctctttctctctctctctctgtctctctctctctctgtgtgtgtgtgtgtgtgtgtgtgtgtgtatacatatatacaatatgactaatcaagggaattgtaagtatggcagaagaatcagatatgctcatgtgagttgagtagttatgtttagaggtcaaatctggttctcaatttcctggtagccagggcagaaaaggaaatgtgatagctcctatattttttatcaaatagaagaacatcctacagctttaagacacaaagcttttttactactaaatgtttaaaaagaaaaaaaagcaccatttttaagaggctctgagaattacataaggaattgttagaccaggcacggtggctcatgcctgttatcccagcacttcgcgaggctgaggccagtggatcagttgaggtcaggagtttgagactagcctggacagtatggcaaaaccccgtctctactaaaaatacaaaaattagccaggtgtggtggcgggcgcctgtagtcccagctattcgggaggttgaggcaggagaattgcttgaacccaggaggcggaggttgcagtgagccgagaccgcaccactgcactccagcctgggcaacagagtgagactccgtctcaaaaaaaaaaaaaaaaaaggaattgctttctgtaacagttttactgaaaatttagatgcaattttcatataatattttctcctaaatagtcattaaatgttgaaggtatggcccaaagtacagcccagtgaaagtgatttgggaaaggaccaagctactgaactttttactgaatgattagcattattggatttgaggatagaacaataaattcctagatcaatgctcctaaaatgcagtattgcgatatactactgggtcatgatctattaataccttccccagaggtaattattattctgattatcaccatggttaggcttacctcggaagaaatggaataatacaatatgaacttgcttgtctggcttctttcccttaatgtgtctgtgagattcaacccatttgtcagtgtaccaattacttattgtattgctgtgtaattttctgtatagtattatatgaatataacactattcatttttccattctcttggacatttgggttctttctggttattggctattataagcaaatcttttatgaacatttctgtgtatgtcttttggtggctatacaaactaatttctcttgggaatatacctaggattggaattactagagtataggtagatgtatttatctgtaagtagatgctgccaaacagttttccaaagtggtctgttttaagatgtccttcaatttggggatgatcagaagctttccacacagcaccctttacaaacaaagatgcctttatgtcttgtaatggttactggggaagaatgttaaatagtcatgtgtcttttgctatttttctcctttctagcatcaattcctgaagattgccaagcccctctccagcctcactccactgattgctgcagctaaggaggcaacaaagaacaatcactaaaaccacactcaccccagcctcattgtgccaagccttctgtgagataaatgcacatttcagaaattccaactcctgatgccctcttctccttgccttgcttctcccatttcctgatctagcactcctcaagactttgatccttggaaaccgtgtgtccagcattgaagagaactgcaactgaatgactaatcagatgatggccatttctaaataaggaatttcctcccaattcatggatatgagggtggtttatgattaagggtttatataaataaatgtttctagtcttccgtgtgtcaaaatcctcacctccttcataaccatctcccacaattaattcttgactatataaatttatggtttgataatattatcaatttgtaatcaattgagatttctttagtgcttgcttttctgtgactcaactgcccagacacctcattgtacttgaaaactggaacagcttgggaatgccatggggtttgataatctgccagggacatgaagaggctcagcttcctggaccatgactttggctcagctgatcctgacatgggagaacaaccacatttttctttgtgtgtgcttctagcagctgttcgggaggaccttgacccaatagtgttcccatgctgtttcttgtgaaatgctctcggctatgtagcagcttttgattccctgcataccctaggctgctgcccctatcctgtcccttgtttataacattgagaggttttctagggcacatactgagtgagagcagtgttgagaagtcggggaaaatggtgactacttttagagcaaggctgggcatcagcacctgtccagctctacttgtgtgatgtttcaggaactcagcccctttttctgcctaggataaggagctgaaagattaacttggatcttctaatggtccaaatcttttggtcacaataaagagtctccaaattagagactgcatgttagttctggatggatttggtggcctgacatgataccctgccagctgtgaggggaccccgtttttaagatgcatggccaagctctctgcaaatggaaatgcttacactgggtgttggggatgtttgctacctcctgctatttttgtggttttggttctcccactatggtaggacccctggccagcattgtggcttgtcatgtcagccccattgactaccttctcatgctctgaggtactactgcctctgcagcacaaatttctatttctgtcaataaaaggagatgaaaatattctattggagtatgcctttcttttttctcttcgttttttctttccttttctaattttttatatgaaataatgagtagtttcttcctgaaccatttgagagtggtaagttgcagatagaatgcccctttaccactatatacctgaatgtgtattctttctttttaacacttttattttaaatataaattaagagaaatgggccaaaaccatttgtattgtttaaagaataattataaacacacttgtatccaccaaatcaagaaatggaacactgacagtaagaaccttctctatcttgtccttcctttctcattatagcccccacctaagaggtaaccaccatcttgacttttatttaaataactttcttgcttttctgtatactttcatcacattcaggtgtgttccaatacaagtagattttagttcggccagtttttgaactttaaataaacatatcataatagatatattcttttgtgcctgttattgtttccactcaagattatgtttttaaaatatatgtacctagtttgtgtgtagctctagttcatgtattattccggctgtaggcacttgagaggaaagttaacttgtccaagatgaattccctgaggactggcctcccaaaggatttggttttctgcagaactctatcataatggactacagccaactgctcaaggcagtcatacctggtagaattctcaggtggctaattaggccatgggtctatcacatcctacagctacaaccataaggcttgagccccagctctgatcacaccagagaaaatgcttctcaaagatggcacaacagagctagaggccagtgttctgtcgtgtggttttactattggatcccagcacctaatactactagagaagatgtagtgcttcttaggtgtgcaaaatataatccccatggctcaatgcctgtagtccttctccggagtatgatatctgggccctactacatttctttgccccagaaggtgatgggcattagagtttccacactctggataatgttcc

SEQ ID NO: 16823 - DNA, 82612 bp, Human
  misc_feature (1)...(82612): n = A,T,C or G
cggtacctaacaagcggctggcagttctggagctgaagccaacaattcccacactgcattagtagcaaaagtgcttaccttaactgccacctccggagccgagtccactgccactgctagagacggctttgatgaaggcgatttagtcaagtgcatgagggagtcggcggctggcagcggacaccgactgctctcactgtccgagtccgattcggaccctgaacccgaaccataggaagcggccagagctgcaatcgcagccgacatgacggcaacaaatcttctgcggagaccctgccagggcggaagaagaagaggctcccaggtcctgacagattgcaatggaacacatcattaactttctttgctaagaaataatgtcttacattttgaaacaataagctaattattattagaataactactgtcgagctgagagcttaaaaaagtttatctagggaaaaagggagaattataatagtttataacatttaggacctagttgactaaagaatatgagttccaaaataccttgaggcctcgcggtcctgcactcccagcgtgcagcgcggcaggaagcgcgagagggcacaatgggaagtgtagtttgcaacgagggggcggaacgggggcgtgtccccctttgaccccgcccccgaatggatgttccattcaattggctatcatcttccctcattccctagccaagcagtgttctcttcgtccccctcccccaaactgaggattgggcaataccacagaacctcaggaaaggggggaagagcgagcttcggccccactaatgggggagtgggcggaggctggatttcccacctcggctgcacctgggcactggaggctgaagaggaaagtgagaatctgaagttttgagacctctgactggccaggaatagctcctggggcggggggcaaggatgggaccataggcggaaagagtctcgcggtcccccctgcttactggcgcgggtccctgcgcccggttgtggagcgtctcgcgcggggagggggcggggggaacggcagctcgcggtgttgttcactcgcgcgtcgagcacacggtgggtccggcggcgggttggcgccccaggcggcgttccctgtggcctggcgcctgggccgctgccctgagcgggttccgccccagagcccgaccctcctgggggctctaggcggagtcccgcgagccgagggggaccggcgaccgctgccgaagcatgaagaaggggtaaggcgtgagcccccaagatttcacggtgagcgcgagtccctgaggaattgcttttttcggggagggggtgttgggagaggaactcttccttactggccggagcagaccgagtggtgtgtggcccgcaaaggtgacggggatggatgggcgcgccttccccgccccggcccccacccccatccgcgggttttccgagcgcccaccgcccacccgccagcggggctgggtgccgagggagacggcggcgggcgcgcctggggcttggctgcagggaccgccccggggctgctctcgctggagagactgtgggtgtcacctgaggtgccaccgcccgggcttccctgcccacccgcgcccgcggtccgccccgtgcctctttccgggggaggcggtagccccgggcgacagagaatcccctgctcgccctacgtgcgcgaggctcggtaaagcgagctcgtgcgtttgcgtgtttgctccgcgagtcggtgtctgaaaacataacggtaaagcgagtgcgggcatccttttcttcgttggaaggggaggcgaagcggtgctgtcgcttctggtgcctgttcatgggggctgccttgggcagagttacggagccgctcactcagcgctcatgtcggcaggactcgcccattgtgccacccagataattattcaactatgcagcatccattgcacctttcccatttttacttttccccttgctacagcatgccccctagcttcggtactctgacaccttctcttgcacttgcggatgatgaactggaataacgatgaaagaaagcacatccgatctcaacattcacgtcctgccctataaccgattaattaattgatccccagctagactaggtacttaaatacgacttactctaatcatttccttttctatgtaataagatgtgcggtggattcgacttaaattttttctttggtgttagattcacgattagctaaggtcttttttctgttcactaattgatgtaattgacttattggttattcaatccgtctaatgttcttaaatttaaatttggcatggtaggtaacattcatttttctgattgttcatagcattatatcataattagaaatgcagtctcaatttgaactctcaggaacagtttatcctttatgctctaagtttctgttaggaaacatttttgtttatattgaatatttgaatgaagtatttgatataaaatttcggaagttttgaataagaaaagttttgtatttgtttttcggtagcagaatatgtcattactaatcgttgccttccattgaatggaaggatttaatatttaagatgaggattttaaccatcatatcagtcattccctaatttatctgattttattttttattcacttttttctttgcaatatcatgtatttaattacttgttttagaatccagtttttttttttctaacttgaatctacaagtatgagtaggcttcagttttgcgtgatctacctgaaggatgaaatttttttttttttgcaaatataagaaaccactgttggttacttgatttttatgttaaaaactgtttacatctcattatttaaaaataaatgattcactataaaaagtaagtgttgtatttttataattttccttttccatctttccttgtttaagcttgttgcatttacccttttgataaaagagaatcacataagcattgcagaggcagttttaaggtatagtaattgttttatggcacttggaagtggcgtacatataatataagttgatggtgtaggattagttgcttggttaggaaatgaccttgcaatttacaaaatggacacctttgtgccttggtttccttatatgtaaatggagataatatttagtaggtagtgtgcataaattcaggaaaggtgtgtttttgtagtccttttaaagaaaatttaaatcttttagctgatgaatgattaaaaaatttctgtgaaaaatacaatgaaaaaatgtcaggattttccatggcatattagaatggctgattaacattgatttttgctttggagaggtatgcctctgaactgaaaaatgtttctcatctatcaagggttttaaataattgcagacataaaggttattacagttaatacctacatatagttaaacatatagataaaatagttaatagtaaacaaaaattatgacttgataataagtagaatattgaattaagttagtgaagaataatatattcgaaaaatattaaggccctttttgttacaaatttgcaggtgttacaatccaaaatacatagttgtgatcatttataaggtatgctatagagttactttattactcatgtttgtaaatattcatatattcagagacagttttaatattgtataagactatatttaattatacattttgctttattttaggaataacttaagatatcttttccaagtgttggattttcattatcacagtacatagtaccttgtgatttccttattggactactatcaaaagattatgttattagcacttttaccaaaacagtgcttttggttactttgtgagaaaacttcatatagataagactattaaagtgtgtttaaagttactattgtatggtttcgtttttgagaatttgttttataatgttttcttaaatgaattaaaatttagctgacaccgtcacttgggtaaatgcagtaaagtcgtggtttttcttagttctttgaggagagaaactgacctgcagcttattgtcataaatccaaagttgttagtatagtgtttaacaaatagcaggggctcaattttctttgttgaacaaataaaatgaatgggtaaagaatatccattgaattaatatatttagtgaaacatttttaaagatttatcaaacattataattaatgaaatgtataactttatctcaggagaaaagagaaaaatgaatttcaaggttctttgaactccatttacctgctcagatataattccattacctgtacacttttgaactggcactagatacttaataatgtatatgttagtagtctttgatttatgaaatattaacaattttcttcttatagctcactttatgaagatgtatgttaacatattttttgtttttcctacactagatagaagtgtgtttgattctttgtgacttacgttttctagtgaaatagtaataaaaaagatatatgtaaattaaatcctatgctgaatgcttgagtacctagttgttaaaaataaatgacccctgaagtggaactttttataaaattaagaatcttgtgttttaagtttatcacattcagcttataattttgagtctttgtgaattggtagttctaacttactacacaattgattacattttacaacttgtaaaatggtttggaacttgagtcttattttctcagaaacagtatacttagtggttagagtcacagacagcccactaaagcctatttaaataataaaatacctgaattataggattatgttaatactaaagaaattataaaattatgttaataattagcataagtatattaaaatacctataataatttgtatgacagtctttctatgggaaaaataagtttcagatgtaccctgaaatgctaggatctgtaactcttgtgttagacatgacaacattattaggaacttgttctctttcacccagtggacttgaagaggaggctgtttctcagttcagtgagtggcataggcttacattatctgggacaagaagttagggcatgacaaaaattagaaggaaatgcagtcttctgcgtgactttacttctcaagatgtttgattataaaatgaaaaggtagaagtagatgacttcggagatctgttttagctacaaataaaattctaagatacttcgaagcttggtgtaaccccctttttttcctgagagttcattttccctaaagttaccgcttacgtccctcttatgaggacatttcttctttctggacctacctctgaaaaagaaagtagtcttgatcctttcacacgtgcctgttctcagaagcaagattttttagtctcttaaaggcgttatttttgtgatgggttttttgtttgttttaatttttaaaaataaactcccagcactgtcaagaaacaggatttttcttttggattgtttcctttgtttccttattttgagctattggtaaagtcagggtagattttattcatactttgaagaaagatcatatccagtcagtctccatagaatttttttaaggaaaaaattttggaatgaggtcatgaagtgggagtatgaagatataaagatggattattgccccataaaatacggggcatcttgtatttgtagcagccttacctggggtgctatggagctttggtatggatgtgatggagctgaaggcagattgagaaagtgaatctgtgaactccttgaggacagttttgttgtaagcgtttggttgttttgttttgctttgcttcatttttgtgttcccagtgcctgtttttggtttaagctaaatggattttgagtgtatgcaattactacagaataaaagagaagtcattctgttccatgtggaaagatcagggtgctgtgagggaagaggtcatgaaacagctatttttgtcatatgcattggagtatttaataattatttggagatcagtgatattcaaaaataatgtgtaacatggtccaaaaggaaaagaagtgacattgcttgcttgctagatgtacaagattctgtatagatgctgtcacatttattatttatcttgtttaattgctatcatagccctataaggatttaattgaagaaaaaggttaactgaattgaacaagttgtttgttctgcctagcggaagcccagattgtttcagaactgctttatctccccttttactgataagtttctgttggagcagtcattttaataacttgataataacaattctgcctgcctgctactgtcccctcatttgtaattggttcatttagtgggtcccccttgttaaaccagtgattcatagttcataatcagcacataattattgagggccaagtaggtgctaaaaaggacaggtctctattctcttggagttaacagtatagtaaaaaacaggtgttgaacaaatacatttgtacttagaaattttggtgaatgctgtaaaggaaaagaagagggaactggatttacactgggagtcaggggaggcttcttagaggcaagattagtggaagttagctaggtggaaaaggaagagaattcaaagaacaggtgaaacagttaaagcttagtgtaagagggattgtgacttgatatgaggttgcagaggtaaacagaagccagactatgcagagggcctacgtgaggtttggtttaacgaggttaaggattttaagtctattggggaaggccatgaagagttttaatcgggttaattactggatcagatctgtcttttgtaaagatcactttggcttggaaggggccagagataccaatcacaattctgttcatttctgtggtttattggcctggttttagacacttttttactaagccaagtcactcagaacttttcctgggtcctccatgcccagaggttgaataatttgttttctcttcagttgctgaagctgtgagatacaaaactctggaactgttaatggccttgtttcttgccctgtgggctagataagccagggcttctagaacaaagagtgcaaagaagcagatgcacagagtcctgactgtatttgagttcctttgtccatggtcctgagattgggttccagagacatcctagttacctttgtcataagtcctcctttttgcgtaaactgttagaattgtatttgtggtacttgtcaaccagcaaactgagtcctctcatagatcaagtaatttgctcaaggtcacatggctaatagaaatggaggtggaatttgagcacagatatgtgtgatttcaaagtcccatttttttcctactcccttatgctgcaaaggtaccatttcttaaactaaaggtcctaaagaaattctaagtaggtgggttttgggtgtgatgacatctgttggatgatgatgacagcaaagtttttttgtttttttgtttttttaatttggtgtgcttgatagtagttagtccagcatgtagccattctttattcctaacctagccaggtctactccaataaagttacattgactaacttatttgaaaagaagaaaagcttatgtgtcagggcatggaataacttgtttgattcctttaccaaaaaagtcaagtgtgttatgttttcaccttatgctacaaaagtaagtttgttttctagttgttttaatagggacatcttgctaaatttgttaaatttgctaaatttttataacatgcatgtgctacaggttatgccagagaattgtgaaagggttaaacgaaaagggaggaacagtgaagcattttatattttagtcgaggatgaagactagcactcacttcttaaaattatttttatagatttagagggtacacgtacagtttagttacatggatatattgcatagtggcaaagcctggctttttagtatagtgtacattgtacccattaagtaatttctcacccctcacccaccatctatccttccactcttcagagtctccattatctattattccactctttatgtccatgtatacaaattatttagctcccacttataaatgagaaaatatggtatttgactttctgtttctgagttagttcacttaggataatggcctctggttccatccatgttgctgcaaaagagattatttcattctttttaatggctgagtagtatttcattgtttgcatttaaattttctttaattatccattgatggacacttaggttgattccatatctttgctattttgaatagtggcactgatttttttttaaaccaaaataaaagccctgtgtggtacatcataatacacaactacaaatttatcaattttgttattttcaaggaatcttcatttagtttcattgtttttttctcttgatttcctgttttcaatttcatagatttctgccttaattattccatggtgtatatgtgccacatttgcttaatccagtctgtcattgatggacatttgggttggttccaagtctttgctattgtgaatggtgtcgcaataaacatacgtgtgcatttgtctttatagtagcatgatttgtaatcctttgggtatatacccagtaatgggattgctgagtcaaatggtaattctagttctagatccttgaggaatcgccacactgtcttccacaatggttgaactaatttacactcccaccaacagtgtaaaagcgttcctatttctccacattctctccagcatctgttgtttcctgactttttaatgattgtcattctaactggcgtgagatgatatctcattgtggttttgatttgcatttctttagtgaccagtggtgatgagcattttttcatgtgtctgttggctgcatagacgtcttcttttgagaagtgtctgttcatatcctttggccactttttgatggagttgtttgtttttttcttgtaaatttgtttgagttctttgtagattctgaatattagccctttgtcagaagggtagattgcaaaaattttctcccattctgtaggttgcctgttcgctctgatggtagtttcttttgcagtgcagaagctctttagtttaattagatcccatttgtcttattttggcttttgttgccattgcttttggtgtattagtcatgaagtccttgcccatgcccgtgtcctgaatggtattgcctaggttttcttctagggtttttatggttttatagatccttctacttttctaatacagacttcatgatattttcaacttaaaataggtttattgggatacaaccccgttataaactgcggaccgtctgtatatatacttggtgccataaatttccctccaagcactgcttttgatgtatcccacacattttgataaattgaattttcattttcacttaatacaaagtattaaaaaatttctcttgagactttgaaccatgtgttatttagaagtgtgatgtttaatctccaaatgttttgagattttcccatctatctttctgagattgctttctggtttaattgcattgtggtctgagagcatatactgtattagttctgttcttttaaattttttcaggtgtgttttatggcccagaatatagtctgtctcagtgaatgacttatgtgagcttgagaataacatgtattctgctgttgttggttgaagtactgtataaatatcagttagatccagttgattgatggtatttagttcaactgtattgttactgattttttgcctgtcagttaattaccgatagaaggatgttgatatctctagctgtgatcatgagttcatgtttccccttgtagttttatcagtttttgcttcacattttgatgctctgttaggtgcatatacattaagaatcattaggtcttggagaatttgcccctttatcgtaatgcaatgcctatctttatccctgttaatttccctcgctcagaaacctactttgtctcaaattgatacagctacttcagatttgttttgactcgtgttagcatggtatatctttctccatttctttacttttaatctatttctacatttaaagtgggtttcttgtatacaatatatagttaggtcttttttttttaatctactctgtctcttatcttttaattggcatatttagaccattcacatttaaagtgattattgacataattgtattaaaatctactgtatttgcaactttttttattcattgcacttgttctttgtttcattaaaaagaaaaagttggctgggctggtggctcacacctgtaatcccaacactttaggaggctgagtcaggccaatcacttgagcccagaagtttgacaccagcctgggcaacacagtgaaaccttgtctctacaaaaaaatacagaaattagccaggtgtggtcacatgcacctgtagtcccagctacttgggaggctgaggtagtaggatcacttgagcctgggaggcggagtttgcagtgagccaagattgcaccactatactccggtctgagtgatggaaggaacctctgtttcaccccctccacccccaaaaaatgtcctctctttttctgctctgactttaattgagcactttgtatggtttccttttctctcctctcttagcatatcaattatacttctttctctttaaaatgttttgtaagtggttgtcctagtttgcctctctttttgtatgattaccgaggagaagtccaatctaatttttatccttgtccctctataggtaaagtggtttctctctgtctttcaaaatttttctttgtctttggttttctgcagtttgaacatcacatgcctaggtgtagattttctggtatttatcgtggttgatgatctctgagcttcatggatttgctgtttggtttcttaattttggaaacattttgagcacctgtatatgctaggcattgtactaaatatcttacgtatttgatttaatcctcacaacaaccctgtgaagaagtatgattctcattatttgtggtggaaactaagttttaagtatagaccactacagaatttttttacaatagtcactaaaatttaactgccttgggcttacccctgacttaagcttcctctagatgtaatgaaaaaatgggattattttgatttacttgttaggtcgcaatactggaggtgagtgttggggactgatttcagagttcaagtcatgtgcagtgtatcagatttgtgtaccatcaaaggagttgaatgaaaatggctgtattgtgtccttttgatgagatgcaactgttttaccagcaatttgcatacatttggaaagttgactgaactggttaatgggagaatccagtactttgctttaatttaaagatgatctcaaatcctaagtgatttggtgctgttactagaaatagagaagcccaaagaataagtttcctttttggggagagtggggaatgatggataatgaatttgattttggatattttgaatttgagttagtgagatgtccctgtggagctgtctggcagactgatagcacaggagtatatattgtcaggactgttagggttgattgtttaagtttgtgtaagtaatttagaattgatggttaaagatctagcagtgatggatttatgaagaggagaaagtgtagaactaggtataacaaaactgttgatgcctaacatttagtggaaagaaaaaggagagacagaagaggatgctgaagttgtgatcaaaggatataatgtgttgcattcttaatatgactgttctgttgggacaggggataaggccttgtggtctggccagatctctgaagaggaatgtgagatgctagtgagtaggaagggaagcaaagcaaaagtgtgttgatggttttgaaagtagaggagaatgacaggattgcaggaacttggtaaggacaaagttgttttataataatgaggcaatgaatggatagggtagaatattcatgtcagaaagagacacttcggagatggagatctcataggcagaactattaaaaaagtctgtgcacagacacttgatgtgcttagtagtagaaggaaaggtgctactcctcaggactggaagtactggcagtggagtactcgagagagatggggtccagttttaaaagccttgctcttgtctatatacttctaacagttgctctaggcttggcaagtagtaaagccacatcatttgaagtgggaatcttggagggatgaaggtggttatgtattgctgctgattcctgtattttaaaatgtattcttcttgcttgcaaaagcaagtctttttcattgtgatagaggcagtgcacaactgcatgcctcatatacagtagtgttaacatcataaaaatcaccattttcactatcacagaaggaaatgaaatagagcatgtctttcagaggatttgtacatacagaacttaatttcattcattagcattaaaaataaaatgtaaattttttggtaatgctatactaagtacagaaagatgacattaatgacttcttatcagttaaacatgaatttcaatatgtatttcatatagtagggatggatttatgagttcctcaacaattttaattaaattcactcgttattaactgttatgtgagaggtcatgttaggaccagaaagtgtggtgaaaatagtatttattttactattctaattaaatattctttgaggtataagagataattgttataaaagggcttttggaaaaagtctatattaacataagatgctactgttaaattttaaggctagggaactaggaccgtagacaaaatcatgatttacgtttttcattaaatactcagtgtggtatgtaaatgtttccaatgtaatcagtgactagaataaacaaatatttgttttggttatcatcaatttagctttattattttgaattttaagtgactataccaatcatattgaacttaaactacagaaagatggtgatgatttattgaaaattaagtcacttatttttaattatgttgtttctatttgaatttgttttttatttgtagctgcctcaccgaatattagtagaattatctatggttgaccttatttgagggttatagtgaaacatgtaagttatagatgtatctcatcttaagaaaacataatatgaatgagattactaatgaagtgagcttagataaaaataagagaaaaggtaccaggactaagtcctggagtcctcaaagaattagaggtacagaagttaaagaaaaggatgcactagcaaaggagactgagaaacacacaccttatcctaggcctacgcagggtcagaataattgatatcactgtcttctacctccacatcttgtcccactggaaggtcttcagaggcagtaacaagcatggagctgtcatctcctatgataacaatgccttctggaatacctcctgaaagagctgcctgaggctctttctaactttgaaaaaaaaaataagtagaaggagtacagtgtaaaataatgataaaaagtataggatagtagatacataaaccagtaatatagtagtttattattatcaagtattatgtaactatacttttatgtaactggcggcacagtagggttttttttttccagtatcaccacaaatatgtgagtaatgctttgcattatgtatgatgtctacattgtgtatgatggctaacactgcatgatggctacagtgttactaggtgataggaattttttttagttcccttagaaccttatgtgactaccaacatatatgtggtccatcactgactgaaactcatgactgcaactccagttatattaagatagcatagccctttatccttggaagattctgctttaagaaatactttaaaatttttttcacacaaaaaaataaacatttttgagttttgtgtgttatatgccaggctttatgctaatcattgtatcttatttgatcctcataaacagccagccaaagaaggcaggactagccacagagggacggagaagttaagattctttgcacagtttgtaaatggcagagccaagattcaaacccatctgatctgtggtcagactctgtactcctaactgctattttgtctacctttaactgctattttatctactctgcttttaaattttacagattaaatacaactagcaatatttttgcttgaggacacagtaaataaaaaattctcatccattgctagagtataaaataccaatattagtttattattttaatgaatgtaacactaaaactgaaagacctttcatttcatgttgactttctggtgtccctggtcattttttgagccttgctctctataaaatgagtaagctaactgttctcattgtcttcaggatagtcttggtaaagactgtactttggtgtgaaaatgtaatttggggaataccactgatatttttaaaacatttaaaatcttttcagggtaaaagagttcagaaatattttggtcaaaatgaggactcagattaggagaattattgtagggcattttttttttcaattggtaaactctcttcttagtcttttttctccctggtttcctgatccaagacactgtttctttttcataagcattcatctgcttttccatttcctttattccctaaataatatagaataaatggcttatcgtattttggcttggtgtatcactgattttttcatgaatgattctgttttcccatctatatccttgacatctttaaaatataactttgccctactgcatttttaccccttgtccttttacaaaaactgtacctatctatttgacttttgtgctttgcttcctttattcctggaattcatgcatcttgccaggaacataaagggagctagaagggtgcacgagaactaaggcttctagaacattgtactcaaactttatcatgcatcttgttaaaaagcagattctgattcagaagttcaggggtgataccaaaatatgcagttcttacaagttcctaggtgatgttgatgctgctgatgctggtttaaggaccacactttcactggtacagaagatccatgtcagaaagaagtagttagaaaaagttttgctttatgtaacaatatattataaaaaaagaaaaagtattggtttaaagggaatacattcttaaatgatcatgtttataaaatagatgaattcaaaggagaggcaaaaggtcaggtaggtagagtgagaaaagatagaaggcaacagacatctgaatagaatcccttcttagttcctaatgttgctagaactcttttatgacatttaaaattttaattgtggtaagatacacacgagttaaaatttacaattttaatcatttgaaagtgtatatagttcagtggcattaagtacattcacatcttccaacttcttttttaagatacttttattttttagatcagttttaggttcatagcaaaattgagcagaaagtacagagagttcccatatattctctgaccccacatatgtatagcctattaacattctgtaccagaatagtacatttgttacaactgatgaacttacgttgataaatcactcaaagttaatattttataccagggtcactcttggtgttgtacatttgatgggttttgatacgagaaatgtgtaatttcacatgtctgccattttagtatgatacagaatagtttcagtgcccaaaaatctgtactctgccaatttatcctctctcctttctaacccctggaaaccactaatcttttcaccctttatagttttgccttttctatcatgccatgtagttggaatcatagagtatgtagccatttcaaattcgcttctttgacttggtaatatgcatttaaggttcctcccatgtattttcatggcttgatatttcatttcttttgagcgctgaatattccattatttgggtgtaccacactttattttacttacctactcgaggacatactggttggttccaagtttcagcagttatgaataaaactgctaaaacatcgatgttgacatttttgtatgggtgtaagttttcacctctttgggtaaatatcaaagaatgtttttgctggattgtatggtaagagtttgtttcattttataagaaactgccaaactgtcttccaattatgcattctcaatagcagcgaatgagagttcttcttgctctgcattctctccatcatttggtattgccagtgttttagattttggccattctaataggcatgtagcaatatctcgttttaatttgcaattccctactgacacatgatgcatgatgttgagcatcttttcatatgcttatttgcaatcatgcagtcagtgtatctcttttggtgaagtatttgttgaggtgagaactttttcccaatttttaatcaagttgttcattttcttgttgaatttcaagagttttttgtatattctgaataacagtcttttattagtcttttgcaaatattttctcccagtctgtagcttgttttctcattctctcaacattgtcttaacagagcagaattttttaattttaatgaagtccaacttaccaattatttttcatggattgtgcctttgttgttgtatttaaaatgtcatcttcaaacccaaagtcatcttgattttctgctatggtaccttctaggagttttatagttttggattttatgtttagatttataatcaattctgagttcatttttgtgaagcgtgtaaggtctgtgtctagattcagttttttgcatgtggacgtccaattccagcatcatttgttgaaaagactatcttttctcatttgtattgtctttgcttctttgtcaaagatcagtgactatttgcacgggtctgtttctgggctctttattcagtttcattgaactatttttctatttctccaaaactacactgtcttgattaccgtaactttatagtaagtcttgaggttgcatagtgtcagtccttcaataatgtgttggctctgctgggtcttttgactctctataataaactttagaatcagtttgttgatagtcacaaaataacttgctggaattttgattaggattgtgttgaatctacagatcaagttgggaagatctggtatcttgacaatattgagttttcttatctgttatggactgaatatatgtccccatcccccacccccaaattcatatgatgacatcctaacaatgtgatagtattaggagataggactttggggagatgattagatcatgagagtggagtcctcataaatgagtgccttttttaaaaagtccccatagcactctctcgagctttctgccatatgagaacacaacaagaagtctacagcctggaacaggactctcactagaacctgaccatgctagcaccttagtttcatagaattccagcctccagaactgtgagaaataaatttctgtcatttataagatgcctattctgtggtacttcattatagcagccccaaataagaaactatccacaaacatagagtatctctgtatttatttagttttttgatttctttcgtcagagttttgtagtttttctcatatagattttgtacaaattttatgagatttatgcttatttcattttgtggggctgcaacatatgttattatgtttttaatttcagatatgacgtattcgttgttaagatgttgggaagcagttgacttttatatattaatcttgtatccatgctgtaattgcttactagttccaagcagttttttggttgattctttcagattttctgtgtagacaattatgtcatctttgaacaaagacagttttatttctccttcccaatcagcatacttttattttcttctcttgtattaactaagactttcggtgtgatattgtaagagggaacatcctttccttgtcttgactttagcaggaaaggttgtagtttcttgccattaagtatgatgttagctgtaggttttttgtaaatcttcttttcaagttgaggaagttaccttttattcctagtttgcggagagttttagtaatgaatgggcattggtttttgtcaaatgcttttccagtatcttttgataagatcatgcaggcttttcttctttagcctgttgatacgataaattatgttaattgatttttgtatgtagaaccagccttgcatatctaggatgaatctcacttggtcctggtatgtaattatttttacacattgttggaatcgatttgttaatattttgttgaggatttttgcatttttgttaatgagagatattggcctttagttttttggatttttttttttttttgccttgtctttatctagttttgcattagggtaatgttaaccttatagaataagtctgcttctgtctgttcctttatgccttttgaagcaagaaatacgttgtctgcgtgacaaatcttaatttatatcttgcttgttttgagaatgctgaataatgaaaaagttaagttgtgattaggtcagagtcgactctcagaagagtctaccaaacagtaggagaggagaagcagaatttgtctatattctaggacctgtccccaaaaacaaagttttttattcttaagtattaatacttgatatgtttgtattatttttactctttgaaaagtacattgaatgtattttcttaaaatatattcactgaagtgcccagtttgtacttcagatatatcagtgatacagatagaattctgaattttacgactcgtacgctttcaaaattgcttaataataaactttagatttatttaaactcatttggtgataacaaagtcctccattttgttttgtgttagacctcttttctttatttgcatatgtgggtaatcatattatttgaatactttctatagggattaggttcttgctgaaattgtggtcctttcatagaggtcaggttaaggctgggccttggttcttcctttcatgtagcttgttcataaagtgcaaagtaacatggttcatcatagtaagtgagaaatctggaatgtaaacatcattgtaataattcattgtaaaaggtataatttctccccagttttttgctgaatggcaaggaatgggtgattcctatttagttttttaaaaaagctatagaaagcaacatatactatcagttttcttcagggaaaacataatacagtgcgataaatgaggtctcacatatcttgaccatgtaaaaatatctggacaagtaaagtttaatctggtaaaataaggtactcttaactgaagaatggtccactgctatctaagaggctcatgtgagtataataagcttattcgggggatcaatatgtggaagaaagagggatagccaaatttatccaacatttggtaggatttttggatgagtttcattgctagttaaatgaaactttagactagttagttcctccctcctaagaacatatgttttcttctaaataagatggtgataatgagtaaaatgaggttagttggtagaaaatgtaatacactatttagtacagttaaacagtacatcgtgagtaaaagactataacataagtaaaaaggtacttaaaatatttgttgaattaatgaatttagaataccgcttttttatcttctgaacttagaagttagaggaagacatcttgaaaggactttgtgatttattgagcctgagttttaacagctaaagattttccagtcagatacggctttagtagcaataggtaaagttttttttaatgaaaaaatgtttcagacttctgggtaagcaagaattgcatttatttcatcgagataatttcaaattcataattggtagaatatgattaatgaggattttactatattgatcctctcatttcctattataattaaaagtaattggctaagcttaaattactcctcaggcctcatgtttcattgttctaattattcaaagaaaaaggtaggttctttgagtattagaaacaaggaataataaatgttggatattatttttgttctcaattttaaacagtgttggagaaatcagcatgttaaaacaactgttgatgatagctgttggagtaaagttgcagtggaagctatggctgcaaaatcgttaaaatcttcaaggtaaaattaagaagtaatgtatctcaatggcaactcctgatagcaggtgtcaatttaaagctacttctcatttctgcttcaaaagttatatactaataaaagtggactggtcttgaaagcatcttctgcatttaaaaattaagtgtgtagggacaggattagaaaacgttggtggttttacaatagatttggaaccagcttctcatttctgttaaaggtagcacactctcctaggctcaaaacctttcttattctgtatctaatgatttttcttctcttgtttccaactaccaacagtctaaaacccgaatcctcatcaattcttcagtggtaaattataagtgctcttaaaagagtcctatatctcgttttcccattctttttagtccatccagcagttagctaacatattattcttccttgctcatagttttcattagacacttgattttaaatcagctgtttttcttactatactgttttttactgtgatgtaacaagtataactaacatttttaatataattttgtgtatgatggaagtgtatattctgtttttaaattagacttattctaactagataaaactttcaagatggtatttttgaatgtaaaaggttattttaatactaaataggagttgaaaaattgctgaagccattgttcttttagagctatgttaaagaaatagatgcttcccaaggtataggttgagcatccctaatccaaaatctgaaatgttccaaaatccgaaacattttgagcaccaacatgataccacaagtggaaaatttcacgtgtaggtacttaaaaccactttaatgcacagaattatttaaagtgttacataaagttaccttcaagccatgtgtataaggtatatatgaaacataaatgaatttcatgtttaaacttgggtcctatccccaagagatctcattacatgtatgcagtattcagatatttttgaaactggaaacacttctggtcccaagcatttcagataagggatgcttaacttctaactgtgtctcatgaatagtgatatttatttgggtttgctggccatagcccggcattaggctccaacagggtaccgtctggtgtcagttggagttgctatttgaagacccctatcaggtgccaaaagataaaagtaaaggtgtggaaaaaatattgtaatgtcacttcacttcagtgataatgttccttttctcagattctggcagtgtcacacggttatcccctacatcaatggttctcaccttaagtatgcatggagcttagtctagaaccttactgtctttaactcaacagactgttttttgttttcgcttttgtgttttttccaaatgcagggttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaatttttgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgcggagaaataggaacacttttacactgttggtgggactgtaaactagttcaaccattgtggaagtcagtgtggcgattcctcagggatctagaactagaaataccatttgacccagccatcccattactgggtatatacccaaatgagtataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactattgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaaaaaaaaaaaaaaaaagaaggcactttagaaataatgtagtcctacctgtaatctcttctagaggcaagtaatttccttattggaaatgtctggtataaaaagattttttttctgttcaaattaaatgtcttctcatcactttaagctattgatcctagatttgctttcaaagaactctcttaatctcattccaagccaggaaatgataatggcaaaatagtttaaccaaatctacctttttagtttctgttccagtttgtgcttatagccgataaaaagcatacttaggtgtacattatgatggtatattggtatatcgaggccaaaaataatgcttaagagttactgaattagtaagagccctgatacttagggagaactatagattaagtaaatctatattgatttactctatagacaaagctgaaaatatgtaaagagtctgattatttcagggtattaggagcacgtggttcattacttttgaatgccctagctggaagtcttccactgtgaaggtatctctttcagaagtatctatttcattaatactagctgtcccatttatatttttagcatattatgtccttttatatcttatttggcattaggatgttcttagcagaagtttttacatgtgcctgactttcaccaaggacaactttacataagatccaggctttggatccttttagtctttgcatttcaatttttatccaaattccctgattttttttagtacaataaagttataaaccatggctgaaaaatatttaaaatcttcaaatgactccgttgcaatatttccaaatttgtggtgtgtttgtttgttcctatataaagtaaaatatcaatcaaaggtaattatattcaggtgtatagttaggatagttaattttattaatcaacagaaaagtgtataatcttcataatcatgtttattaaaatgtttataataatgggtaaattgtgaagtctagggaacaacaatttttatgcccattgcttctgtatggaaattcaatcaagtgaaattttgtggaactttctatttatatctttctcttaaggtacttttttataatacgcaattactgtcctggctcaaaccatgcctgtattaatatattttaggtattacctttagaattcttttctaaaggaaatcaataaattacttgcttcatcctcttccattttgatattaaaagctgtttttaagtcctgtgtttccatatgatattgttaggtacttcagaatgttctttaggagtgttcattcacatcgttgtaatccatatgatattgtattgtattaggtatatagaccacaaaataaaaacattgagaattatgttggaaaaaagtaaacttagagaaaagagacttaagtctctgcctgtgagtccgtcttccttgccgtcattcaaataatttgtagaacctcacttcctctaacatggtttcagatatagaaaaggagagttcacaacttctcctgaaatttacttttggaactcaaagaaatccctctaatttttcactccaaatgtatcctcaactcttcttctccctacttaaaacaaacttaggtatgttattgtcacatttaaatacaagcacagtccctcttatcaaatgttttataatattctattcattctaattgagtatttttaaatccaggcgtatagcataaacctcaaattaccagacacacacaaatccaagttttcctattgttggcttttttttttttcttttttgaggcaggatcttgtgtcacccaggctggaatgtagcagcacattgtagaaaccaggttttactatgttgtccaagctggtctcgaacttctgagctcaagcgatcctcccacctcagcctcccaaagtgggattacagatgtgagccaccttgtccagtcttgtgttagctttaagcaggatagaaaaatgcaaattaaaattatgagataccactgtacatgcagtagattgactaaaattaaaaaggttgacaatgccaagtttgggtgaggatacagtgagaaatcaacatagattgatttaatctatggcttcttttaaatattagggctcttattaaatcagtcttaaactttctttttggactcaaaatgtcagtttatcattacattgtacagctagttatttttatctgccataaggtcaaactggaacagaaaccagaacagtagatttggttaaactattttgccattattatttcctggctccctatcttcacctagaactctgttggtggaaatgtaaaatggttaaactgctttggaaagcaattttgtagttttttacaaagctaaacgtataacccaaccgttccactgctaagtatttacccaagaaaaacaaaaccatatccacatagagacttgtataaaatgttcataagttactttatttacaataatcaaaaccggaatattacccaaatttccataaacaagtgcaacaacatggatgaatctcaatcatctcaatcattaggctgaacaaaagaaggcagacaatagttactactctgtgaatccatttatatagaattcaacaagcaaattaatctatggtgacaggtcagtggtccttggaaacatgaggggaggaagggattacaaaggagaaaatttgggggatgattgtgatgatttcacagtattaagccatgttaaaactgttataaacctaatcaaattttacaccagtatgtgcaatgcattagttttctatcactgcttaacgaattaccacacatttagcaggctaaaacatctctagtaattatcttatagtcctataagtcagaagtatgaataggcttggctggattctctgcatagggactcagaagtccaaaatcatggcactgacggctacatttcttttctgttggctctggggaacaatcaccttgcaagctcattcaagttcctggtagttgtacaatcttaagcttctcttttaatatctaacaagtacagaggcagattctatttttcctgatggatataattcttcattgtattgtgaattgtttctgttggactaagacaaaatcaaagtttagaagaattttgataatacagacatatatgaaataataacagaatcccaacttaaggagagtagttaaccagagtaagtttttgttggatttaatattattgttcctggtttccaggttcctgtcttctccctgggtgtcagaaaaaggtttctagctcctagaactgctttcaggttccctccatctttaagccagcagtagctgccacatctccctcatgcttcaaatctttgcctcctttctccgttgtcagctggagaaagctctactttcaaagggctcatgtgattaggttaagcccacccatataatctcccaattttaaggtcagctgataattgaccataattatatctttaaaacctctcttaacatgtaatataatcataggaatagtgctagggactggatatcatgcggccatcttagaattctgcctgccacatgctgtatgttgtgcttcacttatacctcaataaagtttatattttttttctaaaaaggacaaaaatatataataatatgtgcatataatgggatggttgtgacacccaaataagatgtaagttgatttttctcactgatttgatttggcatagcatttccatgtccagtggggaaatagaactaagataataatatacttaccactttttctatattttttaattttctttcatctatgatgttaagaaacagtagaaagttgaggaagtagctaaaaagtaaacataatagaggtgattttgtaagttttttaagttcactcaaaattgtgattaatattgtgatttcatgtatgtctacaaatataaagtagtatttaaaaattactattactttattaaacttgtgcaagagatgaatgaatgtaagtgtgcattttgttgatcctattgtttagaccaatcttggaattcttgagtttatagaattcttatattacagaatgtgggaaataattgtttttataacatgtaggatgcttttatctccaccttgtttatttcctagaaagcattcaatcaagagtaatacatttaatattttattatagttatttgtggccaaagattttggaaattaaaaattttagtagactagatgaaactttagaatgaaatgtggttagttttgcttggatcctcaaattgctagtgtgtgataccaagtgttaccaagaatgtcaaacagctggaactctcgtaagttgctgatgggggtataaattagttcaagcactttgaaaactatttgacaatagttactaaagctgtatgtatgtatgtgtatatataccctatgacccagtggtttactctctctagtcattccacatttactccataatacacattaaaatctttttaagatcaaatgtttgtcctcttttactcttttattttgagacagagtttcactcttgatgcccatgctggaatgcaatggcgtgatctcagttcactgcaaccttcgcctcctgggttcaagtgattctcctgcctcagcctcccaagtagctgggattacaggctcgtgccaccaagcctggctaattttttgtatttttagtagaaacggggttttaccatgttagccaggctggtctcgaactcctgatgtaaggtgatctgcccgcctcagcctcccaaagtgctgtgattacaggcgtgagccactgtgcccagcccttttactccttttaaggaacttatttgttccttgttgaccaccaaagttcaaaatcttcaatttgattgcttttttaaaaaatcttttattcctgcttctgttttcctttcaagcaagtgtccttatttttcctctcttattctcaacttgctgttttacttgtgatggacatcagtgctgtccagtacaactttctgcagtgaaggtagtgttctgtaactaccctgtccagtatggctattgagcacttgaaatgtggctagtgtgactgaggaactgatttttaaattatttacttcgttttaatttagcaacttgtggctagctggttaatttattggacagaacaggtctaaattactgtcttcctttaacctctttagctggttttgatttcattctctctacatgcataataatttaccttagtctactttagaccttagctatatgttcatttttattgttttacattttctgttacatatttttgcttcctgattattttgtaagctgctgggtggtgaagctattttacttcttttctattcctttcactttctatattttaaccataatatgtaatctgtaaatatttattgaaggaagtagtcatctgggaattgaggaacattatttggagcttcaaaataccattgaaaatcttttagggtattgtgaaatttgggaggccaatttgtcgagaatacaaaatagacttaaatacagtaacaaggccaggtatagtggctcacatctctaataggaggctgaggcaggaggattgcttgagctcaggagttcgacaccagcctgggcaggcaagttagggagaccccatctctacaaaataataatagtaataataaacagtaacagattaagagggtgggagggggctgagggataaaagactacatactgggtacagtgtacactgctcaggtgatgggtgtaccataatcccagaaatcactaccaaatcacttatccatgtaccccagaaacttgaaataaaaaattaaaatatgtatactgacaaaaatacagtagagcaagcaatagatgcaaaatctgaagacaaaatctagtctcatctctgccactgattttgtgaacttagagaagtttcttagctttttcaggtaagtttgctaatctacaaaaatcggatatgaattatttggtgttttaatttctcttccaggttaagattcttttctttttgtttttttctttctttctttccttttttttttttttttttaagacagagtcttcctcttccatgctgtctcctacagaaagaagatgacatttcatatgaattgtggggcattggaaggtgaaatgccaggaatattgtgtttaccctggctctctattctagaagtcaggtggactgaagttacagggcatagagaatggcaacgatgtaggcgaacaaagcaattaagtaaatctaagatttatccttcaggctgaaataggtaaagcgggcatatgccatacagaataatgaaatgtaaggaaaaaaatgaaagggggaaaaaaaggaaagccactaaatgttctcttgctttctcaattaattttggctttaaaactcatcattctcccactacccctgtcccaaataccattaaattactctctccatgagcccagttacttggttgtacatattactagagttagtcataagtcttttcctaatcccatagactttgtggatagggagtcatatattgatataattgatctgctttagaaataattttcagtttttggctgactatagaaagtttcttaagccaagaacttgggcttcaccccttctggtgatctaattaattattagcctgtttccttctacctccagaatatatcttgagttgacatgcttctgtatcactatcacatagtccaagtgactaccatctctgtctctggactactttattcatcttctgtctggtctacctgcatttattctgccattccccactgcccaagtctccatagagcaattagaatgaatggtcattcctgatcttggcactcctttgcttaaaacccttcaagggttttccattaggacaacatagaaaatcgtcaatatgaccttcaaggtcctacctaatctgaccccctactaaccctagagtctctgattgcacttcacccatgatggcttgctctcattattattccctgtccacctttcattctaagaatgaaaacacacgcacaagcttcagtttccccagcttagctagcttagctaataatccttttgttcttaatttaaatattacttccttaaggagacaggtcccctttatagtgtcccctacttttactccattatacttataagcgtaattagatactagattctaggaaatacacgggggattgtttggttttgctcacccctttatctttagcacttggcacacagtacttatttcactgatgttcagtaaatggttggttagatgaatgaatgaatggatggcagtgtgtcagtactgccgtttttcatataaagtacaatgtatttgataggtatatgtttttagaaatacttgcaatatgaagaagacaatcttgtttttcaagtagcttagttctgcatttgtggtttagatgcctcaaacttcaattttaacatcttttaaaccactaaaaataaacttggtggttgggtgcagtggctcatgtctataatcctagcactttgaaaggctaaggcaggaggattacttgagcccaggagtttgaggccagcccgggcaacatggcaaaatctcgtctcttcaaaaaatttaaaaattagccaggtgtgctggcacaccctgtagtcccagctacttgggaaactgagggtgggaggactgctttagccagggaggttgaagctgcagtgagttgtgatcacgccactgcattccagtttgggtgacagaataagaccttgtctcaaaagaaaaataatacagtaataaccttggtgcagtattatgcttgtataatgatttgtcaagtaagtttcagtagtggttatattaatttaaaggaagtacatattttctttgagagtaacatggaatcacataagaaaatactactatttagtggattttattactaagatgactatatacagtcttctttccactctataggtgtataatactattgattatttcattagcatacagttttcttgactctgtcagaaatgtcagtgttatgaattgctgagtatgtagcttatttcttcatttcctttttgctttagtttgcttagcaatgtgttattttcgactttagtagcctatcaaaatttaatgctttgctattgtgacttcaggtgacataattttttttttttttttttgagacggagtctcgcactgttgcccaggctggagtgcagtggcatgatctcggctcactgcaagctccgcctcccgggttcacgccattctcctgcctcagcctcccgagtagctgggactacaggcgcccgccaccacgcccggctaatttttgtatttttagtagagatggggtttcaccgtgttagccaggatggtctcgatctcctgacctcgtgatccaccctcctcggcctcccaaagtgctgggattacaggtgtgagccaccgcgcctggcctcaggtgacataattatttatatatttatttttggtaaagatagcactgttcttagggcagttttttttaaaccaagagccagagtacctcagagcaaataactggagatgttcagcatgatgactagttctttagtcctgtgagtacctaaattggttttgtcattttcctatgaatctcctttagagattcatgagtagtgagtagttttaaagtttgcttctcacaacaaagaggaaatttatgatttctatatattcctgaggtggttttacacaagaaacacaagcttctatttcactggtaagtgaagttattttgaacttcagttttttagtttacaataatgaaacagtttgagataatgtgcattatagatttagggaaaggtaaattataaaattctgtttctgatacacttctaaacaataaccttgcaaatatattttatattaaatcaccgtttaaagacctgtggttttgtataattgaaatatggttttaaagttagatatatatatttttaaataaaaaattagatatatttttaatgtacagttcttcatgcattcttattttaaatttttatatttaataatatctgtcacaattataaagtattttgtcattggcatgggagtttattaagaaaattatttctatgaagagcaaagctctatttaaacattcttatactcaaattatttaacttgccaattgtgcaaaattaagtggcttctattcttaagaagggaggacatttcttaataagtatttgccctacccaaaattcttaacatatttgaaatattgaaattgtttttattagaatacttattttaacctgttcctttaggtcacataatgtaatcctttagtttgaataagtatttaatactgtattgtgaaaaatgaaaattatattttttgttattatactttaagttttagggtacatgtgacaacgtgcaggtttgttacatatgtatacgtgtgccatgttggtgtgctgtacccattaactcgtcatttagcattaggtatatctcctaatgccatccctcccccctccccccaccccacaacagtccccggtgtgtgatgttccccttcctgtgtccatgtgttctcattgttcaattcccacctatgagtgagaacatgcagtgtttggtttttttgtccttgttatagtttgctgagaaatgatggtttccagcttcatccatgtccctgcaaaggacatgaactcatcattttttatgactgcataatattccatggtatatatgtgccacattttcttaatccagcatataaacagaaccaaagacaaaaaccacatgattatctcaatagatgcagaaaaggcctttgacaaaattcagcaacccttcatgctaaaaactctcaataaattaggtattgatgggatgtatctcagaatcataagagctacctatgacaaacccacagccaatatcatactgaatggacaaaaactggaagcattccctttgaaaactggcacaagacagggatgccctctctcactactcctattcaacatagcgttggaagttctggccagggcaatcaggcaggagaagggaataaagggcattcaattaggaaaagaggaagtcaaattgtccctgtttgcagatgacatgattgtatatctagaaaaccccattgtctcagcccaaaatctccttaagctgataagcaacttcagcaaattctcaggatacaaaatcaatgtgcaaaaatcacaagcattcttatacaccaataacagacaaacagagagccaaatcatgactgaactcccattcacaattgcttcaaagagaataaaatacctaggaatccaacttgcaagggatgtgaaggacctcttcaaggagaactacaaaccactgctcaatgaaataaaagaggatacaaacaaatggaagaacattccatgctcatgggtaggaagaaacagtttcgtgaaaatggccatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcgtcacgctacctgacttcaaactacactacaaggctacagtaaccaaaacagcatggtactggtaccaaaacagagagatagaccaatggaacagaacagagccctcagaaataatgccgcatatctacaactatctgatctttgacaaacctgataaagaaatggggaaaggattccctatttaataaatggtgctgggaaaactggctagccatatgtagaaagctgaaactggatcccttccttacaccttatacaaaaattaattcaagatggattaaagacttacacgttagacctaaaaccataaaaaccctagaagaaaacctaggcatatccattcaggacataggcatgggcaaggacttcatgtctaaaacaccaaaagcaatggcaacaaaagccagaattgacaaatgggatctaatgaaactaaagagcttctgcacagcaaaagaaaccaccatcagagtgaacaggcaaactacagagtgggagaaaatttttgcaacctactcatctgacaaagggctaatatccagaatctacaatgaactccaacaaatttacaagaaaaaaacaaacaaccccatcaccaagtggggaaaggatatgaacagacacttctcaaaagaagacatttatgccatcaagaaatatatgaaaaaaagctcatcatcacttgtcattagagaaatgcaaatcaaaaccacagtgagataccatctcacaccagttagaatggcaatcattaaaaagtcaggaaacaacaggtgctggagaggatgtggagaaataggaacacttttacactgttggtgggactgtaaactagttcaaccattgtggaagtcggtgtggtgattcctcagggatctagaactagaaataccatttgacccagtcatcccattactgggtatatacccaaaggactataaatcatgctgctataaagacacatgcacacgtatgtttatcgcggcactattcacaatagcaaagacttggaaccaacccaaatgtccaacaatgaaaattatatttctatgacatataattttttagttaacattaatgtcattttaaaaatactgaaacacctttaaatgatcgtaaattatttcattgaccatgaatgtaaagaattaatcacttgtcattgattaggtaataaaatacttttaattcttatgttctttgtataacccataaagcaattattaactgttaatgtaattatttctgtgacatcttaaaataagcagctattttattttcctctgaattgttaactacaaggagtcctttaaacgttttaaataaactttacaggccattttttgagttctgaaatcagaatttagatagtgtacttttctgatttctcaattcataaaatcattatgacatctgatcttgggttatttttaatactttatatattgcttatactcatacatatatatgcctcattttgaatcaagagaaggcattctttaacagagagtatattatcaatattagcagtagtcatcaaaataaacaatttagaattctgtcaaacattttgctatggttagatttcagtagtttcattttccttgccttcttaaaagagggctttcaatataagatattgtgagatcttataaacagtattgtagctcattttatttttaatgttaaaatctatatcaggatttaaaagtatacccatgaaaaggttttttttaaaattaaaaacagattattaagattttagctaagttattcttaaaaattattttaaaatctttttaggggatatattctttagtttacgtactctcaacaatctattgatgtttgcttcagcaattgatagtttaattgataagaacacaggaaaataaacgaagaaacttgggaattgctttagtttttttttttttttttttttacatcattgggaaaccaaattacttttggaaccacatgtgttatataatagtcgggaaattcaaaaattggttattttatgttatagcaccgtataatttagccctttttaataaaaaagttcccccttattaagcaagttaggcactgatggattaaaagatgttaaattatatgtaattggttcattctatgcaatgtttaaattcttaaacagtgtatcatttgcagtattaaaaatactgagatgaatttgattttatatttgcttgatgattaaattataccttttagcatttagggtttcttttgttttttgatttttttaaaattcttttctagcctgacaaaggatcccatgaaaaagatggtgttgggattgctctaaaatgggaatcaggcagttttctcaggatttaggagataaagttattaggctttattttactttctgccactgagattttgatagttgagttagataaatgacattagaaatcaccaaggaataaggtagagaaataagaaaatggatctggtgttgaaactgaagtaaaaagaaaggatgaggaaaggttttctctctaaaaagcttttgcattgtacctaaaggcactattttaatcacaatgaaagccatttttcttttgcgatttggataatatttcaaaactagtctgtatgctgtacattcctttcatcaaaatgtgtgtgattttatacccttgaactctgagctagcccataaagatgaagaaatgagtaagatatgatccatccatgctttttcttgggagagtgaaacaagcaagcctatgattccataatacatttgtaagatattatttttctcaaatgtatttcttttccatgcacatacaaaaaagcagctccttagaatcatgattaagtagttgctttagaaagtgtatgtgtgaggcgggtggatcacgaggtcgggagttcgagaccagcctgacacggtgaaaccctgtctctactaaaaatacaaaaattagctgagcgtggcggtgcgcacctgtaatcccagctactcaggagtctgaggcaggagaatcgcttgaacctgggttgcggaggttgcagtgagccgagatcatgccattgtactccagcctgggtgacagagcgagactccgactcaaagaaaaaaaaaaaaagataagtgtatgtgtgtctgtcttcccgcagcaacctattttttcttttttggcttccttaaagctcatgattttgttatttcttccatttatttattgattagctgttgaacatctgtgttctagatcttggagatacaagttgagtaaggcgagtaaggcaagatttttgccttctaaaagctgacattcaggcatggatgtgtaaacaaataagcacagtatagtaaagtataattggtagtaattcggtagatgcatttgtggatccatgttgagggcatcaaagagtagatggttacatctgcctgggggattcagttagtcttcagaaaagagttgctgcctgagtctagtcttgaacaattatatattctctctgaggataaaaaagtgaaatacatcccaggcagagagcagcatgaggaaaggcaggactataaaacagtaagatatatttagaataattagagtataatgtaggagtgtagtgagaaatgagggtagaagtgaggaggtgggctaaatcctgaagaaccttgtatattatgtttggactttaccctgacaacaaggaaccaaggaagggtttgattttgcagaaggacatttccagattcaaaatttttataatgcaatagtccccctttcattcatggttttgctttctgtggttttagttaccagtggtcaaccatggcccaaaaatattaaatggaaaattccagaaaaaaaaattcataagttttaaattgcatgtgattctgagtagcatgatgaaatcttgtgccatcctgcctggaatgtgattcatccttttgtctagcatatccacactgtatatgcttccttctcattggtcattgacatcctcagctcctgactttcaaccgttgacattgtcatggctccttctgacatagcttaacactatgtcacagtagctatgtcattcacctcatttcatctgatcctgtaggcattttatcatttcacaccatcacaagaagggggagttcagtactgtgagttgaagaaacacactcaatgtgtttttcctctgctctcacaccacagcaacaatcaacacggaatacttgtgtgatcagttgtgtggggtttttccccgcacaccaagcaagcaattaattcttcagcagacactggctgggtgttcttcaattcaattctgacactatctacctggagatagtgtcagatcccatagattgagggttcagtcccacaagactgccacctcttgagataccagttgcaagttcaggcctctggaacttctgttcctacccacttcaagttgggttcctatgactccccctttgggtttgattaatttgctggagtggctcacagaactcagggaagcacttatacttaccaatttattattaaagggtattacaaggaacatagataagaatgcatggggcaagttataggggaaggggcatagagcatccatgcctttccaggacataccactttccaggaacctccatgtgtttacctctctggaagctctccagacccatccttatgagtgtttagggaggcttcattacatagacatgattgaataaacctttggctattggtgtcaacttaacattcagcctgtctcagctccctggatgttagggggatggggctgaaagttccaaccctctaatcatgcatttgtctttcaggtgaccagccccaatcctacaaaaaagcaatgctttagatattctaaggaatttagaagttgtatcccagaaaattgggtggaaagccaaccaaataaatatttcataatattacaagtacaattagatgttttgagagagcgagaggtcatattcatgcaacttttgttatagtatattattataattttctattattagttattgggttatcctcttactgtgtctaatttataagttaaatgttacaggtatgaataggaaaaaacatagtatatataggctcagtactatttgtggtttcaggcatccactggaggtcttggaatgtatcctccatggattggaggggatctgctctattcttaaagcagtggtgtgggatggattgaattggtgggagtggtggtgtagatggaatgacaaggagaaaatataagactggaggaagaaagtctagtctgtcaacctaagataattgaaagaatcagaatccagtttaaagagtttattcaagcaaaaagctgggaatagccattcaggagatgcagacttcagagaaatggggtcagtgctctgaagttaaaagttaaggttttgcttatgatggcggcagcagcccgtatgtagcagctgctgcaaagatgctggctgcaacgggggaggagcggtcagggctgggaacaggtgggagccctgcgctctaccaagttggtggggtgggagccctgtgctactgggcacaactgcagccacccagccacgggctgtggtcctggccatccccgtgctcttgggggcctgggaaatctctttgcccccacaggcttggaagtgcctgctcccactccctggtctctccccgatcccggcacctgttccagggcagagcaaagttgtggctaagcccgggtggtgtcacaagctggccaggtgtgtgtgtgctcaaggcagtactgacacaccaacccctgccaccttgaccccctccagactttgggtgcctatgagcatgggaggaaaatggaagtgaggctgagggaagctcggctcaggcctgaaggcatctctcagcatgaacagcctgggtgccatggacagcatgttgatggtgacaggaggcagacaggctcctgagtggaaaagggtgggtcccaagtgaaaccccatctttaagccagggaaggcctgtagcctgggggctgggctctcagttctgtggaccacagtgagaacttatggtgtcttttccaagcccacccatggccgcctatggaccaatcagcatgctcttcctcccttctgagcccataaaaacttcagactcagccagattcacacagacattgggactactagctgcaggaaggagctacccactttgggtctcctcaactcattgggacaacctccctatggagaagagctacccactcctggtctcttctctgctgagagctggacactcattgggatgatctgcctgtgaaaagggactacccgcttccggtgtcctgagagctgttctgtcgctcagtgatgctcctcttcacatgcttcattcttcccagacgtgggacaagaactcgggacctgctgaatggcaggactggaagagctataacacagagctgaaacatgatcctcacttgccacattgcaggcaatgagaagaagagaagagagaaggtgaaaatagctgtggcctttggagatcccagacctaggagcttcctaagccattgctgtgacactctctttggggctctgcagttcctggtgtctacaagcttctgggcaccacagtgttccctggttcctgtggtggaagccacttgtggtatacctagtccagccgcagcctctcagggagccaacacctgtgccagcacctggagctccctgccccactgcagccagcatgcttggctatgcacagtggccagaccctgtgcttgcttacacaccccttgccactccgtgcctggctcacccttggcaggtgtgggatccaggctggtagtatgagctgcgcagcctgccaggctgagtgagcggaacaagcccagtggccctgagcaaaactctggcacaggtgccactggccacagaggtttccagctggaaaagtgacacaccctaaggaccctgtgatacttacataggaggaaaacagaaatttaataggattgcaacttctttttaatagaagtctggtttatgagttacagtaattagttacagtttattttcttttccacctggcttttctttcctttacagatgttttttaatttcctttctgattttaaagagtatgcttaacattccatcttatgacagtgtgatagccacaaagtctttgtgtgagaaaggtcagagggaagttaatccataatgaaaatcagcagtgaagaaggaagaggtcttccctggggtcctttcgtcatgtgcaacattttataaaacagtgtaggtaaggaaggaggccagtatataatcagagaaacaaaggttacagctgcataagttacagctgcctgtcacgtgactgaggtcccataatcacattcctttaaggcgcaaaatagagtccaacagcttagattttgaattacctgttttcataagtctaaccaagtgagagaggactatggtttgaattaaagtagtagcagttagaatagaaaaggattatcagaatatgagagatgttaatttagaattaataaggcttgatcctctattggatatagagaagagattgcagtggtatggcagaattgaagatgatgcctagatttgaaggggaaaatataaggaattcagttttgaatgttttgaatttaataggttttatggaacctccaagtaaaaatttctagaagtcagttgcatatgcatagctgcagctttaggagagagatatgaactggaattaagaaattttgagttattcagcagatacatatttaacatttcttatgtgccaagcatgtaccaggcaccaaggatactgtaaaacacatgaaacctgctttatgactaataaaggagacagaaatcaatcatgaagatacataattacaaactgagacaagtgtcataaggaaaaattagaggttgatgtgagaaaattttaacaggaggaccacatctcattgagactgggggatcagggaatgttatcattggagctaaaatttgaagaacaagtaggagtagggcaagtagaatatcttgggcagaaagaacgttagcattataccaataaaagtagtcagatattaacaaactaagttaaagaaaaataaagcaaaaggcagcagctaactgtattctgtgaagagacatgtttaaaacaaagataggagaaggttgaaaggaaaagctctatcatgcaaacacaaccaaaagagctggtacggctacaaaaattagacttttaagcaaaaaccatattattagagatagaggaaacttaataatggtaaatatacctaataacatagtcttgaaatatataaatcatatggagaatttaacaactgtatagtcttagtgggcagtcttaacatgtctctctgatagaccagtagacaaaactcagtaaagctatagaagatgtaggtacattagcagatgtaactaatggacatacgtagaccactgcaaccaccaataacaaaatgtatattctttttcagtatccctggaatgtttacaaaaattgactattttggacaataaagtgtaaatacattttaaaaggatgaagtgatacaaagtgtattttctgaccacaatgtccttattctagaaattaatacaaaaacaaaaaacttttcaaggacattacattaagataacggaccattttggctgggcgcagtggctcatgcctgtagtcccagcactttgggaggctgaggcgggcagatcacgaggtcaggagatcgagaccatcctggctaacacagtgaagccccgtctctactaaaaatacaaaaaaattagctgggcatggtggcaggtgcctgtagtcccagctactcgggaggctgaggcagaagaatggcatgaacccgggaggcggagcttgcagtgagttgagattgcgccactgcactctagcctgggcgacagagcgagactccatctcaaaaaaaaaaaaaaaaaaaaaaaaggttaatggactgttttctctcatggatgtaaatgctaaaaactaattatattaccaaaccaaaactacccttgatcttagccaaaaggccaaaaagtattgacaaccccagactgaatccggtaattgggtaaaaaaaggaccacaacaacgagggggtgttctccctttttggagggtcgctggttctgaatctttacccccttggcgacccttaattctgagccctttgccctagaaggtgagcatctccttggcttccggggatttaggtcctgggtagattttgggggccccttttttcctccgccccaggacatctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatactacacagccataaaaagaatgaaaataatgacattcatagcaagctgaatggaattggagactattactgtaagtgaagtaactccagaatgaaaaaccaaacattgtatgttctcactcataagtgggagctaagctatgaggatgcaaaggcataggaatgatacaatggactttggggacttgggagaaagggtgagaggacggagagggataaaagactacacattgggtacagtgttccctgcttgggtgatgggtacaccaaaatctcagaaatcaccactaaagaacttatacatgcacccaaataccacgtgttcccccagaaacttattaaaataaaataataataaaggaacttccttaatctattaaaaggtgtctataaaacaaaataaccacaaaaaaaaccgtattacagacgccttgtgaaatgttgaagccttttctgcttgagttaaaaagacaaggatgtttgccatcatccttatgtatatgaaatacgtatttcacattgtattaaagattatagctagtgtggtaaggcaagaaaaagaaataaaatatataaaatggattagaatggaggaaatcgtcactattcacatatgattgtgtacatttaaaaatccaaaataattgcagataggttagagattaggaagatcttgggatatagggtcaatattaaaaaatcaatttattttctatatatacaacaatatatattgtggttccagtattataaaaacatctacatacaaataaataatgatgtataagacttctctttagaaaactataaaacattaagagacttttaaaaatcctgaagtagttggagcaatgtattatgttcgtggatagaaagaaatgtataaatatcagtacttcccaatatgataggtttaataacagttccagtctaattcccaacaggtagaggtgggtgtatgtgttatgtgtgacttgataatcttattctaaaaatttacatggaaatacacagggtcaagaataaacaatatttttggagaacaagattggagagcttgccctattgtgtatcaagacttaactataagccaggcacagtggctcaagcctgtaattctagcactttgggaggctgaggtgggtcaattgtctgagctgaggagtttgagaccagcctggacaacatggcaggaccccatctcctaaaaatacacaaaattagccgggtgttgtggcacctgtagtcccagctgctccggaggctgaggcaggagaatcgcttgaacccaagaggcgaaggttgcagtgaaccaagattacactactgcactccagcctgagcaacagagcgaacttactataaagcctgattaattcagtttgtcattagctctaggttagtcaaaaagagcaatggaatagtatgtagctcaaaatctgatttaaaaatacatagaaacttgatttatgacaaaagtgccaccatagagcaatagagaaatactaggcttttcaatgagtggtgctgaaataatatataagaaacctaactgctacatcacaccattcacaaaattaattccacatcagttacagattataagaaaaaacaaagctaagagataaagtgaaaggtcatatttatgatcttggtgtagaaaaagattttagaaactatgcttttgttctaaacttgaaaagattgagaatatccctaccacatggagcgtaaaaacttctgttcattaaaagacatcactaagaaagtggaatagcaagtgaaagaagagattcccatcacctataaccttcaaatggctcatatctagtgtttctacaaatcagccctaacacaacaaatggccaaaaatggacaagaggattgaacaggcacttcccaagagaaaaacccaaaagatcaagaaacatgaaaaggtgcttaaattcaataattgggaaacacaaattaaaactataacaagtagccacaacataccctcaagaacagctagaatttaaaaactgacagtgtcaagtgttatggggatgtggagcagcagcctcttaactgccgaaagtaaagtgttggtacagtctctggaacagtttggcatcatttcctaaagatgaagttgtgtgtatccttaacttggctattcttgtcctgaagtatattcacaatagaaatgtgtacactaagacacatgtgcatgaatgatcagtatagtcctcttcataatagcttcaaactggaaacaattcattaacattagaatgggtaaataaattgtagtgttgtcatatagtggactattatacagcaatgaaaatgaacaacctgcacagagcagtatggatgaatgttacaatgtggaatgaaaaaggcaaggcataaaataatatgtatcatattagtctatataaacttcaaaaagctatcaaaactatagtgtttaaagttgcctatgtaagttgtgaaaataaaaagaaaaacaaggaaatgcttattataaaaagaataaaggttacctattcttggggaggtaagcaagaatgggaagaggaccaaagtggacgggttctggcaattggtacaggcaatattttatttcttaatggggttacatgagagtttggttaaatttttgaggtgtacaattttgtatgctttttttctctacatttcatgttgcacagttttagaatggattaaaaatgtggagagaatgctaaacaaataggtcagaggaaacaaatttatgcaaaaattgttaaaagcatgttgataagtaacacttaactgcaattaggtttatcccaaacttctcatttgttagtcattaaagctcagtaattaataaattgtctcctttagtaaccgttgttcactgatagtacagtcagtcatttcccactttgcagtagtgcaggactgtaaaaaatgacagtataagttgaaaccatgaaaaatgatcttaatttaaaaatggggaaaattacagtattttaacgtacgctctttaaaaatttttgtcaagacagtaaaacctcttctattgtaggttaaaatgtatagggaaatttagaagtatttacttagcacaatgtcattgaagatattggaatcaattagaattagtgttttatttctttgtaaaaaaaacttatcaaaggcagtttgagcagttctcattgtgtaacttacaatagcagagctagcaaagtgagcatcttttctgtgccttggcaaattgtcacactcctttcttttaaattaggattagcttccaacgttttatcttttgtgcttccactgtcatgaagtagctccaagagtttcttaaatgtgaaggtttttttgctagtgtcacttcctttggaacatattccttctttttgtcacaaccacattcctcatttatgtctgtaggtttgccttcgctaagttcctcaggctgcatatctagaagctctcaaacagtggcagtggcaacatttccacagtcagctacttcatctgttactccacttatgttggatttgaatttcatttccagtgttaccattttttttgtttgtttttttgttttttgctgcacttctgtctttgttggccaattcctgctttcatctacctatttagtaaaatttcatgtagacttagcactgggaggcaagaaggcaacagatgcatgctttgctgtctgtaggtgaattgactaacagatgagggtgtaaccaatcatcaactgactttgaaagaagtggtgattggtcactgatcatgacgtacagctcttcttaacagtgatttgtagactagagcagcagtctccttgtttttggcacaagggactagtttcgtggaagacagtctttccacgggcagggggtgggggtgtgtggagtgggggatggtttcgcgatgaaactgtaccacctcagatcatcaggcattaattagattctcataaggagcatgcaacctagacccctcacgtgtgcagttcacaataggcctcgtgctcctatgagaatctaatgccgccactgatctgacaggtggtggaactcaggcagtaatgcttgctcacctaccgcccacctcctgctgtacagcctggttccttacaggccactgaccgttactggtctgcagctggggggttggggagtcctggactagagtactagaaatgaagtttgtatttgtgcaattactcacagttaatatgctgtagtaagtgaaatttgaatcatggtgttgggcagtgttgttactaactcgagtcactcaaatttgtgcatatgcgaagcatgcaaagtgagagcagcctataattcaaagatggttgaactttttgatcagttaaataaagatttggtagattccaatgagatttcaggtgcagggctacttggagtatttgatctgagcttttgaacacctgatacattttgtgtgataatgtaaatttgatttactcttacagcttccttaatccttttatgcacttccttagagaggacatctcacactaactctctagaacaaaatccctattatagtaaataaaaacagtgtttttaggagaataatggtgataattgtgaattcaccatgcagcagctgacattgaaagcaagtttttaaaaaacgttttgtataatgttgatattctagtaattggaagttaaatcaattttgattattttagttgggtaatttcatttttattgtcttcatacaagcaaatacagttggcccttgaacaacccagagattaggggcaccaaccctctgcattgctgaaaatctgtgtgtaacttctgactttccaaaaacttaactacttatagactactgttgaccagaagccttaccgagaacataaagtgttgtttaacatattttgtaagttatatgtattatatgctgcattcttacaataaaataaaccagagaaaataaaatgttattaaaaatcataagataattaactattaagtggaagtgaatcatcataaagtcttcatccttgtcattttcaccttgagtaggctgaggaggaagaggaggggtttgtcctgctgtctcagggaggcagagagggaagaaaatccaccagtaagtggacccaggcagttcaaatccatgttgttcaagggtcaacagtgctttattcttcaatgaaaaataaagtctcattctgtgttggctgaaatttaatattgttaatttatttttgatttcctacaggtgaactggcacaaaggttaatctcaagatgccgctagtgaaaagaaacatcgatcctaggcacttgtgccacacagcactgcctagaggcattaagaatgaactggaatgtgtaaccaatatttccttggcaaatataattagacaactaagtagcctaagtaagtatatatcaattaaaaatatactcacaaaccagaatgttatgctttagcgtattaagaagttgtgcttctgattaatttgggagtatgatttggtgagaagagtacaaaattatcctgaaaaatatagtcacatgagtataattattgagttttacaagaacctcttctgcatgatgtttcttctgggaaaggaaaatacggacagaatctctaggaacagaaacacatgatgaatgaaaattattgagattgttttaaaaatatataatctgcgaaaggaccagagttgtacttttccttggttattatcactatttactctgtttagaggcctcaactatttgtgttttcaaacactagtatccctctctttatatatatatttaattagtttagggaaatatttttatattagcaaagatctaaggtgagaggtatggggtcattattagtcagaggggtaggctagtcaagtgggatgtctaagagacattaggatataagtcaggaatctgatatgcagcattgtgtgaaaacagcaaatgaacttggcctctggcagacagaagtcaagcaggttggccagagaataaaggccagtgaaagaggcagattagggagaaggagacaggcaatatgttctcattgcagatttacagaatagagcaacttggttaaggaattaaacaaattattttctattctaagtttatttagaaaatttaaaaaatctggtctgtcttttgcattgaaggattagctttttcataagacattgatatttcattttaaaggtgaaacaaggtgttcttggcagagataatatccaccaagtggtcctagatttatctcatcagccatataaattctcctgataagcaggcttggcttttcttttcttttccttttaacttttgtcctttcttttataattgagtacttagcacaagaggttgttaatctaatttgtttccggtaagaaagtttaggcatacctgtagcgagagcaacataaaaagttacatttgaatattctctgtgagagtactaaatttttgcattgcctgtgaaatagtaagaataaataaaaggctattttatttgaattttaagtatattccttgttccattcagtggtcatttttttcaggttagtgaatcactaaaatattgtattgtttacttgaggctaataaaaaaagtgttagagttcccagtttaaatatgattaactatattgtttaaagatattttgcagattttttgtgacctagcacggattgaatcaagtataacatgatgtcatataaaatttgttttatatatgttatgtacatacataagtatataagcatgctaatattaaaatacatgttaagaacatagaaatggcattagtaattttgtataacatatttcttaaaatgaattgtggatccagtacaggcatcttattttaggtatatacccaatatagaatttagaactaatattgtgattaagggtgataatttgcagtactaacccatttgttacaaaacttaaagatgaaaatttaaggaatttttaagtctatatagtccatataagcaacatctatcagcaggcacatggttatgctgtagcgaaactctgaaaattataaataccttgtaacaatataactaaattaggtgttgggtgcttcacatttagaatcagagacctggaaggcattgtttaagcagtttgtagagattcaaaaacaaagagaaaacccataaaatattctagcaaggtgtgacaatagcttactgccctgaaattaacttctctggcagctttcccacttgacatagttgagaacctggaattaaatttaaaaggcctctagatagccagaataaataaactcatgcactaaagaccatgcacataaaataaccaattgatccctctctcaaaacctgtttacttttaccttgatagttcaaacagatttgatgatgtggtttccaaacagttatgcttcagaggataaaaggaggaagcatgggaggagatactagaaggaggcatcactgaacccaaccaaaaggaggtagttcacaggaaaggacaaagtgatgtaagggaagatgcaacataaaaactggaaagaagccatttaatgtaaagcaaatatccttatacatttcaaggctgttttctggcctaggataatatttgattttcataattcatgcccatgagtccctaagaaaaaattaaattatgtttaattttatattccatttaagaagagggaagcttagaatacatttcacaagtttccatcgaaaatagttaaaataacaattgatgtattagataataaaatctgaattacttagaaaacttggctatccaaaatgtttctagataatggagattttcactttggtgctattattagtactgaaagtgcttgagaatatagcaatgaaagtaaactgcagggatccacatggctcagggctggatatcttcctgaccttttcctcacaaaaatgtacttcctttttttatttttttgaaacagagtcttgctctgtcacccaggctggagtgcagtggtgcgatcttggctcactacaaactccacctcccaggttcaagcaattcttgtacctcagccaccaaagccgctgggattacaggcgagtgccatcatgcctggctaatttttgtattatttttagtagaaatggggttttgccatgttggccaggctggccttgaacttctggcctcaagtgatccacccgcctcggcctcccaaagtgctgggattacaggtgtgagccaccatacccagccagtacatctgttttttgtgagatttttcctagtagaacataattctgttttgtattaggtaattaccacaaacctataattcactttatatcaatttcctctttctcattttattgctttcttaatgatgcaaggttttttactccttagctgagctaggtccaggttcttgtctcacgatgaggaagaattaggcacacagatactctaagagtgaatggagtagaatttattaagtgaaaggaaagctctcagccaagagaggggtcctgaaagcaggttccaggttgccccgtcacagttgaatacaagggcatatatatatatatatctatatatatatatatatagagagagagagagagagagagagagagagagagagagacgagagagaggagagatacgagagacacaggctctcgcnnnnnnnnnnnnnnnnnnnncatatatatatatatatatatatatatatatatatcatagagagagatagagggagtgaaagagaggtaaagagggtaaagggctaaggtagagtagagagagagagagagagagagagacgctgatggggctgggttccctatttgtatgaggcacagattactggtggcttcaccacatttccctagtgcacatgcaggcccttagtctgctgtgggcatgtttaagcaagccccctgtgcaagttcccttatctgcacaaagcatctggtgtaagcccttgtggggtgggtcagaggttctctggggacccttcccttactgtctgcctaaagcaagctagctaactcctttcattaacaaccactgggattctgaatacctaagggatctcttcccctggcttttctcttatggaatatagtcagttcttattgccaagattagtcttttccatctctgtatctacacctagcatttgtatccctaccaattgttgaataaatgagtaactttatacctgctttttcttccatttgggatgcttcccttatctgccagagaaactgtctctggaagtatcttgatcaccaaataacttttgacacctgaaagtgaggtgcttctatctctgctgtgttgctcttaccttatattaagagctgcctgttattgggctcctctgtatgaggtgcacttcaaggctcttttcttgcttcttttagagacagatgtttttattcctattttacagataaggaaattgataccaaggtctcacagtgaatagaacaaatattaggacttatctattaaattgctttaaatatttgcttaaatgtctggttctccctctgctcaaaattcagtaatggcagggatcttcttcaagttattttggcttactcttttcagtaataagaacttacacaactagaggaatacagtgattttagatttatgatttttttttttcagaagttgtaacaagagggtgtaaaagatctcctaaatttctgaatctatatcttgggcatccctgggacagataatcttctaggtctttgatgaatcttgggttctgctacttggcctaaaatttatttctagctaatataaatgctgattatatataaatgctgattatatataaatgctacagtctacatataaatgctttcagattgacaggcatattatttgcatatacctttacatcataatcttctctaaccctcatcaggtggacagatatagataaagcaagtaatttccattttagacacaaatcatttaacagaaagtagtagaacaaggtttaaaagcaggcttcccagggtatctctttttttttccccactttgtcatggctgggtgactttagatagggtttaaagtttaaaatacagttggcccttgaacagtgtaggggtaaggggcacagatcctcagtgaagccagaaatttgcatataacttttgactcccccaaaacttaactgcctatagcctactattgaccagaagccttaccgagaacataaactgttgcttaacatgtatattttatgttgtatgtgtagtagtatactgtattcctacaataaggtaagctagagaaaagaatatgttattaagaaaaccataagaaaaaatatacttactgttcattaattggaagtggatcatcataaaagtcttcatcctcgttatcttcacattgagcagaccaaagaggagaaggaaaaggaggagtttgtcttgctgtctcaggagtagcagaggcagagaggtggaggaggtagaagtagtagaggtgggcacactggtgtaactttacaaaaacacatcttgatttctgacttttttgcttcttcatttctctaaaaatgtttttatatggtaccaatcctccttttatttgctttagttttggtactgtatcatagaagggttcacgttgtaaaataaatcaaaagtagtcttgaataattggaacgcttttgccagattctctaatgtcaatttgttttctgacaccacttcttctatgtcttcttttttttttttttggattccattttttaaaatcggagatctgcttctttactttctttcttatttattatgatactttaagttctatggtacatgtgcatagtgtgcaggtttgttacataggtatacatgtgccatggtggtttgctgcacccatcaactcgtcatttacattaggtattttttcctaatgctatccctcccccagcccccgaccctccgacagacccgggtatgtgatgttccccaccatgtgtccatgtgttcatgttgttcaattcccacctaggagtgagaacatctggtgtttggttttccaaccttgtgatagtttttttagaatgatggtttccagctttatacatgtccctgcaaaggacatgaactcatccttttttatggctacatagtattccatggtgtatatgtaccacattttcttaatccagtctatcattgatggacatttgggttggttccaagtctttactattgtaaatagtgccacaataaacatacatgtgcatttgtctttatagtagcatgatttataatcctttgggtatgtacccagtaatgggatcgctggatcaaatggtatttctagttctagatccttgaggaattgccacactgtcttccacaatggttgaactgacttacactctcaccaatagtgtaaaagtgttcctatttctccacatcctctccagcatctgttgtttcctgactttttaatgatcaccattctaactggcatgagatggtatctccttgtggttttgatttgcatttctctgatgaccagggatgatgagcattttttcatatgtctgttggctgtgtaaatgtcttcttttgggaagtgcctgttcatatcctttgtccactttttgatcgggttgttttttttcttataaatttgtttaagttctttgtagattctggatattaagcctttgtcagatgggtagattgcaaggattttctcccattctgtaggttgcctgttcactctgatggtagttgcttttgctgtgcagaggctctttagtttatttagatcccatgtgtctattttggctttcttgccattgcttttggtgttttagtcatgaagtgtttgcccatgcctatgtcctgaatggtattgcctaggttttcttctagggtttttatggtgttaggtcttacatttaaatctttaatccatcttgagttaatttttgtatacggtgtaaagaagggatctagtttcagctttcttcatatggctagccagttttcccagcaccatttattaaatagggaatcctttccccatttcttgtttttgtcaggtttgtcaaagatcagatggttgtagatgtgtggtgttatttctgagggctctgttctgttccattggtctatatctctgttttggtaccagtaccatgctgttttggttactgtagccttgtagtgtagtcttgaagtcatgtagcgtgatgcctccagctttgttcttttggcttaggattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacactgatgggtcttgactctttatccaatttgccagtctgtgtcttttaattggcagcatttagcccatttacatttaaggttaatattgttatgttttattttgatcctgtcattatcatgttaactggttattttgcctgttaattgatgcagtttcttcctagcatcgatgttctttaccatttggcatgttttgcagtggctggtaccggttgttgctttccatgtttagtgcttccttcaggagttcttgtaaggcaggccttgtggtgacaaaatctctcagcatttgcttgtctgtaaaggattttatttctccttggcttatgaagcttagtttggctggatatgagattctgggttgaaaattcttttctttaagaatgttgaatattggcccccactctcttctggcttgtagggtttctgccgagagatccgctgttagtctgatgggcttccctttgtaggtaacccgacctttctctgtggctgcccttaacattttttccttcatttcaaccttggtgaatctgacaattatgtgtcttggggttgctcttcttgaggaatatctttgtggtgttatctgtatttcctgaatttgaatgctggccttccttgctaggttagggaagttctcctagataatatcctgacgaatgttttctaacttggttccattttccccatcactttctggtacaccagtcaaacatatatttggccttttcatatagtcctatatttcttggaggctttgtttgtttcttttcactctttttttatctgatcttttcttctcgttttatttcattaatttgatcttcaatcactgatattctttcttccacttgatcaaatcagctattgaagcttgtgcatgcgtcacaaagtttttgtgccatggttttcagctccatcaggtcatttaaggtcttctctacattttattctagttagccatttatctaagcttttttcaaggtttttagcttccttgcaattggttagaacatgctcctttagctcagagaagtttgttattaccaaccttgtgaagcctacttctatcaactcatcaaactcattttccatccagtttttttcccttgctggcaaggagctgcaatcctttggacgagaagaggcgctttgttttttttttcgaattttcagcttttctgctctggtttctccccatctttgtggttttatctacctttggtcttcgatgttggtgacctacagagggggttttggtgtggatgtcccttctgtttgttagttttccttctaacagtcagacccctcagctacaggtctgttggagtttgcttgaggtccactccagaccctgtttgcctgggtatcaccaccagaggctgcagaacagcaaatattgctgcctgatccttcctctggaagcttcatcccagaggggcacccacctgtttgaggtgtctgttggcccctactgggaggtgttccccagtcaggctacacgggggtcagggacccacttgaggaggcagtctgtccgttctcggagttcagacgctgtgctgagagaaccactgctctcttcagagctgtcagacaaggatgtttaagtctgcagaagctgtctgctgctttttgttctactacgtccttccccaagaggtggaatttatagagggaatagaccttactgagcagttcaagcttaccggcctctttgtttacactttgagctactcaagcctcagcaatggtggacacccctcccccgtcaagctgcagcgtcacaggttgatctcagactgccgcactagcagtgatcaaggctctgtgggcgtgggacccgccgagccaggcatgggagggtatctcctggtctgctggttgctaagactgtgggaaaagcatatagtatttgatcaggagtgtactgtttctccaggtagagtctgtcacagcttcccttggctaggaaagggaaatcccctgaccccttgtacttcctgggtgaggcaatgcctcgccctgcttcagcttgccctctgtgggctgcacccactgtccaaccagtcccaatgagatgaaccaggtacctcagttggaaatgcagaaatcacccgtcttctgcatcagtttcgctgggagctgcagaccggagctgttcctattcagccgtcttggaagtgaccccctcttctatgtcttctttctcattgtctggtactggtttggaggcactcttctccatcaagtcatcttctgttaattcctctggtgtgctgtctaattgggttttgaatttctccaagatccataccttgccacgcttcatccccacccttttttctgtatccactgtctatttcattatttccttgactggcactgttaaaaaccctgtgaggtcatgcaaaacatctggacacagttttctcaaattttatgaatttgttttcttgagcttgatggttttcttggctttttcaataataactatgacatctttgatggtataatccctccaaactttcatgatgttctctgttgggattctcttccatagtgttgacagtcttccacagaataccatgtgtaatgagtcttaaatgtccttatgatctagagcctgaattagagctgtcatgtttgcgggcaagtggaccactttgacaccttcagtgtgaaactaatggggttctgagtggccagagatgttgtacagttatcacaagaattttaaaagacattcccttactggcaaggtacttcctgacttcagggacaaagcgtcaatgggaccaatccagaaaaaggattctcattgtccatgccttcttgttgtcttgccttcttcttttggccttctttttccttcaaggtttgaggttagcagctttatagataagggcagttctgatgataaacccgactgcatttgcacaaaacaatagagttagtgtgtcccttcctgccttaaatcctggtgttcactttttcttactaataaatgtcctctgtagcagttttttttttttctggaataggacactctcatctgcattaaaactctgttcaggcagatattgtttctactcaatttttttctttttcttttctgttttgtttttttttttttctttgagagagagagagaaggtctcactttgtcacccaggctgggctggagtacagtggcatgatcacgactcacaatagcctcgacctcctaggctcaagtgatcctcctgcctcacctccccaagtagctgggactacaggcacataccatcgtgcccagctaatttctgtatttttggttgagacggggtttcaccatgttgttcaggctggtctcaaactcctgagctcaagcagtctgcccacctcagcctttcaaagtgctaggattacagactgtcatgcctggccaatttttttttttttttcaagcagcatacatggaaactaattattttcttaatggcatctgggaactcatctgctgcctcttggctgacaaaagctgcagcttctcttgtgacatttttgaggccaaacctcttcctgaaagtatcaaagcatcctttactgccattaaattttccaggtttagatcctttgccttccttttgctttaagttgtcatatatggacttcactttttctcaaatcatgttagagtctgtatgtatgctttcttgtaacagccatgcacccacaaaaattgcattttgatacaagattaaaaggtattcgcaaaaagtacaaggtttttgtgtctgctggtgtatctgcagcaatggcttcatgattttccttttctttttttataattgcccttaagtttgattcatttatcttgaaatgctaagcaaccacagctgtagacctcaatctggggttcatatcaagcaattcaactttatcttgtagtgttatgactttcttgtacttgagagtacttccagcatcactggtggcactttgaatgagtctcacaatgtattcaaggtttacagtattgcataaaacatgatggaaaatacacaagaaccatgagagattacttcctactcttatatgcaatttagtggagagagaactgctcaaacagcattttaagtggatagtaacaacactagagctaactgcagtatcaacagagggtggctataaaattgttacagtaatacagtattacacttaaatttattgttatgatttagtactattaggttggcaaaaactgcaattacatttgcaccaacctaatatatctttccatttctttatatttctcttgactgtgaatggcactatgtatgtttttgttttgtgtgtaaattttgataaattttaactttttataatttctgtatattttgtggtagtaaatgataaaatagtctagtatttacatagattttatgcattcatatctttaaaatatactttaaaatttttagtatttttaggctatgtggttcatctgcaagttttttcaaattgtctcaaatctccaaaattttcaatgtatttattgaaaaaaatccacatgtaagtggactattacagttaaacgattttgttcaagggtcaactgtaattccaaataaattccaaattcaacaggtcaccagttgtaatattacattgttcattatttatctctgatcacaaagtatctgagggcaaatatcatgctagatttctactgcttgcaaagataaaaactcagtgctctggatgttaaattttatgatatatgtgtcatttttgcttaggtaaatatgctgaagatatatttggagaattattcaatgaagcacatagtttttccttcagagtcaactcattgcaagaacgtgtggaccgtttatctgttagtgttacacagcttgatccaaaggaagaagaatgtaagcttattaatattgtattttcttctacgtatatattttaagttagatgagatgaatgatatacttaacagtattaatcatgaatttattacagatcatacccatgtcctttggtgtacatattgtaataaatcagtgaattatctaaaaatgccatcagtatgattctccgggcttttcttttctactctgttttaaatctcttctttttgtacactaaacagctcctaatttttttgcataaagaagtcattttaaccagacattttcctccattctcttcattatctttctcttttcatttctcccttataatttatttgtatacttttgtcttagaaataaaaattattagaaaattacctgaaatctttaggtttgattctacaagaatgtaactggttttttttttgtttttttttttttttgagacagacactctgtcactaggctggagtgcagtggcgcaatctcggctcactgcaacctccacctcccaggttcaagcaattctcctgcctcagcctcctgagtagctgggattacaggtgtctgccaccacgcctggctaatttttttatttttagtagagatggggtttcaccatgttggtccggctggtctcgaactcctgaccttgtgatctgcccacctcggcctcccaaagtgttgggattataggcatgagccactacacctggctatgtaactgcttttaatatgcttttgtatgtgcatattgctaaagtcttattagttatttaactgaatgcaacttcctactttaaatgaacatttcaaaaacaaattgccagtatgtagggtgtaaacattctataccaagatattaaatcaggaataatcagataggctaaaataattgtagaaacttcggtggtaaaatcatgttttatgccttgatagaatacattgaatgccgacgtttcccaaatgcatctttttgtttgtttcacaaaaagaaatgcaatactaagaacataatttgcacttacctaccacagagaattgtttaatggaatttcttacactctcttcaaaatatttttgttgcattaaatagtataaacacaaattatatgatagatctaatttttagtataaatgcaaattatataatagatctaaactttaacaataaaaatactaaaggatgtcagtggaaagaacaaaaatataatgtaatgatagatgtcttagtgatggaaccagctacttttgaaataatccaatgtgtaaataaggagaggcaaatacttggcatactagatttgtaccacttgtaaaatgtaaactcagagctctggatacaagaagaaaaggaaataatacttaaaaaatagctttattaagatatatttcacaacctacgtataccttgcagttcacccatttaaagttgaagtgtacaattcagtgttttttagtatattcaagttatgcaaccgtcaccacaatcaattttagagtatttgtatcactccagaaagaagccctgtactcattagcagtcactctgtttccccttcagctcaacccctagcaatcactgatctttctgtctgtatggatttgcctctatggatttgtctgtatggatctgtctgtatggatatttcatatgaatgaatagtacagtatgtggtcttttgtgactggcttcttttagcataatgttttcaaggttcattcatatagcatgtatttatatctccctgatggctaatgatgttgagtatgttttcatgtgcttacaggccatttgaatatctcctttggagaaatgtctatttaattccttagcccatttataatttgtattattcgtgtttttatttttgacttgttggaattctgtgtatattctggatctaaatcctttatcaaatatatgatttgcaaatattttctccccttctttaggttgtctttcttggtggtatcctttgaaacatgtgcatgtatcaatacattaattacacctcatggaattcttgaaataaaatcattgttagtggtgaaaaatattttatggtcatgctttcaaatacataatttatagccaaaatttgtttttcagataactcaactgcttatcacttaaatataaatttatgccatcaaataatagagaaatacacaggcagttctcatatgtaacagaaataaaaatcaacatttagtttcaaaatattgttacattttaacaaatgtcttagagccaccattaaacttgaaagtgaaaatacagataacagtaaataaattaagatgtttgtgttaaaaaacaaattttaatatgtcaacagctatactgtcagaattatacctagtttcctttaaaattttgtggagcagtgggggaagaattcagaatctaaaagctgaactacttaatttgaaattgttttggagaggttgtattgaaggagttttcagttatttaacctaggttttttaattcagtgggaattaaaaaaaaaacatcatgtgtacagtactaaatagcacagtgtggtatcagtttttttaaccgttttgtagtaactaaaaactatcaattttgaaaatattttttaaatgaattttaaacaaagacttgtacaattatatttaagtcaattatgtttataagcattatgctaatttattgctttataattctattttattaatatcagatgttattgttggcaagtggaaggagcttcaccacaatagtctgttaataataagacaaacgataaatgagaggagttgaagatagaaaagtacatcatgcttattagtttacatgtttcttacatcctttaccaaggaagtttggcgagattaaacactaggtttcatcttaattacatacttattgattaataagtggggcaggagagtggcaagaattgatccactttgactgcagaaaacacaacccacttctggcaggagcctgagaacagcgtgtggtattgtggcaaaaagattagcctcaaaggtagacagatctgacttttctgttctggctctgctgtttattaactgtttaacctcaggtcagttatatactatttcctagccttagctttcttatatttcacaatggagtaataattcctgtcttactgaattgtaaagattaaatgaaatgaaatttagtgaaaccatctagcacatatagtatgtactcattaaatactgtatctccagtgccactttttagtgatagtggggaaaaactttttgcttctctgaattttattttagtatttataagtgtgttacaggtcatgcagcagtggaattgctagaaatggaattatggtgccaccattgcagagccagcctattgtaccttctgtgccattggtcccatgttcatgttgagtgaatttacttgaggggatgacaggaatattattttaaggagaaggataacttaagaattgttggctggatgtggtggctcacacctgtaatcccatcactttgggaggctgaggcgggcagatcatgaggtcaggagttcaagaccagcctggccaacatagtgaaccctcatctctactaaaaatttaaaaaaaaaaaaaaattagtcggccatggtggcaggtgcctgtagtcccagctacttgggaagctgaggcaggagaattgcttgaacccgggaggaagaggttgcagtgagccgagatcgtgccactgcactccagcctgggtgacacagcgagactctgtctcaaaaaaaaaaaaaaaaagaattgttaggattgttatactgaccttgctatgttatagggcatttgtctgtatacttaaggccatattaaatatcaagaaattaccttattttttaatatcgggatatcagtgtaagaattaagaatgcagcatttttgtatgttttttattttaacatgctgcacagttcaaaataaatgaagttgtttttaaatcatgtatgtgatggggctgtgctagtgactgggaatactaatgtacaagatagtctgagtcttcaagagcttatagttaggtagaaatccttatagtacagataaaagataagtgaaaaagagaataatatagatcacctaatacttaaaagtatttcctttacagtaaagtttgttttaacttgagagtacacatacaatatttatagtatatgtagcatagaggttaacagcgtgtttagcccacagtgccactaataagtaattcctttcagagttactggtgtaagctaaaaaaaggaataaagggagatggaaaagaagattataggagaagagaacctaagttggtgggggcccatgatggcaggtagaagaaagaaaaaggtatatttggttgaaatgtagatatgtttcaggtgtcattagggccctctgagccttcaaaatcaaaggttaattaaaacctatctgattgggaaaattaggcgcagaatgatatgggtaaatataatgatagaacatttaaaatatggtttctgattcataagccactaaggtcacaacctcttgagccatgctgacttttagacaaataaagtatgtgaatttgcccttatgttaaatcatcttagtaaaataaaataaaatgaattcttgatttttgttttagtgtctttgcaagatataacaatgaggaaagctttccgaagttctacaattcaagaccagcagcttttcgatcgcaagactttgcctattccattacaggagacgtacgatgtttgtgaacagcctccacctctcaatatactcactccttataggtaggtaggttaataaatagtagccctattatttatctcagacttcagattgaaatgctaaatccccaaacattctttatttcattggggttctagccaacacagagagccctctctgtccaccacctttggaaaacctttgcttttattcattggatgaattcttaagattgtggcatacaaaagacaagacctatttaaaagagttgtttttacaagtttagaaaagccactggtaaacttattaatgtaaagagataaggagttattattgtccttttaatttaatttttaatcaaatggaaaaagctcaaaattctgtcctactaacaaaataaacataatttttgcttgttttgtctactctttttttttttttttttttttttttgaggcggagtctcactttgtcacctaggcttactgcaagctctgcctcccaggttcatgtcattttcctgcctcagcctaccgagtagctgggactacaggcgcctgccaccaagcccggctaaatttttatatttttagtagagatggggtttcactgtattagccaggatggtctcgatctgacctcgtgatccacccgccttggcctctcaaagtgctgggattacaggcgtgagccactgcgcccggcctgtttcgtctactcttgatttgatttgtatacattaacttcttacataatgaataggtagtacctttataaaatgctttttaccacttagaataaaatctggaattatttagcctttctttgaagttctttcacatggtttgttaaatgggtaatgtacaacacaacctgaataaaatagtattcagagagttatttgaaattgtaagtcagtgtgcagataattagatataaatgtgactgttagaatgactattacatgatatcttttggatttagtaagataataaataaatcatagtattggcagaaactgcaaaatttctgtcttctagatgatgttactgtcttttcaggcttttatctttggcagagctatttgtaattattggaattgcccaaaggactttttagaaaatttgggattcagcagaaattagggatgaaaattgcccagctatactttaaattgttagtactaacttggaaaagcatctgctttaccacttttctttgtttcctcatatttgtgagaaattttctattggtgcaatattcagttttattttggcactattttaacatgctgtattttattaatgtaagaggataaacattttagtgaaattatttctattctgattgcctaagtcttactaatgtgtgttttaattgatattttatatttcagagatgatggtaaagaaggtctgaagttttataccaatccttcgtatttctttgatctatggaaagaaaaaatgttgcaagatacagaggataagaggaaggaaaagaggaagcagaaggtattacaagagattaaaaaattgaggttaatttttgtatatttgtgttttgttgcatatattgaacttcattaatcttgtattttgacagttttattttattgggtccatatagttaaatactgaagtctttataactccacagaaagaacacagtctgatggggagcagatgagcaattagattattagagtagggcataataagtgccatagcagaggtatgcataaagggtttagataacacaaaatagcatctgctttagctagcaggcagggtaaacccttcccacaaagcttataatgaatcttgaagaacagataggagttaggtgtaccaaggaagagaggaacattttggtaaggagcaatggaatcttgtacagatattggtaacgtagattaagctagtattttgttgctacagagcacatcctaaacatttctctcctaaatgttttggagaggttattatattcacatgaaatttctgttattgtcattttccactttctaataaaattcacttgtatctgctttatatttcatgttaatgataactgaaaacacagaaggatgaagcaaagttagatttaggttgaattatgaaggaggcaaattctgtctttatcatctctctggttctcctgtagctatctctgctttccctaatccctgtataatgccattgtattgtcttctttgctagatggtaacccagtgttctagctaacatttgcaaattggtgactggcaagccagattatgcctgtagggagtgttttgtttgccaaacacagaggtttttaaattttggaactagagtgcctgagatggacatgtctgtctagctcacctcatgccccatcttacacccgactggcttcattcatgtatgttatccgcttggccgctttgggcgtttgaatttgttacacttactctagccctttctgtactttctcccccagttttgaatcactttttgttttattgtttaaagacaatgttttctgttgagtgatatagttattatcggttaattagataattggatttttttctaatgtgttggctagctaatcagttacttcccagataacataaccttagtaaattgttacgttttgattaggggcagacaatgccattcatcgtagaaatttcaaactaatgcctgtggagcaagggttcatgagtcttttttcatctgaaagactttctgacctcaaattgtattctttaggcatactgttttgtgtctggtgcatcagttcaaattaggggttaaacaaaacatggcaggaaactgggattacagcagactggctaagatttaactgaatgtacaagtaaaccatttctgtgttacttttactatattatgatgacattgtctttttcagtgttgatgttagagtttaatttgattgttataacctcctttttaaaaattagcgcttaagcatttgactttgtttcaatacatctgttatagcagaaaaatctagatcgtcctcatgaaccagaaaaagtgccaagagcacctcatgacaggcggcgagaatggcagaagctggcccaaggtccagagctggctgaagatgatgctaatctcttacataagcatattgaagttgctaatggcccagcctctcattttgaaacaaggtttctttacttttgtttttttttttaaatgataaaacattggctttatttgtagtatctgtacttctaagtcttgagtcctaaactgttgaacaggcagaccctgttataaatatagagattatttcaaaatcctgaccactgtgagcctactaaagtcaggccttgagcaggtcattttcatacctggaccttagttttgtcatcttagaaagaagtggttggagtggctgatctttagggttttagctttagtgtgacgtctcaatagcctctcgatatttcaggcacagtctgctagaattttgtaataaaagtttagggtctggggtttttttgaaatactgttgatttattgcatataaaataggagtgaagaaggggttctgttttgttccttttactttcccctgacttcctttctttgccacattgcccacctcagatatattaggactttcaaacaaaagtattgatcccttttgtagaaaagattttttcctttcttagtggccaggggccctaactaaataacatactaccagcaaacacattaaactggcatctgtctacgaagacacttatttgggtatagtcatacgtttgtttgtttgttttgagacagaatcttgctctatcgcccagggtggagtgcagtggtgtgctctcagctcactgcaacctctgcctcctgggttcaagcgattctcccacctcagcctcccaagtagctgggattacaggcacacgccaccacgcccagctaatttttgtatttttagtagagatggggtctcaccatgttggccgggctgatcttgaactcatgacctcaagtgatctgcctgtctcagcctcccaaagtgctgggattgcatgtgtgagccactgtgcccagcctagtcatatgattttttaatggaaaagagcttaaggttttcttttaagtaatatacatataaatgattgggccataagtgtgcaacatcttgacctattttaggagaaatatacatctgagagatactatttatctgtattactgaaagaattgacattaaaaaattaataaactttagacatttatttctactacagttgagtaattaaggtacttatctgactcactaaatacaataatttctgacttgctgtgtgcacatctgttaaatccaactttttcccaagaatgtactagcaaatatttataaatcttaacatgttcgagttatctaaaattttgcttacatctaagtcacatgttgctatgttactcagctattttctgagtacccttgcacctttgaaaacagcagaaggacagaaacaatatagctagccacctctgtgctgctagtatctgggaggcctttctctctggtgcaagacttttagaagtcatttaagtttaagagcacaccgagatatactagtagtagaaaactcattttcctattctacctttctgtcattggcatcttcttgtaaagaactaaatagaggcagatagctttccacacaatttgctaaaagttaattattttcttgtttattaaattacgtacgtaatgcttttcatcctgtgagttgaattagtattctgttataaaataataaaataaccgatggtcatcatagtagatctctaaatcaacaagtaagggttatattgtgagcagcattctttgttttaaaagcaggattaatataatacatttctgaaagtttcttaaaaatagttaaaatattggcattgaaaggataaactttaaatatttaatatctcatgtagaaccctttcctcccaataattcaagaataattcactgatactatatatttcttttagacctcagacatacgtggatcatatggatggatcttactcactttctgccttgccatttagtcagatgagtgagcttctgactagagctgaggaaagggtattagtcagaccacatgaaccacctccacctccaccaatgcatggagcaggagatgcaaaaccgatacccacctgtatcaggtatgttggaacaagcatatgatgttttatcttaggagtcagtaagctttttctttcaaggacgatatagtaagtatttttggctttcgggccttacagtttttgtcacaagtactcaattctgccattgttgcatgaaagccaccatagaatatacataaacaaatgaatgtgtctgtgttgaaataaactctatttataaaaacagggagcaggtcagatttggtctgtgggacattgtttgtaatcttctggttagagctgacacactctcctaggaaaatttagctaataagaatttaaagattaaagcctgtttcattttattatagtgttgttatcaagcatatcatgtgcagtgtattaagaaaaattaaggattttttggaatgtgggtaacagtctaagaaatgggaaccaaagatgtgattattaatactaatttggtattaaggaaaatacttaaagaatttcagagaggattggcagttgcttataataatctttcagtaaagctattttgaagtttaatcttgtcagttattatccaaatgataaatttctaatagagaaatattagggaaattttctaatagagatatagagatcagctttacaattttcagttaaaaatccaattttctatcactgactcatttggtgttccatcctcaggaaaagagagagctgtaaatttctttttgtggtttgtaattagctgtcattgatttaactgaaatagcatatgatgagacttcatagtttcagtataaatatagcattgtattggccacatgtattgccacaaaattgcattatgatcaatgttgagtcattatagagactcctgtcagtatagaattgagcattttatttattaaagtaagcataaaatatctgagtggatgccaaagttgcatgagagaatgagactatttagactattacaaaccaaagcaccactcattaatttttttattgatgtgcttttagttctttttttttttctaaatactgttgaagatgttaaatttctataggagcatgttattggatccattttgatataattactgatagtcatttatagtttgtgtggttagattttctctttaggcttttctcttttaataacttgctagaatctctttgtcatttcagttctgctacaggtttgatagaaaatcgccctcagtcaccagctacaggcagaacacctgtgtttgtgagccccactcccccacctcctccaccacctcttccatctgccttgtcaacttcctcattaagagcttcaatgacttcaactcctccccctccagtacctcccccacctccacctccagccactgctttgcaagctccagcagtaccaccacctccagctcctcttcagattgcccctggagttcttcacccagctcctcctccaattgcacctcctctagtacagccctctccaccagtagctagagctgccccagtatgtgagactgtaccagttcatccactcccacaaggtgaagttcaggggctgcctccacccccaccaccgcctcctctgcctccacctggcattcgaccatcatcacctgtcacagttacagctcttgctcatcctccctctgggctacatccaactccatctactgccccaggtccccatgttccattaatgcctccatctcctccatcacaagttatacctgcttctgagccaaagcgccatccatcaaccctacctgtaatcagtgatgccaggagtgtgctactggaagcaatacgaaaaggtaattttctcagctccatgaaaagcattgctatagtagcattggaaactttctaaatatttaagacaaaaatgtgttccttatctataaaattttaggtgatcatgtttgtgtacaaatggcctttagaaagtaaagctatatccaacttatatttaaaattattttccagaaaatatatcacatttgaccattttattttcatgctttgtaggtatccttaaaatgtttattgagtgaatgagaaatttaatatatcagacttaaatgttatagaacatttaattaaaaccctttatattatgcttaatgtgtatattaactcctttaaaaatggtattttcttcaatgttaaggctgttcattttgggtatccatgacacttgctctaccagatgcctttagaggagtgagtttcctcccttagtaacaaaggaaagacttctcatattcattcatttattgtcattatttcctaagcaatgactataggccaggcactgagcatatagaatgaataatagtgcctttccctcaaatacaatggataatgaagccacagaaaatatattcaacaatgtttaatttatttgaccattgaggtgatagaagaaatgtaccacctcattaattttttagggggtggtgagcagggaggtatagtagaccatgatggataaataaactgtagatacctactgggatatctggtaagttttaccaactaataacacagataacataaagatttaatgcctctctcagtatgatttcttcacattcttttctgatctttttattttcctataagtatttctcatgtgtatttgattttattccagaaatattaataatatctagtatctagtattttgatttaaatgaatggtttggattcactgtatcaggtattcagctacgcaaagtagaagagcagcgtgaacaggaagctaagcatgaacgcattgaaaacgatgttgccaccatcctgtctcgccgtattgctgttgaatatagtgattcggaagatgattcagaatttgatgaagtagattggttggagtaagaaaaatgcattgataaatattacaaaactgaatgcaaatgtcctttgtggtgcttgttccttgaaaatgtttggtcattctagtgttttgctttcttttccttataataaatgacccttttcctccataacttttgatttctaaggaaaatattagcatacatttcaaactaaatgttttacagtggcttatcttttttttccccctgaaaagactaatttggtcaaataaaccactaagtattaagcatggacagctgttgttagagtagcagattcagttttttgatatatcttaattgtgtactttgtgaattttaatttaaagaaagcaactgaaattgaaatcttgagggcagctgtatctactaatgagccttattccatttcctgatgttttaaaagaagaaacactgccttgattatacgaatacactcagaaagtacatttagcttgtagtgttgaattctcttaaaggaatgcttgaattttttcattattgttttattgtttttatatacttgccttatttgaatgtttagcagtatccccttcccacttatatattgtgtgatatgattttgcttgcctataggagttaaaaacttttccatgtgaaatactctgacttaaacatacatgtaacttacataactgttaagaataacagtctgatttaataaatggttcattttaaaagttcatcagtgttgctctttgaataaaatgatttatcataatttatcaaatactgtatggtaggctttaaatagtgaatgaaaatttgaaaaacacttaggctacataatttcctcttaattgcacagcttcatattgtctactgtgtaaggtagcttttatgtcattttccccctaagttcataaactctgtatttctcaactgcttgtggttttaaattaaaacctcaacttgtcatctaatttcagcataccttaatttcagtttaacagtgttcttgaaattatgttttgcagccaggcatggtggctcatgcctgtaatcctaacactttgggaggctgaggctggtggatcacttgagcctgggagtttgagaccagcccaggcaacatggcgagaaccccgtctctacaaaaaaaatacaaaaattagccgggcgtggtggggtgtgcctttagtcccagctacttgggaggctggggtgggaggatcacttgagcctggggaggttgaggctgcagtgagctgagatcatgccactgcattccagcctgggcagagtgagaccctgtctggaaaaaaaaaaaaaaagaaaaagaaaaattctattttgcaatgataaaatgagttaatgtttgcacagcttagatttaggggtggaggggaagcaccattaatagcagattacttcatctgaagaaacgactccatgaagtttgggtaagttgattgtaaaagtgactgtggtcttcagccttgcctatatctactccttttgcagtacaatttccagttcttccatcgagaggtgagttctgttccatgtccttgaatctgggtgtccctgaaacttgctttggctaataatagcatgtagcaaaagtgacattgtgccagttctaagcctgggtctcaagaaaccttgcaagctttagctttctctccctccatctccctacctccctctctcaaacctgtctctgccatgagaataatcccaagctagcctggctgaagatcagaaacctcatgggggagaggtatctcacgtgagaccgtcatagaccagccaagcccaaactcgcttgctgatggtagacagataagcaagcctggacaaggttcgcctagactagtccagcccagcccagtccactgattcaaaattcgtgagcaaaaataaatgcttattgtcttacacctaagttttgagctgccagcattattgtggcaatagatagttgatatgtgaggtcacttagtaacttgataatttggaggaggctatttaggcagataactaatgacctgtaatctttatagaataggaataatgaaccaagttctattgtggcaattcagtttggacataaaaaaatttttctgatagctttaataaaagatttgatttgctcttttgggtagcttagaaagaacaagagattagagagccatttgaggttcctttccaacctcatgataatgtatattgtcaaatgtaactcaagaaaatatgtcacagtttaaagtctaagtgttcttatggtcaaaaggaggcaactagtatatatattttataaaactcaaatatatatatatatatttggggccagataaccaaaacataatagtactggttttgaagcagctaaggatgttacaaaaggaaattggtgaagatttcttaataatagaagtagacatgttaatcagtaaagccctgcagtgtatatgctcagtagcctatgatagactttttttgtttttcagaatatttttggaagatgaaaaagtgcctgcagactaaataagccagatatgtagtgtccattttaaaatcaaaataaatcttttaatccagatatttagcttaacttgcttagggaattttggaacagaacattcagtggccaattttcataccctaagaagaatgaaagttactgggtaacaattcaaccttcttgttgaattgatttactactcatcagggtcatgca

SEQ ID NO: 16824 - DNA, 46343 bp, Human
gatgacacgctgcccctatgattatggagcagagccctaaccagtgtgggagaacccctcactggagttctctccatgagagcctggttaggagcgtgcatgcatcttagtcctgcaacagtctcctcacagcggcaatgtctttggaggacttggctttgaagtaccgttatctgttgtggactttgtctctgttgctgcacagcagtgtgtttacctttaggagctctgcaatccaccagattaagcccttttaattagcaatccaattttaggttgtaggaagcctgatttacttaactttgagattgtttttggaaaacatcttggtgtaatggagagaatattaccttagcaagcaggcagagctggtgtcaaatactagtctccaccagccattacttggacaaccgtgggcaaattactgaacatcaattgtcttgactttaaaatagagacagaagtaatgatagtaatcataattactatgcaataataatagtggcaacaataattcattatttactatgttcgtagcacttactaagggtgtataacagtacttagtaagttcgtagcacttactaagggccaagtattgttctaagctcttgtatatatttgacttgcagcaattctgtgttgtaggttccattagtgtctctcttttttttttttttttttttggagacggagtttcgctcttgttgcccaggctggagtgcaatggcacgatcttggctgaccgcaacctccacctcccaggttcaagcgattctcctgcctcagcctcctgagtagctgggattataggcacatgccaccacgcttggctaattttgtatttttagtagagacggggtttctccgtcttggtcaggctggtcttgaactcctgacctcaggtgatccgcccgccttggcctcccaaagtgctgggattacaggcatgagccactgtgcccggcctattgtctcttttttccagataaggcaagcgaggcacagagagggtaggtaacttgcccactgttgcccacctcataagtaatgggtctgggatttaagcctaggtagtctgactctggagtctgtgtttcttgctccaattccaggctgtgtcacagagaatcatgaagattcatgtgattacatatgaaacaggacctagaacaaagtcttgtgccttgttggtgctcaaaacaagttggccattctgtctcaccccttcctgttgctaagctaaggctttagactgttgactgtggcagtgaggaaggtcttggatctctggctgtgtgatctgaacacagggtaaggtaaagaaaggtggggtcacctttttaccaaaaagtcagacagtttcatctcggctgcggacaggtcatcacactagcaaggtgtggtttgtgcttatgggagtccttcagtttcttccctccaacaggggaaataattgccgcctttacccttgcctggattgtagattgctgagtctgttattcagaagtgatccatttagctttccagctgagccacacacagacagtgtcagaacaaactggtctgaatttgtggcttcagtggcggagtcagtaaaggtggagttgagtggggacagtgctcacacaagtggaatgtggtagccactctggagaggggagtagggtgtcaaaggtgggattacctccactcacgttttatcccgggtcctagccctaccagttaggtagagtaggtcgggatgggcaagcccagagatccaaggactctgccttttatgcacatgcacccctcgcccccatcacccaccatgcacacacacagacatacacatatgtgcccagagttgattagagtctactggctttctgccacctaaaggaaatattatagaccgccctgtactgaaggcagtgattagaaacgggaagttgtgaaatagagatgacttgtttctttaccttgggaatttaaaaaccactatgttatatgtttttcatttataggtttgtctacagattttgagcgttcgaagttgacccctgactaagtatactttgctgctccctcagcctttgaaaaaatgtctgtcacatatgatgattccgttggagtagaagtgtccagcgacagcttctgggaggtaatgcacctgctttcttccagtgaatgaagtggccaggccaatagtgtctggcaggccctttggtttttttggtggaggttgggaactgaggtgaacatacccccaaaccagccatgcatttgtagtcagacctagatagcagcagaaaaggtttggacacttgtttttaggcagttcaggtatgccttagccatcatcgaaggcagtgaacttaccttgctaggaaaggctgatacttaaagaggttaggggtgtttatgaaaggtcttggggatcaccttcctttttatgtttgccatggtgtgagtgggagagacagacactaattgctcagcttatcctacgaggcactttactgttgagttttatgtagaaacaaggagggctgtgatttgacatcatgctggacaacacaggcaagtggccagagggccaaatgccttcaaacttgctggagcatctgccgccagtctgtacccatgagtggccctcttcctgattggattatttttgtttttttgtggaggcggagggtgttgttcctgagtcccacttacttttccttcctgctagttaatggaaagtccatcttttttttttttttttttttaacagttgaggtctcgagagcgcaggctggagttcagtggcaccatcatggctcactgaagccttgatctcctgggctcaagccatcctcccacctcagcctactgagtagctgagactataggaagtcaatttttggtctaattttgtccctgtggcaaaacccctggagctttcttggccttcatggaaagaggctttgcatggccgggcgcagtggctcatgtctgtaaccccagcactttgggaggccgaggcgggtggatcttgaggtcaggagttcaagaccagcctggccaacatggtgaaaccccatctctactaaaaatacaaaaaattagctgggcgtggtggtgggcacctgtaaccccagctatttgggaggctgaggcaggagaatggcatgaacccgggaggcggagcttgcagtgagccgagacagcgccactgcactccagcctgggtgacagagcaagactccgtctcaaaaaaaaaaaaattatgtgttaactgagtacctgtagtgtgctaggcaagggatgtgacagactgagttcctgccctccagaagctggcttctgccacagcagaaataaatgtggaaaggcacagagcatgcaggtcctctctgctgccacccctcggctggtggcatccttctggaggggtgaggggggcacccagctcaaatttcagcagccggagaggcacatctgcctgagaaatatttcacttaagacagcaagagtgacaggagcagtgacagccaaacaggtcgccagccacatctcacagcatggcaggaggttggccgtgaaactagatgaagcaggaccagcagttacacgacgtggtttggaggtgcccctggaatagtgctagaattcaggactgcctttgcccccgcttgcaggtacaggttcacagtaatcaggtcccgctggctggcccccccagagaggctgtggcctcattagtgcaggagcgcttatggagctggcagcagctgtgagagccttcctgtgagctctccagcctttagaagtgcaggcccttgttctcaacactgaaccaaaactatagatagaaacctttccagttatggggagcctcttttttgtaactgtagtgacattgctggctggcaccaatcattccctgccttgagcttggtggtggtgcagacaggacaagcacactcaaaaggcccttccttgtgagggataggccaggagaggcaatggggacaggtgaagacattgctttggagccaggaggtctgggtttgactgctgacctgatcacttacttctgtgtatggctttgggcaagttactgatttttctttgccttcatttcccaatctataagatgggggtaataacggtacccatatcctagtattgtgagggttaaaagaatgaataaacgttaagtgttttagggcatcagggcaaggctggtgggggcccttccctctgacacgggagctgagggagtcggtgtgcacagtcaatgtctgttcctgcggtgcccttggcgacattgtcttcattacccacttggtggcagaaactgctgggaaaattatgtagctaaatatagtgctattacagaattcttcagctgcttgttaaaaaacattcaggtgaacgttgccagtgtatattgtcagcatatattaaatcaactagctttaacaagtccagtaattaagctcttatgctccctgttaaattctcaactgcaataatgtcagtagacaagaacatctccttttgcctgaaaatgctcaggcgggctctgctcagcttgtgatgctgtccctgaaattactctccagctggtatcaactccgcagtgctgtggtcgtccgccttctccatgacggatgttcgttgagtggcggagtgactgctcagtgatggcctgctgggatctgagagactcaggtgcacactgccaactgcacatcttcccaggcaggtagcaagttcctctttcccatggaaggacacttttccaaagaaagccttgtggtcttgaggtggaaaagttttttgtgtttaattttactccttcccaccaaaagatactaactggaatatgtcattccagagccatcttctgtgtggccctgtcctccaggagcctttggctgtgacatttggaggaataaggtagacactaggcaggtcatcatgccaggtgccgtaggatttgctaggtttgcccagggggaagggcaggaaaggcagcatggggtagtggacgttgctgcacttggatgcttgctggacgaatgaaggaacccatactgacctgtgggaggagaggttacccacagggacatgatactgaatagagctatttaatgcatattcggaaggagtacctcctgcattcccccaaccctgtagatataggggaaaaataaaaagaggaagaggggagaggggatccagttcccacaaagaagatgcttatggagtatgagagcaggagggaccacccccagctctgcctctcagtaacatggtctgctgggcagagtcagcagaggaggcctgtggctgagtagggttgggccaagaattgggaacaagtagaagggatggcattccaggttggaaccaagtctggagcctgaatgagtgtggtcttacagagtgctgaggaccttgacctttttggagctaagggccagttttggagcaaaatgggaagtcgtgtgggattacagtggcgggggccaagtggaggcagttccccaggtgggtcgctccctcagcaagtcagagcctggtctggcccgcccacaggcttcacggcagggcatggggcagcttggctacttctggcaagttttcctgacttgttgcaggagcccaggggccctcctcctgcctttccacttctgggcactgcttccaggccttctctttggttctgggagctggtgtccaaagggcctgggctgtgagccttggggcttttcacgtgtcaccagtgcttcctggcctcccttaccttcattcagtaggctctgggaacaggatggcaggtctgtccctagcagggctgagagccgctgcctgcatctctgaaggctccttgggggccaggctaggagggcagacgccacttattttaggaactggagcctgagtctgcctcaacaaaagctccccggaggcgggatttctgcacagctgtcagctgtctgtgcatttagagctcagatcttctggatgaacccaggctgagtctgacctctgtgcactatcttgtgggtacaaagagcccctgagaagagtatttggggagatgaagagaacataagtatcttgtgtcaaatattctgggaatgttagccctgaagagttggcacgtgactctcaacatttaccgttccctgccaggaaggcgctccctgtaggttgttgcaacttgctctgagtcgggctggtttctctcagactctagcactgcaggacagctcatcacgtgagaacaccttcatattcatcatccatgtggagtgatactttccccatccttccataccaattctataggacacatatttagaagctgccatgacccgggccctgggctaagtcctgggcaccccatatgagagcccagcctcgggcctcctagagccagcgttgtatggagagcagttaggaggcggcagagcagtgccctgagcgcaagcacgaagtgagcgaatgtcaataccacctcatgctcagcagcagtgactggctctgtctgctgcccagccgcctccacgcacgccgaccccaacggacttttccgtgtgatggcctgcctgtgtcagccttgcaggagcactgtgcccacatccatgggctcctcgggacagggtgcgcatcagcttaattatcaccccaccgtgctcacatatggctcctagaaggttagtggcccacattagtttcactaaagtttctaaaaattaccattaattctttcttttcactgaactagtatctgctgaaccatgagcaaggattaaggcatcaactcctcagtctccaccccactgccagatagcccatctagaaaagcagattggatggctccctgccctgctgggaagcttcagttttctgcatcaccttcaaaatagaagcatactctttagcatggccaagacacgagcatgtgttgacagccagctggactccctggctcttcctgagaagctctgccctgggctccagccaagctgagccaccccaggctcccatccacaaagatctgtgaccctgcctggtgtggcttggaggattctttcctccatccagacttccatctccttcctagggagctgctctgggaaaggaagagccttccctgactgctccgggcgggcttgggcagtcttcctctgtgctctccagcatttcctaggctgtaacatggcattgctcatttcctacttccaggatggttgtaagaattacagagaacacccacaaagaggctaaaattgtgtgtggtactttttttctcttttggcaaaaactctttttcctaccccgatgttacacacaaaatgtagacatggtgtatattgcgtaatcttcgtttaaggttcttatgcttattttggggagagttgtgtttctgatggtatttggctgttctgggatttctgaacaggctgctgcagcctgctcttcagagcactgtatacctacctttttcaggaatgagttatattcatgtgaattccttctaagccagtgagaaaatagttttcctaagatcctgcccttctttggtgggtgaccctccccctgagctatagtggacatttccattgtggttcagatagactttgtcgtcctatggggcagatcagggccctcgacgtgtgggctgcctttgtcttggccatgtttggctgaccctgaatctcgtgactcttcagaattacgtgtttttaaatgggtggttttcacagtttagaatacacaacctaagcaatgcttggacgcttatgaaaacagacgtcaacattggacagactttgacgttgagattagagcagaaagcagcctttgctgcccaatctctacccagtaatggaggtttttctcatgatgtgatgggttttaaccaagctgtcctttgtcccccttggtcagtcagtcaggctcatgcctggcctgagcttggggctgggacacagaggtgagtgtgacagggacagtcccttgtcctcttggagctcacaggccagcagcagcacaagacagttccacaagtgactgccatttcccttggacagttttcagcactgctgccatccctgtccatggccactgtcccctagcttggcaggtgttgcttggctggtgttgccagggcctggtgccatgcacagcacatgggagggacttacatacttgaaggagtgggtggcggtgggtggtcaggtagatatgactgaaggtctcacaggagcctctcctgctgtgttccagcagctgcagaattggcctggttcccacaggcggcttcctgcttttagggcaaacagggcagggaccagccctggccagcaccaatcccttttacccatccacccaccaggagcactgcagggagccagccgggcagtttattttggctggctgctgcaggccgtcgaatctgtcatttttgttttcagctctttcatgccctttggtgtatgacatctacaacattgtcttcggcctgcgtgctcagccattcccgatactgggaaaaatcaaattccactttcagtggaggaaaagaaagcagaatttggggtgcaccgtcgcaggtcaggctcagccagcagtgatggcctgctgctgttctgtgatgggctgcccaggccagggacagcacttgctggtagttgggcactgggccagcggcaccaatgagcctgttgacacccagagtttattttgtctgaggtcacaggacacctgcatggcaaggccaagtctaaatgactcccgagcccgagtggtctctgagcgtcctctctacacttaccgtttctgcagccacacgcgggagcatcgcacacgcggagacaggaaaaggtggatgaatgaggtcacctttccttctgttgtgcagacagacctgtcttccccccgtgtgaatgccatcattctgaatgcagagaaagagttctttggtttttgcgttgagggaatttagcacttcggggttttgtgctgtcaagaagcttgtcttctgaagataaaattttttaaattttttttgtgcatttctgtagatgaagataaaattttattttcttatttgatctcagtgatgtcagaataactttttaaaactgtttaagagacacatttttcctttctattcagtaacaaatctcctttcattttagagccggtggggtccgtagtgctcattagactgtggtgggcttagctccatggagacatttgtggataaacgattgtttgagctgggcacagtgcaggggggcggagctggggtgcccaggcacagagatggggagaggagcccacattccactagtggggactggtagggtaacaggagtcataaagtaaaccaggattcgggtgcagggggctagggccagggtggaggtagactggagtgcagtatgggggggctgtggaagcaccaaactgggaagaggagggaacggaaggaggtggggaggcttcctggaagaattgatcctccagcttttcccagctggcgtttccccactagatcatcggctttggaccttaggggtcgagccagttttggatgtctctcacactccctgtcagtcagggggtgccttgggaattctgccaaaagcctcaggtcttcagcgagcttagggaccgggcaggtgatctcgccatggcagctcttccagcaaggtgatgcctgcatcagtgggggcgcctccctgaggagtgagggagagcaaaaacggcagccacataccaaattcctgccacttgctgggtgctcggctgaaggcaagtgagcagtgcatgtcttcccagagacccagggctccaggatgggagatggcacacagggcggcatatgctgtgcatgtgaacgccatgtagggtgtcgcggggccttctcgacatctgtgtaacacgcaccaagggagcagagcatggggagcctggccgacggccttgaggaagagttagttcaacacagctttgcgtaaacacatcctttctttctatgttgtctatcttatgtgttctgcctttggagttaggatctgaaaattgcaatttctgggtttctgtgtcatctattttttattttgtcattttgaacatttcagttaaagattcgtaactcagtgtgtctttatgattgttgaaatctgggattcatgcttttaaatgatcaaacggcaaggggtgctttcagggtagtgagctccattttcttcaccttcgtacttgaggatacaggtttcaggaacagaggatacggccagtcagtgttgggagcaagaactgaaaaccccaagttgagacagaattgaggccccgaggaaaggacaggactagtgctgggtcagaatcgagtctggattgtagatcagactcaaggcgattctgaatctctaaccctcttgggccctgcaaggtaaatagcatcacctcatttgcagatggggagccccagtgaggttaggtgttagtctgagcttgtggttcaaggcagcaccgaagtgtggaactcccagggcctacattccagggctgagacaagttgggagcccagtggtggatgagctggtgggaagtttggggaccaggacgagtggaatcccatagaaatgaggatgtggaaattgcagtttggcacctgaaagcaaggcacggactagatggtttttcaaggacccctgttactctttggtgttttcaaacacacatcacagatttcacaaccctaatatcaacagtcatccccgtttggaaaggaagattcagcataggggttaggataggttggaagaaagttgcctgaagctgtcaccatggggacatctggcaggtgtgtacaggatacaacatctgccaggcacacgcacaccctccccagggaaggtgggtgagaggtagtgactctgcagggcacagtcctgaggagaagggactcagtcctggagccccctctagctgcctgggacgtgggttggcttagggataaactaactcaggccctggatttccctgaaagctttgtagctgcagtgaaggcccggtgaggccctgcagctggctgtgcttatgtgactctctcaggaatgcggcagaagcgccgggagttgctcttctgccggccatgaagttactggctgatgacgtgctaagagttgattccttttagctaccatggagagagctcgtgtgactcgcaggattgagaactgataaataggccgggcgcggtggctcacacctgtattcccaacactttgggaggctgaggtgggtggatcacttgaggtcaggagttcaagaccagcctggccaacatggcgaagccttgtctctactaaaaatacaaaaattagccaggcgtggtggtgcatgtctgtaatcccagctacttgggaggctgaggcaggagaatcgcttgaacccaggaggcagaggttgcggtgagccgagatcatgccactgctgagatgcaccactgtccagcctggacgacagagcgagactccatctcaaaaaaaaaagaactgacagataaaggatcatgagttgtttggttgaccatgcctctgagatctcagcgacttctcagtcccttcctttccagggggaatggaaatcccagctcccagcactgtttgggctctgagaagatagggtgtcctctttctgcctggcatggatgatggagacatatagaggcatagtagttgccctcagaacccactattttgatgcattttggcatgtgacagcacatgtccaccagggggaggggtaatctgtgggggaagcgtcctggggcagcagagcccccagctcactctccgtgggcctcatggcattttcctcagctgtgagaaagcggccttgcctcagagctgtcttcagctaccgcctcaaacatcgcttcctccaggcagccctgaccacccagagtgttccttctcacaatgtgtcactgtctcattgcattatttttctggccataagttccatgagggacagtcgcatggcagtttgttcaccactatatccctagggcctcgtggcccttcacacacagtggatgttccttaaatacctctcagtggcaagagagtgttgccagacgctcagaaatggagtgatgaatgcttcagtggggagccagccagctggtggcatcagcagactggaaactgctccctctgcaccacggagaggaagggccaggggcgagccagctggtccgagctgaaccacggaaggaagacgccctggtggtgcccctgcaggcaaagcccatggaaccagagtcgaatgtctgacccagagctggtcaggtatgccaggaagcaccaacatcgtcttcaaccagacaccctggaatcctgaaggctcacctcaccccccaccctgacccccagacagggtgaagaaatggcttagcaagaagttaggccttgtcaggcgatcgccgtggcaggcggagagcacagctggctgggaagaaacctaccgtgcagtgtaaacccctcctatcctgggccatttggtcctcacaggaatagctctgactctacctgacaactgaaagggcagaaatatacggagagggacttgtacaaagttacacattttggggcagggccagatctgtgctgctcccctcatgagagcaggtgaagggaaggaggtcttgttagggctgggaaatccgatggatttgaacaagttatcgaaagcattttgcccgtctcgttgccaactgcagacttggaattaaggaatccctaaagagttgcctcatccttgtctgccaggctgacagaggagatgctagagcttcttggcatatttggtcagctttggataaaacatttgactctggttccatgggcttgcctggcgaggggtacgccaggagctcttctgtaggtcagcttgggatagctggctcacccttgacccttcctctccagggtgcagagggagcggttgtggtgcttgggccttcagggccacagattaaaggggaagatcatcctgaggttaaaatcagggtcatccttggcaaccggtcctagaagtttacaggcttggggttcctgggaactttgttggcatatggtggggacaggagcagggcctgtgtgctgcatggagtctggaattctgtttgtgacttgctggcgcccacagggctggctggaagcacacgcatcatctcatgttgacttggtaagtctcagtttacaccagctctgatcccggcctgagggatgtttgggcaggtggcctctctttctgttgcatgaccatgagtgactgcatctcttcaaacttcagtttccttttctctaaaatagggacactaggtcgggtgcggtggctcatgcctgtaatcccagcactttgggagtccaagttgggaggattgcttgagcctaggagtttgaaatcagccctggcaacatagtaagaacctgtctctacaaaaaatataaaaaattagccaggtgtagtggtacatacctgtggtcccagctactcggaggctgaggcaggaggatcacttcggacgggaaggttgcgcctctgtgattgtgccactgcactccagcctgggcaatacagtgagacccttctcgcaaataaaataataaaatttaatttaatttttaaaaatagacattaatagtatcccctggctagcattctcacaagattaagtggggtggcatgtaaaactgtcagtaccctgcctggccaagtatgggatgctctattatgacgccgtcgctagtgaaaatcactcagtgtgtggcaccttttggcgggaggcttacagtctagctagggaagtgaggctaatgtgctcgaggcaattttgagacgagctgtgacccgaagggcatggggacggtgttcacaagggccatcatggcccccagctggaccagatggcaggagtcctcagatgagtctcccctgtctgtgggtgcaggtggtgtagactgggttggtgctccacgctggtgctccagcaaggacgggctgcatcagggaagcctgcgtggggaaaaggagccaagacttcacagagagctgagatgggggcaggtaggagggggactcgctcatcaataaccgttcctgtctctatttctccacctgcagttgatacctaggccccctccccatttctaatgttacagcttttgttagcatctgctctcataaacttcgcacccctacttcatgtgcacgtattcttaattgatgtaaatggcatcatgccccacatcattctgtttctgttctgggtcagtgtgtcggcgtagtcgcgcacatccttcctcccgctgcactgctgggccccgtgcttacctgtgcattccccagggagaggccccctacctgtcctgggaccaaagggaacacttctatgggaatctaagcccagaatgaagctgctgggtcatcgtagggcacttgcatgctttatgatttaatgactgcctagttgtgcacagaggcctgcccagtctgtttccaccagtatatccagtaaagggtgctgtacacccacctctgcccacacttggcctttcccactctctggtggttgccagtccacaggcgtagagctgccttgctgttctcaggcacatccctctgggcacccacatacagaggtgtctctgtgtgctctgcctgctgtcatcccagctactcgggaggccgaggcaggaaaatcgcttaaacccgggaggcagaggttgcaagtgagccgagatggcaccactgcgcttcagcttgggcaacagagctagactccgtctcaaaaaaaaagaaaaagaaaaattttgtttaaggagccatgccgtaagtcacaaaggtattcgcgttcattttcttctggtcatgttatggttttacctcacatttgtatggggtgcctgctgtgcggtagaccctgtggaaagcaatggagaaagagtggtggattaggaagacacaggtccacaccctcttagggcccagagtctgaaggtattaggggttgggagcaccacagagcttggcatggtcctgtgtctgcacagcagaccttctccagcgtccttgtgaaaggcacctctggactgtttacaacagatgcatgcaggatggaggaggagctgacgtggcctctttggatagtccccccagcacgcctgtgacaataagctgctgggtttcaggtagagcccctttctctgctcctgattgcacggatgtttctgcacagggatggttgagattccagctgccacctcatcctagctgactttaaaactgaggcttggctgacattgggttctcagaggaacgattagaagcctggctcactgagagggagtgagtgcagcctggaggagggcaggcggcagggcgagtcctgggctcggggaagggcatggggaagggagtggattccctggaggcagagcttgattgtgagggatgtggcccccaaggtccatccctgggaggcaggagagcggcctccggaggaccctagaaaggaggttctcagccgggcacagtggctcacgcctgtaatcccagcactttgggaggctgaggtgggcagatcacctgagttcgggagtttgagaccagcctgaccaacatgcagaaaacccgtctctactaaaaatacaaaattagctgggcgtggtggcgcatgtctgtaatcccagctactcgtgaggctgaggcaagagaatcgcttgaaccaaggaggcagaggttgtggtgagccgagatcgcaccattgcactccagcctggacaacaagagcgaaactgtctcaaaaaaaaaaaaagaaaaggaaggaggttctctttcccaaggtgggcacagcctggagaaggcaggggtgctgtatgcagagaaacctgtctgggagccagggattcccacgacctttgtccccgcatcctccacctggaggatgggcagctcccttttttggctcgcatgccctgggttccactgagcagccccattctctggaggctgctctcaattcttccttccaggatgtccccacccccgccagccttctgagccccaccagtccccaagcctgacacccttcaggatgcaggcctagccttcccagtttctcagcatctgccctccctcattgccatttgctccctgtgttctgtgttccattcccagctgacttctctcagggccccagggttgccatgtggacacaccttccttttgccagtgctgttccctgtgcctggaattattttcctggcctcacctttaatctggccagcctcctacctgtccttgaagatgccctttggatattgcgttcaggatacctctcaccccctcctcctagtgccccagttccagtgccctgtgcccaagcactgagtccctcagtaggtacatgcttggccctccgtctgccaggcagtccctcaggggagtgaagggatgtccaggcacatgtatgctgagcatttgtctttggtagcttagtttctgagtggagtgagcctgaatttagaggaagttaggaacatagcttcatacctggttcaaaaatgaggattttgtgaatgaagcaattaatatgtttggaagaaagcatgcttatattcagtttctacctaaagttttctgccatttggctatcccaaaacaacctaatgttttgaagaagtagaagagaggtttttaattacaaaactgatagagcagaaatagttaactatatatgtgctgattttaatgtatgatcgatttgtcaaatatttgaaaattaattttcttgcattgtaaaaactagtcattattatacgtttgattttttaaaaaatatattaaaaagggaacaggccaggcgctgtggcttatacatgtaatcccaacactttgggaggccaaggtgggaggatcgcttgagcccaggaattcaagaccagcctaggcaacacggcaaaaccctgtctctgcaaaaaatacaaaaattagccaggtgtggtggtgcgtacctgtagttccagctactctggaggctgaggtgggaggatcacttgagcctgggaggttaaggccacagtgagccatgattgtggcactgcactctagcctgggcaacaaagcaagaccctgtctcaaaaagaaaaaaaaggaacaaactttactcaagaaggcatacagatggcaaatagtcataagaaaagattttcagtattattagactttagaaagatgcaaattaaaatcacaatgcaatattgctacactaagtagaatggctaaaaataacaaaacagaacaaaacaccctggcaatactaagtgctgggagcatgcaggacagggaagtctcatacgttgctgatggcagtgcacagctgtccagtcactttgggtagcagttcggcagttttgttaaacgtacagttaacatttccattcctaggtattcaccgaagagtcatgaaagcttatgtccccacaaaagaccaatagatgaacgttatagcttctttattcataattcccccaaactgaaaatgacccaagcaaccttcagcaggaagaatatggataaaccaaagagtggtataactacccaatcgaatactacttagcagtaagaaagagtgaacttctgatagtggtatacctacacagtcgaatactacttagcagtaagaaagagtgaccttctgacgtagatagcaacatggatcagtctcagaaacattatggtgggtgacagaagccagtctcaaaagccaggctgcatactgtgtattccatatatccttgccatcctggaaaaggggcaaaaatcatgtctgtggttgctgggggctgtatggggaggggatgggctgcaagggggcacaaaggcacttcatgagagatggaagtgtcctgttccttgctgtggaggtggtagacagtggtatatgtttgtccacattcagatctaagtgtaccctgtagtgggcagttttgcctgtgtgtagattccatctcgacctagagaagcagccagcagtagctctgctcctgggacgactgcagtgctttgcccagggaagtggaaaggccacattgctctgtccctggtggtttatggcgatagagacttccagtgatggccttcaccggccaccacacaaccgtttcattaaagggacagcagggccgatgttgctggggtgcctcggtcccaactgtttggcatactgcccttctcccgttggctctgtgctcagccaacttgcctcttgtccccagcagtggtcacaggaccagcacaggctcctctgcagcctctaggaccaactgggagcttatttggaaacctgaaatgtgtacttacggaaacactcttcctgtattcatcacggatttccacatttcaagagttgtcatgtaaatgtgtatttgcagctcctgtgtgtgccgatgggtggtaccaacatgtgacttgttaagaaatatccttttcttttccctaaacctttaaccagtggttctgaaaatcacagagataagcaggtttcaagagagccaaaatacatgatttgatggtgattaccaatttgaatactgttggtaataggcagatgaaaaccagctctgggttgtggcttcatgtcgactgtcaaggctaagttagggccgtgttacctcagctcctcctaccaccagctcaacgatactgagttgcttgttgggtatttttttcatcctgctgtaaatttcaaaatgacagtaaggcctcattttaagggaagcaaccacataatgtcacttccagtgagctgtgaaaatgctcacttccgacttcctcacaggagctgctctagtttggagtggatgctcaggttcagctcatgttttgacgagctgccgagctgccagccttgctgggggaggtctttggagggaatgagtagagccggaagtctcatctgcctctggagaaggctgcccaggctaaccaccttccaggggtctttgcttttcaccaggattctggttctcacaggagtggagtcatctcagcccatgtagctcagcctcagggacagcccttcctccaggtgctgcagcccccttccctccccttgcccatctctgtgcagggccaggcaaagagattttagaaaaggtaaaactgacaaggggttgactaagatttttgaaggcattgggagaaaaaggctgaaaagagatcgtttttctgtcatatttcctctgggtgctcaagttatcagcgactgtagcctttcaagccagcagctaaaagaatgaaacatatcgaacattttcgttttcaccccaaattagccattaacatttcctcagttactcttttattacttataactttgatgaactagtttttcttttcatatacgaaaaaaggcagtcaaaactcagcttagccctgacaaagctttgccatcaagacagtcctacttggaaccctttgaaaaactgcctttgggctgggcgcggtgcctcacgcctgtaatcccagcactttgggaggctgatgtgggtggatcacaaggtcaggagattgagaccatcctggccaacatggtgaaaccctgtctccactaaaaatacaaaaactagctgggtgtgatggcatgcgtgcctgtagtcccagctactgaggaggctgaggcagaagaatcacttgaacctgggatgcggaggttgcagtgagccgagatcgtgccactgcactccagcctgacgacagcgagactgtgtctcaaaaaaaaaaacaattgccttcagctccagcctagccactgtggctgcaggatcttgacaaaccacgtaacttctctaagcctttgtttcctcatctgtaaaatggggacacttattcctactaggtaggggagacagtatttggaggtgtaaaacacctagcaggtcgcctggcacatggtaggtgctcaggaagtggaaaagtttttacagctatgattgggaagtaataacccagcacatgatggatgacatcaaagcagaaggctttggttagatgtcacctactccaggaagccagccccagcccctcagtctgcgtgaggtgcccgtttaggcatcctcagccccaccccttcctgagccagtcagcctcccttcctgacccacagcccagtttctacttggtacccaacctaaagaacattgagaagcccccgttcactgatgtgtatgatcttattaataataaaaatagagaggctcattatctaactacacggagtgcctttcaaactcttggagaggggtgtggtaaacatgaccccaggggcgcatcagggcctggttggcatggaggccatttgtgccacagccaaggacaggctgccccaagccccctgcctcccagctggttctctctcctaggtcgggaactacaagcggactgtgaagcggatcgacgatggccaccgcctgtgcagcgacctcatgaactgcctgcatgagcgggcgcgcatcgagaaggcgtatgcgcagcagctcactgagtgggcccggcgctggaggcagctcgtggagaaaggtatggggccccggcacaggtcctgtggcctggaggcagctacaccccagccgggggctctgggcacgttgtgaccctctctatgccagttttctgtcttttaagattggggcaagagtgcatttcccagttccagagcggggtgtgatttttatggggagcattagcgcccatcaccagaaggcacaggctccatgagcttttgtccactttccttggggacacaggactatagcccttgtcatccataggacacacttgcacttgccgagttaactcagaactcgggtaagttcctatcacgtggaaggccttgccgcttggcaccttagtttctaacactgagagctgtttatttttaaacttggccatgtagcaggtcagataagactagctggcaacacctggcagtctttctgagtttacattttaagggaataattacaggtgttgtatggcagaggtttcacccccttctgtccccaccgaaaagctcagaagattctgtagctttattagtgccactgttgtgtggacaggggccatgcttagaacacacttcccagcagggaaggggaacttgactgattacagcctttccggcacagaagcagagcagtgtgggtttctcaaggtgtgttttggggcaggctttcctgtgctgaccagctgtcctcagccccagctgtcctcagccaatcaggggagccaggtcccaagcaagccaggtctagtccagctgcctgtcctttcccgtgatgctgacatgggttgtttgtgtgggcttagcacagtccttagggcagggtatgtgcccaggctgtggagcaggcacgtggcagaggaggggcctaggataggtcagctcccttggtcggtggcagtgtcgtcatttcgtttccacctgctgcagcccctctcccaggatcaagctgtcagtcagagcttgaggtttacagagcacccttaccaccctcaccttgtgggtctggctgtaacgttgtggacaggacaggaatgtgctcattttgtagacacgaaggcacagagaggtccaacttccggggctgttctctgttgtctccaagccccagagtcacgtgtccccctctgggttctcacagcctgccctcccctcagcccacctctgtcatgactcagcgcacttggtcactgtccctgtgaccaccttgaagaccagccatggatcttctcgatttctgccccggctccgttgtggctctccctccctccagcctcacgccaccccaccctaccccctgaatagaaatgccagcctggattagggcttccttcctgagcctcggggactgagaacagtgagtagggagaggcgactcagcccctcctgccatactggtccagagcaggctcctgcttcctcctctccttcctcctgcaggatgggcttccattctgctgaggggacagtcctcattccacagtgttctcaagcttgtgctcagagccaggctctttctgggagtgaatgaacacagtcctgcagaggaaggcagtgcagggctagccaggggccaagcagggctgataggagccatgccaggagaagcgttggcatggtgtgggtgggtgcccaacacctgggagaagcatctgctcacttcagaaggtccccccttctctggccacctttaagtaaattaagacttctaagatgtggaaatttgagtttttatagagttcagtggctttaaataaaggaaaggcatggccgggcgcggtggctcacgcctgtaatccctgcactttgggaggccgaggcgaatggatcacctgaggtcaggagttcgagatcagccagcctggccaacatggtgaaaccccgtctctactaaaaatacaaaaatttagccaggcgtggtggcgggcacctgtaatcccagctactcgggaggctgaggcaggagaatctcttgaacctgggagacagagtttgcagtgagccaagatcacgtctctgcactccagccgggacaataagagcgaaactccatcccaaaaataaaaataaaggaaaggcatgtaatcccccaattttcctaacacgaggggcagagcaaattcagctttgggaactgaaaaaggcacagagtccctgagagaaaaatatctgaaaccctgaaaggaaaccctctgtggtctaaatggccacattgaacagccgaggtgtgagcagagcagaccccaccatggccggcgctgagtgacccgcagcttctctcccctgcacagggccccagtacgggaccgtggagaaggcctggatggccttcatgtccgaggcagagagggtgagcgagctgcacctcgaggtgaaggcctcactgatgaacgatgacttcgagaagatcaagaactggcagaaggaagcctttcacaagcagatgatgggcggcttcaaggagaccaaggaagctgaggacggctttcggaaggcacagaagccctgggccaagaagctgaaagaggtacatctgtcctgcaggcttccctgcccggccttgctctgcctggcaccccactagcagcaccacctcctgcacctaggacttcctgccactggctgtaggcacaggaggccagacctggtagagatgaagccactcctcaggctagaagcccatggtagttgacatttacccaggttgaagatgctgaatgctctatgtgcattctttaaattttttatttttattttttgagacaaagtctcactctctctcccaggctggagtgcagtggtgcaatctcagctcactgcaacctgtgcctcctgggttcaagcaattctgcctcagccctccgagtagctgggactaccggcacatgccaccacaccctgctaatttttgtatttttagtagagacggggtttcaccatgttggccaggctggtctcgaactcttgacctcaggtgatccacccaccttggcctcccaaagtgctggaattacagggcattctttaaatttgatcctaccaacacattttacagatttggtaactgaggatcagaaccatacattggtggtagagctcaaagcccaagctcttaaccactaacagtacttctcccaaccctggggaagtgtctgctggagacttaaaagtccttgccgggcgcggtggctcacgcctgtaatcccagcactttgggaggctgaggcaggcggatcacgaggtcaggagattgagaccatcctggccaacatgatgaaaccccatctctactaaaagtacaaaaattagcagggcgtggtggcgggcacctgtagttccagctactcaggaggctgagggaggagaatcacttgaacccaggaggtggaagttgcagtgagctgagatcacgccactgcactccagcctggtgacagagggagactctgtctcaaaaaaaaaaaaaaaaagtccctttggctgctctgcgtgtgcagtagcctttctttattcctttactttctcaataaacttgctttcactttatttttttttcaagtccctttgacgatagaaagaactagtttacatttttctttctcttgcataggtttttatcccaaaatttcaaacattgatacctgtttttctaaaagtagcaaccaaagccattgagttttgtcgagccttggctagttggaggctgtcatctgtccaccccagccctcagcttgtgtgccccgcccctgcctgcagcctcgccccccattcctagctggaatggagtagacggtagatgtgccacccccaacacccagatgttctctggccttgcgctgccttcctccgcctcagaatcatccagaacatgcctctgtccttccggatggttttctctgtgtctccttttctctgtgtcttagcttttgtcacatctcctttctcttctgttttgtccctggccccattcataatgaaactgtctgtgtctcatgaggcctttgctaataaactcctccttccctctagaatgaaatttgtggctttggctcaaataaggaaggatctgttaagagtgtgtgtgtgtgtgtgtgtgtgtgtgtgtgtgtgtgtaaaaaccattaaaaccagaggaaatgtggctgatggccctgccccctagtatggtcctctctctcatgctgggttcctccttggaactttctttgtatttgccgatcctgcggcctggcatggtcttcctgggatgcccataacccctccatgtgcgtgttccatgtgcgtgctccatgtgcgtgttccatgtcatctcagtggctttctccacccaccccatgctccgtctcagttgtcctcccctacacttaatgccctctaattgactctggcatgtaacttttcctatactgtatctgcctcctgcaactcaaatgaaagcttcacaaagaccttgtgtttcttgctgtgttcctggtgcctcgaaccatgcacaggacaagcaagtactccatgaatatgtgttgagtgcgttcctgttgtgactggttgctatgatagtatacatacaattttgtacctgcctttttctcccctcttggtagcacaagcattcccatggtctgtgtgacttctagtgaggatcctgaactcccagtgacatggcattcaggaactcattctccctgtaggtagaagcagcaaagaaagcccaccatgcagcgtgcaaagaggagaagctggctatctcacgagaagccaacagcaaggcagacccatccctcaaccctgaacagctcaagaaattgcaagacaaaatagaaaagtgcaagcaagatgttcttaaggtaaactgtacacttgtttttacacgtcgagtgtcaccgtgtcagttgttgacgtgtctggcatatagccttctgtaactgcttgggtgaatgggtggatagagggataaataaccaataaaacacacccctgtcctcaagaaggccacaggtgagtgccctagcacctcgcctcaccatagccactgtacctgctcagtcaagggacagagccaggctctgggcaagccaggggtaagagacagctcttggtgctcagagacacaaggacagctgggattgctgcagggagctgcttgtgccaacatgggcgttgccagtggtgggtgtgaatgggtgtggctggtggcaggtgtgaatggttgtggccagtggtgggtgtgaatgggtgtggtgtgagctggtatggagggttatgaggaccaaatcaccagtggcctggacagccaggctgagtaaggagcttaggatgctgctgaccaggagccactcaggaaggcctgagcctgggtgggatcagggaggaggtgaggagggtgagatggtttagaaggattgctctgcttgtgtagggagaggggctgggggcagagacctgggggagggactgcaggctgggagcgcttgtctgggggagccaggtgggagggaggatggaggggccctgcagtctccacagtgacaggccccgaaagtgaggcagaggctgtggagccaggggtggcagaagggtggtctttggccaaggagagaccgtgaccaggcactgtggcatcatgggtgcccttccatttctgttgtgaagcggagattttctgccccatgggttaatgagaaatcattgtgtaaactattacatgctccgcaggtgtagataagtgattctgcctggaaggtcctggagtcacaggacttaaaaccagacagcgtcatcgtcttgtgatttaaaagttcacaggaagggaggggctcagccctcggccccacctcccctcctttggtcagccatgaggggtgagggctggggggtgtgattgccgagggcctgccctgcctcggtgtttggagaggagattcccaaccaggatttgcagagagagacggaatgaggtagagagaggctgcactccaggaagaggacatgggcagaggggaggcaagaggcctaagctggtttcactacccaccagcctttcctggcccctgtcagttaggtggtggcatccctgttttgtgaatgaggaaaccaagatcagagaggttaagtcacgtgccatccagcaggtgagagcaggaacttctgacctcaagcccatacatatgccctttctccactgttcctcactgctatgccgtcggtgtagcaaggggaacacgtcatctacacgagagtgcgtcactcagaccaagtgtcagaatcctctgggaaacccctctcactcccattgctggagccaggaatctgggcttttgaagcagcccaggtgcctccacggtgggatcaggtgaggagcctggaaccaactactgagtgggaggcacctgggctcaagaagcacaaggtccgggagaactctcgggcctttgccagaatcccagggaatcaggtgcccaaaaaggtgcctagaggaaagatggggcttctccatgttgggcgggggcgtgcctgtgtgagagaaagggagacagagatggagaggaagaggcctttcatgtttgacagccacccagaacatcaactcaggcttttgcagaacaggcccagggctcgaggttggacataagcgcctggcaggatgactgggacagtttgtagtgggttccctcctgggaccctccctgcctctttggtctggccagtgactgcaggatatgagaggtccttgtgtgcctagagctctggagaggaggccagtccctccccaccacccttcttgacgcagtttccaaaatccagcacacagcctgggaaacatagtgagacctcatctctacaaaaaatttaaaaacttagttgggtgtggtagcacgtgcctgtagtcccagctactttggaggctgaggcgggaggattgcttgagcccaggagttcaaggctgctgcaagctgtggtcacaccactgcactccagcctgggtgacagagtgagacctcatctctaaagtaggtaagtaggtaggtacatacatacctacctacctacctacctacctacctacctacctacatacataccattgctgactggttgcacatgtactttcatgtttcttatcagccatcaactacatcttgtagcatccatcataaaagaactttttgcatttagtgctaaaatattacaatccacctaagggtgaaggccgcctcttgttttactccatgggtgttcgctgagaactttctatgccctgcaaggggatttccagaacagtgatgaccctgctgagtacctggcctgtgctgggggcaggacttggggctagcagggtcggcacaggctgagggcaggggcagcccagaggtggagcatcttgttgccactgagtaccctgagagctcccgggaggctattgtgtcttgaaggctcctgagatggggctgctctgtgtcacttcagcagtatcctccagatgctgggcgctgaacccacagctatgtgtcttgggcttctgagctaggctcccatgcagggctgccaggtagtgggcacgggcagtgtggatggctgtggggaataggggaatagccacagcgctgtggagctctttctctgctgggcatgccccagccctggcaggggtggccttttcctggcacagaggacccaagcccagccatcttaggaggctgagaagcagagcaaggacccggataccaggagaggagaaaggggcaggagtcagggccctagagggcggggtggaacctggtctcacgaggctggggaaggcttcaagaagaggagttgctttggagcctgaagcagagtctcccagggctctgagccacgtgagtcagaggagagcatctgggaggggagccgcatgggcagggtagactcagtcccagctgggggcagagagggtgcccgataggcctgcagtgtctcgggaagcgctccatccttcctcagaaggccctgcacatgttgttagggacagcaaagcttagacctgagtggagcccgtgactacccccatagtagaaagaattgcaataaataggtggccccagccctgctatctctcacccaccccagggggacaacacgaccatgatcccaccaactaacaaaaccacctggccaccaaactggtggccctgcatgctgagatgagggggtgcggggaagtgtgtaccagtgtgaggtcattgacctcgaggcacatccccaccagatgaatgtgcccactttagccatgtcttaggaatttcacacgttttctagctgcccctggatattcttgagataggccacacctgctttttaacatttcctgccttgtaaaaccccttcttgggacaatctgggagggagcagctgtgtgagggggatggagtgggctgaaagacaagagaaggaggactttttttgaatgccttcttcctgcaccccatcatgtacatatcagaacactgtgaaggagagatgtcctcatctgataaaggacagtgaggctccaagagagctgcaggattcagccccagccccacctttgctgtgggccagatctgaggcttgagggtagccaggcacagcccttccccacagggagaagaggacatgggcgtgtggcacgctcaagaccatacacactgagttctggggagactgccctttgccggcatctacctgtctgggccttgctccagctgagagacagggcagatggcaggagtgtgattcaccttgcaggagtggaggaactgggacttgaacttgaagtctgtcagaatccagagctcctgttttttctttgcatttggaatctgggaaggcctgagacactccaggggcagggtgagccaagggctaaatggaaatgaacctctgtcttgtgcctggattttcctttagaccaaagagaagtatgagaagtccctgaaggaactcgaccagggcacaccccagtacatggagaacatggagcaggtgtttgagcagtgccagcagttcgaggagaaacgccttcgcttcttccgggaggttctgctggaggttcagaagcacctagacctgtccaatgtggctgggtaagtttcctttgagctaaaacacacacgtcattgaagtcaacggaaagtgcttttgaagcaaactcagatgctgctcccaggtttgggatggcgcgttcatcaggaggtctcctcaccgccctcagggcctcctgcttctttgtaatctggatggcagggagggcccctctgctgagtgtttctgcagctgcaggcatggccggctggacctctggaaggcctggttgacccggccaattgctggcccaagcagataaggccgggcccactctgccaactccatgtacaggtctgggtgggaatggagattgcccattctggggccacagctaggaccaaggcagctggcatatcttttcttttctttttttttttttgagacggagtcttgctttgtccccaggctggagtgcagtggcgtgatctcagttcactgcaacctcctccaccttctggtttcaagcagttctcctgcctcagcctcccgagtagctgggattacaggcatgcgccaccacacccagctaatttctgtatttttagtagagatggggtttcaccatgttgtccaggatggtctcgatctcttgaccttgtgatccgcccacctcggccttccaaagtgctgggattacaggcgtgagccaccgcacctggccgcagctggcatatgtaagatccactggaggtgaatctggcatttctgggctggtcgtgcctgggacagtctttctttgaggccctttgtgatcaggtgactgcttagtggctctcagcccccaggacagcacataccctctgagacttggttctgaattgtgatatggaagctgtgctgtttcttctgtgctttcctcatctttggttctgtgatgccttcaccagggcagaggtcccagctaagtcaaggacgtggattactgtcatccatctagcagaaccgtgtagggatgcgtcacgggtcaaggcttgctgttaataggagacacattccgtttgtctccctctgtgtaacaatcatcaaaagcaacagttactgcaccgctgctgctctgccaccattccatttttatgatagtcttgtaaagtgggtggcactgaccccatcttattgatgaggaagctgaggctgggtgagattaaatgacttgcccgaggctgctctgctggcaggagcagggtgaggctggcctgtgtcaggctcttctgcatgtggagtgactcccatcgtgtggatgcttgtctgtctctgtgtctggatttcccccttttaatacaggcaccagtcatatggattagggcccctgctagtgacctcattttagcttgattacctctataaagaccttatttccaaataaggccacattccgaggcactggggtttggactccagcatgtctcctatgaaggacacaattcaacccttgatggaggggatcatgcccactcaacggaggaggaaaccgaggcccagagaaagtacatgactcaccagccataaagattataagtgaaaatatcaggtccagcagtgatccatactcttccctggcagggcagcttcctaggaaggtgagccgatgatggctgccaggcggaaggcagcccccaccccgtcttggtggtgggtgtgttcagcaccgggtcatcttcacgctctgcattggcaagtctgggtataaagcttttctggacagagatgaggaaggaggggtactttctaacaccctccagttttctcttcctcaactctgggcctggtgaaatgggaccacacagagtggtggcccacacagcccacctgctggtgccttttgcatatgtgacacagagcagggcttagtcattgccacctgcttggctggtttgatttaaagctcatttgtcaggagccatctgtgcacgtggcggcccgtgaccttccacctgagccaagggaggagtgttctggctctgtctgtgaaaccaactcacagagggcagagaccacgggacctgctgtggctggcactgggctgggacaaagggtagctggcccctgccttctaaaagagccacgtttctctctgatttagctacaaagccatttaccatgacctggagcagagcatcagagcagctgatgcagtggaggacctgaggtggttccgagccaatcacgggccgggcatggccatgaactggccgcagtttgaggtaagaggagggtgtgcccatgagctcatcagcctggaagaggacctgggcccacagagttgctagatgatgtctttctcattctagactctatgttagtgtttgccctgtttatcaggcagcctttaggcatagctatagtacagaccaagttctggcatagagtcctggggggctgcaggcattaccgaaggccttctgaacctctcctgaagtcgcggttatgtcctctctagttgggaatgtttgactgtcactttttggccactggcattcccttccttcctagtcagtctcaggagccgtaggcacacaggacctcaggtccctgacccaccctgtgggatggccaggaagggagcagccacagtgctcccctcacggtgggccaggggaggggaggtggtctcagtgggcagccctccctacccttccaacaaaggacttttccctactccaggcagtaaattcagtgaatcctgattcaaaatgaatgttcttcttttcccatcatgtgggtctaagctttcattatctttacattcgaaatgcaagggcctggggatctcaggactcacctagcccttggattggtcactaggccccacctggcaccctgaaggcagtgggcaaaggtcctggtgcccctgaggcttaagcacgtggcgtcagctgccccagcagggatgctgagggcgactacctctgctgtgggcgtgggcctcgtggcttccccgactcagcagcggccagagcccgggctgcattcagattctgctcacctctgaccacctgtgggaagctgagcaaactattcgccctttttgtgactcagttttcccacgtgtggaatgggaatgacaagagcacccatctcctgtcgggggctgttagggaacatggtgactttgtccacgcagggctattgacccaggcccaccactcagaaacctcctgggcgcctcatagcctgcagttttgtcagtccttactcctgcacttcttttatggcccttaacaggaaggtttttccaaatgacagtgtgggccctgctgccgagcactcccctgcgccagccccaggacttgctcccagtaggaggcagtagagcagctgtgccccttccacagaggcactgagagagcatggagggccagagccgtcctgactggaagcggccctagaggggacagcacaaagcccagcctctcctctggagccacacaccaggaagtcttggctgacgtgttttgtgcacagctggggtttcagacacagcgaggatttgctgctcccggagtggcacaggaaaccacctgtgaaattcgcctgggtcccttagaggtgcccattatacccaaagaggggcacagtggggaggactatttgacagtctgtctcctggagggtgtcccagccagagcctagggggtccttctctctgtgggtccatgggctgggaaccagcccctgtgcattcattctgcgcacatttgcagctgttacgggaccatgcctttctctaatgcaattctttgtttttatttttcatgccacaaggatgaagtaagtgtctgcgttcggctacctcatagagtgccatacgccatgcagggtgtctgtggcccgcatgggtgggtgtgctgcccccgctaggctcctagcagttcagctgaggctgcgctgctgtcaggggtattgagagccggcccttcccatcagtgccggcttggtgttgatcccattggcctttggaagccacccaatcaggatgaatttatattcagaggtcactgtggagaactctgaggttccaattgagttctcagtcaatctattttggtcagaaaataattaatagatgaaaaggtgacccagatttggggtcgggcccaagtctgccacccacactgcgtgggcaaatcacattgcctttctgggcctcagtttcctaatctgacaaatggacaggttagacaggatgcttctgagttggcttccaacccaaaagttctgtaagtacgtgtgagcagagccgtggactcagccacaccaagttttaatcagagttgtctggtaactggtggagatggggggaaggagagctcattaaacacctgcgggcatgcacagactcttctagaaaatcaagacacagtctccattcatggttttgccctagtccattttcagtgcggttggtgaagccagttcgccacccgagaactcgtgaggcttccaggaggagcgtactctgctttgcttcgttagccccagcatgtgctcagatcacagaggaaaagtcccagggcagcaaaacactggggagggccctgcgctttggagactgagagtctgcttgcctgccccttctgtcagcgggtagccacctagccctggttttatttgcagtggctttatttgcacctggttttatttgcacctgcctttccacatggcaggcttgctcaggtctccgaagccaactgtcttgaccctgtggcccagggacaatttagggcatcgacgcaaaggatcttcagcacttcaggacaggtgcctcagaggctggctcctgtctactttgggaggctcagcagacatctggggaggccacaggggcccatgctggcctgagggggctgggactgagaaccttggtgggtggggtcaggaacaggaggccccggaccttgccctggtcctcgccacccccgctggtcctctgggaggtgggcagcatggcctgggggtggttgtagaggtgcaagcctccagatcccctgatgagcccctgctttgaacagtgaggaggggctcaggtcgtttgggttcataagtggggcatggggagcctgaggtcttctgggaaaccagggagagctggggccctgagtctacacatcagatgcacagagccaactgcaggctcgctgggcaggaactgaggacagacgtggcttccagcaagtagtgaacctttggtttctctccctcggcacctgttgcctaggagtggtccgcagacctgaatcgaaccctcagccggagagagaagaagaaggccactgacggcgtcaccctgacgggcatcaaccagacaggcgaccagtctctgccgagtaagcccagcaggtgagtgggcgccacctccatccaaaagaggccgttccatggtgggggccctgggcaatctgcatggtccagggcagccccggcctggacacctgggaggttcctgggctcctgagctctgtgggccgtggcccagcctggacacctgggaggttcctgggctcctgagctctgtgggccgtggcccaggggcatctccagggaaggtcgtcttcctgcctggtgccagagctgctgacagatccagagagggaggcttggccctgagcttcagacctgagtggggaggagctgatgacagggctggcattcatgtccccagggatagcaccgccctgcccggacactggtggaggtgccaccctggttccctcaggcagctgaggtcctgccgaggttcatgctcactctgtattgtgtgcaggcgccagtcgagggagggacaggagaggactgccaggcatctcctttccaaattacctcttcactaggagcattggttatttctgacttagtcattggctgaaaatgagagatataagggtggcactgtggtcattagaaccttctggaaagtgtgtgctagaggaggtcttcctataggacctgcccacaggcctccatgtgacactcagtaatagtcatttcatacgggggcttcctaagaaggcttagcccaggttcccatggccttcctgcagccccaggcactgaagcccccacccaggctccccagcaggtgtggctgtcgtcattccgctgctttgcacactgtctgggcaggtgggctcggcagtaagtgcctgtcccagggatcaggccagcacctgtatgcttgggggtgggaatgggaaagaagaaacactgcctcagaggagaccctgggggccctgggctggccagggttgctgcacaatccagccgcccccaccagtgccgtctcacaacagtctgctagagaaaggtgccaaggagggaggagggccggtgagctcagacatgtggcctggatattggcctccagcaggcctaggtcaagtaccacttgccaggctgaagtggatgaggcagttactggccactcaggatcaccctggtggcattggaggcatgtcctcgcctcccttccttggttctggggtggtgggtgctcaggctgagcagtccatccagtgctttgggggcctgtgccctgaggccctggtcttggaagtagaaggtgctgctggccagggtagcccggtcctaggatcagttacttggtggggtgccagggcccttggtgcctgtctgattggattgcttgatggtctgcctgtggtcttcgtagtgtgtaactcagctcccggctcccagccctcaggcagagcttggcccagatctctctggttcccacactgggcctggcaaacagtaggcagttgcacgactggattttccctctggagcaccaaaggaatcttctttctatctagaaaagacggtgccgcaggccctggccctgattttggaggcttcagctccacagagcagaagagcgagccctgaaccccttagtagtcaggaggaggccgtgtgggctgaagagctcagagccctctcccactcatccatgggagccggcccctcccacactgtcactctcagaggagaccctgaggggctttttgacccccccagctcacattggtgggagtcaggacagaggagaagccctgaacctggaaacgacttttgctccagctgtggcttgtcacccgcccctgggccaccccagggcccctgttctggacggactgtctccaggtgcaaggaaggaaaagggaaaccaagtcctctcctaggctcctggaccgtgtttcacagctgaagtattgcccgcattctgccatagtaacctttctgttgaaacaccacggtcccctccggtcacaggaggagctgatttgtctcttgagatcctgcagctaggagttgccaggaccctcacgggcccctgcagagctgggatcccctgaaagctctctctctccatagcacccttaatgtcccgagcaaccccgcccagtctgcgcagtcacagtccagctacaaccccttcgaggatgaggacgacacgggcagcaccgtcagtgagaaggacgacactaaggccaaaaagttggtgaacaaatgcttcctctgctcccaccgcgctcactctgtctctcttcctctctctctgtccaggggtctcacccctcggcactcggcaatgcacgaagctctgcaggaagtgggcacctggcgtgccgcaccctggcccactacctgctctctggcacaggctctctggcacccccattcctcggggagggcacagctaacaatcttaagttgctttttctctgtcctctgttaacccttcaaggccctagcagcaccatgacaggaaaacagacaacgcgcagtctgtgctggggactagagagtgaggccccaggttggcctctgctgtgggcatctccagccgcctgcccctggaaagcctgttgatggctcaggatgagtgtggatggcatgaactcacactagcactggctccacctgtgctcttcggaaggagccctcagccctgagccccaaggctccagtgccctcccctgcggggcgggggcctcacaccctctgccgccctgtgctgagggccctgtggcctcccctttcttgcagtgtgagcagctacgagaagacccagagctatcccaccgactggtcagacaatgagtctaacaaccccttctcctccacggatgccaatggggactcgaatccattcgacgacgacgccacctcggggaacggaagtgcgattccgggccctgtatgactatgaggggcaggagcataataactgacttcaggtggtaggtggtcccccacatccaggggaggagggcttccaacctgcaggctgtgggcggtcttttttgttttttaagtctggaaaagttcttgctagtttcacttgtgagtcactgcaggcccttccccagtgccctggcttcattgtcaaaagcagccaattggctggatgtggtggctcatgcctatagtcccagagctttgggaggccgaggtggaaggatcgcttgagcccaggagtatgagaccaacctgggcaaaatggcaaaacctgtctctacaaaaaatacaaaaaattaggccaggcatggtggctcacgcctgtaatcccagcacctttgggaggccaaggcaggcagatcacttgaggtcaggagttcgagcccagcctaaccaacatggtgaaaccctgtctctactaaaaatacaaaaatgagccaggcgtgtggcggggcatctataatcacagttactcaggaggctgcggcaggagaatcacttgaacctgggaggtggaggttgcagtgagccaaggtcacaccactgtaccccaggctgggtgacagagcaagactttgtgtcaaaaaaaaaaaattagctgggctaattttagtggcacatgcctgtagtcccagctctctgggaggctgaggtgggaggatcacctgagcccagtagattgaggttgcaatgaatcatgattgtaccactatactccaacctggacaacagagcgagaccctgtcgcaaacaaacaaacaaataaataacctgggcaacagagcgagatcctgtctcaaataaataaacaaacaaaagtagcagattagctgggcgtggtgttgcatacctatagtcccagctgcttgggaggctgaggcagaggatcacttaaacccaagaggatacagtgagccatgttcataccacgtactctagcctagaagagagagcaagaccccatctcttaaaaaaaaaaaaaagtaggctgggcatggtggctcacgcctgtaatcccagcactttgggaggccgaggcacacagatcacgaggtcaggagatcgagaccatcctggctaagagtgtgaaaccccgtctctactaaaaatacaaaaaattagccgggcgtggtggcagccgcctgtagtcccagctactcgggaggctgacgcaggaaaattgcttgaacccgggaggcggagcttgcagtgagccgagattgcgccactgcactccagcctgggcgacagagcaaaactctttttcaaaaaaaaaaaaaaaagcggatgcccaatgccaagactcagaaatagtgaggtgctgccaagccagtgcctggactcctcaccttgctgggccaaggctgtgaattgcagggcactggctagtcacacagaagggcatctggagaagctgttggccaggaccaccaggttcccccatatgtagtctgggagctgctagccccgcagggccatgagagaagcctttctctaggggtccccaactgccagagaagccctcaggagagccacagctttgcccagaccccagagtagcacttggcatgcccctgggccaggtggggccttgtctcaggcagcaacttgtgtgtgtgcacacctacctgcccacacctaccatgcacacaccaacccacacacatatctgtgttgctaggagcagaaaccatagttttataaaacagcctggatcctgattacatgtgctctgcctgtgaagactttctgtgcaatgtctttttcttctttgaatggtcttcaatgataatcttttttttttttttttttaatagagacacggtctcactctgttagccaagctgggttacagtggtgcgatcatagctcacagcagctgcagccttgatctcctgggctcaagcagtcctcccacctcagcctcctacgtagctgggaccacagatgtgtgctaccaccccacccactataggaatcttttttaatgcatttgcagtttaccaaaatggcttttcacatcttcaatttgaaaagtgttatcttgtccgggcacgatggctcacacctgtaatcccagcactttgcgaggccaaggccgaaggatcacttgaggtcaggagtttgagaccagcctggccaacatggtgaaaccctgcctctattaaaaaataaaaaaattattcaggcatggtggcacacacctgtaatcccagctactggggaggccaagagaatcacttgaacctgggaggtggaggttgcagtgagctgagatcataccactgcactccagcctgggtgatggagtgacactctgtctcaaaaaaaaaaaaaggaaagaaaattgctatcttagcacctaaggaagctggagtggcctagggccaaagtggacccacagcaacccagattcttccctctcttgccctctttgtgaagctcccccagaagcagcatctaccactccaagagggaagctgggccagaactcaacccacacaggctgaagtgtgcccttgcccctaggctacacttgtgggaaaggctgccttaccaccaccaccccaacccctgactcagcagggaagccagggcctgggggctgtgcccaatggcctagcttctaaccagtcttcagcctcctcccctcagcacccagagtgccagcctgctgtccccagacactcttcccctgggctggttatcagctgcctctgcccagtttgagaagttgggtttttttgtttttttggatttttttttaatgtgcctttaagccatcttcatccagtttctgatatctttggttggggttgttacccccgactttgttggtttatttgtttataatttctaactccttttcaatcctgcctattgggtttgacagtaattttgtagatttaaaatgtttcttccagatccaagtaaattgtcaaaagcaaactgattgaaatgaaccttctaatcaccagttcacatttgcacaatgtgaaagctttcctgtccgttctattttctgtgttatcctgctttttaacaatgcaaaattagctcccagccagtgtggcttgacttacgtctcttgcggtgttctggctgtttgccacatggtagtgtggggttacaggcctcatcctagcctcggtagcctggatccaggcctgtgagagcacagcaaccaatgaaggcaggacaaaagaaacgccaggggcccgaggcacgaagcggtggaaagagatggtggttcatcgtggctgctgccctgtggcccctgcatctgctcctgatgcctctgggttagatctgcaggcgcactggtctggcagaagcggcacgacagtgggaggctgagccagtgcttacgcatgtcccaccctcccagggttctttagtgtcttaacacttaatcttcacagtacccccagtccacagatgagggccacaggcccagggagtggacgcagttggtccaggtctcccagccagtgagtgatggctgtgggatttgagcccaggcagtccggggagcactggaagccccaggtattagctccgcaggcatgttgaccagcattgctgccatacaaaatccaaagcatcagggaaatgctaaaccagggggaaaactgcatctaattctgaaaaatggaccaaaaaatgccaaagagagttacaaaacttcaaacttagcaataaaggcaaaacagcactgggactatttctttcccaccaattgcttgctcctgacgaggtccgagccagcaggcccaactggccttccctgcagtgagttaccaaccagaagcacacaggcccctgcccacccctgggctctgagctgctctgcttccctaacctggcaaatgccagacctggggccctaccctagtgccacctccccctcaccaccctagtctgcctccttgagaccaggatccatcagttcctctcatctctgtatctcctcttctacccaaggcctggccagaagtaggaggtccttcaggttggaacaaccaaagataaatggaaccacgttaatacattagagccacagggagattccagaacagcgccaggggctccttctcagggtctcaggaagggttgacacatggcaccgtgcacaagtcatcagccaggtgctggggataaaatgacaggtatgactgtcagacatggtcccttcccctcgcagcctggaagttgcagaggagagggattagcaaaggcagagagaccccagagacagctgctgggagcaaggcggccggggccctggggaggggacagaagaggcccaacgtgagggaggggcacaaccgagggacgattcctgccacctggccagggtggtgaggaaggcacagccctatggagctggatgccgcagtctcagtgggagccactgtggcagctgagagcagcttgttccaaattactgtgtgagactgtcatctctaggtctgtcagaggcccatgaccaaagaggcaacttaaaatgcatgcatttagtagagaaatgaccaggccctcggcctgcccgccacagaatgcctggccctccaccctctgtgggctcaaagctcgtgaatgcggctctgtagcccaccgtcggtgtcatacctctcatggagacggctccctctttgtcttgcaggggatgagctgaccaagatggaggacgaggatgagcagggctggtgcaagggacgcttggacaacgggcaagttggcctatacccggcaaattatgtggaggcgatccagtgatgagtcggggacaggccagcggggggacggaggcggcgggcccaggagcctcagccagccacgtgggcatccactccttttcctgcaagagatgatggttccattgctcttggcttcatggtgttcctggaaggcagatgagctggtcatttcgcctgggactcggcacctttccgagtgcagctggagggatctgagcgcaggaagacgcagaacaacagaaatagccgcccctccccgcccactgtgcctgttggcctatcatagatctctatgttcttgactttgtctctcctttccgagtcaatggtgggttacactgatcttgttccactgattactctctctgacgagtccatcacctgcaacttaaatgaacaagcttacatcccattttgagtgaagattttgaggtttttaatttaaaggctgtgtacagttatacttttttatacacctgttcatttctacttaaattatggcacagattgatgcgcaccagtcttgaggaaacgatctccctattcccttaccctgttactcagccacgccgtgtgtaggcttagcctcaggtggcagatgtttgaggaaaggaattatgccaggaaggtgggaccgggttatggtcgggtttctattgggaatgctctttgtgcttttgggcatctgaatggaagctttacatagaaccttaggtagaactcccccaaatcgccatatttaaaaattattttcactctattcttgcttaaaactgtactcttttgcaaattaacaattttatcactgattcagagttaaaaagaagactaacttttcaagcaaatgcatctgtaaagatgctttagattagactgtcatgtctcagtgtctatctgtatatattatttgatattcagagaatctaaagcactcgtctactgttttaatgagatttaacagcttttaacagtgagtttcgtttgtaaactgcttgaagtctgtggcattcaggcacacgtctggctggccggctgggtctcctcccgggctcagtgggcctggggcctctctgacgtggtgcctgctggagggaggctcgtcgtcaccagctgactgctggtccggcttctgaccggcctttgtcctggctccgtagcagaacactgtaaaagtgcccgcgtctttgcagtagttgcagatttcagtcgtcgtgttacttgtgcacaaacagaagctgggtcttacccgcagcacgagtgtctcgggctgcccggagtcgcccgggagcaggtgctgcagccagagttacgcgggggccacgcgggccggcgggggtggggggaacgtgggggaacctgtgtttcacgtgactcagcagtgcccgccgccgtcaccagctatgcattcactccgtttccagtgagcagatgtcttgcttggaaagtggacctgtgtctgtgtctgtcctgagaacttaccagcagaaatcctcatttctgtgctacggatttaccaaaaattgtcaagtctttttcagtttaacagttcctttaaatgtgtagtatttgaggaaaaaaatcaataaacagttgatctcgtgcatatggaagtcccttcgccatcatctgtcttcatgcccacttcacttggcgggggtggcctccctggggcttactagctttggagctgggcaagatccagggcacaggacccctgcccaaaaggccacggcccactgcccctgccaaactggaggttggggatttgaggcacctgagccccttggggttcccttctccccgagacctgctgctgtttgacctgggcttccacatggtgcgggcatcggctggcgcctctctattgccccagcccaaacagcaggacaagactgacatcacccataactctcctatgagcacattttcctgagcacctactgtgtgctctccactttttacttacattatctgcgtctccaaacatctccacagggtatgggcaagtctccccatttccattctaccgaggaggaaacagaggctccaagagccagccagggtttcttgaggagtctcagccagcccaaagcactgagcgaaatccctgaggaaccaccccctccctcgctggagaaactgaggagggaggaggcttggactggcttgaagacaggagagaagcaagacgtgagggcggctgtggccacgctcaccgagccctgggaaggctgcccagaaaagcacgccagctgggcatggggcctcacagagcacctgggaggagcaaggcaggcagctgcccctgcagtgtggctttgtcccagctcagcaagggtatgggacagatccttgtcacgcagcctccttgtctgaggggtggcgggtcccctgctcccagcttctgaggagttggagccctacagcgcagggcggacacccggctcggcccacagccccaggctgcagagaaacaggcagaacggggttgggagggaaggtggggggtcagaagcaggctcctggtgccagtggcctcagtcactgcccaaacaccatggcaagaccacggtccccgctgagctggatgaagcaacctccactctgaggctggatcacacggccccccccgtgagagatctggcagggcctctaactgcccatcttccctctcctgccctgccctcaggggccagcttggaaacttcagcttgtctctaggcctcagtttccccaagtagaagtgatacttttccagttggagagttagagcaagaagaaaaggtggcctgggcaacatagtgagaccttgtctctacaaaaagtttaaaaattggtcgagtgtggtggtgcatgcatctagtcccaactacttgggagactgaggcaggaggattgcttgagcccaggaatttgaggctgcagtgagccatgattgcaccactgcactccagcctggacgacagagctctcgagacagtctcaaaaaaagaaaaaggccgggcacggtcgctcacacctgtaatcccagcactttgggaggccgaggcgggtggatcacgaggtcaggagatcgagacaatcctggctaacacgatgaaaccccgtctctactaaaaatacaaaaaattagctgggcgtggtgcctggcacctgtagtcccagctactcaggaggctgaggcaggagaatggcatgaacccgggaggtggagcttgcagtgagccgagatcgcgccactgcactccagcctgggtgacagagcaagactccatctcaaaaaaaaaaaaaaaaagaaaaacgccacaggcactcaggagctggtcattgtcacgattatgagtgacaccataggcaggggcccagggttctctgctgtccatggctgcccttcgctcctcccacagccaccaccctggatcagtgctgccaccaactgtccacacctcttcgggtccccaaggcccctgagttgacactagggggagtgttagccccagagccctctcctgggccaaagctacctggagctcaggacaggggtatttcatcatctctctccatccttcccacaacccagaaatgtcgggagggtgagcaagtgc

SEQ ID NO: 16825 - DNA, 19628 bp, Human
ctatgtaatgtataagagcaggatccttggagttcagaaaaacaagcaccctctcttattgagctgtggcaatgtcaacttcagtttggggtggaaaacaaagaactatatttctaattctcctggattcatttcttggtgccaagaaatatgtatgtcctcactgcaaatggtcctaagggtggctgattgcacaggtcagaatacagagacttaaccataatgtcagactacatagaactattagagctaactacagagctaatgttatgactattgtcctgggaatcttttcacattgtttctatggtagaagggactccaaactcaaaacaatccatttaaacagtgatctattggaagacaactcatgtatgacttaacactgcctaaaatatgttgggaaaaatatgtgaactaaaaaagacaaatcagataaaaaattgaggcattaactggtagttaggtgtgtccagttttttctctgctgtgtttgaatctatttttcttttccctaatttagtatttgctttggatcccttcagatctttcctcagtttttatttgtcttactaaaatcttttttttttttttttttttttttttttttgagacagagtctcactgtcgcccaggctggagtgcagtggcgcaatctcggctcactgcaagctccgcctcccgggttcatgtcattctcctgcctcagcctcccgagtagctgggactacaggtgcctgccaccacgcctggctaattttttgtatttttaatagagacagggtttcaccgtgttagccaggatggtctagatctcctgacctcgtgatccgcccgcctcggcctcccgaagtgttgggattataggcgtgagccaccacgcccggcctaaattcttaattatattgcattagtcattgccctcaattggatattttagcttatttttctacgtcattgtgagcctacataatggatccatcttcactagtttcttttgccttcacctccttttctttcccctattgcttacctttgcacgtttttatatagcttaaatccaacagaaagccaaaactttatcacctgtggatagtgttgcaatacaatgttgtattaaaaactttattttaggccggacacggagtctcacgtctgtaatcctaacactttgggaggccgaggcaggtggatcacttgaggtcaggagttcaagactagcctagccaacatgatgaaacctcgtctctactaaaaatacaaaaattagctgattgtggtggcacatgcctgtaatcccagctactcggaaggctgaggcaggagaatcgcttgaacccaggaggcggagattgcagtgagcccagattgcaccagcctgggcgacagagtgagactccgtctcacaaaataaaaatacaaaattaaaaaaaatgaaaactttatttcaggctatcgatcaaaaacacaatttaggccaggcccagtggctcatggctgtaatcccagcactttgggaggccgaggcgggtggatcacgaggtcaggagatcaagaccatcctggctaacacggtgaaaccctgtcgctactttaaaaaaaaaaaaaaaattagccaggcgtgatggcgggcacctgtagtcccagctattcgggaggctgaggcaggagaatggtgtgaacccgggaggcggagcttgcagtgagctgagatcgcgccactgcactccagcctgggagacagagagactccgtctcaaaaaaacaaaacaaaacaaaaaccaaccaaccaaacaaacaaaaaaacataatttagcctaaagtttctgtttatggccccaaattcccctaaaattccccctcattcagatttttccccaaagtttcctaacagtgaaaacttagctacccaaggcagccaacccagaaagccctttggcaggaacaatagctgttgtaatcttccagctgaggccacagaatttcccctgttccgtaagaaggaacaacagtgcttttatgacatcatctgattttgcagaacgagcagccggtgtgtaccacagagaagcacggtctggcaaatacaagctcacctacgcagaagctaaggcggtgtgtgaatttgaaggcggccatctcgcaacttacaagcagctagaggcagccagaaaaattggtaactgatttcacaatgatttttcttcttttttatccttggaggaaaaaaatccatctttcctaagccctagtaagacttctttctccaacccccttctgatatatcactaagcccctaggacatttctgctctctgacttctcctatccatctgcctagagttggcagacagttcctagtaccaccaacttatgtggagtcttaacccagtgtgacctaataaaatacaagtcaaaagaaaatgaaaacctcattatttcaatattatttaaatttctcattaatttcaatgccattgctattctttttagtattgttctatctctttgacttctcagtatggtggctgttaaatgatgctatagtactatattgagtcttacaaggaaatttacttggtagagaaatattgaatttagtggcttttttccccaatttttttccattaagtgggagaatgtatttgtacttcaggatcaaaagctataaggaaaaggaggacaggaaggtcgtgagatagaagcagaaagaaactgggaagatggtatcagaagacctggtgaaaatcccagcaatcaactggtgttacatgcttctttatacaaaagtggattgctaccatctctcttggcctttggggagaatgggccacccccattcagaactcctttgctgactggataacatccggcaaagttgatacattactcaagaaaaaaaataagagtgttttctcaaatgccccaaagcctccccagatgactgctggtctgtaatcagggggcggcatggggcatagtaactggagtggaagagacaaagcccatagtctttactggccatcctggacctctagtaaaattgctcttggtggcattgacagatactaaaacagcctctgaggctgagcaaaggaaacagggctgagcctttgtttgaaatgtatgagagaatttatctttattcaaatcttctaaaacattatgaatatctgatagggtgcagtggttcacacctgtaatcccagcactttggactgcttgagctcaggagttcaagaccagcctaggcaacatagcgaaacctcatctctacaaaaaaaattaaaaaattagccaggtgtggtgatgcacacctgtggtcacagctactctaaagactgaggtgagaggattgcttgaacccaggaggtggaggctgcagtgagctgtgttcatgccactgcactctagcctggatgacagagcaagaccatgtctctaaataaataaataggccaggcgtggtggttcatgcctgtaatcctagcacttcggaagggtgaggtgggcagatcacttgaggtcaggggtttgagaccagtctggccaacatggagaaaccccatctctactaaaaatacaaaaattagctgggcatggtggtgcatgcctgtaagcccagctattcaggaggctgaggcaggagaattgcttgaacccaggaggcggaggttggagtgagccaagattgcaccaccccactccagcctgggtgacagagtgacactctgtctcaaaaaatagataaataagatattacaaatatcttaattgatcctaaaatagaaattaaattaccacttgaaaatattttttcaaaattgataatttcagaaattgtctcatggcattccatacgtcatttgtgaaaagaagccagctctgaacttggattagtttcatacccacaataatttgtagtccatttgcatttttttcaagtaagaggtagttttccaataaaaatcagaagttatatttcatgtgtattcacactttgtctaattaaggaagcaattttctcccttttacatgaactggatttgaccagttaagaaacttactattggaagtggctatctttgctaagatgacttttgcttagccaagacagtttacctgtttagtccataactctttttcttcttgcaggatttcatgtctgtgctgctggatggatggctaagggcagagttggataccccattgtgaagccagggcccaactgtggatttggaaaaactggcattattgattatggaatccgtctcaataggagtgaaagatgggatgcctattgctacaacccacacggtgtgttaaaaataataattttatgttttgcaaaaacagttccatgctgctaagaggttgttaaaaaagaaatggctactttttccagaaataattgattttggtaataataactactactaataactacaattcataaagtgcttatactatacccgacattgagttgtgttccttcgtctacactctaacttaatattcacaataattcttcaaggagctattgttatacctattttagaaatcaggaaattgaaacttagagaattaagtaaccccaaatcaggagtcaataatgattaggcagatgggactgagaattcagatcttctctgtgccagggaacttcccagccataaagaaaaagaaaataaaaaagcagattaaaaacttgtcacagtaaattagctaaaacaataaagtgatgctaccaaatggtaactattcaaaattgtccttttgatacaacggggaaaaggagacaaagtaaacaaataaattctttccttaatttctttttgtgtatatatgctagtacttccaaactaagcaactctaattctatggtttaacaattatatactgtatatactagctatcattataccatatatttttattcatattttttccatgtttgcttgcaactaggaaataatgagaaaattaactcataattactataaagaattattcttaggtcacgttcttggagaaaaagtaggctgttctttttgggtatatttccaccaggacaatgttacaaaatattacagtatgttacaaagtcttcctggcatttaggatcataaacatcctcagatgtgtcccatttggatttaccctataagaaattccataacacagtaggagagttacatagtgaggttttagtgtattattataaaatctattatttaattatattaacatttggagaatagtttctcatgtctgtaactaacctatatctcaaaattatgtgtagtccaagtagaaagatttttgcctacagctacaactagtcttaactgagacaaaataggaataaatacttaacagtgcatttatgtaactttaactttcaagtcactttgacatgctttaagcttatttagtcctatactatacagtactaatttagtcctatatttagttatgtcaacaatatgtatcttcctttcctccctccctctcttacattttcttaaatatatttatgcagaccactcttttttactcttaagagtaactcttcttttcaaatgtattctctgattcttctttcacttgataaactttaggatctctgagcttccactggataatttccatagattaaactctagagtcattgaagaagtgccaatgaaatggtcctttcagtatttcattgccctttcataagaatataatcctaaattataaattattataagttgctttcttttctcagagaggctgaatacactctgggaatacagaatcctgggagatttgtttttacccaattctcagtgcatttagctcgcttttggatttggtggtatgctgactatttaggatgtggttaacttgaaggagacttgaccgcctgaactagcactgggggaacagctcactgaaacatcactggaataaaaaaaaaaaataatggcttcacaaaaataaagcaatcattattgattaatcaatgtcaccaagttagagctgatattctaaataatagatgaggcagtaactagatataacataaaatatagatctaaataaatatagccaaataggcagccaaattagttcaatatttgaattttttctaatctattaatatatacaacaaagattggatgctatgggatggaacaactcgctcctaaagctggcaatgtacatccttatgcagacatacaaactatgtgttgtatattttattatacagtaagaatagcttatgggttgcataacatccttaaattattttctgtattttatccttagaataaccctgtgtgatagataatgggaaaggtatggctacatttattttaccaatgaagaaaatgaagtgtagagtagtcaccaagcttgaactagatccttgaccttcatttgttgctccccagcctttctatgctcctgttctgctttatttcatcaaagcagaacaggagcatagaaaggctggggagcatcttttttctagacattagacacttacctgatatggaattaaaattaaccagggcttcttcctagctttccctctaggtcatattgcaaaccactgattctgagacagcgtttttgttttgttttatatgtgtttgtttttcttatgacaatttataacatattgaaatctgttaaatgatgaatgacttggaaaaacaaacatgaatatctccatcaaatcttaaaatattaggattagggtattagtttaaaatcagtaaaggcagtatacagaataattataaattattccttttaagtggattagagtgactttaaagtctcttgcgatcatgaaattgtataatgattttccaagcagaatttatgggatccattattctaagtgcttgtggccctgaagacatatggtgacaccacagggcaaagtccctaccatcttgatagggctgtttgtaatataaatgtgtatatatttgtcaaaatacatagacataggccaggtgccatggctcacacctataatcccaacactttgggaagctgaggtgggtcgatcaccagaggtcaggagttcaagtccaacctggcccacatggcaagaccctatctctactaaaaatacaaaaattagccagacgtggtggctcatgcctgtaatcccagctactcagaaggctgaggcataagaatttcttgaacaattgcagaggctacagtgagccgagattgtgccactgcactccagcctgggcaacagagtgagactccatttcaaaaaacaacaacaacaaaaaataggcgtgtgcacaaaagacttgttatgttatgccttaaaagataaaataaaaatatttttaaaagtacaattaattacattacaattcttttaattttaaaatttatttttatttttattttttagagctggaggtctcactatgttgcccaggttggcctcaaactcctaggctcatgagattcttctgcctcagcctcccaattagctgggactaagggtgagcatcactacacctagccatttttttcttactatatttacttttttaaaattcatggctgggcacagtggctcatgtttataatctcagcactttcagaggcagaggcaggaggctcacttgaggtcaggagttcaataccagcctgggcaacattgcaagatccatttccacacaaaaaaaataaaaattaccagggctgggtggcacatgcctgtcatcccaactacttaggaggctgaagtgggaggattgcttgagccaaggagttcaaggctgcaataagctatgattgggtcaccgcactccagcctaggtgacagagcgagatcttgtctcaaaatataaaaataaaaataaattcacaaagagtccatgttcattttagagaatttagtaactattgatgaaaaaatacatttattctttagctaaaagcatacataatataccatagatgctgtatactaagacatttaacatttcataaaaagtaatagattgctaagaaatgtcatttttaacagggataatgtttttcctaatgctttggggtttttacgttttttttcttctcatttcagcaaaggagtgtggtggcgtctttacagatccaaagcaaatttttaaatctccaggcttcccaaatgagtacgaagataaccaaatctgctactggcacattagactcaagtatggtcagcgtattcacctgagttttttagattttgaccttgaagatgacccaggttgcttggctgattatgttgaaatatatgacagttacgatgatgtccatggctttgtgggaaggtacgtatgggtccccatacaggaagttaaatgaacgtccagtattttgtttgatgcttctttaattttccctcaactgtccctataatattgattttggaatagttctactctcctaaagcaccatatcatttttcaacaaagatttttcttagctggctgctacaacatacttattaaagcagtgagagtgccttttgattatggctaagttgtaagaactagttagtctattttataaacacctcaagatctgactacaacatacttattaaagtagtgagagctgccttttgattatggctaagttgtaagaaatagttagtctattttataaacacctcaagatctgactataacatacttattaaagtagtgagagctgcctttggattatggctaagttgtaagaactagttagtctatgttataaacacctcaagatctgactaacaataggaggaagaaagatatgtgagttgcaaaaattgttcaggtttttaagttctaatttcttacaaccttaaaaatgattatagggccgggcacggtgtctcacgcctgtaatccacaccactttgggaggccaaggtgggtggattacctgaggtcaggagttcaagaccagcctggccaacatggcaaaaccctgtttttactaaaaatacaaaaattagccgggcgtggtggcaggcgcctgtaatcccagctactcaggaggctgaggcaggagaatcacttgaacccgggaggtggaggttgcagtgagccaagactgcaccactgcactctagcctgggtgacagagcaagactctgtctcaaaaaaaaaaaaagattataaattcagtaattgttgcctttcttcttcctacaaagcattgtgctaagtattatggaagtaaggtaaataagcaaagtttaaccctttctctctttaatatttttcctttggcttttcaacatgctagaacacaaccttttccttcacactccaaatctttaatatactttgaattttgagtgtcttatgatatattgcaaattaaagagtgtacaattaggtattttatatattcaggtccccacctaataacccatattttagactatcaattatcaatagactatcagttttcaattctctattatacatgatagtaatttaatggggaaaaaattgtaatggggacaatttaaaaatgacaaactcaatccctttttatgttgattttgaatgtgtaatttaaatacaaagaaaaccaaaggcatttcttgcaaaaatgaagagttttttaagggaaaatattttttgttttgttttcttctttctacatctttttttctttttttttttcttttttttgagacggagtctcactctgtcaccaggctggagtgcagtggcacaatctcggctcactgcaacctctgcctcccatgttccagcaattctcctgccccagcatcccgagtagctgggattacaggcgcctaccactacacctggctaatttttgtatttttagtagaggtggggtttcaccatgttggccaggctggtctcaaactcctgacttcaggtgatccacccgcctcagccttctaaagtgctgggattacaggtgtgagccaccgcacctggccttgttttcttctttagctgacagactactgctatagagaaaagatagtttataaaaatagtttgatgaagacacaaagtagagttggggaattaagaacaaagtacaggcaggcacacctgtggtcccagctactttggaagctgaggcaggatgagcacttgagcccagtagttctgggctacagtgcgctatgctggtggggtgtccacactaagagcagcatcaatatgatgacctctcaggagtagggtaccaccaggttgcctaaggaggggtgaacctgcccaggtcagaaacaagcagattaaaactcccgtgctgagaattgggaaggagcctatgaataaacattgtatttcagcctgggcaatacagcaacatcctatcttatataaaataataaactactgtctttaggaggtttgaacaggctaatttgttatttcttggatttatattatataatttaccctttaggtaaatttagacttttcctctagaataaattacatatttagaaacctgtaaaacccttacctttttatatgtgtaaaagggttcctttcaagtcatgattcagataaaaatcaaatccttttacacctataaggtccaaaataatttttccagatttaaatcagtctatcctagaattcaaaatattaatatcaccaagcatatgcccattcttctacaactgtgaagaaaactttataaaattaattagaaataaatttttaaggctggacacagtggcttatgcccgtaatcctagcactttgggaggccgaggcagttggatcacctgaggtcaggagtttgcgaccagcctggccaacatggcaaaaccctgtgtctactaaaaatacaaaaattagtagggtgtggtggcacatacctgtaatcccagctactcgggagcctgaggcaggagaatcacttgaacccaggaggcagaggttgcagtgagctgagattgtgccattgtactccagcccgggctatagaccgagactccatctgaaaaaaaagaaagaaaattttaatttttccaaatagattcaaattatctgctgcacaaaattttctagttacacaaagtaaaaatgccacacatatctttcctttaaaatctcattggctgggtgcggtggctcacacctgtaatcccaacactttgagaagctgaggcgggaggatcacctgaagccaggagttcaagaccagcctggccaacatggtgaaaccccatctttactaaaagtacaaaaattagccaggtgtggtgcatgcctgtaatctcagttacttgggaggctgaggcaggagaatcgcttgaacccaggaggaagaggttgcggtgagccgagactgcgccactgcactccagcctgagcgacagagcaagactccatctaaataaaataaaataaaataaaatatcatcaatattgtaagaagattatttcaaataacaaactttgttttaactcctactctctcttacaaatccaggtaaaataacaatagaaattttaaaaattatggaacaatgagctattacttagaggcttaattatcagtaacagccactttactagctgtataatattcatttgtgtgacatctcttttctaaaaattccttttcagatactgtggagatgagcttccagatgacatcatcagtacaggtaaggttttaaattgaggaccaaaactatgatttgtttctttacagtgtccctgaaagtaaagggacactgttaaatagtaaatagtagttattattcactttttaaagttgaaagaaccaacaccagatgcagcttgctaggttgtaaaatgcaaaaaaaaaaaaaaaattaaagatttatgccaactgcttgcactaaaaaatgtataaactcttctttgctgaaaatgtaatgtatctgagagtcttgaatctgcaaatccacaaatattgctatagtttatgatttccataaatgtgctaataaaatggctgaaatttttcattgataaagggttgaagtcatttataaagtcattaaaaatctttgtcactaaaacaatcttacatcatattcattacatttttatcttagtacaatattctccagagaatgtttcaaataacaaagttctgtgagatttaaatagatgttacatgagaagagggctctaaggtcaaataaatttggaaaacgttgggttaaacaatatcaaacaggtttcttcactggaagacagcagggatcttttaatatgctaatcatgtgtagtaaatctgaaaagaccagatataataggtagtgctttccaaatattgcccacccccccattattttctgtgactttgttccaagaaatgtacctcaagaaatgccctgtagtcgcataaatttatctcaatatgcaatatcactctttaatttatcccatactgctattttctggctaaaaacttcctttcttacatgtattcagtattttattttatttccatcaccagcaccagcagctggcatttttaagtgctctattttctcccaagtcataaaactatcacagtacttctgcaactataaacaacaaaactacattgagttgcaatttctaagtactcagatactactagttaacttactcccacaccccagcctttcagtgactcaattctaatttattcgtcataactgtaacagatggaacttcctgctctgttatcgaatgattaatgcttaaaccttgttagttcattattctgttacaaactcccttaagaaagataacctattaaattaaaccgtttacttatctctcattcctttcttgaaaatatattttatattaacagaaagttgaaagaaaacatcttattgctgtaggaggtagttgggggatgagaatcctattaaacaaagaagttaaaaagaagcctaggccaggtgccgtggctcacgtctgtaatcccagcactttgggaggccaaggcaggccgatcacctgaggtcaggagttcgagaccagcctgaccaacatggagaaacaccgtctctaccagaaatacaaaattagccaggcgtggaggcacatgcctgtaatcccagctacttgggaggctgaggcaggagaattgcttgaacccgggaggcagaggttgtggtgagccaagatagcgccattgcactccagcctgagcaacaagagcaaaactccgtctcaaaaaaaaaaaaaaaaaaaaagtctgaaattttacattttccttttttctctaaagtagacaacttactccaaatgtaatcaaatcagtggtggggttttattggcacaacttcaagaaactgggaaaaaaaaaacccacacaatttatcattcaaagagaaacaaatcaagaaacagaaaagaatatagttaaaacaaaaaagccaaagatttagcaaaaaatcaggaagaggacattgatacaaagtaatagaaaaagaagatataagatacagttaacataaaatcctatcaagcataggcctggtgtggtggcttacgcctgtaatcccagcacattgggaggatgaggtgggcggatcaccaggtcaagagatcgagaccatcctggctaacacggtgaaactccgtctctactaaaaatacaaaaaattggccaggtgcagtggcacacgcctgtagtcccagccacttgggaggctgaggcaggagaatcgcttgaacctgggaggcagaggttgcagtgagctgagattgtgccactgcactccagcctgggtgacagagcaagaccccatctcaaaaaaaaaaaaaatcctatcaagcataatactattaacattttgatctggttttctttttaaatatacgcttactcaacccagggtatagattacaaaacaaaaatagaaaataaagacattggccaagcatggtagctcgtgcctataatcctagcactttgggaggccaaggtgagaggcgtgagcctcaggagtttgggaccagcctgggcaacatgatgcaaccctgtctctacaaaaaaatacagaagtcagccgggcacagtggctcatacctgtaattctagcattttgtgaggccaaggcgggtggatcacttaagatcaggagttcaagacagcctggccaatatggtgaaaccccatctttactaaaaacacaaaaaattagcccggtgtggtggcacgtgcctgtaatcccagttactcaggaggctgaggcaggaaaatcacttgaacctgagaggcagaggttgtagttagctgagatggctccactgcacgctagcctgggcaacaaagtaagattccctttcaaaaaaaatttaaaaatacaaagttagccaggcatcctgatgcgtacctgtagtcccagctactcgggaggctgaggtaggaggatcacctcagtccagggaggtcaaggctgtagtgagccatgatcatgccactgctctccagcctgggagacagagtgatattctgtctcaaaaaaaaaaaaaaaaagaaagaaagaacctgaaattgtccataatcctaccacattaataagagatataaaagtaaggatgtgcctactctcctcacctctccatcccagaaaggcatttgataactctgtagtgaccatccttccagatgtttttctattatacaaacattatatatgtggaaactatggacatatttccatgtcagagtatgatatttagatcattcaaattctttttcatgactgcctaataggtcactgtatggatatactgtaatttgtcatgtactaatatttaacattctgaggcatttgattctgatttttttcttttgttattcaacgtttcaatgaacattttaaaacctctgtctttactcagtaattctactttaaaaaaaaatagattcctacagtgccaatttacatttctttttcttttcttttttttttttttttttttgttttttttgagacagggtcttgttctgtcacccaggctggagtgcaagggcgccatcacagctcactacagcctcaaactcctaggctcaagtgattttcccgcacaaggctaatttttattttttatttttagtagagatggggttttgctatgttgcctaggctggtcctgaagtcctgaattcaagctgtcctcctgcctcagcctcccaaagtgctgggatttcaggcataaaccaccttgcctggctgactcccaatttacattttcttttcttttcttttcttttctttttttttgagagtgagtctcgctctgtcgcccaggctggagtgcagtggcaggatctcggctcactgcaagctccgcctcccgggttcacgccattctcctgcctcagcctcccaagtagctgggactacaggcacccgccaccacgcctggctaattttttgtatttttagtagagacagggtttcactgtgttagccaggatgctctcaatcttctgacctcatgatccacccgcctcggcctcccaaagtgctaggattacaggcgtgagccaccgtgcccggccatttttgtgtttgtttgtttgtttgtttgtttgtttaataaggcctgtcgactcatacctaaccaatttacattttaaccagctgaatattctctgaattctctcacaatagaagagcaaaaaagtatcattaataatctaagttgaatttttggtagtgtttttgaacacatttttaaatgtctattagccctttgaacacctatgaattgcctatgaatttatatttcttgcatattctttggcgcttttgtctttctcttttttatttctttgtatattagagatattaaccctattttctctcagtctgtctcgtgcaaaattttttttttatatttaggcaaatcttccaaatatgagaaaatagcagtctgagaatcagagcatgaactcggaaaccagactgcctgtgctcaaacctgactctgcccatttagttctgtggctttgggcaagctacttagtagtcactctgtgcctcagtttcttatctgtaaaatgaatatttaaaaagtatccccctcacctcgcagtgttgttgtgggggttaaatgagttaatagataaaagcaagcattaggaatgtatatactctgcttttgtttatatatatttgcagctcatgcctgtgaccccaacattttgggaagctggggtagaaggatcacttgagcacaggagcttgagaccagcctgggcaacatagtgagatcctgtctccaaaaacaaacaaaaagaaggcctttgcctcctttttgaaaaagatataaatattcctatattttatgttatataataaagtttttcctttttatttagcacattttggtctttatattacggtaaaatgtgtttaggtactctgtgtaaagtaggaatctagcttcatttctaataaatgtgaaacttgttgctctgacatcatttagtaaataactcatccacccatcgctggtttgacctgccctgccattctcctgtaattctgtggatgttccttctacaaagagtatcttcttttttttttttttgagacggagttttgctcttgttgcccaggctggagtgcaatggcagaatcttggctcactgcaacctccgcctcccgggttcaaggattctcctgcctcagcctcccgaggagctgggattacaggcacacgccaccacgcccggctgattttttgtatttttaatagagacggggattcaccatgttggtcaggctggtatggaactctcgacctcaggtgatctgcccacctcgacctcccaaagtgctgggattacaggcgtgacccaccaggcccagcccaagagtaccttttaaatacaagagagaggccaactcggtggctcacgcctgtaatcccaacacttgggaaggccgaggtgcgtggaccacctgaggtcgggagtttgagaccagcctggccaacatggtgaaaccccgtctctagtaaaaatacaaaaaaatctgccaggtgtggtggtgcgtgcctttaatcccagctactcgggaggctgaggcaggagaatcgcttgagcccgggaggcggaggttgcggtgagccgagatcgcgccacagcactccagcctgggcaacagagtgagtgagactccatctcaaaaataaataaataaatacaatagacaaaatttcctgtaggatagattggaggaccaaaggaaaaaatacaaacgtctctcaccctgttccatgcggcaatgaaaccacagactcttcagcttgagaatcgacctctgaattctgggaatcttgttcatgaattcttatattctcctatgagaatgaagagtctttgaattgtcagccaaatcaaaggagagtaacatctttgttcttttgcctccttccccgcaacaggaaatgtcatgaccttgaagtttctaagtgatgcttcagtgacagctggaggtttccaaatcaaatatgttgcaatggatcctgtatccaaatccagtcaaggaaaaaatacaagtactacttctactggaaataaaaactttttagctggaagatttagccacttataaaaaaaaaaaaaaggatgatcaaaacacacagtgtttatgttggaatcttttggaactcctttgatctcactgttattattaacatttatttattatttttctaaatgtgaaagcaatacataatttagggaaaattggaaaatataggaaactttaaacgagaaaatgaaacctctcataatcccactgcatagaaataacaagcgttaacattttcatatttttttctttcagtcatttttctatttgtggtatatgtatatatgtacctatatgtatttgcatttgaaattttggaatcctgctctatgtacagttttgtattatactttttaaatcttgaactttataaacattttctgaaatcattgattattctacaaaaacatgattttaaacagctgtaaaatattctatgatatgaatgttttatgcattatttaagcctgtctctattgttggaatttcaggtcattttcataaatattgttgcaataaatatccttgaacacacatatttgtgcacctctctaattatttaagacaaggacctggaaatagaattactgaatcaaaggttaattaaaataaaattttctgttttgataggcaaaaatgaggcctcactgtagtttgaatttgcatttctttattcatgagattgatggttatataattttttgttaattttttttgtgaattatttttccatgcctttttttcactatttttaaaaactgatataatcttctctattgatttgttagaaattattatatatgtccatgtttgtcatatatgctgtaatttaatttttagtttatattttgtcttttactttaatggttctttaaaatatatcaaatgttaaaatttatttgcaattatacttgattttgctgaggtctcttttctcatatttatgtttaggactgtcaaaagacaaaatgacaacaaatttagtttaaagatcttaattggcttttatttgcaattctagaatcaggcacctcatttttaaaatagaatgagtgttctgatgagctgagcagaggacgttggttttattgatataaaagggctgaggagagcagaaacagaaaacaaaaagcagactggttgtttcaaagttacttttcttataaaggttaaagcagaggcaacttccttatcatgccagctaaaactggtctgtttgagggtttggctattatctctctgtggctcttggtttcttggaaggtcagataaacaactaatttcgggttggtggtgtgaaactttagcatgagtgactccattttggtttggtctctttggcctggtgcagaagctaagtccaaaccaatgacctcctataacttttatttaagagaataaaaattcccattataagatatgacatgtattcatctatattttatttttgttttgtcacttcacctttttagggagaaaaaaacacagttgttactcggtaatgagggatgttgggactcagacgataccctaaagtatgacactttgggatactgagtactttgagctaaaggagactggaaggcctcagaagcaagatctctgtgaccttctccttccatcttccctcttgccccaagtcttcctcttccaaagcaagtcataaaaaccagaattcaccgggcgcagtggctcactcctgtaatcccatcactttggaaggccgaggcagaggatctcttgagctcaggagttcaaaaccaggctgggcaacatagcaagacctcatctctatgaaaaaaattttaaattaaaaaattaaaaattatctgggcatagtgccacatgtctgtagtcccagctacttggggggcagaggcgggaggatcacttgagcccaggagtttgaggctgcactggagctatgattgcatcactgcattccagtctgggagacagagtgagatcctgtctttaaaaaaaaaaaaaagcaaccagaaccaaaattcctcttcctcaag

SEQ ID NO: 16826 - DNA, 10832 bp, Human
gtggtagcaggtggtgaattggttgcttatccctccttttccctgcctacatccctggacagaactgagaagaaccttgtggcacacagctcagactctgagtctgaactagagctagtcctgtaagcttattccagtttggtgttatgactcatggttaccctgcagggaatcataaatttgtatttggggatcccattttcctgacaatgtggcagcatcctttgtgtctggtgtttctacttggaaacctggctatgttgtggttatgagccagccacagagcctaggataagggcagaggttacaagctggggagaaggggcactaagctgttgagtggctggaggctggagtccagtggggagtaaaggatgggtgactggctgaggaggagtgacagatttgaaagatttgtggagggcaagatacagccactttggtcattttgtggggtgctgcacacttgtgtcttaaattattaacttagcactggggtggcctggagctgtgggtacatttttgcccagccctgtgataaggtttgttgtttattaggcagaaaggcaagcatttatataggacaggaatgtgccttctcaggaagagcagaaaggaacttgggcagtcagtagaatgagggtggtggtggaagggagggtgagagagagaagatggggcagctgttctgagaggccagacttccctgcttctcaggatgaagtagccagaatgtggtgaggccaggacaccacaaaataggaggactagcgacaccaaggccacaccactgccaggagaactcagagggtgtttctgactgtgttggtggcctgaagtaggcaagaactgtactaggcctcattctcttgactggtaaggcagggtgatgttgaccttgcccttggagcccttgggagaagggctttaaagttaagccctccttatagtgttccagttgctgagctgggaaggagggagcaatgaagcgattcgctatgctaccagtgggaagatctgtatttttttttccaactttcttctcggccacattctggggctactggtcaacctcacagcatgcgtgagcctcccttgttgaacttcttcaagtaattcaaattcaagtcgtagattgtaacttttttgttgggggagggataatggacttgagattctgataaaagctatgatccctttctaagaaaagatatgaaactttttcttaggtatgtctgtattcatatggacataacactttgaaagagaatttcgagcctcatggaggccctagttaagaaccctgataaaaggtacttttaaaacctgtacttctgagtagaaggactgggggaatgtgtgtggctcttacttctctattgtcccatcaggaaaaatgccctgtccccattctacaggaaccactcttagctgcaagaatctttccaagcacaaaagcaggcagctgagctgccaggcagtgggcaggaagtctggccttcatcctaatccttggccacacagcctgacctgctggctcagcattggataagtcacagcagaactcctcaaggttaacagtaataccacagagtcagagtgctgtgtcctggagcccatggggaatgggaggtaggagggagagaccatgacttttcagagccaagagccggaacaatcactaatcctgtacagttcccagttgcctcccactgctgtgattggacatttggatgtattttttatgtaagcagatctgcagtcactttgttttgtgtctcccatataaggtgctgggggtggggagtatagaggcctttgtatgataatggtgaggacattctggggccccgagggttccagtgcagagcaggtcagagggtctgtctttggctgaagggtatatatatcttggtgactggtactggaaaaattgcttgggagtctaaggccctagggtggtaagggtaagtcaccaatcagtattatttttctttcaggtctcttaaccttcattaactgtgcctatgtcaaatggggaaccctggtacaagatattttcacctatgctaaagtattggcactgatcgcggtcatcgttgcaggcattgttagacttggccagggtaagaaataatattagtagcaactaatcttttttaagcattttctgtgagccgcactcctctaagtgctctttgtgcattatctcatttcttactataaccttattcggtgggcactattattattctcattttatggatgaggaaacagcctgcagaattaagtaccttgggccgggcgcagtggctcgtgcttgtaatcccagcactttgggaggccatcgcgggtggatccatgaggtcaggagttcaagatcagcctggccaagatggtgaaaccccatctcgactaaaaatacaaaaattagccgggcatggtggcaggcgcctgtaatcccagctactcgggaggctgaggcaggagaatcgcttgaatccaggaggcggtggttgcagtgagctgagatcacgccactgcactccagcctgggcgacagagcgagactctgtcccccccccaaaaaaaaaaaagaattaaatatcttgcccaagttgctaccggtaagtagaggagttgaaatttgtatccaggacaactgacccaaaagtctatcctttaacttccatgcacgctgcctcccagaggaggctgatcttggcaaagggttgacagccatgccctgggagctgcctttggcagattgtgataggaggcaggaatcaggcagcctgcagagcagaacagaactgcattgtttctattctccagcttttctgctctatggtggtttcttatcctagaaagctaccctggacccttcctgtcaagatccccatctatgtcattaggatgcagggcattctggtctatctctatagacgtctctcttctgtttcctgttcccttactggtactcttgctgccaaaggtgttgtaggccacttacctgctattatattaccatattctgtcagtcctttacttgaccatcttgaagtgggagaatgagccactaatcccctgccttccaatgttcttgggttccaggagcctctactcattttgagaattcctttgagggttcatcatttgcagtgggtgacattgccctggcactgtactcagctctgttctcctactcaggctgggacaccctcaactatgtcactgaagagatcaagaatcctgagaggtaggtactgcaccaccaactttccatagcagtgatagccatcatttaatgagctcctactacgtgccagacagcataccacaaccactatgaggttaattttaccagcctcattttaatagatgggaggcctgaggctcagagaagtaacttgtctatgatcacagtaacagggctaaaatatgaacttactcatgtatgctttgtaaatttttaaaggcatttttacatttgttcattaatttctgcattaattaaagcaggttgtattatatgcttatgtatgtttttaaaacagattttccttgatagatattttatccacccttatccccacatacatagctttgggatatagacttccagaaaccttcctgtgtttccctctgataccttccttgtttcctaaattcatactgacattgtggtatagtttcagtcattcaattaagtcaccctaccattattgctctgtagtctatatatagagtgaaaagagaactggacaggaagtcaaggacctagagttgatctttccactgacttgttggctaaccttgagggagttgcccggccatctctttgcctgtttccttatctgtaattgagggggttaaattctgtgatctccatggcctttcctggctctaaaattctatgattctgggaactaagatttgccagggagtggagtttcggtaaaatgttttttgttttttggagagagtcttgctgtatttcccaggctggagtgcaatggcgtgatcttggctcattgcaacctctgcctcccaggttcaagtgattctcctgcttcagcctcccaaatagctagaattacaggtgcctgccaccacgcctggctaatttttgtatttttagtagagacatgggtttcaccatgttggccaggctggtctcgaactcctgacctcaggtgatccgcccgccttagcctcccaaagtgctgggattacaggcatgagccactgtgcccagctttctgtaaatgcttaagtgaaaagactcacaattcttataccaataaactccttttggcttgagaaacagaagagcactcttggtacacaactagtggtaacgctatgggaacagagataacagaagcaggatcaaggcctgggtggtacttccacctaccggacagaaactgcatgactctatttgcagagtatttgccccactttgtgctttttttttggcagccttactgttaaggatgcttataaagatcatggctttattgggctacagggaccttgagagctctttgcatctttcttttgcccaccagttaggatggctcctgaggttctcaaactgaggaaggggtgggcagacatatcttccaggctgctagtcagatacatacacttctcttcctactgaaggcctatcttattctctgaagatgttaaatttcacaatttgcctccataatttctttttatatttctcaaccttgaggcaaaattgccaatgttgataatcttagagatggaatcctgacaccaaaagatctttggggtataaaacaaaacaacctcccattttcctgtgcgttatgatgctggggacagtctttgttaatcccccccgccctgcttttttttttttttttttttttttagacagggtctggctgccttgcccaggctggagtgcagtggcccagtcatggttcactgcagccttgacctccccaggctcaagtgatcctcccacctcagcctcccaaatagctgggattacaggcatgcaccaccacgcttggctaatttttttttttttggtttgtttttggagacagagtctcgctctgtcgcccatgctggagtgcagtggcacaattttggcttaccacaacctccgcctctcgagttcaagtgattctcgtacctcagcctcctgagtagctgggactacaggtgcatgccaccatgcctggctaattatttatatttttagtaggaacagggttttgccatgttggccaggctggtcttgaactcctgacctcaggtgatccacccggctcggcctcccaaagtgctgggattacaggcgtgagccaccacgcccagctgcttggctagttttttgtagagacagggttttgccatgttgcccaggctggtctccaactcctagactcgagccatctccctgcctcagcctcccaaagtgttagtactacaggcatgagccactgctcccagctgcacagtcctgtctcctaatatgatattcctttcccctaatgttctttagttcttaagtgttcagagcttcagccactatccagggcaccgtcaaagacaaatgcattgaggaaatgtagcaacagtctccatccctggaaagaccggtgtggcagggagagtctaaggattaaaggagagatagggatatgactgtgggactaatgtgcattttattctatttggctgtaggaacctgcccctctccattggcatctccatgcccattgtcaccatcatctatatcttgaccaatgtggcctattatactgtgctagacatgagagacatcttggccagtgatgctgttgctgtggtaaaggattttcactagcagaaggttgagggtgtcttgtggggtactgggtatattctggctcttgaaagtcctggaaagggggtagacagccttgaaaggagttcatttagaataccgggcttgcaagaaggtcctgttaaccccactgtggaagaaaggttggaatacctaataaggggaatctgggggcatgcccatccatgtctttcatcccttttagatcctgctaatgactcttccattcttttcccttagacttttgcagatcagatatttggaatatttaactggataattccactgtcagttgcattatcctgttttggtggcctcaatgcctccattgtggctgcttctaggtaagagtggcaacttttgtgaggggtgtatcatcaaagggctatgcagtggacagaacttacaggacccagcctttgattacttgtgttctccaaccgataccacaacctctttcttcttgtttctagcagaagcctgcagttgtcattaatcttaatactgagctccagtccatattatccaaatacttttgaaggaagggatggcagagagggagggccatgtggcaggtgaaccaggctgcaccgtgtccaccaattttctcagcttctcctatcttacctaacataggcttttctttgtgggctcaagagaaggccatctccctgatgccatctgcatgatccatgttgagcggttcacaccagtgccttctctgctcttcaatgtaagtgaactcaaggatgagactgaaagccagattgcgggggaaactttagtaacagcagaagcgactgttctagcttcctgaaagctctgaaagattccaatagaaaaactattggtggatcagaatgttcaccacgggcaaggcactatgctaaccgctacaggggaaatccaaatgctctaaggaatggtacacctctgctctaagataaggcaaaaagtacatggaatacactgtaatgattgattgccatgacagatagtgagtgatacggtgtttaagagaagaaacgatcacttccatgggagtagagggtgaagaattacatctagaagtgtgtgtgtgtgtgtcttaaaatccaccaaagtgttctcagaaaaaaaaagtgcatcttgatggctagggttgcaaatggtagagatgggctttaggtaggagaaatagcatcagaaaatcctgtgataaagcagtatgggttttaatacaggttgagtatccctaatctgaatatccaaaatctgaaatgctctaaaaatctgaaactttttgagtgctgacttgacactcaaaggaaatgctcattggagcattttggattttcagaacagggatactcaacatgtaggaggagataagagcgggttattgtaggttggagccattatggaaagggtcctatgcaagacttttgagggattgtttcgagcttgctttatacagggttaacttgaagaatgggttgaaaagccagttgagactactgacttataagagaggggataaggtactgaaactagggtgttaaagggattaaaaccagaagaggaccaggagactttgaggattgacaggggatggatttctggggtataaagggagtgaaaagcctttggattaacaaaggccctgagaagagctgacttaggctcacgcttacagggtatcatggcattgatctacttgtgcgtggaagacatcttccagctcattaactactacagcttcagctactggttctttgtggggctttctattgtgggtcagctttatctgcgctggaaggagcctgatcgacctcgtcccctcaaggtaaggcaactccatcctacctctgctccacctgaaacagctggagttgttgctacaagggactatgacaaagcactttatttagaaacctttgcctgggacttggtcgttagtaatgtgttgaaattaaaggtatggaaagaaggctcagtgcgctaatccttatgggaggtggggttattttagctgttaagaatcctgagttgtccactccagttatgtttcctgtgcccttagctcagcgttttcttcccgattgtcttctgcctctgcaccatcttcctggtggctgttccactttacagtgatactatcaactccctcatcggcattgccattgccctctcaggcctgcccttttacttcctcatcatcagagtgccagaacataagcgaccgctttacctccgaaggatcgtgggtaagccgtgcatccttaagtccgctcagctattgcagagcttggtttttgcctttttctgtaaatccagcctccaaagacatctttgccttagccccttcttatgaacccttcggcttagtggaatcactcccctcacactgagttccattcagtgacacttgaactcagcccagctgacctcttctcaattccaactcaaagttctctttgtagggtctgccacaaggtacctccaggtcctgtgtatgtcagttgctgcagaaatggatttggaagatggaggagagatgcccaagcaacgggatcccaagtctaactaaacaccatctggaatcctgatgtggaaagcaggggtttctggtctactggctagagctaaggaagttgaaaaggaaagctcacttctttggaggcacctgtccagaagcctggcctaggcagcttcaacctttgaacttactttttgaaatgaaaagtaatttatttgttttgctacatactgttccagacttttaaaggggacaatgaaggtgactgtggggaggagcatgtcaggtttgggcttggttgttttagaagcacctgggtgtgcctacctactcctcttttcttttaaaagggcccacaatgctccaatttcctgtctcctttagagagacatgaaactatcacaggtgctggatgacaataaaagtttatgttcctaaagtctgagtggcttcattttatatagtatctatctctaggacagctcccattagcctagaaacacaaagactaaaatcaatcttatgcttgaaagtatatccatcttttctctctcaagctagctgctgaaggctgataaaccaggctctacacaaaggcagacaacagaacacttaaactgctctagtcaaatgttggattgttacataaaaatgacatgaacttcctttttgagacaggatcttgctctgtagccaaggctggagtatagcagcatgatcttggatcactgcagcctcaacctcctgggcttaagctatcctcccacctcagcctcccaggtagctgggactatggacaagcaccaccatgctcagctaactttttagcagagacaaggtctcgccatgttgcccaggctggtctcaaattcctggactcaagtgatctacccacctcagcctcccaaagtgctgagattataggtgtgagccactttgcccagcctggaactttcattcttaattatcactaagaatttgcacacatctacttcttgaaatttttaaagtaatcttgggatcaagaagtgcggttactatatttagatacaatctcaacattcaacttatcagccacacctctagactgcaatccaaatgtgcatagaacaacacatgcatgggttggaagtttaaactgtttttttttttttttttttttttttttttttgagaaggagtctcactctcttgcccaggctggagtgcagtggcgcaatctcggctcactgcaagctctgcctcctgggttcacgccattctcctgcctcagcctcccaagtagctgggaatacaggcacccgccgccatgcccggctaatttttttttttttttttttagtagagacggggtttcaccatgttggccaggatggtctcgatctgctgacttcgtgatccgcccgccttggcctcccaaaagtgctgggattactggcgtgagccactgcgcctgggtggaagtttaaacccttaatgccaggttaaaacattatattttccaaggccatgggccagcaaaagcaatcatgactcactctattcttgttttcttttttttttgagacagtctccctctattgcccaggctggagtgcggtggtgcgatcttggctcactgcaacctccgcctctcggattcaagcaattctcctgcctcagcctcccgagtagctgggactacaggtgtgcaccaccacgtgtggctatttttgtaaaacagcagagatggcgtttccccatgttggccaggctggtctcaaactcctgatctcaggtgatccacccacctcggcctcccaaaatgctgggtattcttcagttttctgaagtgcacactcatttccctgttcaataagtatcaggaagcagcatgtagtacagaggtttactaactctgtgaatgggaagatcacttggctacccagtgctctcttataaacataagtacaagagtgtttcatgaaatccgtttttaaaatgaacatctctgtgtgccacagttcctaggactggggcaaggacacagtgtcaagtcttgttttgaggatgagtctctgaagagacagaattcctgccagaatgcgcacagaacataagtcagccaagtgtgtcgtgccagggatactttgactttggtttgctgctgctgctagggatattgggagggttatcctttccaggttgtaggagagggttgtgggtaaaggtctgtcgtaaaggacctgaggggagaagagaaaacaaatttcaacgaagaacagaaaggaagaaacaaaagacagaatttggcctgaaaggactatttacccctggctgctagctccaactgattccgcatgcgttgttcacgctctcgcagctgacgcgtcatttcagcatttttccagcctgtgtaaagagaagcaagagagtcagttgcattcctatttttagacc

SEQ ID NO: 16827 - DNA, 12537 bp, Human
tgagacggagtcttgctgttgcccaggctggagtacaacggcatgatctaggctcactgcagcctccacctcccacctcctaggttcaagtgattctcctgcctcagcctcctgagtagctggtattacaggcgcacgccaccacgtctggctaaattttgtatttttagtagagatgggtttctccgtgttggtcagggtagtctcgaactcccgacctcaggtgatccgcccgcctcgccctcccaaagtgctgggattacgggcgtgagccactgtgcccagcctggccttcatggtgcattttttaaatgctttggtttttccgactttcctttcctcctccccctgccccgacattattttgctcttgttgcccaggctggagtgcagtggcgtgatcttggctcactgcaacctccgcctgccgggttcaagcagttctcctgcttcagcctcccgagtagctggccgagtagctgggattacaggcgcctgctaccacgtttagtagagacggggagttttcatgttggccaggctggtctcgaactcctgacctcaggagatccacccgcctccgctttccaaagtgctgggattacaggcgtgagccaccgcgcccggccggttttccggctttcattcttttggggcacttgcattgcacccagggttccccagaacttatcctaccccacacccttttcgtatttcctatggctctgtccccaacgagctatggtgatctcagtcgcatggcctcagttcttttcttctagcgacctccatccaactttctattacacagcgccccctagacgttcaattcagcatgaccaaacccaaaccctgatttcccaaaccctctttccgcatttcttgctcactgcatggacagaatcctaggcatcaccccctactttgctttctcaggactccttgccagtcggtccctaagttctgccagcggcgcctgcgtggggtctcttgtaccgtgttctcctctccatccttgctgccgagccctcaacaccagtgggccccctgccttctggagttcccatttacctccctatgtctttccttgcttccttcctttccatctctagcagctaatgacatgagaaaatgtagattctctctggcctccatgccagccaatttcatgactgctgcccactgtaattaatgaattccttttctctatcttgaggtgtgtgtgtgtgtttaggcgtttatttacaccttttgtgtttgaaacacaaaacactacttcctagaatcactaggaagtagtagctgagttagcagtttattttaatatgtaacatagtaaggtgacaaagctcattttaatagcaccagccattaacccagttttctcagtgttcatatggacgtaaataatgacacaagaaaaacacttttgagggtagttacgggaaaagctgacattacatggctgcataacccaaccgactcaggatctgataatgaaagcgtgaagataataaagaagcatcaagctgcgaaaggaaaggaaaattacaaaatgctcacgcagcgaagctgcgaggaaccccaccgagccagccaggagtcgaacctggaatcttctgatccgtagtcagacgcgttatccattgcgccactggccctgagatggcactgtttctctccgtgatggtacttcaaggttatactgcagggtttcatgggcggtgtagtctctcaacggcgttcttcagatagactaagcattctgggagattgaagttcgtcaggaaccagaccctgagattggtggatccatgccgtacgccactgtgcagcccgcggattggcaggaaaagccactccccatccctcctgttcgggagctgtggcagacgctctggttgttaaggcgactcgtcccgccttctggggcactagtttgactttgtgattggctactagtatcaaggaatcccggcgtggacagcgcgaggagaaagatggcggcgatggcggtcgggggtgctggtgggagccgcgtgtccagcgggagggacctgaattgcgtccccgaaatagctgacacactaggggctgtggccaagcaggggtgagggccggacctccacgagcggaatgcggggtccgaactcggggacggagaagggcagactagtcatcccggagaagcaggggtgagggggtcggctaggatgaggaggggagagactattactctttggaggggaggagcctcggacccagtaacgtgaggaaaataacttgtgggaggcctgtggtcactgagtcccaaagttgggagagttgttgggtaaactctaaagggccctggaggtcgcgattattgtctgggagtgggaggaggtgttagggggcaagggagagaagaggctaattttgacgggggaggcatgggcagaactggggcaaatctggatgtgatggtcttggaaacatactgacacctgaggagaaaaaaattctacttgtggatatccatcattttctccttactcatatgtcccatggctgtgttttagggagaaattgaggcacagtacagcagagttgatatcccccaaggtggtctgaactcagcagcctagtaggctgaactgatggcagctgaaagggctgtgcaaaatcaagatagcctaaatccagttgcttggctctctggcactgctgctgtctttacatgattctgggtctgtcgcggttgtaggtttgatttcctctgcatgcctgtcttccatccgcgtttcaagagggagttcattcaggaacctgctaagaatcggcccggtccccagacacgatcagacctactgctgtcaggaaggggtagggaccatcccatatgccccttaattattagaggcaataacaacttctgctttatcggggccctcattctcctccttttctgacttggatatatttgttagtccctgggatatagataacttgttttctccttgcttctctattctgcatcaggctatcccatgtctatgtagaaaaaacctttgtctctcatttctactcttgattcccaaaactaaaaattgaacaagtaaagtgctgaaccttattcagtatttgtctttcttgggtgggggagtgcagactggaatacgctaattgtgggaaagctttctccatggattcgtccagactcaaaagtggagaagattcgcaggaactccgaggcggtaagactgtttgacttctctgctggatttttctaaccaagctgggtggggagagtggtcccctcccatccccaataacttggtaaattaactgatagaatgaaattaaagctattaggctgggtgctgtggtgcacacctataatcctagcactttgggaggctgaggctgtaggatcactggagctcgggatttcgagaccagcctgggcagcgtagtgaaaccccatctctataaaatatacaaaaattagccaggcatggtggtgcatgcctgtggtcccagctactcaggaggctgaggagggaggatcagttgagcttgggaaggtcaaggctgcagtgagtggagactgtgccactgcactccagcctgggtgacagagtgagactttgtctcaaaaaaaaaaaaaaaaaagctgtttgcttgttagctcaaacttttcctcttcatctccgttccaggccatgttacaggagctgaattttggtgcatatttgggtcttccagctttcctgctgccccttaatcaggaagataacaccaacctggccagagttttgaccaaccacatccacactggccatcactcttccatggtatagctgaggggctcctttcctgctgcatatcatagtagtcagattgtgctaagtaccttcttgtgcctagccattcagtgaagggtgtgtttggcagaattgaagtatcagtattggcgggcacagtgggtgatgcctgtaatcccagcactttgggaggctgaggtgggcagatcactgagctcaggagttcgagaccagcttgggcagcgtggtgaaatcctgtctgtataaaaaaccaaaaccaaaacaaaaacaaaaaaacacaaattagctaggtggggtgtcacacgcctgtagtcccagctacttgggaagctgaggtgggaggatgacttgaacctgtgaggcggaggttgcagttagctgagattgcaccactgcactccagcctgggtgacagagccagaccttgtctcaaaaaaaaaaaaaaaaaaaggtcagtattgcgcacctctccatctaaaagtggtatgaagagagtttcaaaacatgtaaatgtaattattttggaaacttacgtaagacaaggcagatatttacataaggatctatatataaggtacatgttcacttacaaaattacaaattgggaaaagcatataaagggattaacgaggtctggatgaagttttttttattgagggaaactttctggacccaatgagttcaaaagagagttctaaaagggtgactgttcatgtgcagttctggatgcgggtacccttggtggcaccagaggacctgagagatgatataattgagaatgcaccaactacacacacagaggagtacagtggggaggagaaaacgtggatgtggtatgtctccctttgctgctgtaccagggtgcaagggatagggtgaggggaagtacagggtgcaacctgtagggaggtctccttgagctgtggtgattggtcggccatatctagtttactgtacttttctgtatttgactgaacaggtggcacaacttccggactttgtgtgactatagtaagaggattgcagtgggtgagtccatgagaatcctgggatgggtgtggcttctcttacctcctgtgaataagaatcaggaatttcatatatagtatacaattttgctacttcccctctgtctcagactggctttctcttaaagaagtaaacagattttgcgcaaaggagcaaggaagggtttcttgcctggcagtggttgacagtttttcttttgcctcatgtagctcttgaaattggggctgacctcccatctaatcatgtcattgatcgctggcttggggagcccatcaaagcagccattctccccactagcattttcctgaccaataagaagggatttcctgttctttctaagatgcaccagaggctcatcttccggctcctcaaggtgagtggtaggagggttctaaaggtagtccagctatacatcttgccttatttacctgtgtatgatcgttttttcctgtgaggctgactctttttctttggtttctggggagcaatttcagtgaagttgggaatcttgagaacaaaaaggtaaatgccagtagtagccctagaaacctttcaaaacaaaccaaacctcatgagaactttgcagaaggtttcatttaggaagttacagcaaggatccatgaggctgtttgggtgttgatactttcatggcataagagggctttttcttttttctttttttttttgagacagggtctcactctgttacccagactggagtgcagccataccatctcagctcaccagaacctctgcctcccaggcttaagcgattcttctgctttagcctcctgagtagctgggattataggaatgcaccactactgcccggctaatttttgtattttcagtagagacaggttttatcatgttggccaggctggtcttgaacgcctgacctcaaatgatccacccgcctcggccttccaaagtattgggattacaggcgtgggccaccacgcccggccaagggggctttttataagtttactgaagcctcatgctgcctttgttggtattgggacagacgctagagaactgttggtctgggccaggtgcagtggctcgcgcctgtaatcccaggactttgggaggctgaggcggatggatcatctgaggtcaggagtttgagaccagcctgtccaacatggtgaaaccccgtctctactaaaaatacaaaaattagccaagcatggtggcacgcacctgtagtcccagctacttgggaggctgaggcaggagaattgcttgaacctgggaggtggaggttgcaagtgagccaagatcacgccattgcactccagcctgggcaatagagcgagactccatcttttttttaaaaaaaaaaaaaaaagagaactgttgatctgggccttattttacactagggctctttggccatataccataatattccagaatcttggtttgagggctgtgtctgatggtctgacttttctcacagttggaggtgcagttcatcatcacaggcaccaaccaccactcagagaaggagttctgctcctacctccaatacctggaatacttaagccagaaccgtcctccacctaatgcctatgaactctttgccaagggctatgaagactatctgcagtccccgcttcaggtgggtctggagtgcacttagaggaggaaggtgggatggaaaatgtttcttgagaatatatgcctccaaatcttactaaaactcagaaagcagtggaaagtttttgatattttagtgcattgtcctttgccagaaactggctaactttgtccttttcctcattcatcagccactgatggacaatctggaatctcagacatatgaagtgtttgaaaaggaccccatcaaatactctcagtaccagcaggtactgtgtggtgcccagggtgaggaaagcacagggccagcatgacctggggaggatgggattacaaccatgggatattctctcctccctccaggccatctataaatgtctgctagaccgagtaccagaagaggagaaggataccaatgtccagtgagtgctttcccctcaatctcagggacttgcatacctatatctgtatatgccaagtctgcttgactcttccctttctttcttagggtactgatggtgctgggagcaggacggggacccctggtgaacgcttccctgcgggcagccaagcaggccgaccggcggataaagctgtatgctgtggagaaaaacccaaatgccgtggtgacgtgagtagcaacctgcttgctgggaagttagtcctcattgccaaatttccttaacatctctccttaccttattgtctctgtttcaggctagagaactggcagtttgaagaatggggaagccaagtgaccgtagtctcatcagacatgagggaatgggtggctccagagaaagcagacatcattgtcagtgagcttctgggctcatttgctgacaatgaattgtcgcctgagtgcctggatggagcccagcacttcctaaaaggtgcccccaggttggggtgtaggtggagggtgatgatgggtgagacagcaacctgggaggagggtacagggtttaggggaaagtgggttggacctgggtcacatcatatgagtttgagagccactgcttcactgcctctgtgcccctagcaaatgaagtcatctctccaaaccttagtgttcatatttgtaaaatgaagggagtgggctgggcgcggtggctcatgcctgtaattgcagcactttgggaggccaaggcgggaggtcaggagtttgagaccagcctgggcaacatggcgaaaccccatcactactaaaaatacaaaaattagccaggcgtggcggtgcacgcctgtaatcccagctactcgggaggctgaggcgcgagaatcacttgaacctgggaggagaaggttgcagtgagctgagattgtgccactgcactccagcctgggcaacagagcgagactccatctcaaataaataaataaataaataaataaataaatatgacatatgtaccctgagcttagctttcatcaggaacttttgtgggactttgtgaccccacaaaagttaagaaccaccagattagactatcttgggttctttcagttttaatctgtgtgactctgtaaattaacctagtagtggaatcctccatgacagtagttggaagcaggctggcttagtaatgtgacaacatgcatttgtctctttcttccatgcccatgccaacgttggttggttttgacatgggaggtttgatccttctgatccttcagttagtacagacataccatttccctccctctggaactaatttgactctcctgctgtgcagatgatggtgtgagcatccccggggagtacacttcctttctggctcccatctcttcctccaagctgtacaatgaggtccgagcctgtagggagaaggaccgtgaccctgaggtaaagaaccactctctctggaaagaagtggtactctttagtcctcttctttttctgtatttgcatcagctattttcttctgctggggatgaagaggtgaaggagaagttagggattggggaagcactaaagtaaaactttttttaatccttggggaagtagttctctcttgtgtgtcttccccaacactctctctctctttctgtctctgacaggcccagtttgagatgccttatgtggtacggctgcacaacttccaccagctctctgcaccccagccctgtttcaccttcagccatcccaacagaggtaggttcttttatggctgtcctctgactagaggggtgcgggcttcttccttcctcctgctttcttcccttactgtccctagtctgccttatctactcttcctttcctgggtcttgctcatgctttatcaagttgtctagagcttctggccccttgtcacccacataattatttcctgacagatcctatgattgacaacaaccgctattgcaccttggaatttcctgtggaggtgaacacagtactacatggctttgccggctactttgagactgtgctttatcaggacatcactctgagtgagtgtctatggcagtagatggcagagtatgagggtgtgcttcctgggcagcttatatgtacatgtgtcatttagatttatggggggcccagtgctcaatgaatggagatctttgtgtgattagagaagagaccctcttcagcataggcaaaagtcacagccatggagacctctgttttttcattattttgtccacacaggtatccgtccagagactcactctcctgggatgttctcatggtttcccatcctcttccctattaaggtaggaactgcttttaagactctctagttaagcagtaacctttgcctttggtgttgtgcttctttccttctcccaggaagatagttgactatgactcatgttctcctgatttcatatgctcttggatcccagtggtaggtgttgggagtatttggagtggccttctgcctggctttcccgcatctactctggctactcttctgtctgttctctactttgagcaagagtcatcttttaaaaactcaaatttgatcttatctctcttgctgtctttttttttttttttttttttaaagagatggagtctcactctgtcgcccaggctggagtgcagtggcacaatttcggctcactgcaagctccgcctcccgggttcatgccattctcctgcctcagcctccctgaggctgagattacaggtgccagccaccacacccggctaattcttgtatttttagtagagacggggttttaccgtgttagccaggatggtctcgatctcctgacctcatgatccgcccacctcagcctcccaaagtgctgggattacaggcgtgagccaccgcgcctggcctgatcttatctctcttttttgcttaaaactcttcaatgccttcccattgtctttaggataaaagtcaaaatctgggacattgcttgtaagacttgatgtgatcgagtgtttgcttgcctttgcagctactgtccccttgcttacactgcttcagccttatggaccttctttttgttctaattgtctatcttctttcctacctcaggctttcatgcctttctcttgcctgtagagttctttgcttgtctcttcacacagttaacctatcttctaggtcttctttaaacatttttattgtgagataaactttctctgatctcctagactaggttagtgttccctttcataggtgtttttctgactctgtacatgttcacagctctcaccacacctttgattatttgtgttctgataggcttcaaataactttcatgagggttgggacagtcttgtcatgtttatcattttatctccacacctaccttaatacattgccatgtataattcatagcttcaccctgaaccttcctgtctttcttcttacagcagcccataacggtacgtgaaggccaaaccatctgtgtgcgtttctggcgatgcagcaattccaagaaggtgtggtatgagtgggctgtgacagcaccagtctgttctgctattcataaccccacaggccgctcatataccattggcctctagccctgcgtgccaagtgtccagagccttggaagcagcttcaggttctgctcctgtagtacagaaggtgcagtacatctatgggctgtgattccccttgcccatcagagaggagcatttcaatctgctttcctgccttacatcaaggtgggcaagggattataattaattgcagggctcaagccaccaatctatgaagacctcaggccagggggtgaggaattagtgctggatttgaagctacgcactcagcctcaagaactccctggaatatccctgagaacatggggtttgaacggattttcagcctttttctgttcttgttttgatggttttgtgtaagaggaaatacaaataaagttatagccctttactgcacgaccatgctgccccctgccactattttcccacacctcacttagacccaggcatgttcagatctgtcctcttagcctatccaagacccaaaggggcctagttgtattccctacttaggaagctgagcaatgactattgtagtcctggatataggcctttctgaccagctacagtgagctcttgtccattagaacctacagttaggcttttctctggggaggaggcatagagtttgccaccttggaaaaagatggaatagtgagtgaagccagtttctcttctgtattcttgagctactgcacgggcaactggttacctctcctttgttacctcttgggaagactggaatccatccaggaatctccagcaagaagctacctgttttttttgaataaaaccacagggttacagtttgaagtcctaagagatcatctagtccaattttccattttacagagggggagtttgaaatgggtacaatgatgtgatattagtatccaagtcagaattggaagtcaggtcctccgactctggctctccccatgttataaccagctacatttttggtagctacagtagaccacagaagtgtctaggggctcctggaggcccctggaaagtgagggtggacatcagttccttctttccggttagaggactcagtactgctacatccaaggagtcacctgagaaactttcaaatttacccttgcagtgggaaatgtgggggtactgatttgaacggaagttatgacctgtgggagcaggccatgacgatagggcagagtgtgggccaagacaagtctgtggcaagatctgcttttccctggtcccaagcaccgaggtcaggagaggtggtcgggaagcttgtttaggtagccggctcagaacggggatttcgagttcagcatccccggacgttaaacaaacgccgctgttctacaaagcttaaccttaacgaccgacgtgactccttcagcaaatccgagtagggacggccaaggatgtaaattgtgcctcctcgttggctccgcccatcgcactggtctagtctacgcgagcaccaggagtggggttggtggcttcttcactcccgttttcagtcccgttttccccgccctccgcaagtcatttaaccaatgagagagtgatgggcggctaccaaaggacgcttccattttctggagtctctgaggttagccaatcaatgggaactcggtggttgctaagacgcatttgagtttgctccacccatacttaggactttagccaatgagaacctgtactttggacggttgccgcgaaaccagtgaggttatttccaaagccggggagtcttggcgcatgcgcagattggggaaggttctggaagacggcagagctgccgccattttgcgggaagaggaggctctgtacctgcagtgctgcttttcttgcctagactctaggaactatccgagctccactccccacaacatactcaaaggaacggagagaaccgggacccccctgcggggacccggaactggtgagaaaccccaaaacccggtccccaccagacgtcaccaatgcgtgacgttgctgcacggcgcctcccccctgacgtcacgggcagaaaatggcgtcacgaagagattcaggcgaacttttaacattaaaaaaacctttgtttgttttgacctggaagtgttagctacttaaatgtag

SEQ ID NO: 16828 - DNA, 12707 bp, Human
agcggaagttaaaaaaggcagaacggggggatagactcccacctcctgggcctccccaggcaccccccagtgatacagactctgaagaggaggaggaagaggaggaagaggaagaagaagaagagatggcaacagtggtagggggtgaagccccagtccctgtgctgccaacaccccctgaggctcctaggccccctgccacagtgcaccctgaaggagtccctcctgctgacagtgaaagcaaggaggtgggcagcactgaaacaagccaagatggagatgccagctccagtgaaggcgagatgcgggtcatggacgaggacatcatggtagaatcaggtgagaggtttgggctggggcgaggggtttgagggtgttgtggatccaacagctcaggcagaataccaaacaaacctttttttccccaggtgatgactcatgggatctgatcacatgttactgtcgaaagccctttgcagggcggcccatgattgagtgcagcctgtgtgggacgtggatccacctctcctgtgctaagattaagaagaccaacgtccccgacttcttttattgccagaaatgcaaggaactgaggccagaggcccggcggttaggggggcctcccaaatctggagagccctgatggcaccaactttagcctggaacttccaaatgacaacatgatttgggaactgagcctcagggtcctcagcctatcccctggagcttggatactgtctgcacttcaaggcaggaattctcaagggagacttgtttgaaaatgagtgtctcactttcccaccctatccttcctccccactctgtggacttgaaattgaatccattacggttggggatgggaggctgtctgtgtcccgacacataatctctgtctcttggacctgccaccatcactttctgggtcaggattggaattgggatggaatgggacagttgtctataaaactctagtgtaaatattagcactcccctccctcatcttttcttctatttcactccccatttattttcttctacaccggttgtatttttaattttggacttcccctattgggcatggcagctcaaaggtggagtactagagcctggccaagtgaggaaggaaagcagaaaggtgacgattctcactcacctcttttgtttttaataatatcggccgctgtttgtacagacagcctgcgtgttgtaaataaagcagagtgggctcttttgtgtttatagccctcactgtcctgctcgggagggaggctttggtggctgaagactagctggaggtggggctgaaacccacgtctcaaagtccaatctgaagatatcacagcactgggcctttcccaccccaagacaagtaagccaccttagagctttcattgtatttggccctccccactcgagtctaggaacccccacagtccccaccttcactccctgcacgcacactcctgcgggtcagagttgcttcgtgctccatcgtgggtggggtaaagcggggtgggagccgatggtccgtttcctgaaggcacaggccagcttagcctgggtgctcagaggacctcggctggggtacacgtttgggggctgggagaccgttgctgaaggcagcgatcatgtggcggcggcactaggcggagtcagacggtcacgtgattgggaggggatcacgtgacggagggcggctgaggagcgcggggtggctgcctttaagtcacgtgacatgaggagaggtgggcgggtacctggaggaagctcgcggcgtcggtggcggtggcgcgcggcggccgctgagaccggggctttgagtcgcaccccgcggcccgccccccgccgccaccctcgcagatccgtgctttttcccctttgcttctctcccgtactgggtcagtcctgtccgcgctcgcgcgtcggtttgcgggtgtgcgcaggcgcggcaggggccattagccctttgggtgggcggtggagcccgggagcgcgcgggcgagaccatggcgggtagcagcactgggggcggtggggttggggagacgaaggtgatttaccacctggatgaggaagagactccctacctggtgaagatccctgtccccgccgagcgcatcaccctcggcgatttcaagagcgtcctgcagcggcccgcgggcgccaagtactttttcaagtctatggatcaggatttcgggtgagcgcaaggcctagataggaccggcgggggctttgctagagtggattgggcgacatggaggggcacacgtctactttgggccacactgggattttctggcctatggtggagcagattgtactatgctgaggtaggttgactatcccaggatggacaaggttatgcttggatagattgaggcacacggacagactaggatatcctaaaccagattagacaagattaggctttactggaataggtgggggcatactggtttatgttggagtattctagtctgtactgagtaaattgatccattgtctggttgtttagtacgttctcaggagtcctgtaacgcctgtaatcccagcactttgggaggctgaggcgggcggatcacgaggtcaggagatcgaggccatcctggctaacacggtgaaaccccatctctactaactaaaaatacaaaaaattagccgggcgtgggggcacgcgcctgtagtcccagctacttgggtggctgaagcagggagaatctcttgaacctgggaggcggaggttgcagtgagccgagatcgcgccactgcactccagcctgggcgacagtgcgagactccgtctcagaaaaaaaacaaaaaacacttgggccattatggactctactgggttgtattggttaatcctggtttctcttggggcaagacttggttttattggagcactcggtataggggcagacaaggctgttggggcctgtgctagcacaggcagccgtattgggatgttccaatctagactggtgcagacagctgcgtgtgggggcattgtaggctgtgctagaatagattgggctatcctagggtaatttgggacattcagggctatcttggactagattggcgtgtaaataatgcagagaaagcccttttgtgtttatggtctttggggctgagccttctgggtcctcaacctctgcttttttttttttttttttttttttttttttttttttttgagacagtctcgctctgtcgcccaggctggagtgcagtggcgcattctcagctcactgcaagctctgcctcccgggtccacgccattctcctgcctcagcctcccaagtagctgggactacaggcgtccgccaccacacccggctaattttttgtattttttagtagagacggggtttcaccgttttagccagactggtctctgacttctgacctcgtgattcgcccgcctcagcctcccaaagtgctgggattacaggcgtgagccaccgcgcccggcccaacctctgcttttttgaaggcaggctggattaagttgggatagcatgggttttagaagaactgaacaaactggactctagctagaaagattgtttgacatggggatgctgatactatcttgggagttatcttggctttaaggcaaggtttttctagttgtcagcaatgtaatcttggacaatttatttaaattttgtgtcttgatctcatctgtgacatggagaaaatcacagaatgaaatggttagttcacgtgtgtggcacacgggaaattcttggtgaatggtaattgtaattagcattgaggctgaccactctgtaaagtaggttatggtgatacagaataatttgcctcagagtggaccaagctgtgctgagattgtgttatgttgggaagaatcctacattatgctgagacgggttagtagtgactgggctgtgttgtcacgttgacagcaaatggattatgttgatatatatcctggctcccatgaccatattaggctaacgggttaattagacaaggtgtcctaatttggggctaaggttgtgtgtggaaagagagagaggaacaactagggtagagagtctgatgctttatacgtttattcatttagtcgacagtatttgttaatgcttaagtgtcagtgtgtggtgtgtggctaggacatggtgttgaccagagtaagtgttcatggtttgatgtcatggtcaagaagaaggggcaagtccggtccaccacagggaacccattggagagatgaccccaaggctgggctttgggatctgtcaggttgagcagattgctttgtgcagaattttgtgcccagtgaggcacaggggaatgggaaccccagcttgccctctccttgggagctttcagtctaatgaggaacttccattgtttgtttgatccaatgggtggtttttttttttttttttttttctgaggtggagtctcactctgcccaggctggagtgcagcggcgcaatctcagctcactgcaaccttcgcctactgggttcaagcgattctcctgctttggcctccggagtagctgggattataggtgtgcaccaccatgcctggctaatttttatatttttagtagagaaagggtttcaccatgttggccaggctggtcttgaactcctgacctcaggtaatctgcccactttggcctctcaaagtgctgggattacaggtgtgagtcactacgcctggcctctaatgggtgtttttactcaagaaaggacagtcttctagaaatgaattagagaaaactaaaggaaagtataagagtagaggctttgatgaggaccaaagccttttttggaaggtttttttttttttttttgagccgcccaggctggaatgcagtggcgcgatctcgacttactgcaaccactgtctcccgggttcaagcgactctcccatctcagcctcctgagtagctgggattatagacacccaccatcatgcccggctaatttttgtattttagtagagatggggtttcaccatgctggccaggctggtcttgaactcctgacctcaggtgatccgcccgcctcagcctcccaaagtgctgggattacaggtgtgagccaccgtgcctgacctttttggaaggtttgtaaggaacaggggtggggttgagaggaggccaccagccagtctcattagataggtatctcaggcagccgcatcagcgtgcgggattgcttttgaaactggactaagaggtttgagtcagactcaaggaagtctttggagcagcactgtgcccctgagggtgcgttagggagaggagaaataaggaaaggggattgagtttggagatttcttaggtgtcggagtgagttctttcaatgtaagagaagacctgaacagggcaggagaaagtcaacatcctggagccaggtgaagattgggagaaagtttgatgggggtcggggtggggatggttggtccagctcactgacctctaccttgtcgcttggcagggtggtgaaggaagaaatttcagatgacaacgcccgcctcccctgcttcaacggaagggtggtatcctgggtaagaggttctgacaccgaggaccaggccccctcagcattgccaagctccctcaagcctcagtctgtttctgtatcctccccaggccgcgcgttagcagccctggctctttacctcctgtctgtttggagagccggcgagaggccctcagccttctccttctggagtctctaatacttgctaggtttttttgctcttctccagctctctgagaccctttctcattctttcacttactgccacctgtcacaccctgactcccaagtgagccactgtttatcatttgcacccttctagctggtgtcctcagataatccccaacccgagatggcccctccagtccatgagcctcgggcagaactggcgcctccagccccacctttacctcctttgccacccgagaggaccagcggcattggggactcaaggcctccatccttccagtgagtccttcagattcttgactgcaggggagggaggtgaggagggaacccaggcctttggtaggggacgcctaggatccggagccctgttctcctgatgtgggttggaaaccatctctgcctgtccagccctaatgtgtccagcagccatgagaatctggagcctgagacagaaaccgagtcagtagtgtcactgaggcgggagcggcctcgcaggagagacagcagtgagcatggcggtgaggggcaggcctgggggccgggaagggctgggccagaccccagccttggtggggtgagcagggggaagcttggttcttgagcttcctgtccatatgtagctgggggccacaggactggtggcccctcaaggctggagcgccacctggccggatacgagagctcctctaccctcatgaccagcgagctggagagtaccagcctgggggactcggacgaggaggacaccatgagcaggtgtggctccgcacagctctccccagcgcacccagccccgtctcgtcttccagtcaatcctcttgttctttctcttggccccatgaccactttggcctacgtttgctctccttcccaacctcctggtaggttcagcagctccacggagcagagcagtgcctcccgcctccttaagcgccaccggcggcgaaggaagcagaggccaccccgcctggagagggtgaggggttcctacaggaaggctggtgctgggagaaggtggggcatgggctttggtttgggcggtgccaggacaccggcagcaccccagggttgaccctgggttattgaagggcactctggctccttttcccaccacagacgtcatccttcagcagcgtcacagattccacaatgtctctcaatatcatcacagtcacgctaaacatgggtatggggagagcctgtggctagggcgtggggagggcctggtctctagggttccgggcgtcctgtggcaggggctcctcttttcacatggcctctctccacagagaagtacaacttcctgggtatctccattgttggccagagcaatgagcggggagacggaggcatctacattggctccatcatgaagggtggggctgtggcggccgacgggcgcattgagccaggggacatgcttttgcaggtgtgctggggtagggccactgagctgccctgcacgggggccctcagcctctcccaccgtgtctctgacccacttgccgtcgcttccaggtgaatgacatgaactttgagaacatgagcaacgatgacgctgtgcgggtgctgagggacattgtgcacaagcctgggtgagttgccaagcaggttgccggtcctcagtcctctttttttttctctttcatgttttgttttggaattttaataagtactaagacagccgggcgtggtggctcgagcctgtaaacccagcactttgggaggcccagatgggtggatcacctgaggtgaggagttcgagaccagcctgaccaatgtggtgaaaccgtgtctctactaaaaatagaaaaattaagtgggcatggtggcacatgcctgtagtcccagctagtgaggtggctgagacaggagaatcacttgaaccctggggggtggaggttgcagtgaaacgagatcacgccactgcactccagcctgggcgacagagcaagactccgtctcaaaaaaaaaaaaaagtgctaagacataacgttcaaagtacatgaaacaaatgcatgacatagcaaataatactagagtaaatatccatgtcactgccatctagatcatcaaataggagattgctgataccctagaacttcctcctcagatgtcccttcctgctcccaaatgcctcactgccccaggggtagtcactctcctgacttctttggccatcaccataacaaagaaaagctttgcctcactggatagttaccacccttgcacgtatccttgaacactgcagtttcgttttacctgtttttggactttctgtgaatggaactgtacagcgtgtactctcttgtctcacttggcagtatgtttttaagagttttccatgttgatgagtcatccacattgtggtgccttccaccctcaccttctctagcccagccgcgatgtgcttgcttctccccctctttgtgtctcttaatccatccttgcttcagacccccgccctcctgaggcctcctcttcccctgcgcccttgactggacttctcttccccatagccccattgtgctgactgtggccaagtgctgggatccctctcctcaggcctatttcactctcccccgaagtgagtgacactcagggaggggcctgaagttgggggtgggggctgcccaggaggctggggccgggcctgtggtcatggggaatgggtgggaggagggtccaggcagaggtggaacaggaggctgagtcagggagggactgggctggcttttggggactgagaatgggtcattttggtgccatctttgtcccagatgagcccatccagccaattgaccctgctgcctgggtgtcccattccgcggctctgactggcaccttcccagcctatccaggttcctcctccatgagcaccattacatctggatcgtctttgcctgatggtgagccgccagcccacctcatcccaccctcccagcagaaggctgtcccgcagtggtctgatccattgcccttgtgggagcgatccctgactctggttacccgttgtctcctctgccaggctgtgaaggccggggtctctccgtccatacggacatggcatcggtgaccaaggccatggcagctccagagtctggactggaagtccgggaccgcatgtggctcaagatcaccatccctaatgcctttctgggtatggctgggtcctgggcaggtggctggagaaggggaggaggtggtgaccaaagccaggaatggcacaggcagaggcgagagcaggagttggaagaagaacctgaggcctttttccactgtgggtgctcccaggctcggatgtggttgactggctctaccatcacgtggagggctttcctgagcggcgggaggcccgcaagtatgccagcgggctgctcaaagcaggcctgatccgacacaccgtcaacaagatcaccttctctgagcagtgctattacgtcttcggagacctcagtggtggctgtgagagctgtaagtccccctgccccaactctgggagtgtggctttgcctaccttgttctgcctctccaaccctagacctagcccagaaaccgcagccagggccaccatggatggtcgagcagtgtgtgtcccgcactaggtcctgcactggccgaggatgggggctgacgtccacccatgtgctgctggacaagccatgtgccaggtgcaggactgtgtccaccgggggaaggtgcacctcttacctgagtcccgcaaagacgtgggctagtggctgtgcccctgccctcatggcagaagtagatgggagtttcttgtcagagacccttgtgaacccctgttttgagccccatcgtgggtgggtctgggagaactgttcccagttcctctccattcggtgtcttggggccctagcctcttgaagcagtgatttcttcctctcttcccttgctttccagacctagtcaacctgtctctcaatgacaacgatggctccagtggggcttcagaccaggataccctggctcctctgcctggggccaccccctggcccctgctgcccactttctcctaccaataccctgccccacacccctacagcccgcagcctccaccctaccatgagctttcatcttacacctatggtgggggcagtgccagcagccagcatagtgagggtaagtcatccccacatacctgtacggccaggatctgagggtggatgagaggggagccagggaggagcctgggtgaggactcagttgcccctcccctccctccacaggcagccggagcagtgggtcgacacggagtgatgggggggcagggcgcacggggaggcccgaggagcgggcccccgagtccaagtccggcagtggcagtgagtctgagccctccagccgagggggcagccttcggcggggtggggaagcaagtgggactagcgatgggggccctcctccatccagaggctcaactgggggtgcccctaatctccgagcccacccagggctccatccctatggaccgccccctggcatggccctcccctacaaccccatgatggtggtcatgatgcccccacctccacctccagtccctccagcagtgcagcctccgggggcccctccagtcagagacctgggctctgtgcccccagaactgacagccagccgccaaagcttccacatggccatgggcaatcccagcgagttctttgtggatgttatgtagcccactgtggggccaggctgggccgggcgctcctggtgtgtgactgggtgtcctggccgtcatgtgcttgctcttacagtgcctgggctcagcctaccagctgctgccatacaggagattgtggccactgtgactctcaccagcagtgcctggttcctcccccttccctcaggggtagacaagggacctttgattatttttagctttgtttttttataagcctttttgggggttaaaatagagtttcttacatttttgggacttttttaataggcatttcctcttttatatgaagaattcccatccattgggccccttctaaccccagaatgtgacctcctcctccagttacccacagccctgccctttgcagggttgggggtggtcagcggtaccccggggttaggcatcctagacagcagcctgaggaagctgggagatttgggccatgtagctgcctttgttactctatttattttagtcacttgtataaaacaccaaataaagcaatagaggcaaactccccacgcctctggctcctttctttgggagggaggcaggcagcagggggaaagaaccgtcacacaggagcaaagcatgactggctagaaatttttattatttgcgaggcagtaagtgctcttgagagcaggcacagtgctgggaacactaggccccttcgggacaaaccagggccttaaggaaaggggcttcggctttggcttgagggaaggcacataactgggacaggccctggccgggagtattcagaagccaagtgggttgctggtgaccacaccaccccgctccaccaaggccttggagatgcttttgaagttgcggtagagctcttgctgccaggggtcagactgcagggcggccatgccctctcggatccgagctgcagcctggggagagggaaggaggggttgggcctgcacctccagccctcacctgagcttggcagccccgagtctcacctcgatacaccaggtgtcacagagcattttctcatgctgggccgtggggtggccctcactcagggatcttgaggccctggcaggaagcaggagatgaaaataaatctgggccggctgggatccaggcccaggccccctgcggctcaggcattccctgcctgcctcctcacctcgagagaaccaccaccatggcatagaggtcgatggccccgtctgccagccgctgcagcagaaactgttcatctgtccggtaggtggggtgggggtgggggtgggggcattagtctcaaggagaggaaagggaggggcggaatggtgtagagctcacttactgacaatccccttcttgtgttttatcagcttggcctccaccacagtggcaaactgctccagagcccgtactgccttaagagatggggacagtgcggggctcagaggggccatcggctgcagtccctgatgcaggctctcctggacccctggccgcttaccagctcgccactccgactcaactccgggtggacaagtccgctgagactcaggccgctgcccagccctgcccgcctgagaggaagagggagaatgactggttagttgccatacaccaccctgccctcccctggctctggccctaagcctaccgcctcagctgtttgcctgcctctcctagcaggaggccagcattcccaaagggattctttagagcactgccaagcccagagagctcctttcctttgtcctatgggggaagagggtccagcagtcaggactcactgtcctccccacctctacccccacccaattctctgtcttaccatacagccctgcagagccacaaacagccgaagaatgtcatttgtcccctcaaagatccggaagatgcgaagatctcggagcacacgctctactccaggttcctagcacagggccacacaaattatatgcccgtgctgagatgtgcctacccacccctggcccagccgaggctctgcagaagaccgtcctgtaccttcatgaagcccataccccccatgatttggatgcattcatctgtcaccttccaggctgcctcctagggacaaagaacagatgagactggttttgggagctgagcacccaaactggactccctcccagcatgcctgggacctcaccgagccaaagattttgctgatggcggcctctatctggaagtccgtggctccctggtccatgttagcactcaccatgtaagccatggactgaggttgcatagttgggacatgggaaggaaaattgcaaagggctttgtcagacttggcctcatca

SEQ ID NO: 16829 - DNA, 6253 bp, Human; identical to SEQ ID NO: 12023
  misc_feature (1)...(6253): n = A,T,C or G

SEQ ID NO: 16830 - DNA, 6691 bp, Human
ctgccgtcctttgaagggagaacctggggtagggttcgaggagcctggcgagaactgtgcacctcctcgggaggagcagccccctcctgtgctgctttccccctcccttcaatatgctggggcggagaccctggcctccaaagtgcagtgagtactgggaggggtggggagagatttccaggggctcggatggagagggcccaagcgcagccactggggtcttcatgattcgccctccccttttctcatctcgtcttgctagctgccagtctccaactcagccctttcttcattcattgaacaaatactacttatatactcttctagtgggcaaaaaaaggaaccttgctcttgtggaacttctgccttttctctctacaatgttcatacgtaataagtattatttatttatttatttttatttttattttttttgagacggagtcctgctctgtcacccaggctggagtgcagtggcgtgatctcactgcaacctccacctcctgggttcaagcgattctcctgcctcagcctcctgagtagctgggactacaggcacgcaccaccaagcccggataatttttgtatttttagtagagacggggtttcgccatgttggccaggatggtctcgatctcctgacctcgtgatccgcccacctcggcctcccaaagggctgggacaggcgtgagccaccgcgccccgccagtatttagtatttttaaaggtaataagtaaggactatggaaacagagaaagaatggggcggagacagcagtgcggttggtgtggacatcctaagaaggtgggagagattcgagcaaaggcttgaagaaggaagtgaagggtgtagctgagcaggctttgggaggaagagcatttcaggtagaacagctagagcgaagttcccataaggtgggagtatttcctaggtacagcaaggcttgtgtggttggaacagactttgcaagggggaggtgatggggcgagaggcttcactcccttattttttcttgtctgacagattccgggaccccaaatcccagcggacgcaccaggctcaggtggcgttccaggtgtgtgtgcgccctggctcctacaccccgggacccccttccgctgcccttggagaacctcctgaccctcacttcagtccagccgaacttgagtgggtcactaaggagaagggggccacactcctctgtgccctgctggtacgggtggaatgaggggtgagacaccactactacaagcacagtcgggccgcgggcccatggactctgagtggcgactgcctccacctcattcccgtgactcgtggcatgcgcaggtgctggagcttggcagccgcgcaggagcatgtaggcaggctctcagatgtaggtggcaagtggcacagctccatgtccggaggcccagcactccgtctgatgggaggagccgtgggagcccagctccaggccctggtacccctcttcatgcactgatttggggaacatgactcccttttactcccctaccccacatcacttaatttatttccgtttttgtttctggttactgtgaatcccagaggagtctctccctgtgcccacatgaagctgctttttccggggccaccgggcgggagtggggaagggtgggcgcacggaagatgggggcctctgtacagttgttactgactctgatttctaaggagccaataaacaccgtctcagagcctccgcctcggcctctctctcgcgcgcccctctccggagcccgcgtcccctggggtgccaccaggtgggcccgcgaaattaaagagagctgaggatgccaaggccagtctgcagccgtcgtcgctcacgttcccggcgacggggtttgtacgccgcgggcacccgtcgcagcgcgcttccgccttctttcacctgtgaggtcggccgccgccgtgactccggaaggactcggccgggccgccggatgtgacgcaggggccagggcgcgtcggagccgctgagaaagcgcagagaaggcgggtaggaagggcagtcgtccgcgctggctgggcagggagcggcagcagcgagccggggaccccggcgccgcccgcgcgcggtgggactggggctgcggtcccggccgggtggcgggctcctgggacacgtgaccggggcggcgagcgggccgggcggacgggcttccgcctgggccgggcgcggccccctctgagcgcccgcctccccgcaggccccgtctgaggtctggcagtcagagacagccgggcgcccacggcccgagcgcccacggcagcaccatgcccgcactcctggagcgccccaagctttccaacgccatggccagggcgctgcaccggcacattatgatggagcgggagcgcaagcggcagggtgagccggggccatagcagggggacgcacggcccagaatggctcctgtacctcaaggctggcctcaacccaccggccaaccagcgcgcccgctgccgagcgcagaggagggaaggaatagccccgttgtggtgggatttaagcgtcctgttccacgctccagaacccttgagatgggaaggaccttggagagcacctgataaagcctttccgttccctattgccgcgatggggagcttgtcccctcgaggcaaagagcatacaggcgtgttgggatgactgggttttgctggtcttcaatctgtaacgttggaattgttttcactaccctgcctcttcttcattctgcctgattctccagaggaagaagaggtggataagatgatggaacagaagatgaaggaagaacaggagagaaggaagaaaaaggagatggaagagagaatgtcattagaggagaccaaggaacaagtaagcagtcccttgaactttcccagctttgatttcttcgtttgactctccctgccttcatcttcttttcccaccccatcccagattctgaagttggaggagaagcttttggctctacaggaagagaagcaccagcttttcctgcagctcaagaaagttttacatgaggaagaaaaacggaggcgaaaggaacagaggtgggatcagagtgctaaaaactgaaatgggggccaagtggaactgggatcaggtagtaaaagaaccagtgtttaatggcaaaagagaaggcatctgtccttgactttgacctgtcttcctttcactccagtgacctgaccaccctgacatcagctgcataccagcagagcctgactgttcacacaggaactcatctcctcagcatgcagggtgaggactaaagaaaccaccagatggaaccggccttcttggaggtcacagcctcccatttcagcatcatgaagcccttctccctttctagggagccctggaggacacaatcgcccaggcaccctcatggcagctgacagagccaaacaaatgtttggaccccaagtgcttacggtgagagtaggattggatgcctagcccctagtacttccatccatgcatccttgccaccagtattcaagtcacaaacatatcaagcacttaagtttagggggaaacggggcatacagatacacacaagtcactgggtttcagctttcaaggagtttgtaggcgagttctcattctccttccttagacccggcactacgtgggctcagcagctgcttttgcagggacaccagagcatggacaattccaaggcagtcctggtggtgcctatgggactgctcagcccccacctcactatgggcccacacagccagcttatagtcctagtcagcagctcagaggtgagtaataggagggatggggcttggccttcctcaaggtcaaaggaggaatgccattcagtaaaagattttaatggctctgtcttttcctttctcagctccttcggcattccctgcagtgcagtacctatctcagccacagccacagccctatgctgtgcatggccactttcagcccactcagacaggtgataacatcccatgcaggagctctagctctcaggtcctcccctccctgtttcattctcatctcacatgcccctcttccccacctaggtttcctccagcctggtggtgccctgtccttgcaaaagcagatggaacatgctaaccagcagactggcttctccgactcagtgagtatggcaccttgggaggtcagggttagggatatgttaaggggagcttcagtatgcctcaggccctgactctgttctctgcagtcctctctgcgccccatgcacccccaggctctgcatccagcccctggactccttgcttccccccagctccctgtgcagatgcagccagcaggaaaggtaagaatggtaatagaatttacctgtcagaatccctacactagggatccggaaaagcaggattaggtaggacaggtggcccacatcatctggtttttccttcctctttgggggtggttatcagtagggtattaagtggaagggagagtatgcccagtgacaaagccctcttttcatcaccaccaccagtcgggctttgcagctaccagccaacctggccctcggctccccttcatccaacacagccagaacccgcgattctaccacaagtgaccatcagattatatcttcaacaccacaccccccaccccatcgtgggtgagggtatcccctgtgtgtcccaggccaataaaatctacctgccactgcccctggctgctgctgtttgtgttgcctcccacccaactgtctggaataggtcaaggttgcttggagggtggggggatggctggcaggtccacagcaagtcaaagtgatagacagcgggttccagtgaactcagtggcagagttcagtctttttgtggcttccaaatacacccatttaattcaaataagcagctgagttgggggcttcatattaaacttgtagttttattcaggtttgattttaacaaatgtgtcggggagagagcccgcagggaagggtaaagcccatgggggcagggccctcccagatgcctgaggagggggcaggtcccctcccctctcctcctcttccctccccatctaaaggggtttggggagagacacaggcaggcgagggggctggtccccagtctgttggggtggtgctcagggtaaagggctataggcaacaggggaccagaccagggatgagtggggagggcacaaggaccatttgccagaatccaccgctttctgattccagattgaattaaaaaaaaaaaaaaaaaaaaaagactaaaccacaagcagcacccacccccttctcccccaccagggctgtagtgtgaggggagaagaggagggcagcttcaccaaggccacagcttcgctcgctcctggccaagggagctaggtgaagggcaggggctccccgacagattgagggggtggggaaaaccaaaataaaacgtcaaataaattgtgtaggaggagtccagcttaggaccgggccagagccaggccaggctcggggagggggcctctgcaggttcagaggatcactgctgccaccaccgccaccctaggtaggagagagaaattagtaagacaggataataccttcaacaggaaggatagggaggacagagccaggctaggggcagaaagtaagcctgaaacaattaagactacagcagctctgctgaggacaacaaaatgtgaaggggacagtgagggatttgtcacactcacctgggagccagttattttgccatggccttgattgcaacagctgcctcctctgtcatggcagacagcaccgtgatctggagaagcaagagggatagccaagagatgtctgagctcaggaagaaacgtacagaacaaagctgagcacaaaagcagggagggaggcaccataccaggatctcttctccacagtcgtacttctgctcaatctccttgccaaggtctccctcagggagacgaaggtcctctcgtacctccccgctgtcctggagcagtgataggtacccatcctggatgccaatcagctgggggcagatagggaaggaggctgaaggtagtaggcccagggaggctgacatgacagtaaaggctctgatagacaaactggactgatagcaaactaataccaaacaccctctcctgccatttccctcctctctcccagcacaagctctcctggtcagtccctatcccccaacccctccctccaccataaaccgctaacccatcctcatccagaccatctacatacctggaagtcattccttttgatgttggggacatccatattatgagttgacgggcagatatcttcatatttcttcccagtaaagatgtcaataccaaccagatggacctgtatgtatgcatcacaaagagaaacccaaccaaactctaaaacggaggaaataaaggctcaaattgaccttgcctgatgagggaagtcagaattacattgttggggcaaagactggagtgttggaattgaaccagtcaactcaagaaacagtaaagcctcttaaagaaaaaaaacagaggctaaaaaaccaccgttgagattggggttgacagcacaatagaaaactgcatggcaggcttggagaagacagttaccttgataaaagataagatgctaagagtctaggggagtgggaggagtctgagtaaaagtttcgaagagttttccggacaccaggagaaggagctgagaa

SEQ ID NO: 16831 - DNA, 6691 bp, Human; identical to SEQ ID NO: 16830

SEQ ID NO: 16832 - DNA, 5992 bp, Human
tactgaattgcagaggcagctgtgtctgatggagtttagaccagtgtaaactttgaataggatagagaagaaagtgtggttcacattttctggatcccaagtaagagagactggatcatgagatcagggaaccaacctctggatcaccaaatgccaggagggcttggatggtagggaatgtctcccacctgaatttctactcaccgcttcttgcttttctgttttctttcccactttcccctcagggtgactctgtcagcaagcttcctaagggcccctcggagaatggggagctctccgcccccttggagttgggtagtatggtgaatggggtttcataaaacctccaacctgcacccctcccttctccatctcgcttgctgcccaacaccatggccctcacaggcccaactgacctgcgctggagctgctcttatctaggggggaggggggtggcacagcagcttgggtaccccccaacctccaggagctagtggaggggtgtgtaacagggtcataccccctccctcttgtccaccctacccccagggtaaggggagcctctctccttccccatcagactggatgtgcctttatcctctaatgccccaatctctctctgaacacccccattctccacctgttggtggggggtgctcctcgacccacccagatttgaccgttcagggggcctcccctgctatccctcctcccatcctgtaccccccatttctggggcctcatcactgtggaagacggggatagtaagagataagtgggtgggaggcacggggaaggttttggagtagaaccaggggtgtgtatgaaggggggtgacaaggtccccctggggaggggaccaaccttgtctggtggatgagaaggcgtatttatttttcactgtacagtatttaaaaagagaataaaaaaatccaaatggctgtctggctcctgtgccttctttgtccccagtttggtccatttgtttctctaggactgacctgccctggcccctggctcttgttttctgttcctccacatctgacttctcttcattgtctcttgtcccaaagatggtcttacttctgggaattcctgacattcctaaactccccaggcccaggttctccctcctggttcagaggaggggggcttgtgccttgttgcttctcccctcccccaagtttgctggtagagggagttgggccactcctataccctgagtcacagcacaggctaggcagggctgctcagagctggagctgttcctgtagaagctgagagccaaggcaggctgcttaatccgattacctgaggcctggggcttgggctgggccgttgggcagagtggggagcagggttccctcacagcagcctctggagcccggggtccggccttcttggtggtgttctgttctggctccaggctttttctccggcatgcgcatcacagacctcttaacttggggagttgtcctgggtttcctggctcccccctcatgacttggacgactgaagctaaaacttgccataattcaatagcagtggagaaatataggtttagggactggagttgggagggcttaagttttctcacttgggaaaggggttgaatcacggcccaagcacctgctggaatgactcaggaaacaaaaatggtctccctcctcggcctttcttgccccaggggcagttctgggatttgaggagcaacaggcaccaggaaaggggttggggtggtggtccgggatgctcccaagctcctctcagcacaactcgggccctgagggcacttcatccccctgtgtttgatcccattgtggaaagaattggctttaaattgcctgtgcttcagggaggggaggcaatcagcaacgggctggaaggcctgacatcaggtcttgggtggggggggcggggggcgtggcaccctgagggtgttgggggctgggacaaacaggacacctgggtttacctacgggctgaggatgttggcgcccttaaggaggtgcagtcttatgggagggacaggggcggagtcagtctttaaaagctgttcccaggtctggcccgcctgccacaaacgctgagcccaggtgggagaggtctggcctatccgcgcctggcagctgtcggaactccggagaccacaaaggggtttatggtttaccccctccacggaaggtcggtctgatcgcagctgcgggtcggggagagggaccgggggtcccccagtcagtaggcctcagaacacctcttcagtgccggggcaccagacagcggattttgcattcgactctccccaaagtgtgccgaacaggttggaagcaaaggctccggtttaagctctgggcttggggataaaatacactttttaaggacccaagttcctcggcaacgactccagactgggaagacctttccattttcaggatcgacgcttcacgttgaggggagggcattcaggacgccctcttaaggcttctcccaacccatggcgctaccaggctcctcacaggaccaggcctggagcctggagcctccggctgccacggctgctgcctcctcatcttcgggaccccaggagcgggagggcgctgggagccccgcggcccccgggacgctgcccctggagaaggtgaagcggccgatgaacgcgttcatggtgtggagctccgctcagcgccgccagatggcgcagcagaaccccaagatgcacaactccgagatctccaagcgcctgggcgcgcagtggaagctgctggacgaggacgagaagcggcccttcgtggaggaggccaagcggctccgcgcccgacacctgcgcgactaccccgactacaagtaccggcctcggcgcaaggccaagagctcgggcgccggaccttcccgctgcggacagggaagaggcaacctggccagcggcggcccgctctgggggccggggtacgcgaccacccaaccgagcagaggctttgggtacagaccccccagctactcgacagcctacctgcctggcagctatgggtgagtgcctgggaagcgggccgaagacggaggcccatgcgcccctcttctggagccttggtgggggcggatgccggaggacgggagcccacccaagcagaggccactcgcggccaaggtgtggcgggcgcaggcccagtacctccggggcctgtgtagggtggggcggatcagggttctcccagagggcgtttccatctcagtctgaaggtggtgggccctgtagggtcaggtgactgacccctggatgcgactgtgtcctagttagatgccccgtttcccccctgcttctggcctgtgtgtgacccagcttcctctcccagcccccagggcaaggagaggccgagctcattctgccctttcctggcctgactccccaagaggaaaacagccgtgcagcacgcaagcccgctcccgagcgtgccccaacagggccgcgggctctccatcccggggtcggcttccatgcctgctgcgcccagcgggctgggtagccagggctgggtgggtggcacgctctaccctgtctgcccagaactggccagactcacctccaacccagggaagtgccctctaacctcttgtttctctctgcagctcttcccactgcaaactggaagccccctcaccgtgctccctccctcagagtgaccctaggctccagggggaactgctgcccacctatacccactacctgccccctggctctcccactccatacaaccctccccttgctggtgcccccatgcccctaacccacctctaaccctcatggacgcagacctcacgggacgggcctcatcctccttttttaatccagcagcatcccctaccccaggctgtcaaccctttctcctgttggactacagttcagaggcagcctgcagtcctcccatgatagccagggagagccgcacaacatacaattatatttttggtagtattaaacagttttgtattattcaactgagtctccagtctttattgtcccatctgttcccctcactgcagcaggaaccagccccatctccactcccttccgcctagacctgccagagcaggaacctcctcaccccaccctggggccctgcctgagtcattctccgtcccccttcccccaccccagcactggggtccgggagacagtcccagccgggctgagggagggaggcagccacagcctcccagtccctccactctgccgtccagactcagtcttccagggccagaagggaagcagggaggctggaggacagggtaaaacatttgcccaggatagtgttaaacagctggaaattgctgctagaggaggaggcttggctgaatgactgaattaatagtacatgtacagggcttacgaaagcactcaaatgtcaaaattttggcttgggagactctacccccatcctctccttttctaaggatctggatccatcaaccatttgtttccactaaaagaaaaccctggctcagaaagtctgcaagtgcagaggaatggaggatgagtaagtcacaccagcaggctggctcagatggggagaaccctgaggttgggtgaatgagtggaaacggaatgactccagtagctggctctactgcgcctttttctgcttgtggggaggctttgcattccagtagaagagcagctgggcggcgatgaggccgttgcagagagaggagaccacaaaggtcccagccatcaggggatctccggtttcctggttgcaagagacagagccagggttacccttcagcatagctcaagaaaggttcccttatggacaaaggttcctcacggggcagctttggcccttagctgggagaagtaagacgaggttttagtgccttctagaaggaagatgttgcactcacctgaatggaagtgaagattcgggccagggagcccccaaacagcaggaagactgtgatggctgagagctggcctgtgtgcccgttgtggtagttggtggctgcctggagaagctaggggaggagttgagacctttggctctgtcacctgagctcttcccatgctcccccaagtacaacacccccacactttgatcttctactcttccccccgaccctgcccccacaacatcttgtcccttgctcctggtacccaccctccccaccaccacagcaggcacattggaggcctggagcagggtgactacagtcaagggcgtcagaggtgagagaagcaccagcaggaccaggccgtagcaagcgaggaaagcgacacctaggggtggggagacaggagtccttgtcaatctctccacatcatttggctttcccagacctgagttcccagcagggttcccaggaaccacacagcctgctcttgggtaagtccccagcacctttcacagtctgtcctctgtagtgcatgaccaggaagcagatggtgatcgtctggagcatcaggaataaggcttcaccccaagagctgcagagtcaagagttgggaggaagaaaggcgggcctagaaagaggcagggaaagcctccatagcccatccatccagggacactatgctctgatcacgcttctctacagcccccacacgggactggctcattctgaatcgtggccattctcgggatgctcaccccttctcaagatcacctccactggtgatgattaggtttctaaaagggcttaaaactttcctagccccttgtcccttttttttttttttaagactgagtttcgctcttgttgcccaggctggagtgcagtggcgcaatcttggctcactgcaacctctgcctcccaggttcaagtgattctcctgcctcagcctcccaagtagctgggattacaggtgcccatcaccacacccagctaattttgtatttttagtagagacggggtttcaccatgttggccagttcgaactcctgacctcaggtgatccacccgcctcggcctcccaaagtgctggggttacaggtgcaag

SEQ ID NO: 16833 - DNA, 8345 bp, Human
aacccaggaggtggaggttgcagtgagccgtcatcgcgccactgagccaagatcgcgccactgcactccagcctgggcgacagagccagactgtctcaaataaataaatatgagataatgcagtcgggagaagggagggagagaattttattaaatgtgacgaactgcccccccccccccccagcaggagagcagcaaaatttatgcaaatctttgacggggttttccttgtcctgccaggattaaaagccatgagtttcttgtcacatgcctttctatgccttccatggctgggtctcagggagccggaagcagctgctgaggagggatgaaaatgtcagtgtgtgacgatgcctcatgggttcaccccccaaagcctggcacagctggtgttgggtctgccgtgcctcccttccttcctcctcttggggccactggctgctccagttccccatccgtggcaagccggtagagccattcatccccgcagccttcttcctgaccctcgtacagtttcaaatgcagcagacagccaaagcaatgagtggggggctgtggaacttcattcccaaaggcagcgccagtggctcctgagcaatgagaatgtcctgtcctgtccaccatattcaaggccagcagaagagcccgattaaaccctcgcagcacctggcatgctcctatcccacctgcaaggggttgaatcaagaaggagcagtgggtactctgacctccactgggggctcctgggaacagcatgccccccacacggggccacctgccaagcctaacttcatgcccccagtacttgagatgaggagtgtcactctcaggacagccaaggtccagattctagaaaggacctcccagatggccacagcctgcaccagcagtgagcgccagtcccacccattacagctggctacggcgcaatccctgggagccaggatgagcagcaccccccagccgtaggagccccaggaggcttccggcctccaaggcccagagactgccccacaagggcagccctcacctggcagggccccagcagccccacctctgcctgcagacatccgtgtgaccttgtagactttggaggggggccgccaaagggctgatccacagcggaatgacgcacgggtgggcaccgtgggttggcgtcccggcggtcggtaacgaagcacaacgcccccaccaggtagtccaaggtgccctttcccaagcagcgctgcagggtccactcggcctcgccgaagtctctgcccagcacgtggtgcgccctcgggccagcggggagggggcgaatcccgggactgcctcgccaggcctcggctccccggagactcttgggggtctgggccccaagggtgattcaggtgctgcccttccccgacctgggctcgcctcccccacctcctcctctgcttcactgtcccgggcccagcagttgccggcgcactcatgctccgaggcctgagccaaccggaggcgagacaagcacagggccctgcgcgcaacccggcacctaaggaggcctgcccggtgcagactctcctgctcccaccggcgcccttccctctagagacgctgagagaacgggagctagtagcgcccccacccaacgccacctcggagactccggctccttctctctcaacttcgaacaatacaaagtgtgctaggagaagacaagatggcgcccagcaggaggagcggagaaaggcaggggtgtaaatctggcttccaaactggaagcgtcaacaaaggcgtgggaggtctaaccgcgcaggcgtgcagcttcggcaagctttacaattccaacagcgcgtccaaaacgtggtccctgactgagacttattttacgccactagagtgagggtgggtagcgtcagaaagagcggggcacggggcgggccagcttcgccgcgggaaaagaacgggaggcggagtgtccgcagcgcgcacgcgcaacgaaagtcaatggcggtctggagagactggcggaagctagctttgcaatatggcggccgaggcggacggaccgcttaaacggctgctcgtgccgattcttttacctgagaaatgctacgaccaacttttcgttcagtgggacttgcttcacggtgagttttattcagcatccgatccaagtcctactcgagtgaccgtgggcccttagtccaagccttgatcggcgactaagtgacggcagtgactgccgccatgccgagctggacggaagtcacttctgagaagggcggaagtgtctcgggctccttagagggaggacaccatattagtgccagtggggaagtcaccgggtggaattacttctttgtggagtttgtgctgtagcgacaatgaaaaacgaagagtcaacttttataaaacaaaataaaaattaagtcaaatcatgccaacctttattagatcgctagcagggttaaacttaattcaaagcccctgatgaatcgggccttcattgcacccccaaaggctccgccaccctgattgctttctttccagcctccaggtttgctcatagtctgatttcggaataatttgcctcccttcctttttctgattgcgagacagctccacaagggtcaccgtcagaccgtttggggagcgtcagtctgcccctgtcagttcatggtacctctcttgagctcgtggggcactttgttttagccgcattcatgacccgtgagagtcagactcccactagaccaagttccttgaggggaaggcttcaaggctagagaagttgtggatggccagggcataaaagcaagccttgaaagggtaaggtttagtccctgagtaggggccagggacagtcagagtgttcaagaaagagtggtatggggcgggcacggtggctcacgcctgtaatcccagcactttgggaggccgaagcgggtggatcacctgaggtcaggcgttcgagaccagcctggccaatagggcgaaaccccgcctctactaaaaatacaaaaaattagccgggcgttgtggcaggcgcctgtaatcccagctactcgggaggctgaggcaggagaatcgcttaaacccgggagacagaggttacagtgagccgagatcgtgccattgcactccagcctgggcaacaagagtgaaactccgtctcaaaattaaaataagaaaaaaaaaatggtatgaagacttgtctttggagagagaagacatgtgaaatggggcacccattggcccagagaagggaaataaaggatcagagagctcttgggcatttctcagctttatatggggaagcaatggagagccgtggaggtcaagccaagtttgggtgttaatttatagggaatggaagattggatgtggggggtggtaggcatcggagaaaagctgttttggaaagtaacagtctggggcccggtgcggtagctcgagcttataatcccagcactttaaggaggctgaggcaggtggatcatctgaggtcaggagttcgagaccagcctggccaacatggtgaaaccctgtctctactaaaaacacaaaaattaaccgggcatggtggtgtgtgcctgtaattctagctacttgggaggctgagacaagagaattgcttgaacccaagaggcagaggctgcagtgggctgagattgggccactgcactccagcctgggtgacagagcaagactctgtctcaaaaaaaaaaaaagtgtggtggtttggagcaggaaggaccaggactttctcactgccctccgcctctcctccccccaagacaatgcaagaccctggtgtgggtaagggggctcggggagagcccacaggagcttcaagccctggcctgggtttcagacatctcctgtctgcttacccttttttctctcctcagtcccctgcctcaagattctcctcagcaaaggcctggggctgggcattgtggctggctcacttctaggtatgtctcttatctttctttccagctgttgggttggggtggaggtgctgagaggccatcaactgtgtgggtgttcgttctatagctgttgtgttgcatcccaaagaatggagagtcctcagtcctacttttctcatctttcccctagtaaagctgccccaggtgtttaaaatcctgggagccaagagtgctgaagggttgagtctccagtctgtaatgctggagctagtggcattgactgggaccatggtctacagcatcactaacaacttcccattcaggtgaggggcccacccttccaccccaagggtaatacccacaactctaatggggattaaggtgaaggaggttacaaggcagcaaagtggccgggcccagtggcttgcacctgtaaccccagcactttgggaggccgaggcgggtggatcacctgaggtcaggagttcgaactggccaacatggtgaaaccccgtctctactaaaaatacaaaattagctgggtgtggtgatgggcacctgtaatcccagctacttgggaggctgaggcaggagaatcacttgaacctgggaggcagaggttgcagtgagccaagattgcgccactgcactccagcctgggcaacaagagcgaaactcagtcttaaaaaaaaaaaaaagggacaaggggctaggaaagttttaagcccttttagaaacctaatcatcaccagtggaggtgatcttgagaaggggtgagcatcccgagaatggccacgattcagaatgagccagtcccgtgtgggggctgtagagaagcgtgatcagagcatagtgtccctggatggatgggctatggaggctttccctgcctctttctaggcccgcctttcttcctcccaactcttgactctgcagctcttggggtgaagccttattcctgatgctccagacgatcaccatctgcttcctggtcatgcactacagaggacagactgtgaaaggtgctggggacttacccaagagcaggctgtgtggttcctgggaaccctgctgggaactcaggtctgggaaagccaaatgatgtggagagattgacaaggactcctgtctccccacccctaggtgtcgctttcctcgcttgctacggcctggtcctgctggtgcttctctcacctctgacgcccttgactgtagtcaccctgctccaggcctccaatgtgcctgctgtggtggtggggagggtgggtaccaggagcaagggacaagatgttgtgggggcagggtcggggggaagagtagaagatcaaagtgtgggggtgttgtacttgggggagcatgggaagagctcaggtgacagagccaaaggtctcaactcctcccctagcttctccaggcagccaccaactaccacaacgggcacacaggccagctctcagccatcacagtcttcctgctgtttgggggctccctggcccgaatcttcacttccattcaggtgagtgcaacatcttccttctagaaggcactaaaacctcgtcttacttctcccagctaagggccaaagctgccccgtgaggaacctttgtccataagggaacctttcttgagctatgctgaagggtaaccctggctctgtctcttgcaaccaggaaaccggagatcccctgatggctgggacctttgtggtctcctctctctgcaacggcctcatcgccgcccagctgctcttctactggaatgcaaagcctccccacaagcagaaaaaggcgcagtagagccagctactggagtcattccgtttccactcattcacccaacctcagggttctccccatctgagccagcctgctggtgtgacttactcatcctccattcctctgcacttgcagactttctgagccagggttttcttttagtggaaacaaatggttgatggatccagatccttagaaaaggagaggatgggggtagagtctcccaagccaaaattttgacatttgagtgctttcgtaagccctgtacatgtactattaattcagtcattcagccaagcctcctcctctagcagcaatttccagctgtttaacactatcctgggcaaatgttttaccctgtcctccagcctccctgcttcccttctggccctggaagactgagtctggacggcagagtggagggactgggaggctgtggctgcctccctccctcagcccggctgggactgtctcccggaccccagtgctggggtgggggaagggggacggagaatgactcaggcagggccccagggtggggtgaggaggttcctgctctggcaggtctaggcggaagggagtggagatggggctggttcctgctgcagtgaggggaacagatgggacaataaagactggagactcagttgaataatacaaaactgtttaatactaccaaaaatataattgtatgttgtgcggctctccctggctatcatgggaggactgcaggctgcctctgaactgtagtccaacaggagaaagggttgacagcctggggtaggggatgctgctggattaaaaaaggaggatgaggcccgtcccgtgaggtctgcgtccatgagggttagaggtgggttaggggcatgggggcaccagcaaggggagggttgtatggagtgggagagccagggggcaggtagtgggtataggtgggcagcagttccccctggagcctagggtcactctgagggagggagcacggtgagggggcttccagtttgcagtgggaagagctgcagagagaaacaagaggttagagggcacttccctgggttggaggtgagtctggccagttctgggcagacagggtagagcgtgccacccacccagccctggctacccagcccgctgggcgcagcaggcatggaagccgaccccgggatggagagcccgcggccctgttggggcacgctcgggagcgggcttgcgtgctgcacggctgttttcctcttggggagtcaggccaggaaagggcagaatgagctcggcctctccttgccctgggggctgggagaggaagctgggtcacacacaggccagaagcaggggggaaacggggcatctaactaggacacagtcgcatccaggggtcagtcacctgaccctacagggcccaccaccttcagactgagatggaaacgccctctgggagaaccctgatccgccccaccctacacaggccccggaggtactgggcctgcgcccgccacaccttggccgcgagtggcctctgcttgggtgggctcccgtcctccggcatccgcccccaccaaggctccagaagaggggcgcatgggcctccgtcttcggcccgcttcccaggcactcacccatagctgccaggcaggtaggctgtcgagtagctggggggtctgtacccaaagcctctgctcggttgggtggtcgcgtaccccggcccccagagcgggccgccgctggccaggttgcctcttccctgtccgcagcgggaaggtccggcgcccgagctcttggccttgcgccgaggccggtacttgtagtcggggtagtcgcgcaggtgtcgggcgcggagccgcttggcctcctccacgaagggccgcttctcgtcctcgtccagcagcttccactgcgcgcccaggcgcttggagatctcggagttgtgcatcttggggttctgctgcgccatctggcggcgctgagcggagctccacaccatgaacgcgttcatcggccgcttcaccttctccaggggcagcgtcccgggggccgcggggctcccagcgccctcccgctcctggggtcccgaagatgaggaggcagcagccgtggcagccggaggctccaggctccaggcctggtcctgtgaggagcctggtagcgccatgggttgggagaagccttaagagggcgtcctgaatgccctcccctcaacgtgaagcgtcgatcctgaaaatggaaaggtcttcccagtctggagtcgttgccgaggaacttgggtccttaaaaagtgtattttatccccaagcccagagcttaaaccggagcctttgcttccaacctgttcggcacactttggggagagtcgaatgcaaaatccgctgtctggtgccccggcactgaagaggtgttctgaggcctactgactgggggacccccggtccctctccccgacccgcagctgcgatcagaccgaccttccgtggagggggtaaaccataaacccctttgtggtctccggagttccgacagctgccaggcgcggataggccagacctctcccacctgggctcagcgtttgtggcaggcgggccagacctgggaacagcttttaaagactgactccgcccctgtccctcccataagactgcacctccttaagggcgccaacatcctcagcccg

SEQ ID NO: 16834 - DNA, 9901 bp, Human
gttcaagcaattctcctgcttcagcctcctgagtagctgggactacaggcacccaccaccatgcccagctaatttttttttttttttttattgagacggaagctctgtcgcccaggctggagtgcagtggagcgatctcggctcactgcaagctccgcctcccgggttcatgccattctcctgcctcagcctcccaagtagctgggactacaagctcccgccacgacgcccagctaattttttttttttgtatttttagtagggacggggtttcactgtgttatccaggatggtctcgatctcctgacctcgtgatccacccacctcggcctcccaaagtgctgggattactggcgtgagccaccgcgcctggcctaattttgcatttttaagtagagacggggtttcaccatgtgggcaaggctagtctcgaactcctgacttcgtgatctgcccgcctcggcctcccaaaatgctgggattacaggcataagccaccgtgcccggcttgagataatgattcttaacatgtggtatgtagagcaagtgtactcccgccctagactgtgagccccgtgagagatgtggcttcagtgtaacctctctggcctccccagggctacagcacacagtctatagaggtgctcaataaatgtttgttgacccaagtagacacataaggaggtgagttccgacgtgggggtgggggtgccaggaggcagagaaccgaagtagacctggctgcagggctgggatctcagggcagtgctggggactgggaatgtggtgttgagagggcttcagggagacgtgatgggaagatggggaagcctctgcacgtggacagagccaggtggtgtggacaggggctgtgagattggagaaggaggcgtctgggggactggtagcggctcccaacaggggaacgtccctctgggggtggcctttatccatctctgcggggcctgtcctagcttccctcctggctcggccagcctcccggctggtctcttcgctctctttcttgatctctagctctttattcctctgacattctgccccatctgctcccggactcttccgccgcatctgtatcttagtctctttctaactccctgcctggggcccccacctttgagcatatatcggcttctctctctgccgttgtgtttctctggggttatctttccctctactccgcccggacacgccctctatctcttcctcccaccctgtcccagtctagtacctggggtgggggtaatggagagacagctaggtccctaagagaagtcaggggggcgggcccaacctctccatatttacatatgtatgaggtcgcctgggccagtggcgaggaggcggagcttctgggggtgggaagggggcgggcacccccagagccgcagagtataaagaccgcgctcggcgaccgcgggccccgcactgctgaggagcggagcctccgcctggggggccccccatccctggctgtcccccagctgcgcgtccccgccccacccccgcggctgagccaccaccggtgcagtggtctccgcttggcggagcgagccttgagcttcgttccacagcttctttgcatcttggatttcggggcggccccctcccccacctctctctgcctttttgtaccccgctttttttctgcgttctgctcggtttttgtagccgtctgtttttgcaccccatttcgttttgtttctagacggtttggcggggggtgaagctgcattcataccccttcctcttgttattctcccctgctctgacagcaccccttttcatcgcagttggggggcctaggatcggtgcatcttccgccgcgctgccagcaccccgcagcgcgtggtcgtgcaccccggaatctgcagcagctgcatatctgaggggggtctcctttgcccgcgccgccttcgctccccgtgcttttgggtgtgtggagggcttcagtgcgcggcgcccccgcttctccgcaaccccccgccccgcgcccggactcgccccgcgccaccaagatggtcatccagaaagagaagaagagctgcgggcaggtggttgaggagtggaaggagttcgtgtggaacccgaggacgcaccagtttatgggccgcaccgggaccagctggggtacgcagggccggcacgcaaggggcgggggaaagccgcggggcgacgcctcgggggcgcagggtcccgccgacgcggccccagctcccctcccgggtccccggcgtccagcctccctgccgggctctgggctgggagggggccgaatcgccagtctaatctccccggctggccgtgcggaggcggagaaagtaggtcacagccgccttcccgccccccgcggagccccctcgggcggggggtcgccagctccgcctgcgtgtccgcgccgcggcgctcacactccctctcggggcctgtccgctccacacgggcgtcccccacctccaaagagcgccccttccctccctccggctctcactagctccgcagccccgtctatttttagctcgtgcccaccccctggaccctgggaacgttcatgagggggcgggtcttggggggtgtgttaggggggttcttcacggcggaagttgtctgtatcccaccgcctggccttgggagccttctgggactgctttgtgggttggggggctgctgatagtatgagttttaccgaggctgcaggttttgctcccatgtcggtgacggagggaggagtggtcgctgtggtgatttgtgtgcatcagccagccaggtgtctgtgacagtcggatgacttggaagcctccccaggctgaccatggcaggactcagggagctgtagtggtcgggggttgggggggtggagggggtctggtgaccggcacaggtgcaggtgaggggtggaattcttccaagagggatggtcaagctgggacgttgagacacaggggacagaggacactgtgtgacacgatttacaatctttccacactgggcaccgtccccatcagtccacccattcggggcctacacgaagtgggtcccatgcaatccattccctcagggaactcaaactccagcccctgggatgagaagaatccagcaatgcttgggagagccagaggacttcatggaagaagtgtcctctgagatggaaggattgggagtccagggtggtgggaacagccggcccttgggtccttacttcaggcgggggagccatggagagatcccaccaagggaaggctgtgggagattctgcctttcctccctgcctctgcccagggtgctgggtgtgaactgagggtggggtgactgttgaaggttctaacaagccgtctctgagagatttgtagctaggctagtgttaggtctttcatttcaggaactgtgttcaaagtttggcttctgaagggcaccaggagagagatgttgctattcaaatctgagggtccagtctctgcggggtggtatgagggtttgcttgtgaatggtggccagtacccgctttaaaaggcaccatgctagcacagctttaagcatgagtacgaatgcagaggtaacagatgtgtgccttgtcaggactatgcatggttgagaagttggaaatgtaattggaggcaaaataacagacctccacaaggtcgggcttcactgtgccctaggaccaggagggggctgggagtcatggctagaagccagacacaactgcctgtttccagtttgtctcattttgcctccagaggaaggctctaagacatccctgtggctctgtgatcagtcccagtgcagaacttcagagtgggtagaggggtgtgtggggatagttgaggttatggtgggaaccttgggccctgctgaccctgtttcctcctccctagcctttatcctcctcttctacctcgttttttatgggttcctcaccgccatgttcaccctcaccatgtgggtgatgctgcagactgtctccgaccatacccccaagtaccaggaccgactggccacaccgggtgagtgtggaggctccccctgccagctactctaactgctcttgtgcccccaaacctccagaaggaactcatagttccttccaggagtttgattttgatgacccaatccccacgtgcttggaagttcttgaaatctgtccaccttcccatttactgcagttgggagctgtgtgatttgggcatgtggcagatagccacaggagatcaccctcccatgaagacgatctcagatattcaccgctgtccccactctggtgttccctgtgtccattttcttccctctgtgtgcagtccctcatcttatagatacccccaacttctgcctttgttggctgtaggcttgatgattcgccccaagactgagaaccttgatgtcattgtcaatgtcagtgacactgaaagctgggaccagcatgttcagaagctcaacaagttcttggagcgtgagtgtgggcctggttatgtgtcagttcaagacttcgggcaggggactggggaccttggaagtggaacatctggcccctgagtctctccctcccacctctttagcttacaacgactctatccaagcccaaaagaatgatgtctgccgccctgggcgctattacgaacagccagataatggagtcctcaactaccccaaacgtgcctgccaattcaaccggacccagctgggcaactgctccggcattggggactccacccactatggttacagcactgggcagccctgtgtcttcatcaagatgaaccgggtatctatgaccttggtccccagggtgaatggaggaaggatctggggacaccacctgcagacaattgcatcctttcactggggctaatgggcatgagaaagacttggatgtttgtgtagctgagagaaaaagagaggtgggactcttggaggctaagctctgcagttagaaggctggatgccttttgttttttttttagacagggtcttgctatgttgcccaggctggccttgaactcctggaattaagctatcctcccgcctcaacctccctagtagttgggactacagtccccggcttagcttggtctggatgcccatcttcgacaacttcttcctctgactctcttcaccttccaccctcactccaggtcatcaacttctatgcaggagcaaaccagagcatgaatgttacctgtgctgggaaggtgagttcgttgggccttgtctgcctgctcacctgagtggctcacctgagtgtccttcatggtttctgtgtaattcacctgtctctccctatcttctttgctcctagaggccccatcaccatagaaacaagggggtaagagtgggcttttgggctccactgtagcttgaactccgagggccccgcactcctcttgcttctctctgggatgcagaggcctgctctcctaggggccagacacacgccctcctccaccaacgccctggcctctggcttctctccctaacgcttccaccttctccttcattcccagattgtccgtatcgttcgctctccctcccatatggcccccacccgtcagttccttctaggtgtctggtagctgctgatctgttagcaccatctgccaccagttcgttgtccttgggaccctgttccccgcttcccccccggtctgtcctttctagaaactggctgctccctccacatccccttccttgcttcctattcaacccttaatcatgtatctcttctttcttggctctgctccagaaactgattcctgaggatggggtaagaacttggggtaggagtggagtaggaggctttcgtgccattagcagccttcaggagttcctagaatgatgacagggacagaccatcccctcatctacacacgcacatgcagacacacacacacagactcacagctccagggaggcagacttgagacaggaataattggggcgaaggaagaacaaaagaacaaatggaagtctggtgagctcctgggtgcctgccatccctaactggctcaccccctatcttcctgcacccccacagcgagatgaagatgctgagaatctcggcaacttcgtcatgttccccgccaacggcaacatcgacctcatgtacttcccctactatggcaaaaagttccacgtaagtcccaggggaggcccaggctgatggcgggtgcgggtggtgagctagggaaggaggccgcgttgccccaggcctagaccctgcactgctcctccggcccaggtgaactacacacagcccctggtggctgtgaagttcctgaatgtgacccccaacgtggaggtgaatgtagaatgtcgcatcaacgccgccaacatcgccacagacgatgagcgagacaagttcgccggccgcgtggccttcaaactccgcatcaacaaaacctgaggccccttcctcccaccccatctctctcctgtggatgctcctggaatgtccctgaccctgcctgatccctccctcacccaccccaaaggtatttttgataacagagctatgacttgtctgagcctcacatccttttccttgacttctcaacccagcctgaagtccattgcggttccgtcactcgcctttcccaccaacttctcccaacctcagatcagtcagacagggagctgggctaagatggccacagaggagttaggagcctttctagttctggtttagctgtgagagctatccactctcctgcctgcatatcccctgagagttataggaagtgcccactgacccacccacccacctacaccccccgccacacacacacacaaacgtgcacacgcgtctcatttgacccctttgcttccagagatgaatgtggcactccctccttccattcctaagctctagccaccgtcccttgatctctcatactttctccctgtctacacagtcgccatcttggtgactttgaatttatctggctcctgggcaggtcttctcctcctctccatccctattccctcctctgaaatgcacccctttgtaattgaggacaaggtggttctgtggccttttccctctttgctggcacgttctgcttctcaccctctggtgactctgtgagctgggaaatgagggactggaagtgaggcctgtgttgacccttcctgaaaatcctctagcagcccccgacttcagcagtttctttctttgtttttttgagatggagtttcgctcttgttgcccaggctggagtgcaatggtgcaatctcagctcactgcaacttccgcatcccaggttcaagcgattctcccgcctcaggttcccgagtagctgggactacaggcatgtgccaccatgcccggctaatttctttctttcttttttttttttttttgcattttttagtagagatgggggtttctccttgttggtcaggctggtctcgaactcccgacctcaggtgatccacctgcctcggcctcccaaagtgttgggattacaggcgtgagccaccgcgcccggccttcagtttcttcctaggccgttctgtcacccaaatagctgctacccagaggggcggggttgacctaggctgaatatccactttgtttttatggatggctcccttcccccattcgccttcccagaatatccttcaagttccacttcccagggagctctgggggaggggcggccattctggctccgtccccagtggccaccttggaaacatcggctggctttgggactattccacctccttcccctgagcccagatctgcccccaccatcctttctctggcttcttttagcaagttatcaactaatcactaactccttccttttcctctgcatgccagcctgaaaattccaaatctagcctctgaatgtcttggctccatctcttcagacccctttgcctttaaaaaaaaaacaaaaacaaaaacaaaaaaacccataatgcccacagaatgtcaaatgaggggcctcctgcctcctgctctgaatattctgtagctgtagaggcattttaaccctttgtcctccagcatcccttcacttcctcatcctctctaacctcctttttctttttttaatgctgcagcctccacactccacccacaggtggacccttccctttttctctagctggatctgtgtttcttcccttcgggcccccatgttttcctgcacccgccctaccatggtctctctctgcagttatttaatgcctgtgtcagatctactgtaaaaagaggattaagtaaaataaaatgagagcaattatatatataaatatatatcatacacagagccctgtgtgtgggttgttcctttctgagcagttggaagagcccagggaaggagtggagggtggatctgggtggtcccaaggggatcccccaggccttggaggccgctccccagctttgatctcttccttccagtgtccaagcatctacccccttcgccttgactaatttagtgcgcactatcttgggataactccatacaagagagacaggaagcctacgtcccttttgtacagtgatgcttatgaagtgcctactgtgtgcattctaggcaccgtgaggacacagttatgaaagaggcagagatcctgcccccaaggagctccccagtttaacaggagaggtgaggagcacacgagaaactctcatgcagggtagacctaaacatgcttcaaggaaagggagagaacctgtgatgataaaattcagagccgtcaaccgctgtctgtcaggcacgttaaagggaagctttctcagaggaggtagcatttgaacgggagcttaaaggaggggtgatttggagagaaaagagcatcagcaaatgctcagagacagatgagaaaagttgactagaagaaacatgaatgtcaaagcaataagagccgggcatggtggctcacgcctgtaatcccagcaccttgggaggctgaggcgggcagatcacctgaagtcgggagttcaagaccagcctggccaacatggtgaaaccccgtctcaactaaaaaaaaaaaatacaaaattagccgggcgtggtggtgcccacctgtaatcccagctactcgggaggctgaggtaggaaaatcgcttgagcccgggaggcggaggttgcagtgagctgagagtgtgccattgcactccagcctgggcaacaagagcaaaactccatctcaaaaaaaaaaaaaaaagcaatatgaactataagatcctaattttgtggaaagtaaacacacaggccgggcgtggtggctcttgcctgtaatcccagtgctttgggaggctgaggtgggaggattacctgaggtcaggagttcgagactagtctggccaacatggtgaaaccctgtctctactaaaaatacaaaaaattagccgggcctggtggcagatgcctgtagtctcagctacttgggaggctgaggcaggagaatcgtttgaacccaggaggtggagggtgcagtgagctattgtgccactgcactccagcctaggcaacaagagcgaaactccgtctcaaataaataaataaaaaagtaaacagacacataaggatagaaaaaaatatatatgatgtttcctgtagtatatgggggaggggaggggcttatagctaatttttattttcttatcggggccttttttctttttgcaatgaattggtcttcgtatttgtcttaaaaatagctttattacacatgaatccacctatacacaattttatcatgaatgcataatatacacacatgcacgcacacacacacacccctcatcatatagaaaaggatcactgggttttggtcattgttatactaaaattgggtcataccatacacactttcatgcatcttacttttcccactcaataaatatcatatgtcagtacttcccctggca

SEQ ID NO: 16835 - DNA, 27525 bp, Human
ccatgttggccaggctggtcttgaactcctgaccttgtgatccacccatcttggcctcccaaagtgctgggattacaggcgtgagccaccgcgccgggccactattattattatttgttgttgttgttgttgagatggagtctcgctctgtcgccccagctggagtgcagtggcacgatctccgctcactgcaacctccgcctcctgggttcacgccattctcctgcctcagcctcccgagtagctgggactacaggcgcccgccaccacgcccagctaattttttttttttttttttttttgtatttttagttgagatggggtttcaccgtgttagccaggatggtctcgatctcctgacctcgtgatccgcccgtctcggcctcccaaagtgttgggattataggcatgagccaccgcgccctgccattattattatttttaaagaagaaatttcactcattgcccaggctggagtgtggtggcatgatatccactcactgcaacctccaccttcctaggttcaagcgattctcctgcctcagcctcctgagtagctgggactccttccgagtagctggaactaccacggctaattttttgtattttagtagagacgaggtttcaccatgttggccagaatggtctccatctcctgacctcgtgatccgcccgcccgtgatctcggcctcccaaagtgctgggattacaggcctgagccaccgcgcccgtcctaatttttgtatttttagtagaaacagggtttcgccctgttgaggctggtgtcaaacttttgggctcaagtgatccaccgcctgagcctcctaaagtgctgggattacaggagtgagccacagcgcccgtctgaaactattcttaaagctttctttctattctttctttcttttttttttttttttgagactgagtcttgctctgtcgcccaggctggagtgcaatggtgcgatcttggctcactgcaacttctgcctcccaggttcaaggtagtctcctgcctcagcctcccgagtatctgggattacaggcgcgtgtcaccacgcccggctaatttttgtattttattagatgcggggtgggggggggggtgggtttcaccattttggccacgctggtctcgaacccctgacctcaggtgatccgaggacctcaggtgatccacctgcctcggcctcccagagcgctgggattacaggcgtgagccaccgcgcccggccaaaactttcattgtatcacaatctcttcaaggtaagagccatgactgttaaatctactacagtagagagttacagattcttaaaatatcggcgatgcatacgcgaagagggtaaagctcagcgcgtgcgcaccaagcacctttttccttgcggcgactcctcttcttttttttttctttttggagcgtgcgcaccaagaaagacaaaggtggggaaagtgaccaagcagtcgttcaggcgcatgcccatccctaacttgtccaagcccggtggggccagcggcggcggagtgggtgtggcctgagcgctgtgtgactgtgcggacgccgcccaatcggactgagcgagcccggcccctccctccccctgattggttggttctcagtgttgtggggcggggaaaggaagagacggggtggctgggcggtggagcggtgaagaaagaaggctaatcttgttctgcgcaagcgctagcaagcgaccaggagggggagtgagagagtgaaagggaatgtggaagccccgatgcgctagctggcgctagctggggctctaaccttgacgcctgcgcggtggccctcggggccccgcgcgcagcgggcgggtgcccggtgcgcctgcgcagtaggcggcggtggcagggggaggtggaggctgtggagcggcagcggcagcagcgggtcccgggactgaggcagcagcgggggcggcggcgggcggaagctgaggtgacgaaggcagcggcggcggcggccgtttccctcacggtggcggagaccaaggcggcggcggcggacggggagcggcccggccccggccccctgctcgttggctgtggcagggccgccgtggggccggcccggctcccgccccccgcggctccccctccggctcctcctccggggagacgccgggggcctggcccggcccgcactcagactgctgctgcagccgccgccgggggagtcggaggcggtggcggcgccatgggcggcctggcctctgggggggatgtggagccgggactgcccgtcgaggtgcgcggctccaacggggccttctacaaggtgagacggcgcgccgactggggacgccggtccttagccccctcccctggccggagcaggaacgcgtggggcgggatcgagcttctggagctgagtcctggcccttagaatcttggacccttgctccaacccgcagccttccctgggagaccgcttagagtgaaccctgttcctcttatttttgacccctctaaggcacctgcacctgcttctacccccatctccgggagaatgaacttcaggccattattgtccctggcttggcgctccccgctccgcaggagagacccctttacccagcttctaattgactgtgtccgttgtctggtggaagacataccttagaccttaatcacatcttccccacgatccaagcacatggagaattgtctttcttccacacggtccctttgggaaggccctctgtcccgtaaaagatcctttcatcttcctcagagaggcctctgcctactggctctggaacactcaccccactttcatcttatattccggttcccaagccaaggagaaatggtcagatccatttacgacgtttggcatctttgacctcaggaaccctgggttggatcagtcaagttgcttcccagccagccataaggtggcatctttcgcaagtctctctccccaccacaccttgatctcaagacccactgctctaccattctactcaggaatggatttgaggtctcacttagacctcagataccttcaggtcattcatatagtttcttcgtcttgaggcatgtaagcttcatagtcataatctctaaaaggatctctgaaaggaagcttatgaggttcccttctgtttatcttaagatttccacttcttgaagactcttggccaactatcccagttcgggaatctgacaaccttttttggaagacgggatcatctttcaaagacccttccttatttcacctccccctttgcccaggatttggttccttagaactccttataataccaccttccttatctgctctgaatctattttctaggacatttttttcccatttagattaagccagagagagccctttcttgcctcccaagagtttttctttgtgtgactgttggtattctgaacctcttggatttgatgcctggaattgtcctagagactctcctgatttctgtctcattctttgatttcaccctggggagctggggaagagataccttcccatggcatcacttgttaagagtggatcccccttccccctttccttcagttcccctcaggcctttttcccccactgtagtcctctctagtttctcatgcccttggaaatgtctttctttgactccttctctaagtcatatttttctataactgcagagggtcttgtaatttctcttgggtggtttctgcctgtacttcagttgctaagtgcattgtagtcatttttttttttttttttttttttttttgagatggagtctcgccctgttgcccaggcttggagtgcagtggtgcgatcttggctcactgcaagctccgcctccctggttcgcgccattctcctgcctcagcctcccgagtagctgggactacaggtgcccaccaccatgcccggctatttttttgtatttttagtagagacggggtttcactgtgttagccaggatggtctcgatctcctgacctagtgatccacctgcttcggcctcccaaagtgctgggattacaggcgtgagccaccgcgcccggccattgtagtcattttttactcactcttcatacttacccatttttgccttacttccctcatcagatttatttctctgcggtgactgtgggtacccatgtctaacttaccttctcaattcaagtttttagctttttctcctaatatttctgtattcctgtgtaatccccaggaatcaccttattccctgtctagctgaaggaagctccctgctgatctctttttgtcattttgtgcatacttgcctaactcttgggactttttcttctagcctgcctccatagcatttctgttttctttggcaaaagtctctaattcctttctgcttttgatagagcacatttgtctctcatatccttttccccaaacttgcattacctttgttgaaatagcttcctaaagtggccctccctgtttaccttggtatcttttccttcatctgggtccttaccacccccaaattctgagttccaagaaaagtgattcttaagttgagtccaagatcaagatatgatgtttgctttgttctaggaagcgtaggagccctgcacagctgagaaagattggtatccagttcaaatgaactgtatgagatggctgggaagggacacgttttctgtcccacatataagtgtccagcagaaagtctctctgaatcttttccctttctcctgtgtgctgtggcagtgatagacttgaatagatggggaccaggatactgtgattcagagagtagagtttggggttgagctgaaagccaggtaatgtggtaatgtggatctgggcaggttagcattttctgccctgttcctgagttaaaaaccacaaatccctaaattcaggctaatcttccactctcagtaccctacagatacttatccgttttgaccttgctgctgatttaatattcatgactcagcaaacttgggatgggtcagggagtatttacactgcttctggaattgtacatttgggaaggtccctttctcctctctcagaattgggccctgttgtcagttttcttttctttcttttccttttttttttatttgagacagggtctccctctgtcatccaggctggagtacagtggcgtgatgtcgtctcactgcagcctccgcctcccaggttcaagtgattcttgtgcctcagcctcccgagtagctgggattacaggtgtgcaacaccatgcctggctaatttttgtattttcagtagagacggggtttcgctatgttggccaggctggtttctgactcctgacttcaagagattcgcccgccttggcctcccaaggtgctgggattacaggcgtgagccaccacgccctcccgtcagttttcttaaaggataaaatattagatctgggatctaagttattttgtagctatctgaaaattaagtttgtcagaatttactctttttttccgtccttttttttttcatgtcagactggcatccgtaacaagggttgagggaggcatacctcaccgtgagcttgaaaccgcagtcatcatgcttaagacgtacaaaatggcttaagacgtacaaaatggcctaatgtattttattctttaagttgtactctcccaaatgaagtattcaccgtccagggcgcaatcttcctactccaaacctcatctggatatcctaatccccattcctttcttaatcaacatggcatcctcagcttcagtacttggtttttactcagactgttcctgctcttctcctagaaccccctcctttgctttgggagtctagaactagaagacggtgaaggtggggaccaattttatatcttctaatttgaggaaaccaaagtacctaggaacctggggctctctcttcctctgctggcttggtgccaggctccagaagccaaagccaggtgatgctatggccactgaatcaagttatcctctggatctaggtggctccctaatacattccacccacctgctcttgccttcacctgcttattttcacaatgagcgtagactgagcagaacttggggctcacttccaccacagatacccttggagaaaaaaactagtatgggatgaatgggtggaatttaggagcagagacaggattggaatatgaagttggggacagagctagttttggagactaattgaaggaaaaagaccctggaaatataagggttgagtgagatttggttgaactgctgagtaatgtgagagattactccattctgagctttgcatttctgccttggaagtcatggtagctgggaaaactagggtaatattgctgctcaccctggggccaagcctaacatggtggaggagaattggattacaccataggcatagccgatttgaatatatctaggagtagaaatctctccacaaaagcagtaaattagtgattctcatctctgtctcttttccacttctttctgtcagtgtaactcctgccttgataaactacttctaaggcttggagtagacattttgggtaaagaactggataaagtcagcggaagaggctggttggaataattctagaaatccagacgaccctgcagcctctgcctcctggcttcaagtgattctcatatctcagccaccctgaatagctgaggttacagccatgtgccaccacgcctggctaatttatatatatgtgtgtgtgtgtgtgtgtatatatatacatacatgtatacatatacatgtatatatatatgtatacatatacatgtatatatatatgtatacatatacatgtatatatatgtatacatatacatgtatatatatacatatacatgtatatatacatatatatgtatgtgtatatatatgtatatgtatacatatatatatagtagcaatggggttttgccatattggccagactggtctcgaactcctggcctcagctgatctaccgacctcggcctccaagtgttgggattacagggaaaagaagagggaatggataaaatattagtggttgtgggagtggggaggacacttgagcaggagctaagggaagaacccaaaagggaagagagacccaggcaagtagaagtaaaagtgcctcagaagacttgaatggagaacagtaggagttggcattaaacctgaatgaacatgctcataactcaggttctttttgaaaaaggaaaaaaatctgaatgaagagtagaaaaaacatttctggagaagagaatgtcagagaaagaaaaagcatgggtaaaaaagaggccaggaagtaccagtagtaattaaagccttgggcagtagtaaggctctaagaaagaacattcagtcaagaatgatcttgactgactgcagcctctatagcaagacatatccctaaagacgagaaaggtggcttgtatgaagagtgaaatgcaggcttagattttcccatcgtaaggaaatagcaatctggtaagtgtttgtgattgattagttctatgaggtgggagctgtgcatttgccaagggcatttttggtgttttctctcctaagcttagcctttgtccctagcagcaaagctcatgaatagttcttgtgtattagccttttgaaacctctaattcttttatttttgtttatttattttgttttttgagtcacggtcttgctgtgttgcccaagctatggagtgcagtggtgcaatcacagctcatcacagcctcgacctccctggctcaagtgatcctcccaccttagcctcctaaatagctgggactacaggcacaagccatcataccctgctaatttataaattttttgcagagatgaggtttccctgtgttgtatgggctctctaatttttttaaaaaacatctttattgagctgaaattgacatacaacaaagtagacatatttaaagtgtgccatttgttaagttttgacatgtatgtaactgagtccatcactgcaatcaaaggaatgaacatttctgtcactcccaaaagtcctccatcaactaccaatcttctgtcattatacattaaattgcccttcctgattttcgatagaaatgaaaaggcagttcaattcagctaagaaaggatagtcttgtcttttcttttcttcttttcttctttttttttttttgaggcagagtttgccctgttgtccaggctgcagtgcgatggcatgatcttgactgactgcagtctctaactcctggcttcaagtgattttcatgcctcagccaccctgaataactgaggttacagccatgtgccaccacgcctggctaatttatatattattattattattattattttttttttttagtagcaatgggattttgccatattggccagactagtctcgaactcatggcctcagctgatctgccagcctcggcctcccagtgttgggattacaggcgtgtgctaccgcccctggccagaaaggatagtcttcaacagacagtgctggaacaagatatctttaggtaaaaaatgggctgggcacagtggtcacacctgtaattccaacattcttggaagctaaggcgggtgcattgcttgagtccaggagttcaagaccagcctgggcaacatagcgaaaccctgtctctattaaaaaaaaattttaatttaaaaatatattaaaaataaaaaaaagtggcctggtgcgatggttcatacctgtaatcccagcactttgggaggctgaggcgggtggatcaccagaggtcgggagtttgagaccagtctgacgaacatggagaaaccctgtctctcttagaaatacagaattagccagggtcgtggcccatgcctgtaatcccagctacttgggaggctgaggcagaattgcttgaacctgggaggcggaggttgcggtgagccaaggttgcaccattgcactccagcgtgggcaacaagagcgaaactctgtctcaaaaaaataaataagaatttaaaaatttaaaaaacattgatcaatacctcaccttatatataaaatttaattcaaaatggatcataggctgggcacagtggctcacatctttaattccagctttgggaggctgaggcagatggatcacctgaggtcaggagttcgagaccaacctggccaagatggtgaaaccccgtctctactaaaaatataaaaaattagcctggtgtggtggcggttgcctgtaatctcagctactcgtgaggctgaggcaggagaattgcttgaacccggggggtggaggttgcagtgggccaagattgcgccattacactccagcctgggtgacagagtgagactctgtctaaaaataaaggattatagatgtaaatgtaaaacaaaaaactaaaagtttaagaagaagacataagagaaaacctttgtggccttggattaggcaaagatttctttttctttttcttttttttttttttgagatggagttttgctcttgttgcccaggctggagtgcaatggcatgatcttggctcactgcaacctctgactctcaggttcaagtgattctctttcctcagcctcccaaatagctgggattacagacatgcaccaccacacctggctaatttttgtatttttagtagagacggggtttcaccatgttggcaggctggtctcgaactcctgacctcaggtgatctgcctgcctcgtcctcccaaagtgctgggattataggcgtgagccactgtgcctggcctgggcaaagatttcttagatatgaaaccaaaagcacagttgataaaataataaattcataagctagacctttttcaaaattagaaatccctaattgtatgtgaaaaatagggagaaggtagaaaaattgggagcataggggtgaatgcatggctttggcctccttagtgaggacacagaccacaggaggtggatcagctgttcagtcatccctcttgctcttgtcaaaatatcaagattggagtcttccataaattttattatcctttataaattatcagtgtcattctagattcaattctagtattaaaaaaccgatgtttttaaattaagtcttaatttttccttctgtaaattgtgttcatcacaattttgaacttgtctagtgttccgattattgtcttaggacccatgcatcagggcagcgagtctgctcagatctcttgctgtattgcggaggtaggcccttctctctcgacagatcctcatgtcctctaggtgttccaggacagcctcacactgtctcatgggatattcttagccttgctgaatgttgttggtattttaattgaactctggcaggctgcttagcacaacaggaggcagacagatagggaggcccctgtgggagcctgagtagatcattggtttccaggctgttctgatgcaggtggtacatacacctctccatgacaatatcatttcctttctctgtttgactgcccatattctttccccagtgcagcctttcaggctgtctcattacaccacttgtgtccctatctaaaactcaagtttaaggttttgtggtgtcttattcccttgatggctaaggtggaagtaaaaggtcattttattttttttgcttttttctaaaatccattctagggctttgtgaaggatgtccatgaagactctgtcaccatcttctttgaaaacaagtaagaccttgggaatagagaatccagcatactaggtcctagaaggagagtggagaagagggggcagctgagtcctatgaggcatgtaataggttgggagagctgagggtttgggtgggaactcatatggatcccaggagaggaaagggctgagaatttggtgagggtgggggcatttgacccagtatttagagtctagaaagagatggaagacactactatggagcagggcctggggtttagcctctaattatccagataggtggaactcgcccagctgaggcaataacccttttgtaaagaaatgggcaaccatatcagtcagagtagctttttcatattattgtttctattatagctggcagagtgagagacaaattccttttggggatgtccggctaccacctccagctgactataataaggagatcacagaaggggatgaagtggaggtaagggctgtggagtacacctttctaaatgtcacttttccccaggattctaggcttttctctggttggttcatgttccttcctccccaactaagccatatccagccatgtagcctatggaaatgtaaaatgcaacagttccccttttatcactgttgtgatcagccaaactctcaggaacatccccagtttcaggcgatttgccttccatttatggtaacaacatctaaaatccagtgccctctgatttttttgttgttgttgttgttgttgttttgagatggagtcttgctctgttgcccaggctggagtgcagtggcgcgatctcagctaactgcaacctccgcctcttgggttcaagcaattcttccacctcagcctcccaagtagctgggattacaagcacctgccatcatgctcgggtaatttttgcatttttgtaaagacatggtttcaccatgttggccaggctagtcttgaatttctgacttcaggtgatccacccgcctcagcttcccaaagtgctgggattacaggcatgagccaccatgccctgccgtcctctgattttaattagttccttcctctggtttcttgtatccttggtttaagatacatcccaggctggatgcagtggctcacacctgaaatcccagcactttgagaggtcgagtggggcagatcacctgaggtcaggagttcaagaccagcctggccaacatgatgaaaccccatctctactaaaaatacaaaaaattagctgggcgtggtggcgggcgcctataatcccagctacttgggaggctgaggcaggagaatcgcttgaacccaggaagtggaggttgcagtgagctgagattgtgccattgcactccagcctgagcaccaagagcgaaactctgtctcaaaaaaaaaaaaaaaaagatgcatcccaaataccttttttttctttttgagatgaagtctcactctgttgcccaagctggagtgcagtggcgcggtctcagctcactgcaacctccacctcctggttcaagtgattctcctgcctcagcctcctgtgtagcttggagtacaggcatgtggcaccacacccggctaatttttgtatttttagtagaggtggggttttaccatgttggccaggctggtcttgaactcctgacttcaggtgatcagcccacctcagccaaagtcctgggattatgggcataagccaccgcgcttggcctctttttttttcgtggaagtggggtctcactgtgttgcccagatcgttcttgaactcctgagctcaagagatcctcccaccttggccttccaaagtgctgggattataagcttgagccactgtgcccagcagccccaaatatcttaatggttgttctattgtttatgttgcccaagctggtcttgaactcctgggcataagcagtccttttgcctcagcctcccaaagcgctgagattacaggtgtgagccccaccatgcccggcctcctcatccctttcttgatgcttttgggtggtcttcaatatctctttgattctctacttttctttaggtttattctcgagccaatgaacaggaaccttgtggctggtggctggcccgggtgcggatgatgaagggagatgtgagtgactgggaatgcctttggagaactactgaaacaaatatgttattcatagaaagttgctcaggtcatccacaacttctccttttttaccatgtgccagttctatgtcattgaatatgctgcctgtgatgccacctacaatgaaattgttaccctggagcgacttcggccagttaatcccaatccccttgcaaccaaaggcagcttcttcaaggttaccatggctgtgcccgaggatctgagagaagcgtgagtgttaaggatggtgggaatgagggccctctttacagccctaatctctggctttatttctcccaggcatcactcccactttgcagttttctctgttgttcccctggccctctactagagcccttcttgctaagaagacacttagtttctttattttcccatccttgttctttaactgtggtccctcttcttttcttttcctttctttctttttttttttttttggagacagagttttgctcttgttgcccaggctggagtgcagtggcacaatctcggctcaccgcaacctccacctcctaggttcaggcgattctcctgcctcagcctcccgagtagctgggattacaggcatgcaccaccacacccggctaattttgtatttttagtagagacagggtttctccatgttggtcaggctggtctcaaactcctgacctcaagtgatccgcctgcctcagcctcccaaagtgctgggattacaggcgtgagccaccgcacccggcccagtcccttttcttttcttatttactcagccctgcttctctgaatttttttttttttttttaatagagacagggtctcactatgttgcccatgctagtcttgaactcctgacttcaagtgatcatcctgccctagcctcccaaagtgctaggattacaggtgcaaaccaccatgtccagcctcccccgaactcttcactgtactctctgcattctgcccgctgagtacttttttcctctgcagctgctccaatgaaaacgtccataaagagttcaagaaagccctgggagccaactgcatctttctcaacatcacaaacagtgagctcttcattctggtgagtttattctgcctgaatttcacataagccttttgaacattttttctttttccctttttaacccttttgcagaaagagaagggcttaaatgtgcttatatttatttgtcaagaggactttattgctcctgactcctacaggcccaggtagccctaccttttttttttcttttttttgagacgaagtctcactcttgtcacccaggctggagaacaatggcacgatctcggctcactgcaacctccacctcccgggttcaagcaattctcctgcctcagcctcctgagtagctgggattacaggtgtgcgtcaccacgccggctaatttttttttttttgagatggaatctcactctgtcgcccaggctggagtgcagtggcgcgatctcggctcactgcaacctccacctcccagattgaagcgattctcctgcctcagcctcccgagtagctgggattacaggcgcctgccattgcgcctggctaatttttttttgtgtttttagtagagacagggtttcaccatgttggccaggctggtcctgaactgctgatctcctgatccacccgcctcggcctcccaaagtgctgggattacagacgtgagccaccgcgcccgacatgcccggctaatttttgtatttttagtagaaacagggtttcaccatattggtcaggctggtcttgaactcctgacgtcgtgatccgcccgccttggcctcccaaagtgctgggatcacaggcgtgagccaccacgcccggcctctgaccctttttttttaaacctgataatcatgttgccatctgggttagagaccctctcttgatatttggactttcagaaatagagtatgtagctctcaccttatgcttgctccttgctttctctctaaaccattttccttcagtaccctgatagtcagcctttgtgggactgacaatgagtctcctccttcctagcttcatttcttttttttttgaaaacagagtattgttctgtcaccaggctagagtgcagtggcgcagtctcggctcactgcaacctccgactcccgggttcaagcgattctcctgcctcagcctctggagtagctgggattataggcatgtgccaccacgcccagctaatttttgtatttttagtaaagacagggtttcaccacgttggccaggatggtctcgatctcatgacctcgtgatccgcctgccttggcctcccaaagtcctgggattgcaggcatgagccaccgcgcccggtctcctagcttcatttcttaacccttttcccgggacttaggcatcctgatttctagtccctggctctcccttagtgtttattccaagccagttttaatgactttcccactggtttcctcccagtcaaccacagaagcccctgtgaagcgagcatctctgctgggtgatatgcatttccgaagcctgcgcaccaaactgctacttatgtcccgcaatgaagaagctaccaagcacctagaggtaacttttagctccttttccttctgctgaagggtattgtcttcctcccttcctaccctgtcctccatccatgatcttgtgtttacagaacaaagactaaggctttttctgggcaattaaacctgggtcagctattttatctcagactcctccagatggcagagctctatcatggtatagtgcaattattttcaaatttcttttagccaattttttttttttttttttgggagacagagtctcgctgtgtcgcctaggctggagtgcaatgacacgatctcggctcactgcaacccctgcctcctgtgtttaagcgattctcatgcctcagccttctgagtagctgggattacaggcgtgcgccaccacacccggctaagttttgtattattagtaagatggggttttgccatgttgcccaagctggcctcgaactcctggcctcatgtgatccacccgcctcagcctcccaaagtgctgggattacaggcgtgagccaccacacctggctgaatggttttttttgagacggagtctcactttgtcacccaggctgtagtgtaatggcatagtctcagctgactgcaacatccaccttctgggttcaagcgattctcccgcctcagcctcctgagtagctgggactacaggcttgtgccaccacacccagctcatttttgtatttttagtattgatggggtttcaccatgttgaccaggctggtctcaaactcctgacctcatgatccacctgcctcggcctcccaaagtgctgggattacagacatgagccgctgcgcccggccttggtcttgaacttctaggctcaagagatccatctgcctgtactttgcaaagtgctaggattacaggtgtgagccaccacatgcagcctagactagaatatttattttttagggtgggcgcggtggctcacgcttttaatcgcagcactttagcactttgggaggccgaggcaggcagatcaatccgaggttgggagtcgagactggtgaaaccccatctttactaagaagacaaaaatcagctgggcgtggtggcacatgcctgtaatttcagctactcgagagactgaggcaggagaatcgcttgaacctgggaagtggaggttgcagtgagccaagattgcgccattgcacttcagcctgggtgacaagagtgaaactctgtctcaaagaaaaaaaggatatgactgggcgcggtggcccacgtctgtaatcccagcactttgggaggctgaggcgggcagatcacctgaggtcgggagttcaagaccagcctggccaacatgggtgaaaccccgtctctactaaaactacaaaaattagccaggcgtggtggcaggcgcctgttgtcccagctactcgggaggctgaggcaggagaatcgcttgaacctgggaggcggaggttgcagtgagccgagatcacaccattgtactccagcctgggcaacaagagtgaaactccatctcaaagaaaaaaaggatatttcttgtttttttgtttgttttttgagatagcgtctctgtcgcccaggctagagcgcagtggcgctatcttggcttactgcaacctccacctcccagattgaagcgattctcctgcctcagcctcccaagtagctgggattacaggtgtgtgccatcacacctggctaatttttgtcttttttagtagagatggggtttcaccatgttggccaggctgatctcaaactatggacctcaggtgatccgcccacctcgacctcccaaaatgttgggattacaggtgtcagccaccacgcctggcctgactagagtatttctgtgagatctttttgaattctgacatcgtataattgtcagattccctttcgttggtattatactattctaagtgaatagggtgtgtgtgtttgaataccatttccatttatcaagggaattgatctttttgggaggcttttttctgtgcctgtgcaatttctgggtcatgataatctttgacttcttcagggatcctgctcagggcactggcaggtaaaaattcaccattaccttcagatgatacaaactttattttttgtttttgttttttgttttgagatggagtctcagtctgttatccaggctggagtgtatgtagtggtgcgatctcagctcactgcagtctctaccccccgagctcaagtgatcctctcacctcagcctttgggtgggtgggattacaggtgcatgccaccatacctggctatttttttttttttttggagacagtttccctctgtcacccaggctggagtgcaatggcacaatctccgctccctgcaacctctcgctcctgggttcaagcgattcttgtgcctcggcctcccaggtagctgggataataggcacgcgcccccacgtctggataatttttgcttttttagtgtttcaccatgttgcccaggctggttttgaactcccgaccgcaggtgatccacctgccttggcctcccaaagtactgggattacaggcatgagccactatacctggccctaatttcagtatttttagtagagacggagtttcaccatgttggctaggctggtcgcgaacccctggcctcaagggatccacttgccttggcctcccaaagtgctgggattatagacatgacccattgcacccggcctaatttttgttgttgttttttaattttttgagacggagtctcattctgtcgtccaggctggagtgcagtagtgcgatctcagctcactgcagcttgtgtagttagcgcagagtgagcaaagggagaccgatacaaaattcggtcagagagtagatcatgtaagacatgtacggtaggctgaggaggggggattttattgtgcgtatactgagaagccattgagttaacagtgccttctggttttttgttttgttttgttttgttttgtttttgagacggagtctcgctctgtcacccaggctggagtgcattggcgtgatctcggctcactgcaagctccacctcccaagttcacgccattctcctgcctcagcctcacgagaagctgggactacaggcgcctgccaccacgcccggctgatttttttgtatttttttttagtagagatggggtttcaccgtgttagccaggatggtcttgatctcctgacctcgtgatccacccacctcggcctcccaaagtgctgggattacaggcgagagccactgtgcccggccgaaagtgccttctgttttaaactcctgtttcaatgacagatggaaaggggggcaagaatggaagcaggaacagagcacagtagtccaggtgagaaacttgaactggagtgctaaaggaagagagagagagtagttttatgtaggataaattttacgagtaaaaccagtaggactgacaggctctgtgatactgagagatacatatttggtctcctgaccaggctcctggcattcaacttctaaaatccttggaatctccagtgatgtgtgtttttgtgtgctgatgagttgattcatggctagcccctctaggtggcttcatgattagagggttggaactttcagcctcacccccaccaacttcctgggaggggaatggggccaaaggttaaggcaatcactgaggatcagtgatttaatcagtcatgcctagtagtgaagcctctaaaaaccggaaaggggccgggtgcagcggctcacgcctgcaatcccagcactttgggaagccgaggcaggtggattgcctgaggttaggagtttgagaccagtctggccagcatggtgaaaccccttctctactaaaaatacaaaaaaagggaggcagaagttgcagtgagcagagatcatgccactgcactctagcctgggtgacagaccccatctcaaaaaaaagaaaaaaaaaaaagaaaacccagctgttctgcaagcttatctagaagacgcttataggtcattgtagatctcttcccctcccctcctaatgtagtgattttgaacactcaacttagtttatttttccaactttctcttcttgcctggtataaatccttggtataattcagtcctatccaacttggaagtgggaagtagtgtatttcaatctaggaatgtctcctttcaggtattgtttctatttggtgcttacaacatgggattcactcctctaaaacctttcctgtcttcctgcccctgaacccaggggttcctctaaggactgattgagaaatgaagtgaaagcctggtgttctagaggcatgttttctgtttttcttaacccctcacttttttttgagacagagttttgctctgtcaccaggctggagtgcagtggcatgacctcggctcactgtaacctccaactccctggttcaagcaattctcctgcctcagcctcccaagcagctgggattataggcacaccccaccaaggccagctaatttttgtatttttaatagagatggggtttcactatgttggcaggatggtcttgatctcctgaccttgtgatccacctgcctcagcctcccacagtgctggaattacaggcgtgagccaccgcgcacagcctacccctcactttttacttaagttgttgagttttatttggggatgagttgatatttgtttgattaaggtaagagttccttacacttgcatgtaccttgtgagaagtactttcacaccagccttgtctaatcctcttgctagtcttgagaataagataagttggatataatcacttagcagatgacacaagaggcagagtatgttttgtttaagatcacacagatagatactcttagggacagatactgttagggccaaatccagaacttcggtgtgtcccagtccaaactctgccctctttacctttcctcccccacaaaccactggtatttggaaggagtggaattaaaagttcctgaccttggccgggcgtggtggcttatgccggtaatcccagcactttgggaggctgaggcgggcggatcacctgaggtcaggagtttgagaccagcctggccaacatggtgaaaccttgtctctactaaaaatacagaaattagccaggcatggtggtggacacctgtagtcgtagctactcaggaggccgaggcatgagaatcacttgaagtcgagaggcggaggttgcagtgagctgagatcgcgccactgcactccagcctgggcgacagagcgagacgccatctcaaagaaaaaacaaaaagttcctgacctttccacacaggtcctcgtggtccgcggactccagagtggttctagctttctattaatatcacacagttttccttatttaagttacgcaaagggtcgtgtgcctgggactgtgagattctaccaccatgattcctacagtgacttttcctttcagacaagcaagcagttggcagcagccttccaagaggagttcacagtgcgagaggacctgatgggactggcaattgggactcacggtgccaacatccagcaggcccgaaaagtacctggggtgaccgccattgagttgggtgaagagacctgcactttccgcatctatggggaggtcagcaaaggatgtctttcttctgggtctcttaggggatagagggaagagaggccgaagtagaaaataagcctcaaactgggcacagtggctcacacctgtaatcccagcaccttcggaggtcaaagtgagaggatcacttgagcctaggagtttgagaccagcctgtgcaacatagtgagacccaatctctacaaaaatttaaaaattagctggaagtagtggtgcgtacctgtagtcgcaggtacttgggaggctgaaatgggaagatagaggggaggatcacttgagcctgggagttggagaacaacctggacaacatagagagaccctgtctttaccccccaaaaaaaccaaaaaccaaaaaacgttaactgagcgtggtggcatgcatctgtggccccagctacttggctacttgggaggcggaggcaggaggatcacttgagcctggaaagtcaaggctgcagtacaccatgatggtgccactgaaccaacctgggcaacatagtcaatagagtgagaccaaaaaatcaaaaaaatagaccagatctctgttgcccaagctggttgttaactcctagcctcaagcaatcctcccttcttagcctccgaaactgttgagattatgggtgtgagccgctgtgcctggccaaggtcctctgtttttttttttaagttatttatttgtttaattttttttttttatgagatggagtctaactcactctgttgcccgggctagagtgcagtggcacaatctcagcttattgcaacctctgcctcctgggttcaagaaatctcctgcctcagcctccggagtagctgggattagagacgtgagccaccaattttgtatttttagtattttagtatttttgtattttgatttttgtatttttagtagagatggcgtttcaccatattgcccaggctagtcttgaactcttgagctcaatttatccacctgcctccagcctcccaaagtgctgggattacaggcgtgagccaccacatccagctggtcttctgttttagtaacaactccctgctgttcttcctttagactcccgaggcttgccgacaggcccgaagctaccttgagttttctgaggactcagtgcaagtgcccaggaacctggttggtgagttggtggtgtgtatatacagttagaggtcagaatcaagattctctacagtgattctgagcttttatccaggattggcacctccctgtggactcccagtttcacaaggacagagaaacagtctgtaatgggagtgataaaaatgaaagaataaatttctagggattgtaacattttgtcctgtaaaaacacatcagaaacctagaagcaggagaatgaagtaaatggaatccatataaagaaaatgaggctggaagacggtgtatcagctttattcttatttccttaaaaaaaataaaaggctgaattcctcatttacctattccaggcaaagtgattggaaagaacgggaaagtgatccaggagattgtggataaatctggtgtggtgagggttcgagtggaaggtgataatgacaagaagaaccccagggaggaggtatgggtacggggcaagtgggcatagagattggtttccagaagtaaatgggattgtcctctgagggctgggattgttctttgagagggtggagtacggaaagttgtttaacactagtagatttagagcccagaatgatcccactgggcaggctcccctaggagactgggcggcgttaatccttccatttcattttcctttctgatccatcgtttctgctctctgttctctagggaatggttcccttcatttttgttggcacccgagagaacatcagcaatgcccaggctttgctggagtatcacctctcctacctgcaggtacccaggccgggagagaaaaatgctgggtgtgaaaagggaactaagactgctgtgggggtcagctcagggattttggttctctgtttgtctctccgtgtagaacagaaaacatctgtggaaatttggggctatagggttgggtcccagaattttccttgtttagccagtgtcttccttctccctgcattcctgagaggttagatatagagggacagtcagggtgcagaagcatgaagcaaggcactgatcttatttctccttccccttcttccatcttttacccaaccaggaggtagagcagcttcgcttggagaggctacaaattgatgagcagcttcggcagattgggctgggctttcgccctcctgggagtgggcggggcagcggtggcagcgacaaggctggatatagcactgatgagagctcctcctcctccctccatgcgactcgaacctatgggggcagctatgggggccgtggccgtggccggaggacaggcggtcctgcctatggtgagacagttatgggaacaggaggcaaggagtggcagggcttgtgggtagaggcagaggtctggatggaagtttggggaaatctggaatggagatgatgaaaaagtgattgattggctgggaggcttgtgagtgagaaggagaattcttccagtttgggggatgtgatggatcctgaggtgggatgaatggccgtgaataaatcccattgtgttcttcaggccccagctcagatgtgtctacagcttcagagactgagtcagagaagagagaggagcccaaccgagctgggcctggcgacagggatcccccaacccgaggggaagaaagccggaggcggccgactgggggccggggtaggggacccccacctgccccccggcccacttcgagatacaattcttcatctattagctcaggtaccagacagctgggttcatgaatatgggccaaaaggaaagatgatgggcacctgactgccaactcctcctcttcttcctctgaccagtgctgaaggatccagacagtaatccctacagcctattggacacgtctgaaccagagcccccggttgattcagaacctggggaaccccccccagcaagtgccaggcgccgccgctcccgccgccgccgcactgatgaagacaggaccgtcatggatggaggcctggaatcagatgggcccaacatgacagagaatggcctgggtgagggtgtgcctggggtctggaaagttagagatgggtaggaatcgagggtgggaggttggatgtgtgactctggttttttcctaccctacagaagatgaatcaagacctcaacgtcgtaatcgcagccgccgccgccgtaaccgtggtaatcggactgatggctctatcagtggagaccgccagccaggtcagccaactctggacaccagaatccttcctcagagctgagagaatgggatgctcacccctgtgaaaatcaggggttcgggttcagtgggtgtcttaggctggctaccagaattccatctgaaagtcttaatctcctgccttccccagtgactgtggctgactatatctcacgagcagagtctcagagccgccagaggccacccctggaacgcactaaaccctcagaagactctctttcaggacagaaggtaggcaggcaagatgtgctttaccccatcccttttttgttgttactctggggcagggggcacaaaaaatttcacaaatctcctactgaattgcagaggcagctgtgtctgatggagtttagaccagtgtaaactttgaataggatagagaagaaagtgtggttcacattttctggatcccaagtaagagagactggatcatgagatcagggaaccaacctctggatcaccaaatgccaggagggcttggatggtagggaatgtctcccacctgaatttctactcaccgcttcttgcttttctgttttctttcccactttcccctcagggtgactctgtcagcaagcttcctaagggcccctcggagaatggggagctctccgcccccttggagttgggtagtatggtgaatggggtttcataaaacctccaacctgcacccctcccttctccatctcgcttgctgcccaacaccatggccctcacaggcccaactgacctgcgctggagctgctcttatctaggggggaggggggtggcacagcagcttgggtaccccccaacctccaggagctagtggaggggtgtgtaacagggtcataccccctccctcttgtccaccctacccccagggtaaggggagcctctctccttccccatcagactggatgtgcctttatcctctaatgccccaatctctctctgaacacccccattctccacctgttggtggggggtgctcctcgacccacccagatttgaccgttcagggggcctcccctgctatccctcctcccatcctgtaccccccatttctggggcctcatcactgtggaagacggggatagtaagagataagtgggtgggaggcacggggaaggttttggagtagaaccaggggtgtgtatgaaggggggtgacaaggtccccctggggaggggaccaaccttgtctggtggatgagaaggcgtatttatttttcactgtacagtatttaaaaagagaataaaaaaatccaaatggctgtctggctcctgtgccttctttgtccccagtttggtccatttgtttctctaggactgacctgccctggcccctggctcttgttttctgttcctccacatctgacttctcttcattgtctcttgtcccaaagatggtcttacttctgggaattcctgacattcctaaactccccaggcccaggttctccctcctggttcagaggaggggggcttgtgccttgttgcttctcccctcccccaagtttgctggtagagggagttgggccactcctataccctgagtcacagcacaggctaggcagggctgctcagagctggagctgttcctgtagaagctgagagccaaggcaggctgcttaatccgattacctgaggcctggggcttgggctgggccgttgggcagagtggggagcagggttccctcacagcagcctctggagcccggggtccggccttcttggtggtgttctgttctggctccaggctttttctccggcatgcgcatcacagacctcttaacttggggagttgtcctgggtttcctggctcccccctcatgacttggacgactgaagctaaaacttgccataattcaatagcagtggagaaatataggtttagggactggagttgggagggcttaagttttctcacttgggaaaggggttgaatcacggcccaagcacctgctggaatgactcaggaaacaaaaatggtctccctcctcggcctttcttgccccaggggcagttctgggatttgaggagcaacaggcaccaggaaaggggttggggtggtggtccgggatgctcccaagctcctctcagcacaactcgggccctgagggcacttcatccccctgtgtttgatcccattgtggaaagaattggctttaaattgcctgtgcttcagggaggggaggcaatcagcaacgggctggaaggcctgacatcaggtcttgggtggggggggcggggggcgtggcaccctgagggtgttgggggctgggacaaacaggacacctgggtttacctacgggctgaggatgttggcgcccttaaggaggtgcagtcttatgggagggacaggggcggagtcagtctttaaaagctgttcccaggtctggcccgcctgccacaaacgctgagcccaggtgggagaggtctggcctatccgcgcctggcagctgtcggaactccggagaccacaaaggggtttatggtttaccccctccacggaaggtcggtctgatcgcagctgcgggtcggggagagggaccgggggtcccccagtcagtaggcctcagaacacctcttcagtgccggggcaccagacagcggattttgcattcgactctccccaaagtgtgccgaacaggttggaagcaaaggctccggtttaagctctgggcttggggataaaatacactttttaaggacccaagttcctcggcaacgactccagactgggaagacctttccattttcaggatcgacgcttcacgttgaggggagggcattcaggacgccctcttaaggcttctcccaacccatggcgctaccaggctcctcacaggaccaggcctggagcctggagcctccggctgccacggctgctgcctcctcatcttcgggaccccaggagcgggagggcgctgggagccccgcggcccccgggacgctgcccctggagaaggtgaagcggccgatgaacgcgttcatggtgtggagctccgctcagcgccgccagatggcgcagcagaaccccaagatgcacaactccgagatctccaagcgcctgggcgcgcagtggaagctgctggacgaggacgagaagcggcccttcgtggaggaggccaagcggctccgcgcccgacacctgcgcgactaccccgactacaagtaccggcctcggcgcaaggccaagagctcgggcgccggaccttcccgctgcggacagggaagaggcaacctggccagcggcggcccgctctgggggcc

SEQ ID NO: 16836 - DNA, 23167 bp, Human
gtcaggagccctagaaacaggggagagttagaaagctggccagacctatgcttttcaagtgtagggctagggctgagcctgcctctggggtaggtaagcccccctgaatccttgagggaagtagaagacacaaactgctagataaaatgtaagctcagtctaaaagggctacgtgccgcttctcccagctctggggcatccctctcctagaaaactggactgttttacagtgaaaatctcgggggtggtcagctccctgccccgttgttatccttaccacttacagcctttcaagaagttctcaggttgggtgctgaactctgaccaggaaccactgagaaatcgaggcagctgggagaagctgtagttccaagcgctgaaaggaagatgggggacaataaacctgggtcgccaagcaaagggggcagaggcctggagaagtgggtctcaggaccagaggacagatcgacctcacacttcatctccccagactccacactccactgccatcaccacttacgtgtctccctcgtcctctgcagcgggttccccagaggtatcttccatggcttttccagaccccaactctggcccgttcgcttcttcttcagaaaggctcccgtttgcttcttctgcaggaaggcttgtattttcagaaagttcttgctcctcgattcgaggactcaactcactaggggaaccaaactctgtttccaggggagtggagagagaaactgggtccccctcccctagctcctgggacacagctgagccagccacaggatctggggacaaccggggcggatcccccctttcgggaggcggtggcatcagttcagagtccgcatttttattcatcggggaagcgtggggagaaggatgggctggagctgggtcctggtctgaaggacagcagtccggagctaacggttgagtctccaaagtcttcatactgcagaggaagcacagcggagattagcctcagccaggatggcttcgaagttctcagggatccgacgcagagctaaagaaacccacctgtgcttccctcctcttctgggagtaggcagaagactcccgggaggagaggcgaacagcggacgccaattcttttgaaagcactgtgttccttagcaccgcgggtcgctacgggcctcttgctgtcgcgggatttcggtccaccttccgattgggccgccgcatcccggatcagatttcgcgggcgacccacggaacccgcggagccgggacgtgaaaggttagaaggtttcccgttcccatcaagccctagggctcctcgtggctgctgggagttgtagtctgaacgcttctatcttggcgagaagcgcctacgctccccctaccgagtcccgcggtaattcttaaagcacctgcaccgcccccccgccgcctgcagagggcgcagcaggtcttgcacctcttctgcatctcattctccaggcttcagacctgtctccctcattcaaaaaatatttattatcgagctcttacttgctacccagcactgatataggcactcaggaatacaacaatgaataagatagtagaaaaattctatatcctcataaggcttacgtttccatgtactgaaagcaatgaacaaataaatcttatcagagtgataagggttgtgaaggagattaaataagatggtgtgatataaagtatctgggagaaaacgttagggtgtgatattacggaaagccttcctaaaaaatgacattttaactgatgagaagaaaggatccagctgagagcaaacgcaaaagctttcttccttccacccttcatatttgacacaatgcaggattcctccaaaatgatttccaccaattctgccctcacagctctggcttgcagaattttccaccccaaaatgttagtatctacggcaccaggtcggcgagaatcctgactctgcaccctcctccccaactccatttcctttgcttcctccggcaggcggattacttgcccttacttgtcatggcgactgtccagctttgtgccaggagcctcgcaggggttgatgggattggggttttcccctcccatgtgctcaagactggcgctaaaagttttgagcttctcaaaagtctagagccaccgtccagggagcaggtagctgctgggctccggggacactttgcgttcgggctgggagcgtgctttccacgacggtgacacgcttccctggattgggtaagctcctgactgaacttgatgagtcctctctgagtcacgggctctcggctccgtgtattttcagctcgggaaaatcgctggggctgggggtggggcagtggggacttagcgagtttgggggtgagtgggatggaagcttggctagagggatcatcataggagttgcattgttgggagacctgggtgtagatgatggggatgttaggaccatccgaactcaaagttgaacgcctaggcagaggagtggagctttggggaaccttgagccggcctaaagcgtacttctttgcacatccacccggtgctgggcgtagggaatccctgaaataaaagatgcacaaagcattgaggtctgagacttttggatctcgaaacattgagaactcatagctgtatattttagagcccatggcatcctagtgaaaactggggctccattccgaaatgatcatttgggggtgatccggggagcccaagctgctaaggtcccacaacttccggacctttgtccttcctggagcgatctttccaggcagcccccggctccgctagatggagaaaatccaattgaaggctgtcagtcgtggaagtgagaagtgctaaaccaggggtttgcccgccaggccgaggaggaccgtcgcaatctgagaggcccggcagccctgttattgtttggctccacatttacatttctgcctcttgcagcagcatttccggtttctttttgccggagcagctcactattcacccgatgagaggggaggagagagagagaaaatgtcctttaggccggttcctcttacttggcagagggaggctgctattctccgcctgcatttctttttctggattacttagttatggcctttgcaaaggcaggggtatttgttttgatgcaaacctcaatccctccccttctttgaatggtgtgccccaccccgcgggtcgcctgcaacctaggcggacgctaccatggcgtgagacagggagggaaagaagtgtgcagaaggcaagcccggaggtattttcaagaatgagtatatctcatcttcccggaggaaaaaaaaaaagaatgggtacgtctgagaatcaaattttgaaagagtgcaatgatgggtcgtttgataatttgtcggaaaaacaatctacctgttatctagctttgggctaggccattccagttccagacgcaggctgaacgtcgtgaagcggaaggggcgggcccgcaggcgtccgtgtggtcctccgtgcagccctccggcccgagccggttcttcctggtaggaggcggaactcgaattcatttctcccgctgccccatctcttagctcgcggttgtttcattccgcagtttcttcccatgcacctgccgcgtaccggccactttgtgccgtacttacgtcatctttttcctaaatcgaggtggcatttacacacagcgccagtgcacacagcaagtgcacaggaagatgagttttggcccctaaccgctccgtgatgcctaccaagtcacagacccttttcatcgtcccagaaacgtttcatcacgtctcttcccagtcgattcccgaccccacctttattttgatctccataaccattttgcctgttggagaacttcatatagaatggaatcaggctgggcgctgtggctcacgcctgcactttgggaggccgaggcgggcggattacttgaggataggagttccagaccagcgtggccaacgtggtgaatccccgtctctactaaaaaatacaaaaattagctgggcgtggtgggtgcctgtaatcccagctattcgggagggtgaggcaggagaatcgcttgaacccgggaggcagaggttgcagtgagccaagatcgtgccactacactccagcctgggcgacaagaacgaaactccgtctcaaaaaaaaggggggaatcatacattatgtgctcatttttgtcgggcttctgtccttcaatgtactgtctgacattcgttcatgttgtatatatcagtattttgctccttttcatttagtatagtccatcgattgtatatccgtccttttgatggccttttgagttgtttcccatttgcggttatgaaataaagctgctataaacattcttgtacaattctttttgtgatcatatgttttcgtgtttcttggagaaatacttaggaggggaattgcgagtttggaagtaaaaagtagctgtattttgaactttttcagaagctctgagttttccagagcggttgtaccattttacactccaactagcaaggtatgggagttattatggttgtgccacagccttccggacattaggtattgtcagtctttctaatgtggtatatccttgtggttgtaatttacagttctctattgactaaggatgttcagcattttttcatgtgcctattggccattcgtattttgtttgtaaagtagctcttcgagtcttttacctgttattttggttttttgtttgtttttattgttcagttgtgggactgctttatacattctggatacaagtcctttatcagatccatgtgtcgtgaatgttttcttctgatctgttgcttgcctatttgtttgctttacagagtttacagtatcttaagaggagtggatttatcttttttatgttcagtatttgccttgtcctgtttaggacatctttttttttttttttaaccccagggtcatgaagatattatcttacattttcttttaggacctttatggttgtaagttttacagtaaggtccttgagccattaattaattcttaaaattaattgtttatggtgtgaggtgtaggagtcagtctctggtatctttcctgtatggaaatccagttattctgtctccacttgttgaaataggcttcctttctctactgaatgcttttaattttaattattttacagttggagtatagggctaccattttagtgctattttctttttttctttgttaatttttgagacagggactcacactgttgcccaggctagagtacaatggcacaatcaaggcttactgcagcctcgaacccctgggctcaagcagtcctctagcagcctcacgagtagctgggattactccaccacacccagctaactattttatttttttgtattgacaggatctcactatgttgcccaggctggtctcaaactgctggcctcaagctttcatcccatctcggcctcccaaagtgctgggattacaggtgtgagccaccatgcctgacctcttagtgctattttctatttatctcctctgttctctgctctctttaaacgttggaggaagaaacagtacccatcttacacaaactcttcagaaaacagaggaacagactgggcgcggtggctcatacctgtaatctcagcactttggtacgctgaggcaggggatcatttgaggtcgggagttcgagaccagcctggccaacacggcgaaaccccatctctactaaaaatacaaaaagtagctaggcgtggtgacacatacctgtaatgccagttactcaggaggctgaggcacaagaatcccttgaacctgggaagcggaggttgcagtgagccgagattgcgccactgcactccagcctgggcaacagagtgagaccctgtctcagaaaaaaaaagaaagaaagaaaaaatagaggaatatttcccaacttgttttcgaagccagcataatcctggtaccaaaaccaaacaaggacattataagaaaagaaaatatagaccaatattcctgttagcatagacatgcaacagctaaccaattttagcaaaccaaacctggtaatatagaaaaaaggataaataggccagtcgcggtggctcacgcctgtaatcccagcactttgggaggctgaggcaggcagatcacttgaggtcaggagtttgagaccagcctgaccaacatggtgaaaccccgtttctaataaaaatacaaaaatcaggctgggcacggtggctcacgcctgtaatcccagcactttgggaggccgaggtgggcagatcacgaggtcaggagttcaagaccagcctgaccaatgtggtgaaacgccatctctactaaaaatacaaaaatcagccggtgtggtggcacctgcctgtaatcccagctactcaggaggctgaggcagaattgcttgaacccgggaggcagaggttgcagtgagccaagatcgtgccactgcactccagcctgggcgacagagcaagacttcatctcaaaaaaaaaaaaaaattagctgggcatggtggtgggcacctgaaatcccagctactcgggagtctgaggcaggagaatcgcttgaacccaggaggcagaagttgcactgagctgggatcacaccattgcactccagcctgggcaacagagtgagactccatctcaaaaaaagaaaaagaaaaaggataaatacattctaaccaaataatgtttatctcatgattgtagctgattcaacattcaaaaattggcctggtgcagtagctcaggcctgtaatcccaacattttaggaggctgaggcaggaagatctcttgagcccaggatttcaagaccagcctgggcaacatagtcagactggtctttactggggggaaaaaaatcagtctgtgtaattcaccacattaacaaagggaaacataaaaaccctatgatcatttcaacagatgtagcaaaagcagttaatgatattcaacacatatgcatgattacaaaccaaccaacctcctagcaaactagggaaaggaaacttaacctagtttgataacagggcgtccacagtcggagttccactagcagcatacataatggtagaaaactcagtgctgccgggcgcggtggctcacgcctgtaatgccagcactttgggaggcctaggcgggcggatcacgaggtcaggagatcgagactgtcctgactagcatgctgaaaccccgtctctactaaaaatacaaaaacaaaaaattagccgggcatggtggcgggcgcctatagtcccagctactcgggaggctgaggcgagagaatggcgtgaacccgggaggcggagcttgcagagcctagatcgtgccactgcactccagcctgggtgacagagtgagacttcgtctcaaaaaaaaaaaaaaaaaaaaaagaaaagaaaactcaacgctttttcctctaagatcaggaactagaaaaggatttgactctcacaacgttgataccatactggaggttttaaccaggcaagaaaaagaaataatgagggccgggtgcggtggctcaggcctgtaatcccagcactttgggaagccgagacgggtggatcacgaggtcaggagatcgagaccatcctggctaacacggtgaaaccctgtctctactaaatatacaaaaaattagccgggcgtagtggcgggcgcctgtagtcccagctactcgggaggctgaggcaggagaatggcgtgaactcagggggcggagcttgcagtgagctgagatcgagccactgcactccagcctgggcgacagagcaagactgtgtctcaaaaaaaaaaaaagaaaaagaaataatgattagtggcccgatgtctcacgcctataatcccagcactttgggaggccgaggtgggcagatcacctgaggtctggagttggagaccagcctgacaaagatggtgaaacctcgtctctattaaaatattaaaaaaatagccaggcgttggccgggtacagtggctcatgcctgtaatcccagcactttgggaggccgaggtgggtggatcacctgaggtcaggagttcaacaccagcctggccaacatggtgaaaccccatctctactaaaaatacaaaaattagccgggcgtagtggcgggcgcctgtaatcccagctacttgggaggcttaggcaggagaatcgcttgaacctgggaggcggaggttgtagtgagccgagattgcaccattgcactccagcctgggtgacaaaagcaaaaactccgtctcaaaaaaaaaagaattagccaggggtagtggtgaacgcctgtagtcccagctactcaggaggcagaggcaggagaatcacttgaacccaggaggcagaggttgcagtgagccgagattgtcccattgcactccagcctaggcgacaagagcaaaattccatgtcaaaaaaaaaaaaaaaaaaggaaagaaaaaaaataacgattagaaaggaagaaataaaacacattcacagccagtatgattctatacatacatgtcctaatggggccaggcgtggtggctcatgcctgtaatcctagcacttttaggaggctgaggcaggtggcttccctgggaccagcctggccaacatggtgaaaccccaactctaataaaaatacaaaaaatcagccaggcgtggtgacgggcacctctaatcccagctactcaggaggctgaggcaggagaattgcttggacctgggaggcagaggttgcagtgagccgagatcgcgctattgcactccagcctgggcaacaagagtgaaactccggcagggtgtggtggcttacgcctgtaatcccagcacttcgggaggctgaggcaggccgatcacctgaggtcaggagtttgagaccaacctaacatggtgaaaccccgtctctactaaaaatacaagaattagctgggtgtagtggtgggcgcctgtaatcccagctacttgggaggctgagacagaagaattgcttgaacccaggaggtggaggttgcagtgagctgagatcatgccattgcacaccacgccgggcaacagagcgagattccgtctcaaaaaaaaaaaaaaagagtgaaactctatctcaaaaaaaaaaaaaagtcctaatggaaaatccataaaaagctaccaaaactaataaataaatatagcagggttgcaggttacagggcaatatagttatccctctatctgtaggggcttggttctgggactcctcacacaccaaacccacagatgtctaagtcccatatataagacggtatagtatttggatttaacctacacatatcctcccatatagtttaaattatctctagattacttacattacccccatacaatgaaaatgctaatgtacatgcaagtatgtatgtaagtacttgtactatattgtttagggaatcactggacatataggccttcaagactgataccagcagccactgttaagattctggtcaggcctgcccctgtttggggtctcagttgatctcattgccttcccacccagccaagggcacctgcatttctcttggctccctggccatttggaaggcctagttcagcctggcacatttgtatcctggcccactgatgctggtacccctgggaaggtcctgctctgaaaaacacggagattttagttgctactgaagatttgagagataaagacagggagacctgtctgtagacctgtgtccctccaagtgggattgagactttgggccccccatttcaggacagcacctcctggcctgttgactgaatagatccctgaaggaggtgtacttgcattaatggagtgggggtgggagcagtaccacagatccgcactaacaatcacacagttctctctagaataataatatagaacaagtgaaatagaacaattgcagaaagagctaacctttgttgagctcttactgtgtgcccagcactttcctcaactctacatttcccataatacacagagtactaggtaggccaggcttggtggctcacgcctgtaatcccagcactttaggaggccaaggggggtggatcacctgaggtcgggagttcaagaccagcctgaccaacatggtgaaaccccgtctctactagaagtacaaaattagccaggtgtggtggcacatgcttgtagtcctagctactcagcaggctgaggcaggagaatcatttgaatccgggaggaggttgcagtaagcggagatagtgccactgtactccagcctgggcaataagagctgagactccgtctcaaaataaaataaaataaaataaaataaaataaaataaaataaaaaaagaaaagagcctgccattaaaggagctgtttggtaggggatgttttgtcagtgcaaacaacagaaaagtgggctgggcacagtggttcatgcctgtaatcccagcactttgggaggccaaggcgggcggatcacctgaagttgggagttcaagaccagcctgaccaatatggagaaaccccgtctctactaaaaatacaaaattagccgggcgcagtggcgcatgcctgtaatcccagctactcgggaggctgaggcaggagaatcgcttgaacctgggaggcagaggttgcggtgagccgagatcgcaccattgcactccagcctggacgagagcaaaactctgtctcaaaaaaaaaaaaaaacagaaaagtgtaacaaacacttacagtaggcatgtttcttagcaaatctgatgacaaatttggcataaagaaagagagcatccctgaaaaaaaaaaaaagaaaaagaaagagagcatcctgcctgggcaacatagtgaaaccctgcctctacaaaaaaactcaaaaattggccgggtgcagtggctcacacctgtaatcccagcactttgggagtcggaggcgggaggatcacctgaggtcaggagttcgaaaccagcctggccaacatggcaaaaccccatctctactaaaaatacaaaaaattaatcaggcgcattggtgggcgcctgtaatcccagctactcaggaagttgaggcaagaggatcgcttgaatctgggaggtggaggttacagtgagtcgagatcacaccactgcactctagcctgggtgacagggcgagactccgtctccaaaaaaaaaaagaaaaagaaaaagactaaaaaattagccaggcaggcctctgtggtcccagctacttgggaggctgaggcaggagaatcactgagcccaggagtccgaggctgtagtgagccatgattgcaccactgtaccctagcttgggcaacaaagcaagaccctgcctcaaaagaaaaaagaaagaaagaaagaacatggcgggccaggcacagtggctcacacctgtaatcccagcgctttgagaggccgaggcaggtggatcacaaggtcaggagttccacaccagcctggccaacatggtgaaaccctgtctctactaaaaatacaaaaaatcagccaggcatggtggcaggggcctgtaatcccagctactcgggaggctgaggcaggagaattgcttgaaaccagaaggcagaggttgcagtgagcctagactgcaccactgcactccagcctgggcgaaaagagccaaactccatctcaaaaaacaaacaaaaaaacaaaacaaaaaaaaacatggcaaagcctttgaaagcttgtctgggagaaggtgcgatgatagttgcataacttcgtgcaagatgctggtccacacaggggctgccccttgctctttctcgctctcttaacctctcatataacaggcttgtgtgttattcacatttattgagcccaagcaggtgcaaggcattgtgatctaatactttggtcagcaagacaacaagatagatcactgccctgcccttaggaagtgtatatgctattagaggaaacagataaaataaacaaggaaaagtatcagacaatgtaagtgctatgagaatgcaaatgaggtgatgtgaattaaaataggatgacttaaagtctgcacgggaaggagcctacccccatgttcctggctagccaaggaaccaccagttgattagcagagaagggcagccagtctagctagagcttttggggaagagggagtggttgttaagagatgagattaaagaagccgagacgggccattcgtgagggggttgtaatgcagggctgaggagtgtccgaagagaatgggcaggtgagcggtgagacagttgttcttccagaagctttgcagtgaaaggaatcaaagaaatggagccgtgtatcaggtggggaagggtgggggccaagggggtgtccttccccatacagagattgcaggctgagaatgactatatccttgttaacaggaggtgggagcagggcacggtagctcacacctgtaatcttggcactttaggaggcggaggcgggccgatcacctgaagtaaggagttcgagaccagcctggccaacatgcaaagccctgtctctactaaaaatacaaaaattagctgggtgtggtggtactcgcctgtaatcccagctactcgggagactgaggcaggagaatggcttgaacccggaaggtagaggttgcagtgagctgagatcatgccactgtgctccagcctaggtgacagagagagactccatctcaaaaaaaaaaaaaaatacaggaagggagttgggaatagggtgcacatttaggaagtcttggggatttagtggtgggaaggttggaagtccctctctgattgtcttttcctcaaagaagtgcatggctggtgaggggtggggcaggagtgcttgggttgtggtgaaacattggaagagagaatgtgaagcagccattcttttcctgctccacaggaagccgagctgtctcagacactggcatggtgttgggggagggggttccttctctgcaggcccaggtgacccagggttggaagtgtctcatgctggatccccacttttcctcttgcagcagccagactgccttccgggtcactgccatggaggagccgcagtcagatcctagcgtcgagccccctctgagtcaggaaacattttcagacctatggaaactgtgagtggatccattggaagggcaggcccaccaccccgaccccaaccccagccccctagcagagacctgtgggaagcgaaaattccatgggactgactttctgctcttgtctttcagacttcctgaaaacaacgttctggtaaggacaagggttgggctggggacctggagggctggggggctggggggctgaggacctggtcctctgactgctcttttcacccatctacagtcccccttgccgtcccaagcaatggatgatttgatgctgtccccggacgatattgaacaatggttcactgaagacccaggtccagatgaagctcccagaatgccagaggctgctccccgcgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacggtcagttgccctgaggggctggcttccatgagacttcaatgcctggccgtatccccctgcatttcttttgtttggaactttgggattcctcttcaccctttggcttcctgtcagtgtttttttatagtttacccacttaatgtgtgatctctgactcctgtcccaaagttgaatattccccccttgaatttgggcttttatccatcccatcacaccctcagcatctctcctggggatgcagaacttttctttttcttcatccacgtgtattccttggcttttgaaaataagctcctgaccaggcttggtggctcacacctgcaatcccagcactctcaaagaggccaaggcaggcagatcacctgagcccaggagttcaagaccagcctgggtaacatgatgaaacctcgtctctacaaaaaaatacaaaaaattagccaggcatggtggtgcacacctatagtcccagccactcaggaggctgaggtgggaagatcacttgaggccaggagatggaggctgcagtgagctgtgatcacaccactgtgctccagcctgagtgacagagcaagaccctatctcaaaaaaaaaaaaaaagaaaagctcctgaggtgtagacgccaactctctctagctcgctagtgggttgcaggaggtgcttacacatgtttgtttctttgctgccgtcttccagttgctttatctgttcacttgtgccctgactttcaactctgtctccttcctcttcctacagtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtgagcagctggggctggagagacgacagggctggttgcccagggtccccaggcctctgattcctcactgattgctcttaggtctggcccctcctcagcatcttatccgagtggaaggaaatttgcgtgtggagtatttggatgacagaaacacttttcgacatagtgtggtggtgccctatgagccgcctgaggtctggtttgcaactggggtctctgggaggaggggttaagggtggttgtcagtggccctccgggtgagcagtaggggggctttctcctgctgcttatttgacctccctataaccccatgagatgtgcaaagtaaatgggtttaactattgcacagttgaaaaaactgaagcttacagaggctaagggcctcccctgcttggctgggcgcagtggctcatgcctgtaatcccagcactttgggaggccaaggcaggcggatcacgaggttgggagatcgagaccatcctggctaacggtgaaaccccgtctctactgaaaaatacaaaaaaaaattagccgggcgtggtgctgggcacctgtagtcccagctactcgggaggctgaggaaggagaatggcgtgaacctgggcggtggagcttgcagtgagctgagatcacgccactgcactccagcctgggcgacagagcgagattccatctcaaaaaaaaaaaaaaaaggcctcccctgcttgccacaggtctccccaaggcgcactggcctcatcttgggcctgtgttatctcctaggttggctctgactgtaccaccatccactacaactacatgtgtaacagttcctgcatgggcggcatgaaccggaggcccatcctcaccatcatcacactggaagactccaggtcaggagccacttgccaccctgcacactggcctgctgtgccccagcctctgcttgcctctgacccctgggcccacctcttaccgatttcttccatactactacccatccacctctcatcacatccccggcggggaatctccttactgctcccactcagttttcttttctctggctttgggacctcttaacctgtggcttctcctccacctacctggagctggagcttaggctccagaaaggacaagggtggttgggagtagatggagcctggttttttaaatgggacaggtaggacctgatttccttactgcctcttgcttctcttttcctatcctgagtagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgaggtaagcaagcaggacaagaagcggtggaggagaccaagggtgcagttatgcctcagattcacttttatcacctttccttgcctctttcctagcactgcccaacaacaccagctcctctccccagccaaagaagaaaccactggatggagaatatttcacccttcaggtactaagtcttgggacctcttatcaagtggaaagtttccagtctaacactcaaaatgccgttttcttcttgactgttttacctgcaattggggcatttgccatcagggggcagtgatgcctcaaagacaatggctcctggttgtagctaactaacttcagaacaccaacttataccataatatatattttaaaggaccagaccagctttcaaaaagaaaattgttaaagagagcatgaaaatggttctatgactttgcctgatacagatgctacttgacttacgatggtgttacttcctgataaactcgtcgtaagttgaaatattgaaatattgtaagttgaaaatggatttaatacacctaatctaaggaacatcatagcttagcctagcctgctttttttttttttttttttttggagacagagtctcactctgctacccaggctggagtgcagtggcgggatctcggctcactgcaacctccgccttctgggttcaagcgattctcctgcctcagcccactgagtagctgggattacaggcacctgccccgacgcccagctaattttttgttatttatttatttttttttttagtagagatgaggtttcaccatgttggccaggctagtctcgaactcctgaccttgtgatctgcctgccttggcctcccaaagtgctgggattacaggcgtgagccaccgcacccggcctgcctagcctacttttattttatttttaatggagacagcatcttgctctgttgcccaggctggattacagtgatgtgatcatagctcattataccctcctgggctcaagcaatccccctaactctgcctccccagtagctaggaccacaggcatacaccaccatacccagctaatttttaaaattttttgtagatagatagagtctcactatgttgcccaggctggtctctagcctacttttttgagacaaggtcttgctctgtcacccaggctggatagagtgcagtagtgcagtcacagctcactgcagcctccacctcccaggctccatccatcctcccagctcagcctcccaagttgcttcaactacaggcctgcaccaccatgcctggctaatttttatttatttatttttattttattttattttatttttttgagactcagtctcactctgtcgcccaggctggagtgcagtggcatgatctcggctcactgcaacctctgcctcctgggttcaagtgattctcctgcctcagcctcccgaatagctaggactacaagcgcctgctaccacgcccggctaatttttgtatttttagtagagacagggtttcaccatgttggccaggctggtctcgaacttctgaccatgtgatcgccgcctcggcctcccaaagtgctgggattacaggtgtgagccaccacgcccggctaatttttatttatttatttaaagacagagtctcactctgtcactcaggctagagtgcagtggcaccatctcagctcactgcagccttgacctccctgggctccggtgatttcaccctcccaagtagctaggactacaggcacatgccacgacacccagctaattttttattttctgtgaagtcaaggtcttgctacgttgcccatgctggtatcaaacccctgggctcaatcaatccttccacctcagcctccccaagtattggggttacaggcatgagctaccacactcagccctagcctacttgaaacgtgttcagagcatttaagttaccctacagttgggcaaagtcatctaacacaaagccctttttatagtaataaaatgttgtatatctcatgtgatttattgaatattgttactgaaagtgagaaacagcatggttgcatgaaaggaggcacagtcgagccaggcacagcctgggcgcagagcgagactcaaaaaaagaaaaggccaggcgcactggctcacgcctgtaatcccagcatttcgggaggctgaggcgggtggatcacctgaggtcaggagttcaagaccagcctagccaacatggtgaaaccccgtctctactaaaatacaaaaattaaccgggcgtgatggcaggtgcctgtaatcccagctacttgggaggctgaggcaggagaatcgcttgaaccaggaggcggaggttgcagggagccaagatggcgccactgcactccagcctgggcgatagagtgagactccgtctcagaaaaaaaagaaaagaaacgaggcacagtcgcatgcacatgtagtcccagttacttgagaggctaaggcaggaggatctcttgagcccaagagtttgagtccagcctgaacaacatagcaagacatcatctctaaaatttaaaaaagggccgggcacagtggctcacacctgtaatcccagcactttgggaggtggaggtgggtagatcacctgacgtcaggagttggaaaccagcctggctaacatggtgaagccccatctctactaaaaacacaaaaattagccaggtgtggtagcacacgcctgtagtcccagctactcgggaggctgaggcacaagaatcacttgaaccccagaggcggagattgcaatcagccaagattgcaccattgcactcccgcctgggcaacagagtgagaccccatctcaaaataaataaataaatatttttaaaagtcagctgtataggtacttgaagtgcagtttctactaaatgcatgttgcttttgtaccgtcataaagtcaaacaattgtaacttgaaccatcttttaactcaggtactgtgtatatacttacttctccccctcctctgttgctgcagatccgtgggcgtgagcgcttcgagatgttccgagagctgaatgaggccttggaactcaaggatgcccaggctgggaaggagccaggggggagcagggctcactccaggtgagtgacctcagccccttcctggccctactcccctgccttcctaggttggaaagccataggattccattctcatcctgccttcatggtcaaaggcagctgaccccatctcattgggtcccagccctgcacagacatttttttagtcttcctccggttgaatcctataaccacattcttgcctcagtgtatccacagaacatccaaacccagggacgagtgtggatacttctttgccattctccgcaactcccagcccagagctggagggtctcaaggaggggcctaataattgtgtaatactgaatacagccagagtttcaggtcatatactcagccctgccatgcaccggcaggtcctaggtgacccccgtcaaactcagtttccttatatataaaatggggtaagggggccgggcgcagtggctcacgaatcccacactctgggaggccaaggcgagtggatcacctgaggtcgggagtttgagcccagcctgaccaacatggagaaaccccatctctactaaaaatacaaaagtagccgggcgtggtgatgcatgcctgtaatcccagctacctactcgggaggctgaggcaggagaatcgcttgaacccgggaggcagaggttgcggtgagctgagatctcaccattacactccagcctgggcaacaagagtgaaactccgtctcaaaaaagataaataaagtaaaatggggtaagggaagattacgagactaatacacactaatactctgaggtgctcagtaaacatatttgcatggggtgtggccaccatcttgatttgaattcccgttgtcccagccttaggcccttcaaagcattggtcagggaaaaggggcacagaccctctcactcatgtgatgtcatctctcctccctgcttctgtctcctacagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgccacctgtgtgtctgaggggtgaacgccagtgcaggctactggggtcagcaggtgcaggggtgagtgaggaggtgctgggaagcagccacctgagtctgcaatgagtgtgggctggggggcccagtgcccgggttccgggaggggaacaaaggctggagactgggtcagtctgcgggctgcatgacaacaagggagggggtggctccattcataactcaggaaccaaccgtccctcctcccctccggccacggctggcacaaggttctctccctcccctgcttctaggactgggctgcttccccctcggcagcctctcaccaaggattacgggatttaaatgtctgatttagcaaggctgagcctccagggtggccatctgctccatcagaaagtggcaggatacctgggttcccaaggggaacaggggtgggtgctactggatggagagaggccagtgggaggcctgctagccagggtcccaggaaagtgggggcagctaaggtaagagtaggggtgtggggctaggtccttcccagcatcccctcatcctgggcctcatgccaggtagctgaatgaattgaagctttaaactctgccaggaaaacctttcaaagggcttcttgggatagggaggagagtcgggttgaggagctcagtactgcctgcccatgctcctcagggctgctggctcccagggaggggggctgggagcaggcaggctcttccccatcacccactgctctcttggagccagtgcttgaaggggcagtcagacatggcttgcccttcctcctccctggtggtggagacaggtgttagggtccagtgggtgctactgtccaggggggcttctggggccactagcctgtcagctcatcaaccaggctgaaggtgcaagcaggagccccttgccttgccccaaggatcccagacagctatgaagccaccagccttcctgacctcaagaccaccttttttttttctctttcttactagggaatgccaaacactctccccaggagatccagacccgcctctttcagagacttttaacttaaacatctgtccctacccagcaggcaaactagagctcctgaagctcagtccctgtccttgcctctgtagacaggtcaccttgatgagcttcctttttttttttttaatttttttttattttaggctttattggggcataattgatcccccaaaattgcatacattcaaggtatgcagtgtgatgatttgatatgggggtatattgtgaaaccattaccacaatcaaattaatcagcacgtccatcatcacacacagttaccatttgtgtgtgtgcacgtgtgttcacctacgacgaggacacttggacctactctgcagatctcaagtaaacagaaaatctccctttttgacaaccatcctccaccctttcaatcccaaccttttcctagattatgtccctagctctgtttttatttctgctgtgctgcttcagatccattctgactctgccaaacccttctttgtgagctgatagattgctggattgagaattacagctgggcgcggtggctcacgcctgtaatcccaacactgtgggaggccaaggccggcggatcacttgaggtcaggagttggagaccagcctgaccaacaagatgaaaccccatctctactaaaaatacaaaattagctgggcatggtggtgcacgcctgtaatctcatcttcttgggaggctgaggcaggagaattgcttgaacccgggaggtggaggttgcagtgagccaagatcctgccattgcactccagcctgggcaacaacagtgaagctccatctcaaaacacacaaaaaaaagaagtacaaagtctgagacttcaggccagctctgctacactatatactctaacctctctggtcctacttggtgacttctttccctctggtcgtgttcaagttcccgtcccatccagtcaagcaggtactcattggtaccttaccctgtgcc

SEQ ID NO: 16837 - DNA, 7527 bp, Human
tggaagacctccctgttggttcctcctctacgcccacccgcctgcccccgcacaagttgccccattccagcctcgctattctccacatctgtggccagcactccgcccaggggcagcttccagaaaccgtctgtccccagttcttttggtcatttctcttaagggccaatagaaatgggagaaacatatttgctgaccaaacgcgaaaaggagttatggagaccagggtctgatcaatttggctcacacaacggcagagatatgaaggaggccggatttcgcccaaggctggatctcaccaccccccatcctccatctctccagttcttcccccactttactcgtgcggttctttcttcactaacatcccggccagtagggtctctctcccttctcccagcgtccgccattccatctcccttaggcccaacctctccttcctacccaggggtgcgttcaggaggccttcctgtccctcctcctctgaaggctgagacgtgcggccttgcctcggctttgcctgcttgtaagacacagtccgcactctctacctccaaggaaccccggggttcctcctgcccggcttcaccctcctatttcccagcgtctccgccccctgccccgcccccgggccggctctccgaggagggggaactgctgtcgccgccgccgccgccgcctcagcttcccacagccgctgccgctgccgccgctctgcctggtccagccaccggcccagtgctctgacttcgccggaccggggagctctgcagagacaccctcactccttcccgagggtccgggacgcctagccgggcgtggggggaagctccgtttgcgggggacagggagggaggagcctggagccgaagccagcgccacccgtcgccggatcaacaggacaggacaggttgaggggcgtcgggaaaaggaagagggggtgctataggcaatcccggggaggacgaggaagccctgtagcaggaagctgtgatccgctctgacttgtagggggcctgttcacatctggggactggtgacaacgtgggtgcactcctctcttggggggctggttagattggagggcgtgggatctaaacagcaccagctgtccccaagaaaatttaaggggcagccaggggagaaaaaaacaaaaacaaaaacaaacacggatgctcctcattttgaggtggcggaaggccctccagtcaactacctggtgtatccactaggaagggtggatttggaggtgacttcaaaaggagcggagggtgtgaaggtgaagaaagggtcttggccgctagaattctatgctactagacatgggggggacttggtgaaaaaggtattatccggccagagggtctgggagccctgtcttactgaacctgggcaacctggatattctgagacatattttggggggatttcagtgaaaaaagtgggggatcccctccatttagagtgtagcaaaggaaaaaacaccaaggttgggttccttcctgacattggcagtgccccagtaggggtgggatgagcgaatattcccaaagctaaagtcccacaccctgtagattacaagagtggatttggcaggagtgtgccccaaaatacagtggaaaggtgcctgaagatatttaaaccacgtcttggaaatttagtgggtcttggctttgggataggtgaagtgaggacagacactggagaggagggaaaggggacgttttcaataggaggcaaaattcgagggtgggatccactgaggagtacataggctgctggatctggtggagccagcactgggcccacgggtggtaactggctgctgtggaggggggtacgtgagggggggggtctggggcttattctcaggtcctgtgggtggggcagcgagtcggggcctgagcgtcaagagcatgccctagtgagcgggctcctctgggggagcccagcgcgctccgggcgcctgccggtttgggggtgtctcctcccggggcgctatggcggcgctggccagtagcctgatccggcagaagcgggaggtccgcgagcccgggggcagccggccggtgtcggcgcagcggcgcgtgtgtccccgcggcaccaagtccctttgccagaagcagctcctcatcctgctgtccaaggtgcgactgtgcggggggcggcccgcgcggccggaccgcggcccgggtgagtgcggctggggcggggtctcccggccagaggtttctctgcctgggagattgaggccagggactctgaagaatagggcccggctgaggggctccccgaaagtggaagggggtgggccaggacgacaaagtccctgccagactgtgcctcagtttcccttctcttttgtccataacccggagtctccttattttcgaggtcaaggggaaggcttgaggggctgcctggcgccccgaaagcctcgtagttcctgctcgtccccccttcccaacacagcagtccccacccccatcgtcctccgcctacgtgccggttctcgcgattctttcaatctggagcggaggggcccgggggtttccagatgcctgggtcaccccaaggatttctgcagctccagccgcacgcccccccccagcccccgcctgccccggttctcccgctcctccacgcctgggctcggttcctcctggtcgagctctgctggctccgagccaatctccccagctctccctcgggtgtccttgcagctacctcgccagccagccctctatgcgccctcctcctgtgacctgcgcttcaagaacggagctgggcacccctcccataacccccgcgccactccgaaatcgggtcccgtaggctcaggggaccctacgctggcaggaactcagacacagttcacggctagagatgggcgccgactcgggggtcgtaccacctacaaggggggacagggaagtcggcagagagcaagcgatgggggaggagagttgtgagagttagaattggtccccgtccatgtacgacagtcagggagtccctctggccctgctcccgcccgctcccagctcccctaagggtagccacctcgcgccctcctccccgcgccaccggctgcccatagtggtacaatccgcagcccaccctctgagtaggaccgggcccccacgtgactcagcctgcctctccatctcctcagctcccaccccccatatccttggtaaggtcccccttaccccaggcgagttacctggccgaaggggagaggctgagcctcagggagaactgggcccccgggagccagcggactgacagacagacagacagacagacagatgggtcagtgtcagacaggccggcgctgggccaaggcaaggctctcgccaagctagcggcagccgcagcaggtgctgagtcagcgtcaggcccagtcccacccccactcctgagggagagcccctaccctgtggtcaatttgctgctgccaagatcccccaccttcgcaaacacgctgccccttcagtacccctgctggtctccctctgtccctgccttttgatatatctctcccctccctcctcccccactccttcccccttctggttgagctgtagggtaggaattaagccatttaaataaatttcaataaattacactgaaagctcctggttataggaaacagaagggacccacaccagctttcccaggagtgaaagagaggtgggagagagcgtgcttggaggataagagagctggggccctgggaccctcttccttcctttcattctcctttcttccctctaatcctgccaagtgtaggaatgtttctgggaacggagatgtcattttcaaagatgaatgtctctctctccagagcctcagctcaaaggcatcgtcaccaaactgttctgccgccagggtttctacctccaggcgaatcccgacggaagcatccagggcaccccagaggataccagctccttcagtgagaggggaagctggctgcagggtgggaagggggagaatggggacaggagatgacaatcctattccctcttcagcttctgttgccattgatccgtcttcctgacctctaagggaaaaagtggagctgggatgaggggagctcaggtgagggtcagaggcctgggtattgatgctccctctctccacctgcagcccacttcaacctgatccctgtgggcctccgtgtggtcaccatccagagcgccaagctgggtcactacatggccatgaatgctgagggactgctctacagttcggtgagacaatgaggctgagtggccgggaaatactggggactccccttcctcaatttgtcccttgagggaatgacaaccttcctcaactacagacattttgcccgggactcctccctccagctttgctgatggcctgtcatcgctgcccattccagaccagctcctctagggtctctccagtccccactccttgcacacccccaaaacagccccaggttctttgaatgtccaactctttctgccttttagggcccctacttcttatcccacctcctccagattttgtcattactcacttccctagagtcatccaggataggggatagtgagagactgggagtacagtggagagaaggaatcttattgcaagacccctaaaagtctagttcttttttttttttttaaatagtgacagggtcttgctatgttggccaggctggtctggaactcctgacctcaggtgatccacccgcctcggcctcccaaagtgttgggattataggcatgagccactgtgcttggcccagagcctagttcttagccctcagccctcttccttgtcctccctttgctcccaggtcctacatggactcagaagttgtcctccccctcccccaaaaaggatttgtgctttccatgagctcctttctgcccagtgatgtgtctttttatctctctgtctttgtgcgcctttctgggtctttgtctccttagccgcatttcacagctgagtgtcgctttaaggagtgtgtctttgagaattactacgtcctgtacgcctctgctctctaccgccagcgtcgttctggccgggcctggtacctcggcctggacaaggagggccaggtcatgaagggaaaccgagttaagaagaccaaggcagctgcccactttctgcccaagctcctggagggtgggtatagactcaagaaaatgtgggccacaggagagggtattgaccttgatatggacatttaggggcagacagctcaggctacaagtgataagaggaccctttgtgacagatcaagccaggaaggctttgccctttgggggtttgggtgcggtcctcctgtggggttggggttcttggagggtgaatgtacgggaagggagcccttttggagcactggttctgcctgggtccctctgtgcctaactctccttcccctgctcctctctttctccccttcacagtggccatgtaccaggagccttctctccacagtgtccccgaggcctccccttccagtccccctgccccctgaaatgtagtccctggactggaggttccctgcactcccagtgagccagccaccaccacaacctgtctcccagtcctgctctcacccctgctgccacacacatgccctgagcagccaggtcccactaggtgctctaccctgagggagcctaggggctgactgtgacttccgaggctgctgagacccttagatctttgggcctaggagggagtcagagagggggatgtctgaagatggtcctggctgatcacttctttctttccacactcacacaaccccatgccttttcctgagatggcgctgggagttcccacatggacagccagggcataaacacttcccaccccggctcagccagttcctggagtcctgtgccccttttcattgccactgagccatttctagattcactggagctcaggattcatgtgtccttctttccctactctaccttctaccttggtctggacacattctggaacactggacaccctcgccagggccacttctgcactagggctctgtgctggaacccaggcatgctgccagccttttctctggatctgtcaggcctctgtccttgactcagatggacccctggtttccaagtagaaagaggctagatttgggccttgtctagctgttggctttggcctgaaccggaaccagtctcagatgaccacgggtttaaccttcttatcccagagacacccaattctagagctttatggagccgtacttccccctgaatcctagctctaggacatagatcatgactctcagcccttttacccaggatggagctggggcctgtatagccatattattgttctaagtaagttctagccccaccctcccgccttcttgagtgatacctattacggatgagttctggaaaagacccagctatgattcataaaaacacttctggatgaatcaagaaccatttcttgtttttcctagataattctctaaaaatatgattcttccatatagaatgctaagcttatttttacatgcagtttctagctccttcaacccagctgaggtcgtgccagggagacagagtctggagaagggcagaggaattttggaaggatccctggctcatagtagggaagctgggatgggggaggggtcaaaattatggcatgactgaacctgcatctgtgttgggtggacatgaatacttagctacctcagcaggaattccttccaggtcccctttaaagctgaggtccttagagtaatatgtccttaataaaaaggacaaatggatacagccttgaccctcccagtgaggagaccccaattcagcaataagtctcacccttctcccctacaggtcaggccaagaagggtgaaggcctcttgcactccagacctcatacgccccaacagcttctaattggatagaacttgctttaccttacagctcacaacctcagctgggttttaggtacccaaaaagggcctgtctagattttttcagaaaaacgtggagtgctaggggcagcctggaaaagatggggaacctgctagtgaactaggagggagacttccatagcctcagacttggatagggtaggctgagggggccctaagggagggactaaggctccaaggcaggtcacttttccttaggctgttctacttctggcttgttgcaagaggagtagatgccccctcacccacacaaaccccactcagtctccacccaactcctggcactgctcccaggggatcgggtctccactccagctttctcaattaaagacgatttatacaactgaagtgctgtctgtcatctgtcggtggcgggcttggcagttgctcgaggcaggatcaagtcccgggggcggggcgggtgggctggcggctgtcctccagcaacaggtgcacattcccgggctcctcgtcacttcccctgtgctggcggtcccagcggctctctgagcgaagtcactgagcgagccgccaggctatgaccccaggggctctgc

SEQ ID NO: 16838 - DNA, 9948 bp, Human
gctctggtggtgtgggggggggccagactccagcatccctgatgatcaccagggcgagaaagggcagggaggaacggagggaggtgtgggtgagctgatataaaaaggtttttatgatactagagtcttcgtgtctgttttgggggggcatatgagtgaggtgggggaccaggcagggggactggcgggctccctggtccagcagcagtgggtatggcatattggtcctgaaaccaggcgttgagaggtgggaccaggcaggagccaatggggcggctgagcttggtgtgaagtcaagtgggtgggggtggggcttcgtgccattgactggttggttgctaggcaacttggtaaactgaagggggaaacctgtttgaaatctcactcccaaggtgggggcggcaggggtcagggtgagcggggctgagcaggagctgggtcagactgttgggtgtgaccgtgtgagactgtgcagacagtgacagggcgcctgtcgcccacactccacactgtttgccattctccagcagcatggggaccattactcagctctgaggggagcaggagcactctcctccgctccccggggctccccaggaggcagacaacccagttgccagagtcaaggacacacataaaagagtaaaggtgttgaaaaatacagtcgtcacctttgatattgctgttccatgcggggcgcggcgagggtcttattcattcagcggctgtcgctgggcttgtttctccatttgtctgctctgtctttgggggtgggggacgagtgtgtcatttgaagcagtgactcctccctcctccccccaacaccttcccaaacactgagaatggggggactttgaagaaatactgccagcaggggatgtgattttggacctcacaatcaaagggaagggacgaaaggcctggggaggcttgagagggagaggaatgtcacccctgcccagaggtgctgaaagccagggctcttacacccgaaaaggcaactcctcccttcccccaggataattggaaacagcccttcctgcgcagcgccggtttggggttgtaggtacgccccttcttctcccagccccgcttctccccccagccatctaggaaagacccaagtgtatcccctaaactcttgtttttcactaacccccaggtaacaacagcacttggtccatggagcagtgacaaaagagaccccaagagtgggaggtgcgcagcctgggtttggtttctagctttatcccagacttcctgtgtgaccttgggcaagtcacggggcctccctgagcctcagtttcctcatctctgcaatgggatcgttagctctgcccctcccacttcacacaggtagtcgtgacgatcagctccgccgcactttgtaaagcgccaagccttcaaggttattattattctctccaaacctgccgggagcagcggtgttgttttgggatggaggaggaggctgcgggagcgaaaggggtgggttcctcggggtggagagggcgagagcctttctggattcgagagaggaagattccagcagcttgggcgatcggagggcaggaggggagccgggcagaactcagccggagccagaggctcggagagacaaagggggcgtgacagcccgcgccgggggctgaggcggggcggcgggcgggaggtgcgcgaggtgagggaggtgtggggggcgtgggccgcgggatgctgccgcccgctccgcctcgagctccagctccggtttttccctccaccatcctctgcccctccccgcctctcctttaactcccccctcctgggctcgggactggtttcctcccttagcccgctgccctcaatcccagcgaggctggggctccggctcggcgcccccttcctcgctccctggtccggcgccccatgccgcccccgcccggtccccggctcccccagtcccccacttaggcgggctcacagatcccggggtgctggcgcgtgggccgggggcgcgtagggcgcctgcagacggcccctggaagggctctggtggggctgagcgctctgccgcgggggcgcgggcacagcaggaagcaggtccgcgtgggcgctgggggcatcagctaccggggtggtccgggctgaagagccaggcagccaaggcagccaccccggggggtgggcgactttgggggagttggtgccccgccccccaggccttggcggggtcatggggcccccccattctgggccggggggcgtgcgagtcggggccctgctgctgctgggggttttggggctggtgtctgggctcagcctggagcctgtctactggaactcggcgaataagaggtgagtggcctgcggctggggagatcccagaccctagggcagtgggtagggaagctctgggggcttggaggcgggcttctgtgggcagggaggaggcgggagggaaggtgctggtgctctgatgtgtgatgggttactagacaggtgatcttgggagccagactccgggtcccacgcagagctggatgcgggtggtgctatggatgtcaggagtttggagaccccaaaggggcaaggagaagaaagttcatgggtagccgggagggcagtgaggtgggtatttggatctgtgggaggcctgcgtcgggggctgggcttggagggagcctggttactgtcagctctcaggagagagctgcagattaggtgctgcgagtcgctgaggggaaggcagggcagggtgcctccctcccccagagggactgcgcatccgagatgggaggcaagggggttccgtttgggggctctggggacaacttccccaaggctccttgactctcttcacagtctgtctcccaactcttccccacagccagagggtcagtgaactgttggctgaacgatttcccagccagaacatattcctgccttcctggcttgccggcatcttgctggaagaagcctggagccccctgaaccctccttccttcccttttgcatctggaggactccattgccccctcccccaatctttgctgcaaactcttccatcagaccctctgttccatggcatgccagctttgctctgaaaagaggccaggggtcagatgaaacttcaagccacgctgggtaggacagaaccttcgggaggtcacctgggtcccttgcctacatgcggatcccacttcccgctcataaaagagttctgtgttttgaaaaattcctacttccctggggagactgtgtgaggccatgggaagggggtgggctttggagctcatcaaatctttggtcttaatcctagctctgccgctttcagctgtgtggccttgggcatgtcacttaacctttctgagtttgtatcctcaatccttacagctattatgaggattagcggtaaggtgtttgaatgtattatgtgctcattaaaggagagctaggattattgttcctctctttacttcccagcctccctcacacttctctgctctgccatccctccctctcttttccctggatctctttgggtataatctcaatgtcttttctgtactcagtcacccacctgccaactcccagctgcaatgtgagtatcaggtgtgtagcttgagaacataagcttgttttcacagggtagagaaaagggagttagggtgtcctgggggctctttcggatgtggggtgggagtgggacacttgggagtctgggaagatatcaagtagcagtcccctgggacccagtcctgagaccctgtctcagcagctattgatgtccaggaaggggctgcaggggttggcaagttgtggctgtgctgggacagtggatgcctgggtgcactggccaaggagatggtgaagtgtgttggttgtggttagaaaagtcaactcctttcctttccaaagcaatagagcacttgccccagaagtctaagacccagtgtgggattctgagtgggagaatgactcaggcagcaggttcctagaccctggttcccatcagccccaatgatggtcgtggccaaaccaggcatttgccttctgtgctattagctggctaacttaggacactggtctggaccaccctccacacagcccctccctgaaccgccgccccctttgcccggaaatccctgaaattcagtggtggcctgaaggaggggaggctctgcccgcatggttggctgccatggaatagtgaaatcacctgggaggggtgggctgtgtggttccagagaggccagctccttggtaactggcatcctgttgccatggcaacggggctggtgatggagcgggagatggcggtgtgcatgtggtgagggcgggctgaagagtggagtgcatttgggcacaccaaggggcaggagacccctgagcctggcttcctgctgcttccaatgtgaatgcacagagtccttggtgcctgctctataagaagagactttccactcagacaaaggcgggcaagcgtgagctgagaattgctgtcctggaaggttgtggggtgagggaaggaaagttctgggggccaggcctctgacatctcttccttgtccaccttaccctcctccccataggttccaggcagagggtggttatgtgctgtaccctcagatcggggaccggctagacctgctctgcccccgggcccggcctcctggccctcactcctctcctaattatgagttctacaagctgtacctggtagggggtgctcagggccggcgctgtgaggcaccccctgccccaaacctccttctcacttgtgatcgcccagacctggatctccgcttcaccatcaagttccaggagtatagccctaatctctggggccacgagttccgctcgcaccacgattactacatcattggtactgctgggcagagggcacgattgagtggggggctcctgatactgagcagagagggagggggacccctgcagccaagagggagatcccagtgccctcaggcagtgttcacaccagggtgtggggccagaatcagggctagattctggagtgccaacctcttcctctggcttttctctcccagccacatcggatgggacccgggagggcctggagagcctgcagggaggtgtgtgcctaaccagaggcatgaaggtgcttctccgagtgggacaaagtgagtggggctgggggacacctcctgggcacgaagggacgttggggcagtacgatcatggttggggcagttgtctcagcccctctctgggtcttcctcatctccaggtccccgaggaggggctgtcccccgaaaacctgtgtctgaaatgcccatggaaagagaccgaggggcagcccacagcctggagcctgggaaggagaacctgccaggtaggaaccaggggctaggcccctgccttccccagcttcctctgctctcagaccccagctgccctgccgtcaccctccctccctcttcagttttgggggcggtgatacaggaaagaggagaagagaggatgggagggtgggaggggaatggaaaccaaatgaggaaaagactcaattagaactaattagccaagtcagtgcttcaatcagtgctgtcagagaagtggggaggactccgtggcaggaagctgaagggctggacacctggattctgagcagagttcggagggggaggagagatggggtccccaaggggcctgggcgctacaagggaagcccatggggacccccagggttgggtgtccaggtgcccaggtggctccttcagtccctccccctctttcctccttcaccccttccctgccaggtgaccccaccagcaatgcaacctcccggggtgctgaaggccccctgccccctcccagcatgcctgcagtggctggggcagcaggggggctggcgctgctcttgctgggcgtggcaggggctgggggtgccatgtgttggcggagacggcgggccaagccttcggagagtcgccaccctggtcctggctccttcgggaggggagggtctctgggcctggggggtggaggtgggatgggacctcgggaggctgagcctggggagctagggatagctctgcggggtggcggggctgcagatccccccttctgcccccactatgagaaggtgagtggtgactatgggcatcctgtgtatatcgtgcaggatgggcccccccagagccctccaaacatctactacaaggtatgagggctcctctcacgtggctatcctgaatccagcccttcttggggtgctcctccagtttaattcctggtttgagggacacctctaacatctcggccccctgtgcccccccagccccttcactcctcccggctgctgtcctcgtctccacttttaggattccttaggattcccactgccccacttcctgccctcccgtttggccatgggtgcccccctctgtctcagtgtccctggatcctttttccttggggaggggcacaggctcagcctcctctctgaccatgacccaggcatccttgtccccctcacccacccagagctaggggcgggaacagcccaccttttggttggcaccgccttctttctgcctctcactggttttctcttctctatctcttattctttccctctcttccgtctctaggtctgttcttcttccctagcatcctcctccccacatctcctttcaccctcttggcttcttatcctgtgcctctcccatctcctgggtgggggcatcaaagcatttctccccttagctttcagccccccttctgacctctcataccaaccactcccctcagtctgccaaaaatgggggccttatggggaaggctctgacactccaccccagctcaggccatgggcagcagggctccattctctggcctggcccaggcctctacatacttactccagccatttggggtggttgggtcatgacagctaccatgagaagaagtgtcccgttttgtccagtggccaatagcaagatatgaaccggtcgggacatgtatggacttggtctgatgctgaatgggccacttgggaccggaagtgacttgctccagacaagaggtgaccaggcccggacagaaatggcctgggaagtagcagaagcagtgcagcaggaactggaagtgccttcatccaggacaggaagtagcacttctgaaacaggaagtggtctggctggaactccaagtggcttagtctgggggatcaggaggtgggaggtggatggttcttattctgtggagaagaagggcgggaagaacttcctttcaggaggaagctggaacttactgactgtaagaggttagaggtggaccgagaaggacttttcccagtcttcagtggcacttcccaagatctcccttcccttgtgctctgtgctgattttaggacagctaagatgactgccatgtgctgtggcaggcctaatttgtcttgttctttcctttccatatcccagtataatctctgttaatcaacaggactaccccaagaacccatgtgctctcccgagtaacccagatggctgtcttgttcattccatcctacatttctgactcctttcagactcaacacagttcccttcttagtgaccaaaatggtggcctactggctggtctagctgacagtggtacttagcaaaggccactgtttccatagtgaccagctgatacctcttcctgccctctagtgtgcaattgggtgttgcctcagtttcctcccagctcagttttattagatcaaagctgttgttgggcaccaggttggccacctcaatcaccagccaagatggttgctttgtccaccagaggtcaagttcacctctctggtgctgtagttcccagctccttcctgatttttctaatcgctccttctggggaacaggaagttgatattgccatggtggcggggtatgccgtcacctcagtagttttactgtaaaagggaaatttgaacaacaaaaaccaaaaaaaataaaaataaaaaacttcaaaagttgacaagaaggctggagaatgactggacttgaattgggacaaaggcttggttagaatggctttcagctgagggttggattgcatgaaaccaaccaaggggggtgggtagggatagggctagtttggagtggtgaggttggcagtgcttggggaggcgaaaatgggctgggcgagaaggcagaggaaggtgtcacctctaggggagggagagagtaatgcaggcaggagtggggtcgccaattcatccatggggacagtctgagtgtcttgctaagccaaagcaccagagacagggtaagacgcaattaggatcaaagtggtaaaaacatgttcacatgttaaagtctattccctaccatccctacccaaggcacttgagaagttttgctgttggggactcatggggagaagggatgtggctgatcagaaggaagtaggaaggactcagggagggacccaggcatcaagctgcgtgtgccctggctccctgtatacccataaccgaggctcttctcccccaaaaagcccaggtgcccagtcccctagacttagccccattctccaaccacaaaagcagccgtcaggagcatcactggagcgagtcagcaggggtcacaacctctgccctccctgcccctcccctgactttaggtcccctcccgctgtctcccatctgcctggaggtcaaggggtccctcttcctctcttctgtccagtgggacccctgctcctccccctccccgtctgagcaagatgcctgggtcttgagaggtgcgggcaccgcaggaggggagttgaaagctgggaggccaggtactgggctgtctggaatttactcttgccttctgagcccacactggagctgcccgaagtggggaggctcgtagggggtggaaaggctggtccttgccccttagtgggggttggttgtcatggcaacatccccttctctacacaatgggaagcccccctcagcctcccgcgtggatggagccgacagccccatcgctggctatcagcctcagggacttggcaaccgtcactatggcaacccagagcccagcaacagggcccactgagaaagggaggggtccaagactggggcagggtggtgtgtgaggggcaagggagatcagggagactccccctccacctacatctagaggcacaggtggagagacaagagggaagagacgtggggataaatagtctccgtgacagacaagcacctcgccaaagcagccaagacatcataacatgctgagagacaggaagacacctggggacagatgcacagccagggagaggaacagcacagactgcacagcgcctgggacacgccccctcagagcgctggcatccagagactccccgcagccccgctcgaatagcacaagaccaacagcctttcacatgtgtagtgacttgggtgtctggagctatttgaaaatgctggtgacttccacgcagaataacacaggccgtcctatttgctttgtggggacaaatacacacacatattcctagagtaacaactgcaacaaaacaactacagcaaaacgactacaggcacaggaagacatttgtttgttcattggtttgttcgttcactcgctcagcagcatgttaaatgctactttgtttcaggcaccggttcaggcgctgggaggacagggtgagtaaggccaggtccccgctttcacaaagtccacatttaggtggggaacgaaataatacaatttcaggtgtgaaaagggatataaacaaaacagaatgacaggatgaggaggatggagagtaaccaggagctgctttatttatttattaatttattaatttatttatttttgagatggaatcttgctctgttgcccaggctggagtgcagtggcgcgatctcggctaactgcaacctccacctcccgggctcaagcgatgattgtcctgcctcagcctcccaag

SEQ ID NO: 16839 - DNA, 12249 bp, Human
  misc_feature (1)...(12249): n = A,T,C or G
cttgaactcctgacctcgtgatctgcctgcctcgcactcccaaagtgctgggattacaggcgtgagctaccctgcgtggcattcaaaacagtttttgttgttgtttgtttgttttttgagatggagtcttgctctgttttccagactggagtgcaatggtgtgatctcagctcattgcaacctctgcctccccggttcaagccattctcctgccttagcctcccaagtagctgggattacaggtgcctgccaccacacccggcttatttttgtatttttagtagggacagggtttcaccatgttggccgggctggtctcgaactcctgacctcaggtgatctgcccacctcggcctcccaaagtgctaggattacaggcatgagtcaccactccgactcaaaacaggtttcttataccttgttgaggctggggatggggtcagacttaatgataatcacagtcctgtgcagccacggtttatggggcacctgctcttctcccgaaagcctggaacctcggacttcccactcaattgccctcacctactctaactcttcattcttaaggctctgcccctttccttctggctcccaccctcaggtgtcctgaaccctcccgactctgggctggctgcccgcagagctgggctccttacttctccacattgggggatttctgcatcaagttggagctgttctttcgtaggatgctccggggccggtcctgttgggagttttgggggttcaagcaagttggcccagagtgcggactgcacccggggctgtttacctcttgccctgcaggtcccccaggcccggggctggaagccctggatacactggttcgaggcccggggatgttgaatccaccagggttcctgccagacccaaggctgtggttcgcagcctcccttgggtgctgactgggcccggaaccaaggaccactatccccccggagggacagcttgaaccagtactatgagttacggagccccctgagtgcacgtggggcccagaaccgtgaaacaagactactctggagggctgcccagcgcctgcctcgactcctgtgaccgctgcgggcactcctctggctgcccctccaggggaatcccggttgaggccgccagcagcccctagggactccaccttctccatggccccactggggggccgctctcagcgatcctgacccgcctcccggctccacgtagccccgcccctggccccgcccccaccgctgccggccggggatgctcgggctcagtcccgggtccacttctcccctgctccagagctgcggcgggcggaatcaagactatatagagactcgggctgggggtccctccgctcgcccctttcctttgtgtcccacccaaagattttctttgtctgggcaatttgttcccgcccttctccatcaccaccctcatccaaaccagccaatcccagtcagggggccaggccaggagcttcgactgtgacctcacggtcctccagcctgagcgtgagcttcggggagttgggcagggggcttgttaatagctctaagggagatcttttggggtcatcaacgctgtcgcttgaaacggcctgtcgggacttctttagactctttgtggtcttaacatggaatagtttggttgagttggagttgaagctgggcttgacttgaactatcagcgagcttcccccacccccgccagtcggctagctcagccaatcaggagaggtgtgaggcaaagtggaaggactgccgcactgttgcaagacacttcgtcctcagtcgggtggcgggaagagactttcactaccgcttctctgggtcctccagactcggctcacgctgctttggagcctgcatcccgaggggagacaccccctcttgccgtaaagcgagtgcttcaaggtgtcaccgccccctagcgagggcggggtcgtcggtgccgctgtcgcaaagcagaaagtgtttgggctccagcaccccaccgtcgtaaagatgcctgcggtgggcgtgtctttctcccactgtcgcaaaagctccctgcccaggtcttcgtccccctcggagccgctccgtcacctcgctatgccgtaaagcgaggctcccgaccccgtgtccttctgttctcatcgtggtcgtccccagctcctagcgcgggctgcttcattgcccggcagtgccgtaaagcatacctggcctcagccccccggtcgtatccctcggactgtctgcccgacgcggttgccacggtgccgccaagcgcggctgtcgcgctgccccggtgtcagcggagatggcggcagggtcgggtgggagtgggggctctgggggaggccctggaccggggccgggcgggggtgggggccccagcgggagcggctcaggaccggggtccaacgggggtctgggcagcggcggggaactgcacccgcgcactgggcgcttggtgagcctgtcggcctgtgggcgtacggcgcggcggcagcagccgggccaggagtttaaccacgggctggtgttgagccgagaacccttgcgcgatggacgcgtcttcaccgtccgcatcgaccgcaaggtgcagcgctggtaccgcggaacagagatgtggagggtggtgggaggcgtctagagggagacggggtaggacagccagggtagcccacattgccgggcaccgagagggaacagaaagaccatagagcaccagggggcggtcaggaagacagcatgaagcagaaacattgagtttgaagatgacattaagagcttgagttttctcaagatccagaaccagggaagggacacgagggctaacccactagaatggctgggaacagacctcctggtacaatttcttgggcatggaggatggagagatgtcagagatgtgatggcaagtgaagaaagatgccaaggaacgaacaaacgtaatcccagcactttgggagtccgaggcgggcggatcactagagtcaggggtttgagaccagcctggtgaacgtggtgaaaccccgtctttactaaaaatacaaaaattggccaggcatggtggcgtgcgcctgtaatcccagctactctggaggctgaggcaggagaatggcttgaacccgggaggcagaggttgcagtgagctgagatcatgccattgcactccagcctgggcaatagagtgagtgagactccgtctcaaaaaaacagaacaaaccattgaaggacagaggctgtgccagaaagataggtgaggagaaagatccagggtgagggaggtgtgtgtgattcagtgaagaggccaggctcacagaaaaagaacttggaaggagattgaatctgggtagagcctgatctttggagagaattaggccaggggaaaggaatgaatgatacacaagagcaagaggtgtgggtataggaagtaggagaatttggatggttggagagccatagagacaaggaaagttagaggaggcaggaggttggaaccaaggaatttgtgcttggcttggaaaggagtggtttagtaaacactgagtagagagcagagttgctaaaggaaagcccaaataattaccaagacggagtccagaaaatcactgtctgcatctctggattagtgttccaagagacagaaagccagctagctgtctgagaggtgggaagatatggtggcctgtggaatggggggtggcccattctaagcctctgtccaatacccctatcccaggtcaactcctggagcggctccattgagattggggtgacagcgctggaccccagtgtgctggactttccaagcagtgccacgggcctgaaggggggctcgtgggtagtgtcgggctgctctgtgctgagagatggacgctctgtgttggaggagtatggtcaggacctggaccagcttggtgaaggggaccgcgtgggcgtggagcgcacagttgctggggagcttcggctctgggtgaatgggcgggattgcggtgtggctgccacaggcctgccccctcgtgtctgggccgtcgtggacctttatggcaagtgcacccagatcaccgtgctaccccctgagccaggcttcagcccccctactcccatccccacacctcccctcgagcccttggcccccactgaagactctgccttggctgaacaggggacctctgcagatgaaggtgagaacacagctagggcagtggtggtggggtggggacggaatgggggaaatagagtgacaagacaggctgggtgtgggcagggccaccctgatccccaagtctgttgaatgggagagcaggagctagaggatggggggttctcctggctatgggccgtgaagcagggactgaacccttattcccctcccatcccacctggtccccagccttcatggtgtccccagcgcaggcccggccggagacgtttcctaacagccttgagtcgcataatggtgagggctttggggaggccctgggaaggggagtgggaagtgaggtggacaagggagggccctcaggagaaggggtagggagagaggcaccaggtctgggggtgtagagcctcatcccaacttccgagcttccttcttccatcctgctgctatagactttgccaacatggagctgtctgaggtggtgagcaacaccatcctgtctgcctacaatggagggctcctgaatgtgaacctgagctccccaccggcaggggaaggcctgggatctagcggtgctgccacctcgcccattctcacttccaacgatgccctgctctttcatgaaaagtgcgggaccctcatcaaactcagcaacaataataagacggctgagcgccggcggcccctggatgaattcaacaatggggttgtcatgaccaatcgcccccttcgggacaatgagatgtttgaggtgtgcaaagtcctgtggtctggttggcgccttatccctgggagctaaagatggggattgacccttggtgctaggagggtgggccctggggaagaaccaagggctgaaggtccctttctgcatttacattccctgcttctcccttctgtccctcaatgccagatccgtatcgacaagcttgttgataagtggtcaggctccattgagattggggtcaccacccacaaccccaacagtttggagtacccagccaccatgaccaacctccagtcaggtaccagccccgggcaggggcgggggtgcaggcctggtgttgctgaggggaaggaagccccgtacccgaacccaagtgtccactatcacccaggcaccatcatgatgagcggctgtggaatcctgaccaatggcaagggcacccgccgggagtactgcgaattcagtctggatgagttgcaggtgagggtggggcacagatccctgggccgctttcagcagagccacaggtactctgtgtccctgccagggcaccaagcagggtctcctatgtgacctagaggcagtccctgtatcttccacctaaaggttccttcctagaagcctgagttgcccaagagttcagcactcagattttggagtcagatggttgaattcctcttactgttttcccatttgtagtagcgaaccggggcaagaagcttatcctctttgattgctcccccacctcctgcaatctctaaaatgagcctacgagtagtacttattccataggctgagacttgtagaagctaatgtctgtgaggtggtttaactcagtgcctgactcacgtggagcattgacgaaatgtggaaattgtcatgtctggaaaacaaggacccaggacctgtcctccagggtggtctgagactctcacgaataccttctggagttgttcctgtgtggagtggggtgctgagcaggcctcaggactcctctaaactgtttgtcttctttgattaggagggtgaccacattggcctcacaaggaagtccaactctgccctacacttcttcattaatggtatcgatcagggtaagggccgcccagagagagcctctgggccggggctttcggtggggctgggactgggggctgtacctcatcctcctgcttctctttggtgcttggcctccctgtgtttgactttctcccctcattctccctgtccactcccacacccccgtaccttcctgccacaggagtggcaacccccttgacgcccccagtggtgtatggtgtggtggacttgtacgggatggcagtgaaggtgaccatcgtccacaataacaaccacagtgaccgtctccgccgaaacaacgccatcctgcgggcgctgtcccccgagggtgctctccgccgtgctgcccctgccgcccaggcagaacctgagcgcctgctcttccaccccaactgtgggcagaaggcagccatcacccacgagggacgcactgccctgaggccccagtatggcccatggggtggggagaagcctgaagaagggattctaatgggggggggggcggggcaaggaagtggaaggcagagggagcctggcgggggcagcttcctggaggttgagctttagttctttggcttggggcagtgagtgttggcaggcattgctgggctaagccttggcacattgagagcgtgtgttggggatctgactctccacttgctgtgccctcagtgccaccgatgacttcaatcacggcgtggtgctgagcagcagagccctgcgggatggagaggtgttccaggtgcgcatcgacaagatggtggacaaatgggctggctccattgaaattggtgtcaccacccacaaccctgcctacctccagttgccctccaccatgaccaacttgcgctctggtgagctcccaggaagggcagggacaggatagggttttggggggaagctatccccaaagccctggcacttgttctgcagctcctttttcacttgtcactcttgtgaccactcattcagtggctagagagtgtcccgtgggcagggctgtggctgtcttggaagctgcagagttttcttgtcctgctcagggaagaaatctagtcatcaaagaaaaggcaaggtggactgtgggctcgggagtcctgtgggcgctgctgtggcaaggagaggagccctgcatttcccctcatgtcccctcctgctccttgtcctcccagggacctggatgatgactgggaatggggtgatgcacaatgggacgaccatcctggatgaatacgggcacaatctggaccgcctcaaggtgggaaagtgggtgcgccgcctggcggccgcagcgggcatcacaaacaccgcggggctgatgcaggaccagccccggcaggaactctgcctgactcctcactccagcacccccttcttccaaggcaggggacacggtgggcgtggtacggcgggaggacgggactctccacttctttgtcaatgggatgactcagggccctgctgcctggaacgtgcccccgggcgtctatgctgtcgtcgatctctatggccaggcggcccaggccaccattgtggacgacgtgggtgagggccgggctgggctggggctgggggttagggtggccttgggaggtctgagagacacctagagacctgatgggtgatgtccacttttacagaggtggctccagttcctgaaccactccctgaggggaacaaccaggtgtctccaagctctccgtcctcaggggccgggggctctgacctgcgcttccatcagctgcacggcagtaacgcagtcatcactaacgggggccgcaccgccctccgccacaactgtcgcagcgagtttaatgacgccatcgtcatctccaaccggtcagtctctcaactttcatgtccccaccttcctcctgcccagcctcagccatgcaagtagagcctctctgatcgccagtctcctggcagggccctgcgggatggagagctgtttgaaattgtcattcagaagatggtggaccgctggtcaggctccattgaggctggtgagggccgtctgtgtgtgttgggggctgttggatgtctgtgccttggggatcggccttgacttacccctgcctcctcccaggagtgactgctattcggcctgaagacctggaattccccaacaccatgacagacattgactatgacacatggatgctgaggttgggcttcctgctttggggaccagcttggggctgagtggagctggctgggatcagggaagcaaggtttgggcctatggtggctgtgggtagtgacagacctaggggatctacctgtcccctccccttgaattctgggaagtcctgcccaggcccacaggggctcagtcctccttcatcttaggcagttcttgctttttcctaaggggatcccagggacagaggagataggattgggccttacacccagatcaagacaccagcccaagacattggagggttctgacagacagggagtgggcaggggccaatgtgaagttgaagttggcaggctgactcaccccttctgccatccccccagtggtacagccatcatgcaagacggtaacacgatgcgcaacaattatgggtgtgacctggatgcgctgggcacaggtgcacgcattggcatgatgcgaactgccaagggcgacctgcactacttcatcaacggccaggaccaaggcgctgcctgctcgggcctgcctccgggtaaaggtgactatgtggctttcagcctgccaccctcagcccagaccacctggctgtcaggcttctgaccttccctctcctccccagaggtgtatgcggtagtcgatctctatggccagtgtgtccaagtgtccatcaccaatgccaccggccccatggacaacagcctggcgaccagcaacactgccaccgagaagtccttcccactgcactccccaggtgcggcagcagggcgggggctggacgggctctgcttgcctgctgtgcacctgaggagtagggtttccaggttagagaggttctgcaaagacggttggctggggtagctgccggctccagggaagggacagcccacggtggcaagcagccagtgagggggaggttacacctggtacttagagcctggacacttccctgccaccaaggggccaggacaccataagctgagcatgccaggtttggaaatgggccttgctgtggtgaaaagaggtatcagggccgggcgcagtagctcacgcctgtaatcccagcactttgggagttcaaggcaggtggatctctcgagcacaagagtttgagaccagcctgggaaacatggcgaaaccccgtctgtaccaaaaatacaaaatgtaggcaggtgtggtggcatgcacctgtggtcccagctacttgagaggctgaggtgggaggatcgctggatcccaggaagtcgaggctgcagtgagccacgactgtgcccctgcactccagcctgagtgacagagcgagactctgcctcaacaaaatacaataaagaggtgtcaggaggccctgaggtgtaatggcagatggcagatggggcgttggcgtccccatttcgtttcatctgaaagctttgctctgtgttctgcctgaagctcgctgccccaatcctaccccttctactggtgccatctcttcacagtggctggcgtggctcaccgattccacagtacttgcggcaagaacgtcactctagaggaggatggcacgagggcagtgcgtgccgctggctatgctcatggccttgtcttcagtaccaaggagctgagggctgaggaagtctttgaggtaggccgtagtgatgtgacagaggggctgcgagccccatcacgacagggccagcttatgttttctctgtctcgtaggtgaaagtggaagagctagatgagaagtgggcaggttccctgcggctggggctgaccacactagcaccgggggagatgggacccggggcaggcggtggtggcccagggctgcctccttccctgccagagctccggacgaagaccacttggatggtatccagctgtgaagtgaggcgtgatgggcacctccagaggatgaactatggccggaacctagagaggctgggggtgaagtggctggctccagggacaggggaggggttgggagtggaggtggcagggagaggtgggctgaacatcgtccgtccttgtcctacctcggtcctaggtggggagccgtgtgggtgttcgtcggggggcagatgacacgatgcacatcctggtggatggagaggatatggggcctgcagccactggcattgccaaggtagacctgaacgcttccttgggttctgggaggatggttgaggtcttctgctgatctctgattttctgggtcttgtgtgcctcccagaacgtgtgggctgtgttggatctctacgggccagtccgcggtgtgtcaattgtcagttccacgagactggaggagtcagaaggcacccagcctccttcccccagttcagacaccggcagtgagggcgaggaggatgacgagggcgaggagcatggcctgggagtaagaggctgcagcatggtctgctgtgcacatggatgggcagttgctgggccgttggatgccaggccttttctgggttctctgatcgttgggtggaggctcacactcaggatctgtgcaaactccagtggggtgggtcagtcctggcattggcaacccatgcagctcagtcccttcctccacaccagggccagaatgaagtgggtattatacccaccaccctcgagttcctggagaaccatgggaagaatatccttttgtctaatgggaaccgtacggccacacgggtggccagctacaatcagggcatcgttgtcatcaaccaacctctggtgccccagctgctggtgcaggtgggttctccctccctatccccagcttctctcgctccacagtgacccatggccaacccccctgaaaaaaggcctttttgtgtggagaaaaagaaagcaagccacttggatgagcttcctaggcttttattcatagcctgtaatgagggtcatcagtcagttaccacgaagtccctacctggtgattggtgagggaagcagtagggacaggctggaggagtccaagagaaatgcctgatcctatatgtgggagcagagagggctttccagaagaaggtgcctttttgctacaaactgaaagatatgtgaaagttagccagctgagcccgggtgcggtggctcatacctgtaatcccagaacttttggaggccaaggcaggcggatcgcttgagctcacgagttcgcgaccagcctaggcaatatagtgaaactctgtctctacaaaaaaaatacaaaaattctccaggcatggtggcacgagcctgtaatcccagctactcgggaggctgaggtgggaggatcacttgaacctgggaggcagaggttacagtaagccgagatcacgccaccgcactctagcctgggagatagagcaagaccttgtatcttaaaaaaaaaaagaaaaaaaggccaggctcagtggctcatgcctgtaatcgcaacactttggaaggccgaggcgggcagatcacgagatcaggagatcaagaccatcctggctaacacggtgaaaccccgtctctactaaaaaatacaaaaaattagccgggcgtggtggcgggcgcctgtagtcccagctactcgggaggctgaggcaggagaatggcttgaacccaggaggcggagcttgcagtgagccgagatcgcaccgctgcactccagcctgggcaacagagcgagactccgtctcaataaaaaaaaagaaaggaaaagaaaactagctaggtnnnnnnnnnnnnnnnnnnnnnnnnnnnnnnnnnnnnnnnnnnnnnnnnnnnnnnnnnnnnatctcggctcaccgcaacctccacctcccgggttcaagcgattcttctgcctcagcctcccaagtagctggggactacaggcatatgacactacgcccggctaattttgtatttttagtagagacggagtttcaccatgttggtcaggctggtctcaaactcctgacctcaggtgatccacccacctcagcctcccaaagtgctgggattacagtgtgggtcaccatgcccggctggcggttcttttttttaaaaaaaaaaaaaaaaaaaaaaaaaaaaaaaaagagggaaagaaacaactaaattagcgttttctggtccttccaagcataagaaaaggcagcatcccaggccacattctgggaggtgcagtattccctctctggctggg

SEQ ID NO: 16840 - DNA, 12249 bp, Human; identical to SEQ ID NO: 16839
  misc_feature (1)...(12249): n = A,T,C or G

SEQ ID NO: 16841 - DNA, 26103 bp, Human
  misc_feature (1)...(26103): n = A,T,C or G
tttgtattgggacttggagtctggggtggggtggtgtgggtcccggatctgggtacgttggggagagaagcgtgaaaggatccgaggttgagatgggtctttgtgtcaacccggcctcccctttccctcttggctttctgaatagaccagaagagacgtcagaggctgcttacattttacaactgaaatgaaaacccacctcccctctccccctgggcaatttttatctccctttcagccctccaagtcgaatgagtgacccagatacaccccctcagatgactttcggaggtaaaacttcgggaaattatttttagcacactcattatttctgtctacctaagtgtggggaaaagaaccctcctctaaggaaatttgttcaggctgccctcgctcttccttgtctagagtatgcatttgtgcacaggagagatttccattgttttccattccgactgctttgattctcaccattttgttttacattcttactcaagaccaattttatcccttccccctctctccagtctccttacattgttaaacgtttaaaataatagcagtcgtgttggtgggggaagggagcaggaagccaaaaactcatttcttctccctcccccttctggcaagtcgagagaaataatataacataatatatagatgtgattccttgggggtgggggtggggaatgattgtgggtggtgcggaaaattctggtagtttctttgcaaaaggtctgaaaatacaaacccaccccctgcctgcagtacgcatgtgcagcagacctattatggtggtgcgttgtgggggagggaggggaatttgagaaaaaataaatatatgtgtgagagattgatggtgagattagaagaagagaggggcgggcgggaggcgaggcttcggccgagactcctcccgcttgctcgggcggccaggctccgccctgcgccctccggcccccgcctctctcctccctgcctccctgagatccgagccggggatgtgggagagtctgggctccaggccagcattgagtggctgctgagaccgaggttgggacttagatttgctttattacccttccttgcttttccttgccgttctcgctttgcctctcccgccaccgacgcctgcccaagttcgggaacctcccgctggggtggggagtagagtgaaccggcttgtgcaccacccctggctggtggtggccgaggccgtgtccctgaaccttagccagttggcctgcccttgccactgcctcggcagcctgcgtttccatgttcaagtcaaccgaagtccctggggccagggggagccggctgctggggcatggcgccttccttgctgacttcctattacagtccccattccgtttcacacccgggctctggcagccacccccctgcacacacgcacacagtcctagagtgtcttcctgcacaaggggacacaggatgctggagttagcaggaaaggtggcactgaaggaaggcgaggcagcgactctgaggcagtggaaacggaggcctctggtgttaattgtggctaattttccgttggctgttgagggaaggagaaaggattgtgtgtcctagagctaggggctgggccaagcccaggctttcccatcttgcatcggctgcctctctctgtactagacaggtctggctggttagtctagtgcttggtaggggagggacgtgaaccagagccccagggccccaggtctgtggggcatcctgtcttcctttatgtggggtaactctccgttccgttccccaagccttcacagagtgacaccttcacagataatggggtggggggcctggggtcctctggcagagacatctggggagaaagccagggacctatccctgctgaagcaggtacaggccatcctctggatttgtgggcctgagagtgtgtgtgggtgtgggtgcgcgcgtgcgcgcgcgtgcttttgagaaggcatatgctgggtgtgtctgtctgtgcctatatctttgtttgggtctcccatactgcgtatagatgaatgggtcaggatatctggaacaaaatatggaggtgaagggtgagatcgggaaacaaagggtatggccccctagttcccaaagggagcagggagatgggaatagaattgaaggtaggttttaggctacttgggaggaggaatatttaggtaattgtggagactttctcctgtgtgatgaaggcggcagacactgtgatcctgtgggcaagaagtaaaaatgaccagctgaggatttcttttcctccaggactgtgttggggtgacaggatgcctggtaattatccgaggaaatgtaaatagaggcctccctcttggcaaaaggatgtcagggccccagggtgttagtgtgagaacccaggtgtccacctttggctctccctccccagcatctggcttagggagctgccagcttgtgtctccccactccaagtgctggggtcaggccaggccagcagctgggcatggcttccccagttcctgggcaggatgccagctggcgaagtgagggggaaggcaggaggagccctggcggtgactgaaaggacctgccacagtcagagcccatggcctggagcctggtctcttgttagtaggaggggagggaggggagtggtttggctgctcttctcttctgacccctgacctcccattcagaaccagagcatcccagagtactcgaaacactttctgtttgcatccagtgaagggaggcagggcttggaggagttaatgcttcctagagagtgggaactgccgaggtggggaaggggcaagttgaggggcctcagaggctggaaacctagaggcttaggttttctgatgctttttgcttcaaagataaggatgacattcggctgctgccgtcagcattgggtgtgaagaagagaaaacgaggacccaagaagcagaaggagaacaagccaggaaaaccccgaaaacgcaagaagcgtgtaagtgtcaagaattcctaactctgtggcaaggctcaagagacccattctcagagacctacattttctctggtcctgattactggtgtgggggtggggttctgaagccagggaggcttgatcccccgggccccccacttccctgccactgttggcctgtatctcagggatctgggaccctaacttcattcactgcaacctagtgaagagcctcgttgtcagtgtgtcctcagcagcaaagagaagcagttgaaagcacaagctctggaagactgtatgaattcaagagtccagcattcctctgtctaggataccaggccgtttatttggctctctgtgccttagtttcctcatctgtaaaaagtagataaaggccggttgcagtggctcacgcctgtaatcccagcactttgggaggctgagccgggtagatcatttgaggtcaggagttcgcgacaagcctggccaatgtggtgaaactccgtctctactaaaaatacaaaaatcagccgggcgcggtggtacgtctgtaatcccagctacacaggaggctgaggcaggagaatcgcttgaacccgggaggtggaggttgcagtgagccgagatcacgtcagtgcactccagcatgggtgacagagcaagactccatctccaaaaaaaaaaaggagataaaaaattagttactatcacaggattgttgtgaagattaaaagaggtaagatatggtatgtgctgagaacagtttctggcaatggtagggatgaataaatgttatttttatttctttctcttaggacagtgaggaggaatttggttctgagcgagatgagtaccgggagaagtcagagagtgggggcagtgaatatggaaccggaccgggtcggaaacgaagaaggaagcaccgagaaaaaaaggagaagaagacaaagcggcggaaaaagggggagggagatggggggcaaaaggtgagtagaattagggaatgagagtgagaaatctgcattaaagacgggcatgaggaggggaggaatggagactggactggagaatggggcaagaagcaagaaagcccagggaagctagtgggtaggtagacaggcctgtgtggggcctggaataggggctggaggagcacctacttcaccaaagcccctctcccgcagcaagtggaacagaagtcatcagcaactctgcttctgacctggggcctggaggatgtggagcatgtgttctctgaggaggattaccacacgctcaccaactacaaagccttcagccagttcatgaggtgcggtaagactggggaatcctcgctaattgacacttttaatttgagggaggtcctggaccccttggaatctgatgaaagctatgaaactgctctccagagaattcacggtgtatacacaccaaattctacacgtcatttcagggaactcctagactcataaggatccaagaaccccagttgagaactcttcactgaggggcgaggggtggaggggccatcatgattccagtgctgggttagagaactctttagcaacagaataaagtgaggacagaatatagtgagccctcccctgccccaacagctccatcttctgctctgtgacttctctctagactggacctgagagataccatcagtgttcctgaacttccttagctcacttagcaggtcctgtgccccttccttaggccctggtaataatggagggtccactgctggcagtgggacctgagcttcagtggctcctgaagaaaagtagagaatagtagagtagaaaatagcagagatgggccaggtgcagtggctcatgcctgtaatccaagcactttgggaggccaaggcaggtggatcgcctgaggtcaggagttcaggaccagcccatccaacatggtgaaaccccgtctctactaaatacaaaaaaattagctgggcgtggtggcacatgcctgtaatcccagctactcgggaggctaaggcaggagaatcgcttgaacccgggaggcaaaggttgtagtgagccgagatcacaccactgctatgctctagcctgggcaacaagcgaaactccgtctcaaaaaaaaaaaaagaaaaaatagtgccgatgtattttgttttggggagaaggcactttaacatatcagttcagtgctctggaggcagctgctgaggttcacatctggttacattttgggcaagtgactgaacttcttcaatcctcaatttcctcttctataaacggggaataataatatatacctcataggaatctgtgtgggtttggtgggataatgaatggaaagcacagtaccgtcagtgcctggctcctagggagcattcagtaactggtgactgtcattagtaacgttgtctcacctaccttactgctgaacttggggcttttctcagcaccatggatcacccatgtccgcacaagagttgagcaccccaccccagagcagaaccagcatggtctgactctttcacactccgtcctacggaagcccatcttcagggcccatggaacttactagtaaaatgcagagaatcatagcaactcaagagtattattgtgaggacaagataaggtggaatgtatgtgaaagggttttatgaactgtaaagtagtatacaaaagtaaagcatttttgttgattttattttaaccttttatgcttttaagttttatttcgctgttttttatttccccttttttttttttttttttgagatggaatctcactctgtcgccaggctggagtgtagtggcgcaatcttggctcactgcaacctctgcctcccaggttcaagcaatttttctgcctcagcctcccgagtagctgagactacaggtgcgcaccactacgcccagctaatttttgtatttttagtagagacggggtttcgccatgttggccaggatggtctccatctcttgacctcgtgatcctcccaccttggcctcccaaagtactgggattacaggcgtgagccactgcgcccagcctatttccctttttttaaagacagggtctcattctgtcacccaggctgcactgcagtggtgtgatcatagctcactatatcctccaactcctgggctcaagccaccctcctgcctcagcctcaggtgctgccacacccagctaattatttttttttattttaattttttgtagagacaggatctcactttgttgcccaggcttatctcatagccctgggctcaagcaatcctcctgcttcagcctggaattacaggcatgagccaccgtgcctggcctgtatttcttttttaatgcttttttaaacctgttctttccccgctttttttaaacttctttttatttatttttttaaatggctgtttttcctaataggacatattctcaccacccaggaatcctagcatgtacatagatttaattgatgaggggagatggcagtgttcccagaccatctgtgaagggtccgagttttctgcttctatatttacaggcccctaattgctaagaagaatcctaagatcccaatgtctaagatgatgaccatccttggggccaaatggagagagttcagtgccaacaaccccttcaaggggtcagcagctgctgtggcggcggcagcggcagcagcagcagcagctgtagctgagcaggtgtcagctgctgtctcgtcggccacccccatagcaccctccggaccccccgcccttccaccaccccctgctgctgatatccagcccccacccatccgaagagccaaaaccaaagagggcaaaggtagggaactctcttccaacaactgtcatctcaccttccaaactgcatgtcttcacattagagtctggaactctcgccttcccagccctgattgctggaggagagatgctttccaggaagtggggcttagtgaaaccacagcccacagaggaatccagaggcccctgtgacctccataattccaggatgtcatgacctctcctttttcctcttctcaccccgactcctcattcaggtccaggccataagaggcggagtaagagcccccgagtgcctgatggacgcaagaagcttcggggaaagaaaatggcaccactcaaaataaaactagggcttctgggtggcaagaggaagaaaggaggctcggtgagtgacccgtccctgtctactaaacacctgggggccaaggatccagagacagggatccgtgagggccaaggatccagagacagggatccgtgagggatggcggaacaggaagccaaaggcctggggagggcgtagaatgaagtctgcctcactgacggccacggggctatgggcagtatgtttttcagagcgacgaaggtcctgaaccagaggctgaggaatcagacctggacagtggcagtgtccacagtgcctcaggccggcctgatggccctgtccgcaccaagaaactaaagagaggccggccaggaaggaagaagaagaagggtaaggagtgttgactgtgtgtgatcctgtcagtgggccgtcctctcattcttattttcaattttgacttctctcttcaacccttctccctctctctctccatctccccctgccctgcttccttatccctccaccggggtatatgacagtcctgggctgtcctgcagtggccggggaggaggaggttgatggctacgagacggatcaccaggattactgtgaggtgtgccagcagggtggggaaattattctgtgtgacacctgccctcgtgcctaccacctcgtctgccttgatcctgagcttgaccgggctccagagggcaaatggagctgccctcactgtgtgagtacctaatgccagcatctgatggccctgaggaacccacccatctctttcccccttggtttcacttaccctcttcctgcccccagatggctggacttcttagtaacagatgtccgagtgtctaggatcctaatgtattcctttctcccacaatcaacatttctgaaactggagtgtccttttccttagttcccaccagtcttctctgcacttctaggattcaggtgtcctgtctttgcctgtatcttccagtttcattccttaatttcttccatctgtctgtgtgtctatccttggccccctaggagaaggagggggtccagtgggaggccaaggaggaagaagaagaatacgaagaggagggagaggaagaaggggagaaggaggaggaggatgatcacatggagtactgccgcgtatgcaaggacggcggggagctcctgtgctgtgacgcgtgcatctcctcctaccacattcattgtctaaaccctcccctgcctgacattcccaatggtgaatggctgtgtccccgatgcacagtgagtggaaacatctcccctctgtatttactgtcaggcctgatcccttcccccatccctggggcccacatgtccagcttttcatttctctgcactcccccacccttgtgggacccctatcttctcatctaacaatgggttctttctgcctctttctttcctcctccttgtacgtgtccatcccaaagtgccccgtgctgaagggtcgagtgcagaagatcctacattggcggtggggggagccacctgtagcagtgccagcccctcaacaggcagatggaaatccagatgtcccacccccccgtcctcttcaaggcagatcagagcgagagttctttgtcaagtgggtaggactatcctactggcactgctcctgggccaaggagcttcaggtactaggaccttttctttccctctcccccatgacctcatttcctgccatcctctccctctcttactcctctgtttgttgggttcccatactctttgttttctctcatttcaggcctgtggccttcataccctacttgcttagtttccatatgtggttcttttggtctacagtcctctttctctcagtctccgttagcttccttccctcagatatagcatagcctttcctaacttcatgtccttccttatctgtctttttccatgttttataatattcctggctgggcatggtggctcacacctataatcctagcacttttgggaggccaaggcaggaggattgcttggagaccagcctgggcaacatagtgaaaccccatctctgtttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaaaattctcaatgtttctaatcccattccctatctcttgcttgtaagagccccacccaggccttgtcttctgaaactgttgcatctgtttcattttatttattctccgtcttggctttgactcatttatctctaatccatcctttttctttttttttctatttttttttttttttagatggagtttcgctcttgttgcctaggctggagtgcagtggcacgatcttggcttactgcaacctctgcctcctgggttcaagcgattctcctgcctcagccactcaagtagctgggattacaggcatgcgccaccacgcttggctaattttgtatttttagtagagacggggtttctccatgttgatcaggctggtctcgaactcccaacctcaggtgatccacctgcctctgcctcccaaagtgctgggacgcgcctgttattctcttattgccccggctggagtgcagtggtgtgatcttggctcgctgcaacctccgcctcatgcattcaagcgattctcctgcctcagcctcctgagtatctgggattacaggcgtgcgccaccacacctggctaatttctgtatttttagtagagacggggtttcgccatgttggccaggctggtcttgaactcctgacctcaggtgatccacccgcctgagcctcctaaagcactgggattacaggcatgagccaccgtgcctgggccaatccatcctttttcatagctccctttccctgtcccattcctcctgccggcctcttcccggttccttgttgtcctctgtgagtgtcaggactatctctttcccttttttctgtgccctgctagctggaaatcttccatttggttatgtatcgaaactaccagcggaagaatgacatggatgagcccccacccctggactatggctccggcgaggatgatgggaagagcgacaagcgtaaagtgaaagacccgcactatgctgagatggaggagaagtactatcgttttggcatcaagccagagtggatgaccgtccaccgcatcatcaaccacaggtgaatcctcggtccctgggaagtcagacctggtatatgacattattcttaccatggtgatggccccatgttagtatttgctgattaaccaggtaattgatctaaccttgataacctctgctgtagctccagcctttctggccttgtttcctccaggggaacgggagaaaacaggaggaaaatccggccaggcagtgcctcttttgtcctttgcctcctgtcatctccagtggcataagacatagcacatgagtctggggatgagggcatgaaagcaaaacatgagagacataattcatccagaccagtgttttgaatgtttcttcttcatagtacttattactgcctaaacttaatggtatgtatttagttatttcaatgctgccttccccacgagactctgagttccatgaggaaaatacttagtgattaggtgaacaaatgataaggagggatctccaggaatgttttgtgatagctgatttttaggataccatcctgagaaggttaggctgctaggtcaactattccaatctcccttccagcagctcactgttgacggttgggtgacaaattttgtgtgtttgctgataattgcgtttctcaggccttctttctgtttgtgatctgtgcaatattttcctcctgctcctccccatggcctcctgccccacagtgtggataaaaaggggaattaccactatctagtaaaatggagggacttaccatatgaccagtccacgtgggaggaagatgaaatgaatatccctgaatacgaagaacataagcaaagctactggagacaccggtgagggaatgagcttgtggattcaagggattctgacgatgagggcatgaaagccaaaactccagcataaaatgagggtacagtagggactgattcaacctggagttcagggcaatggccacctgagctgggttgtttgagataggcttgctaaagaggtagtgtaaggaacagaaacaagatctggctgagtagtggagaagaggatgttcaagagtggggagggctggctcttgaggtgaaatccaaagggcaagggtaaagagcctgggaaaaaggaaatatgggaaaatctaggtcatggacagtgggaagtaggtctggaatgggttcagaaaagaaagcgtaggactcccaaggatgaggcctcattcagacccactctttttccagagaactaattatgggggaagaccctgcccagccccgcaagtataagaagaagaagaaggagctacagggtgatgggcctcccagttctcccactaatgatgtgagtcctctcagttgtcatttcttgtttctggagtgatggtgatcgaagattttccaagggctactgatggaacttcccagagattcagtaacctctgtgaacagtagctcttccttcagcatccagtcttgccccaagagtggctaagaattttggcctgaaagggcaggagccactagagatagcccactggtggctctgtcaccagctggcccttccccatggtgctgctggatattgtcttaaggaatgagggggaggggctgaagactagatgtgagaacttttgtaaactcaggccatagtagagggaattgtaatccaacttggtatccatgccagggaggaagagactaagactggaggagccgccgactatttccttgagctttctgacttcttgtctctatagcctaccgtgaaatatgagactcagccacggtttatcacagccactggaggcaccctgcacatgtatcagttggaagggctgaactggctacgcttctcctgggcccagggcactgacaccattctagctgatgagatggggctaggcaagaccatacaaaccatcgtcttcctctactcactctacaaggaggtgctggattctaggaccttgaaggggaccgcctggactggggaagtggggagggggaagataaaggggtgtagctggcagaggactagggtatacggcctctagcctagacttatgctgcccccattcttgactcccagggccacacaaaaggtcccttcctggtgagtgccccactctctaccatcattaactgggagcgggagttccagatgtgggcacccaaattctatgtggtgacatacacgggtgacaaggacagccgggccatcattcgtgagaatgaattctcctttgaggacaatgccatcaaagggggcaagaaagcttttaagatgaaggtaagaccctctacctcatatcctctgagaccctcaaagctgtcacttctttttctcagccaggaattcagtttctctattcccctcctcacctttctcctcttcctccacctgtcctcctgtctctgcactaccatcctagagatatggcaggtactcccaggggcatacatggatctgtcggtactggaaatgtgggcagaggtttaggagccatggtctgtaatccctgcttggagaacagagtaatggctcctgttgggagccacagtcaggacaaggtgtctggttctggaggtgtaggtgcatggttgtcaggtggcagctgaatgggcaataattatgttggcagagggaggcacaggtgaagttccatgttctcctgacatcgtatgagctgatcaccattgatcaggcagcacttggttccatccgctgggcctgtcttgtggtagatgaggcccatcgactcaagaacaaccagtccaaggtgagtgaggtttccagacctaaaaaacttgaagttgtggacttcccacttgccttggtcctaaaaaacaacaaaaattctggggattttctgtagtctgggaggacgtccaggttggaagagggagagggccagagatttggggcctctgatcctgagtgaaatgggagctggggcagggaaaggctgatgctgtgggttggtcacttgtcactaataagcccattttcctgccttgccttgccccatcttttagtttttcagggttctcaatggttacaagatagatcataagttgctgctgacaggaaccccattgcagaataatctggaggagctcttccatctcctgaacttcctcaccccagagagatttaagtaagtggttccctaagggtagttggcagagatgagaggtggagcagataaaatgagctggtagaggattaatctgaggtggtaagtctgagatcaggggcaaggaacttgccgacctgttaattttcttctcttctggctcttagcaacttggagggcttcctggaggagtttgctgacatatccaaagaggaccagatcaagaaactgcatgatttgctggggccacacatgctgcggagactcaaggcagatgtctttaagaacatgccagccaagacagagctcatcgttcgggtggagctaagccccatgcagaagtaagatgcaagacgagctgcctggagtagggcttggggattgatgggagcgttccaagtgcaatatcataattgcttcctttatttatgtttcttttacacccctttcctggcctttaggaaatactacaaatacatcctgactcgaaattttgaggccttgaattcacgaggtggtgggaaccaggtgtcgctgcttaatatcatgatggatcttaagaagtgctgcaaccatccatacctttttcccgtggctgctatggtagatacacagagcagggagctgatcgaacgcccattctcagaaaacatgggtggggagtagtggggaggtgggtattgagccacaggggtggagctgggctggaaggccacggactgggtgtctgagaacaggaggaattgggaacatgtggaagctggatccgggcatctggccttctaggtgtggcaagaatatgggggcatgtttccaactgaccccctcctcctcctctctcctcccttttcaggagtcccccaaactccccagtggggcttatgagggtggggcacttattaagtcgtctgggaagctcatgctgctccagaagatgctgcgaaagctgaaggagcaaggacaccgagtgctcatcttctcgcaggtgacctgtgcccttagctgtctttacatctgcttcctcttccctctcctcatcctccagactttaatttcttacggtcttcctgtggctgctctggtgtgacaaatgaggagattcctcctgtaagagttttttttttttttttttttttgagacagagtttcgctcttattgcccaggcttggagtgcagtggcacgatctcggctcactgcaacctctgcttcctgggttcaagtgattctcctgcctcagcctcccaagtagctgggattacaggcgtgcaccaccatgcctagctaatttttgtatttttagtagagacgggatttcaccatgttggtcaggatggtctccatcacctgacctcaggtgatctgcccgcctcggtctcccaaagtgctgggattactgtatagcaagttcattcttggcctctgatgcctgttcttaaggttgctggaagttgaggtccagctctagttccttttcagctgcatgagggaagggggagggtgagccatctgcctccttagggactggtattatttcttcatcttattggcaggtgagggtgaagggcacagaccctttggaaatgtgatgaaagctctgggtctactcaccagaaaactgcacatacaatgacacaattttgtacggattttcagggggttcctggatttccctgaaaccttttcatgggtctcagagaacctctgccttaggagaaacaatcttaaatcaagagagtgtgacaagagggccagacgtggtggctcacacctgtaatcccagcactttgggaggccgaggcaggaagatcacttgaggtcaggagtttcaagaccagcctggccaacatggtgaaaccctgtctctacttaaaatacaaaaattagctgggcgtggtggcgcacacctgtagtcccagctactagggaggctgaggcggtaggatcacttgaacccaggagtggaggttgcagtgagcagagatggcaccactgcactccagctagggcaacagaatgagactccatctcaaaaaaaaataaaaataaataaaaataagaaaagagagtgtgacaagaaggtggaataatgaggagcttaagacagggcaggggttcaggtgtaaagattagggttgagtttgtgtaaaggagtagttagaataagcaagcatcccaccacctcattattgcagactccatccttttctcttgctctagatgaccaaaatgttagacttgcttgaggacttcttagactatgaaggctacaagtatgagcgcatcgatggtggtatcacgggtgccctgaggcaggaggccatcgatcggtttaatggtgagggagatacactggtccctggtgggtgtgggaggcctgagaaacctgtgataggtccctgggatgggagggggactggcttgggggacattggaaacttaggctttgagttgggggcatggttgtttgtcatcagagaacatctaggagcaggtggacagaactaccgggtacaagaaaaacctgatccaactctcacctcctagctcctggggcccaacaattctgcttcctcctgtccacccgagctgggggcctgggcatcaatctggccactgctgacactgtcatcatctttgattctgactggaacccccataatgacatccaggtgggaactcgcatcctagaacccctgcaccatttagcaaggagatgtgggttcatggaggagggtgtcatgttccggggtcagaaataaatctcttctgggaggagagaaggcccttcttcagcagccttctttcctgaggcagctctgtgggcagcttctccccggccactcccctgacccacccgccactttctcttgcccctgcaggcctttagccgggctcatcggattggccaggccaacaaagtgatgatttaccggtttgtgactcgcgcgtcagtggaagagcgaatcacacaagtggccaagagaaagatgatgctgacacacctggttgtgcggcctgggctgggctccaaggcaggctccatgtccaagcaggagcttgacgacattctcaaatttggcactgaagagctattcaaggatgaaaacgagggtgagaaccttttctgcagctctgtgaaagcaggcccctgctctctcaggagtacttatcagccccctggggagagaaaaacaactcttctctgcagcctttgaaggaaggagagccttcttttagtagcccttggaggaaggttggcctctttctttgcctgtagggttaaaacaaacaaaacaaaaacctttcaacattggctcccggggaaaaagccttctctagggctcctgtgaaaaggacgcagagtagaagctttcccatcagcctttctaaactttggaacccaaagttcccgtttgttttccctctcaccaggggagaacaaggaggaggacagcagtgtgattcattatgacaatgaggccatcgctcggctgttggaccggaaccaggatgcaactgaggacactgacgtgcagaacatgaatgagtatctcagctccttcaaggtggcacagtacgtcgtgcgggaagaagacaaggtgagaggctttgggggccagacattatctatcccaggccatctccaaaaggcagtatcctttactcagccttgaagtaggagggtctgtcccccttaaaacagtagtggacctcaaacaacttcttcgtctaataggtgagactggacttcagagagaaacgtaggcacagacagtactggtaaacacagaagggtaccttctgagacagtgcaggagaaacactgtcagagggattagaggagagatttagaaaacatgaggagagcacattgcaggtaagagatggcatggaacatgcgcaatgtccagaaaatgtatgcagagccacgaagctgcaggagtggggagaccggattgggctgacgcagcagagtagggatttccttgcagtggaaggattagcaaagaaggagacccccagtgttcattcattctgttgcccttcagattgaggaaattgagcgagagatcatcaagcaggaggagaatgtggaccctgactactgggagaagctgctgaggcatcactatgagcaacagcaggaagacctagcccggaatctaggcaagggcaagcgggttcgcaagcaagttaactacaatgatgctgctcaggaagaccaaggtgaggactgccccagatgcaggcagtaaaggggggaagtgatgatgagtagggacttgaaggctggagctatttagagggaaagagagaagcctagaagtcagagccttcctctgctaaaagggaaagacataaggtagagtcattaggaactacccagaggccaggtgggtttgcaggagatttaaactcttcggtggttgcacaggcatcctgtggacacccagggccattgcttagagtaggttttgcaggagaagcagaggggcccagagactgaaggtgggcggtgaatggagatggtgtaggatatgcggctcccaagtcagactttgggcagtgatctggtgttcccagaaggaccaaggccagaataaaggtagacaagtctcggcagggaggaatccagccagaaagggcctcagcatgggcatatcccgagagccctccctgaccactgggccctttccacccccacagacaaccagtcagagtactcggtgggttcagaggaggaggatgaagacttcgatgaacgtcctgaaggtggcatctgtgttcctgactctacctcacctcttcccgttttattttccagtttgctttaagcccactgtttttatacaagtaaaaaagtcttcgtgtgtgtgtggaaaaactcgattgcagatgagcagaaaggaagaaatattcatagtctctctgctagtaaacttcggtgtgtgtgaccacataggctagatccagaaaggccatatcattttccattcccactggtaatctgggcctttgtcagatatcagctgttaattttaaaatatgactggttcttttagacttagtgggttagtagttctgaagtgcttgggagagaattgggagcacctcaaacgtgacaggaatgttcctgtgttgtgtatcttgtgggaatggggtgctaaggaggactgaggcttagaggaggtggtggctcagctaactgatgtcatccccaccctcagggcgtagacagtcaaagaggcagctccggaatgagaaagataagccactgcctccactgctggcccgagtcgggggcaacattgaggtgagagctgggcccagtgttcctgagttctccaagagggcatgagggcaggaggttggaagttggtgcctggatcactgaaggtagaaaggacaagacctaagaaccctagacatttgtcgccattgcctccttgctcccaccctcaggtgctgggcttcaacacccgtcagcggaaggctttcctcaatgctgtgatgcgctgggggatgccaccacaggatgccttcaccacacagtggctggtgcgggacctgaggggcaagactgagaaggagtttaagtgagtgtgggtgatacagggctgagttggacgcaaggggaagagctttgggtgttcctttcttccttggggccgccatatgatgtgaccttactcaactgattatcaccctccctgtcatacaatacttcctggctcgatttcctggggggtggtctcagcccactccacctcccctcagccgagcctagagtagaggggccaggcatcctccccaggggaggggcgttgaagcaaggagcctctcctgggctgtcctagcctcacatttacttgaccacaataacctggcaggaggagctggtggaaaggatgaagagctgactgatggggcccaggaattaagtaccaaggccaaagggaaagacccaggggtggggcgcagggggacagttaggacttggagggctggtaatggtgagagtgagaggcccaggggaggagccctggagcacctggggatttgggggtttgggggtcctcagtcatcctcgcgcctccctcactgccctataccccttctgtggctcccctaaccctcctcccactcccatgctccttagggcctatgtgtctttgttcatgcgccatctgtgtgagcctggggcagacggctctgaaacctttgccgatggggtccctcgggagggactgagtcgccagcaggtgttgacccgcattggagtcatgtctctcgtcaaaaagaaggtatcagtcttcctgtcacccaaagaatcaagctggctgcctagtctctgtccttcctctgcctctgtccctgagttgtaagcttgcgctggtgtgagacggaggagactggagcttcctgtctgtaagcgcctggagctgacacctaaccctcccaccctgccaccccaggtgcaggagtttgagcacatcaatgggcgttggtcaatgccggaactgatgcctgaccccagcgccgattctaagcgctcctccagagcctcctctcctaccaaaacgtctcccaccactcctgaggcttctgctaccaacagtccctgcacctctaaacctggtaatcagaagtcaggatggtgggagagacagaaagggagccaggagtcagggcgggagaatctctgtctttatcactgtgccttcccctgcagctactccagctccaagtgagaaaggagaaggcataaggacacctcttgagaaggaggaagctgaaaaccaggaggaaaagccagagaagaacagcagaattggggagaagatggagacagaggtgtgtggctccctggattcccctgtggagcgggaggggagggggcttggaggccaggtacctgggagccctctggctcatcctgaccccattgtcctcttccaggctgatgcccccagcccagccccatcacttggggagcggctggagccaaggaagattcctctagaggatgaggtgccaggggtgcctggagagatggagcctgaacctgggtaccgtggggacagagagaagtcaggtgggtgcatggccttaggagtgatgggggattagaatttgggatttccctcttctggggtcaggggatgagggtaacatcctcccttcctatcccctaccccctcccacagccacagagtcgacgccaggagaaaggggggaggagaagccgttggatggacaggaacacagggagaggccggagggggaaacaggggatttgggcaagagaggtaatgggtggaagggaccggacacctgggtcccagagggcatcaggggaggtggagtctggggaaccgaatgcttgggtcctgggcgggtagctgtttgaaaggccagtacagtacagtacagatagtagtcttgggacctgggaggagggtgtcctgaggtgtgagctttgacctgtctgtcctagcagaagatgtaaaaggtgaccgggagcttcgaccagggcctcgagatgagccacggtccaatgggcgacgagaggaaaagacagagaagccccggttcatgttcaatatcgccgatggtggcttcacaggttggggagactctcgctgctttctgctcctcaaggggatctgctcatcctcatggggtttctcgttttgcctgaggcttcctgctacctttaattccaagtaacttccaatgaagtatgttgcatgctgactccgatccttgctctaaatctttcttaagtatccctcttaactccaaagctggccctaatcccacctttattcttaattctaacgaacctggttagaactgagtttgttccaaacctaacctttacccattcctcttcaggagcccttagttccctttcattattcagtttctccatctctacctgtctgttggactgagtgcagtctgcaaaaccctgttacctcttctgtctgctgccttctttgcagagcttcacacactgtggcagaatgaggaacgggcagctatttcctcggggaaactcaatgagatctggcacagaagacatgactattggcttctggctgggattgtcctgtatcctttgatacacatgcaagaaggaaaaggttctctcaagctggcaaaaaaaaaaaagatgatttcacacccagggacagggctagtgccacactttggggagtcaagccaaaaggaagaagtgttcaaagccaagcccattcctgttaaattccttgatggttccctttccttcattggtagccatggctatgcacggtggcaggacatccagaatgatgctcaatttgccattatcaacgagccatttaaaactgaagccaataaggggaactttctggagatgaaaaataagttcctggcccggaggttcaaggtgggaatgagggaggaaaggagcgggttatagacgggcttgggtcagaagtgagaccagatctagttggaacctagggaaggttaacaccttcagggctgaggtgatacctggggccaagaccaaagtgtaaccttgtgcttgggagtgtgatctgggtcagggttgctgctaggttcgcagtcggtttggagctgggagtgccctgggccagcagtgagggcagggtgggtctcttgctatgtccgcccccccagcccctcacccactgctggcagagccctaccttcacctcccaactctgtgccctcagctcctggagcaggcgctggtgattgaggagcagctgcggcgggcggcctacctgaacctgtcgcaggagccggcgcaccccgccatggccctccacgcccgcttcgccgaggccgagtgcctggccgagagccaccagcacctctccaaggagtcgctggcggggaacaagccggccaacgccgtcctgcacaagggtaagggccgcggcggccccgcgcgggggagggcccacaacgctgcgtaagtcttcaccccgcacccctcaaaatcttcccaccccctgacccctctacctgctgaaccatccccctctgacctctaaccccactcctaccgacctggcacccccttggattttagcctctaggacttgtgcaagccaaccctcatccatgtctgatagcattcacatccgtgcccaatagagggacctgccccagcctctgtgtcccctccacacagtggggcctcttcactggcagtggaactgcatgcctgccatactgcttaacatcatccagttaggggccttggactgtgaatgcaccatacagatccctggctgtgatcaaacaaatcacattccctcacatgtgtttcaccccataaggcagaaactaccacccatccaaccctctggccttaccccatgaaacttccctttgaccttcgacctttcctcctaccccctctcaccttgccattgatagagattatatcccaaagccctctaaccatctaatcctgcctggtgtagtcactgactcctggcccctttgatccctgttctaattccttgaatctgtaatactgaccttctaacctccctctccccttacatattaaaaccgtgattccttaaagctttgacacttaccacctcccatgcctcctgactatttcctccccatcatccccaaccccaaaccttgctcttccagtatgagatgttctgacaactccccgcccccatgtcttccaatgtccccccatcttcctttcctccatgctccctttttctttcttctttctctccatctgtcttctgtggtaatctggtctctctgtctcttttcctgacactttttcttttcccctgagttgcttctgttttccatctacttcttttactttcttgatctctggttctttgacatctgtgttctcctctctcgctctttttctgcctgtatctgtccatctgatgcctctcttttcctggctccatctctgtatttccctgtctttctcttgcccttctttctctgtggcccgggccccagttctgaaccagctggaggagttgctgagcgacatgaaggcggacgtgacccgcctgccagccacgctgtcccgaataccccccatcgcagcccgccttcagatgtccgagcgcagcatcctcagccggctggccagcaagggcacggagcctcaccccacaccggtaaccctctttccccctagctccagttttccctgtttgtgttcctcctgcacacatacaaacacttccatcagaatcctatacaatatggaaaaacaacttgctagaacacagtcatcacccttgagtgagtctccctgcctgtgtatcctacccttagcagttgtggagtgtggctcataatgtctcccctacagcttctttcctctcacagactatgaactaactccaacttctgcttcctctctgttccaggcctacccgccgggtccctacgctacacctccggggtacggggcggccttcagcgccgcacccgtaggggccctggccgccgcaggcgccaattacagccagatgcctgcagggtccttcatcacaggtcagctggtgttttcctaccccctgctactcacactcctcctttgccaaactttatttctgctcagctgccctttaactgctctagtccatctcatttccttggtggtatccggtgttttatgggatagagttgttctaggctgtccccccacccatccctttcttaacccctcttcagtcccctttattaaaaaccagagttttagtagatctgtggcttggtgtcttctacccgagccacctccctccgggttccttcaagggaaagtgaatatgaaacccgaggggttagagagtgggaacatgtgttcaatcatgtagcacaaagtggaatctcagggaaaggggtttgcccgggtcttccctccctcacgtgggacaacgggaagtggcaggaggtgacctagaagtgagaattcaccattgtcatgaagtgacgtttgagagtgatctggagattgatctttccttacccctttcccaaacagccgccaccaacggccctccagtgcttgtgaagaaggagaaggaaatggtgggggcattggtgtcagacgggctggatcggaaggagccccgagccggggaggtgatctgtatagacgactgactggatcccaggcctgcccttcacccaggccccgtccccgaggccgacccccagctcaagcgctggggcctgctgccagccctccaccttccccaccccttgggccatcactgggctaggaacccctttgcccctctctgcagctcctctcttcaagaagggccctttgtctttctccactcccacacacctttcccaccaagccttgaagactgtgctggtgagaagaagtctgggtgggagatggctggcagggtcttccaagtaccttcctcccacactgccaagtatacacaacttcccagtaaatggttgtggggaggaaagaggtggagcctccccagccgtttccctgcagaatcagctctgtctcatgtggaagtggagaatcagccttgcctggcctttaggaacttttgtggggaagagagctttgaagagaggagggggactttagagagggatgaaaatgagccctgggagggaggaagggacgaggaggggtggctgcatgttaccgtcccctacctctccccacgtggagggtggagcagttatgagggaggaagtcaactgctgttcagcctcagaataaaggtgccgttcactggctcagttacctcctgtgtaccggcatcttgtgttgggaatgttcccccctccctagggaccaaggaccacccctacaaaaagagtaatggttgggtgatactccctcaagccaaagaggagctccccaacctgttctagggacccaggtaacctagaagggtgggagagaatacaatgggccagatgtggtggaagcccagctctggggctcaggttcctggaagacttctactaccctccctcctcaaggcctggatacagactaaatttgtataagtcaggcaggggacctagtcagggtcttgggagctaccttgtcgttgggaccagagcaaaatagtggagggcaggctagggaaatgtgggcacatcccccctcccaggaggggccggggagagtggcagtttgcatggcgaaccccccacttcctctttgctgccccttcactttcttgctgcccctttcccagtctctcttcacacccactcctggtctgtcctgatcccctcttctgtatcaggtttattggttgtacatataaattatactttcctttctgtgtgctctgttattttttatggggggggggagtttttggggggagggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16842 - DNA, 8730 bp, Human
  misc_feature (1)...(8730): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccctccttacccctgggaaggtcagggatgcatggatctccacgctacacggatctccaggctatgcctcctccagtggagtgtccttgggtccgtgtcctggggagtggagggagggaatcagcttctcactctggcctgctcggggtgcctgacccagatactgcccctgcctgccccaaaggctaggtcttctgcgacctttcttgggtgcaaggggagtggggccggtgggaaggatggaccacatttttcatctccatgctgagggacagggtctgggtagactgaaatgtaactgactttatctcagaggactgccagaccagaagctcagaacctgaagtagggggtagaggaggggctcctgcttgggagtgagctgaggtcactgatctgacctgctttgtcacctgaggaatctgatcccctctatatggtggccctgattggaaagctgagctgacacctgggttgggggctttgggaggatgagggggctcactggttcagagacagtcttcacaagtcaataggaacagagggagtggagagggagaactaggcttttctgtcttactctcccccctccccccaggtcctcaatctgcctttcctccaggcccatctgcctagcctagccagggacccctgtctgtctgaatgcctgaacttgacttggtttacctcttccaacctgccatctaccatttggcacagcactctgcctgagggcctggtctcacaaactcaccacaatcaaacaaaattcctcccagcccctcactgcacacaacccacagatgactcaaacacagacaagaccccagaagaaggacaaaccagactgcacgtcttcaatgtgataagagggaatggagactctggacagtggctccagaggaacagtcacatatggttcacttgtccttttgagaaaattcctaggacctctgctctggagatagcacttgcccaatcttataggcccactgggtctaatttctttggactgagacacctgagggcttctcagtctggaaggagaggagctgggggctgataatctaagtccataatggaggctccaccccttcccgctgcttctgtatcttgcaggaacctagggaagtctggtcttcgggtatcctgtcttggcctaggtgagtcagaatagggattaaggaaaggagggcattctttcatggtctgccccctgcagttctcatgtgcctggcttctctcttgcaggtacctgggtcacatttggttctcagatctcagatgaggtataagttatcggacctagaatcagggtggtgggggtgagggaacttgaaaaaagggaagtgaacctggataggggtttggacaacaagcacagggaatgagggatctgaggctggaggatggggagaggggagagactagagaacccagggctgagatgtgatgggttagagtacagtgagggaggtaactgaggagcagtagttgatctttacctctttcacctccctagacagcagaggatgtgctgactgtagcctatgagcatggtgtaaacctgtttgacaccgccgaagtgtacgcagcaggaaagtaaggactggggtgaaagagctaagctccatttggaaggctgagaggacctcagggattatcttctcgttttccctctaaagaaccctgggacttctgagaacgtgaagttccaaccttttggcggagggacccgaaagcactgtaggagctacagtcccaacattagtccctctctggcttagaagtcaatgggcgtactgtgcagctacattaaataaaggcaacaaatatatctgaggcattagttatgtgcaactacaaagatgaattttcaaacacatcatgccgtttcacactaggagcagggaaaacctaggatgacctaccctgcctcttccccatctagcaaacacttctgctcatcttcaagacttgacccgagtgtccgctccttcaagaactttgcccaactccccagagttggtcaccccctcccccaccatgagctcctaaagcactgtggactgccttctgacacgcaattcgtggtttatgcagctatattagctgctcaagtcagaggcctccttccatggaacttgtcttgctcttccccaagtacccacacagagcctggcacagagcaggtgctgcttctgggaagaatcaacatgtctgcgaaagtgcacacagtctaagtggttaaaggaaaaaaaaagggcaataggaaagattaaacaacggtaaaacatttcagtaacagtccaccatgacaacttaagacttgtcacaagtgagctcataattttatgctaaattatgtagccaattctgtggaagctgaccagaaggctggaccatagattgtggcactcagagaacacattatggatgaggcagaatttgagctgagctttggaggacgggtgggattttgcagaggctcaaagaaggaggagggcaacccagatagttgaagccagacaaggcagtgtccttcctggctccaccatagttggcccctctcccctcatcctattctatctttttggcacccacagcagggcttggtacacagctaatgcacaacagatatttgttgaatatgtgatgaaaactatacaactacacccctagttccttccaacagacctcttattttgtccaggatggggctgtgagctgaaatggactcctggtttatatcctactttgcaagagaggaaaaggtggggaggagaggaaggaattgattggcctagaagggatcagtggctctgccttatgtttcttttagggctgaaagaaccctagggaacatcctcaagagcaaaggttggaggtgagactgttttggggggttgctggggatgtgatcacccaaaaatccttttcttactggttctcccatttctattcttccaggagatcaagctatgtcatcactaccaagattttttggggaggacagtaagtggctgccccactgcgattgtggagaaggcctacaaagaatgtgtgaaggtgtatggggtgggggtggggacagctatcctgcaccaggtccgcaccatgcctgtgaagactcgtgcaatcccatttccttatggctccaagccagccccggtcccctatctttgtcacatctcatctttgacttaccttttcctacagggcagaaaccgagcgaggtttaagccgaaagcacatcattgagggtgagagttaggggctggaaacccaaagtgaggggatatggaagccagaggagtagggaacattctctgaacttctggaggctttgaatagggatttaggtggccatggcaagggggcaaggtctgaattttttttttttttttttttttttttgagacggagtttcactcttgttgtccaggctggagtgtaatggcacgatctcggctcactgcaacctcctcctcccgggttcaagggattctcctacctcagcgtctcgagtaactgggattacaggcacacgccaccacgcctggctaattttttgtatttttagtagaaatggggtttcaccacgttagccaggctggtctcaaactcctgacctcaggtgatccgcccacctcggcctcccaaagtgctgggattacaggcatgagccaccacgcctggtggcctgaattcttagtacactgaagctgaggtgcttattttcttctccctaccccacctccaggcttgcgaggatccctggaacgcctccagctgggatacgtggacattgtctttgccaatcgctcagaccccaactgtcctatggagggtaaaagcagcacccccaaaccttacagtccttcaaaactgagcacttccttgctgggtgcggtggctcattcctgtaatcccaggacgttgggaggccaaggcaggaggatcacttggggcctggagttcgagaacagcctgggcaacatagcaagaccctgtctctacaaaaaatgttttaaaattagctggctgtggtggtgtgtgccttgtactcccagctgttcaggaggctgaggcaggaggatcattcaagcccaggagtttgaggccacagtgagctatgattgcaccactgaactacatcctgagtgacagagtgagaccctgtctcaaaaaatctaaaatacaaaaattgagcacttcctcaaaccctcagcaggaagccagcccctgctcagaaggcctccaaaactccacagtggaggctgagactccaggatgtggacaggaagagaggcaaagagtagatattaactttcatgactccatagagttgcctggggccttggtggggcaggtggaggtctgcaaatctggagtcttagattccagggctctgacagtaaggctttccctctcctgtgtacctagagattgtgcgagccatgacctatgtcatcaaccagggcctggccctatactgggggacatcccgatggggggctgcagaaatcatggtgagtgtgtgaccccaccttgcccctgtcccacaactggttcccacttttcacgtggttactccaaagcccactgcactgggggagaaggcagagaagaaaacggaagtagtgctctgaccactttcttttccccaaccccaacccaggaggcctactccatggccagacagttcaatctgattcctccagtgtgtgaacaagcggagcaccatctgtttcagagggagaaggtggagatgcagctgccagagctctaccacaagattggtttgcagccctcatccctgcctttaccttagcctcatccatggctaggtccttttcctgacacccagtgttcttcccttaggagttggatcagtcacttggtaccctctagcctgtggtctcattactagcaagtatgatgggcgagtcccagatacttgcagggcctccatcaaggtgagatctgggggctctcgatggcaggactgggctatatgggctgctttggggggagttacggggggctgctttgtgagtgtggtggtggtggtggtgatggcggggtcttctgttgattcttcttggcctccagggctaccagtggctcaaggacaaagtgcagagtgaagatggcaagaagcaacaagccaaagtcatggaccttcttcctgtcgctcaccagctgggctgcaccgtggcccagcttgctattggtgagacattgcaccctgcaggggccctgtctcctcctgacatgctcccaagcccatcctaaaactggtttgtccctagggaggacgcttgtcttcagagacacttctgaaatctatgtggtcactgttccccatcagtcctctttttttcctcctctggccccagcgtggtgtctccgcagtgagggtgtcagctctgtcttgctgggggtgtcgagtgcggagcagttgatagaacacctgggcgcgctacaggtgagccggggactcagaggcagagcctatctgtccccctccccaggagtcaaagccacgctatccaacccaggatggctctatcaggtcacccactacaaagtcctcactttgcaggtgagaggtcccagggccggaaagcgaggcaccggcacagctgcggctcttgccttgccacttgaccccactgtggtgcttccccggctactggaaccccatgccctttctcagtgacccagcatgggctgccgtcgccaccgtcccactctcctccaggtgctgagccagctgaccccgcagacagtgatggaaatagacgggctcctgggaaacaagccgcattccaagaagtagtctgtcgcgggcgcagggacccaacccggtgtcgctgcacccgcccgagccccgctcctcgcagccgcctctcccgctccggatccctccacgcagcggccggagccagactagccccgcccaccaacgagtcccggcttcgagtagtgatacgcatgaacaaagccatatccttttgcagtggggtcgagagagaaagtagcacgcccgccccctgctgcgtctttctaggcccttcttgcaaatcccgggcatgagctactcgccgtcggctctctgccacttcgtctcgctccctactctcctccccttattcccgaggcccagaaaagaaaacaaaaacaaaaacccagcacatacaagaaacatacagtgtacctcaaaaggggcccttgaaatgtcatcaaagggtaataacctagtgagtgagttgtgatgtcatctggaacataggaaatggggctcttagcgtattcggtacgaaggaagccaggctggtcctggcaggaagtaaatgataatctttgggaaaccaggaccctgcctcccagcccagaggtggaggagggcggtcagggtggggtctacagtggcacagcactgacaaaggtagagggaaatgtaatagcacatctacgctgcagtctggtgaaagtggccggggtggtccttggaaaacagttgggctgttcttggcaggaattagtgacagcctttccgtcacgggcagggacgccttgatttaaaaaaaataaataaataaaacgtctgggtatagacttttgagccttgagcagggcctcctacctggcagtggggaactgcagtcttcctcctggcaataaccctaaagcaataatgatggccccttctctgtaagacttcccaggtaactgtaaataaacctcagcttgatcctcacagtgtctaaagttgcaggggcttgggaggttagggtcacagtctcacttgtctggccctctcgccccctaacattagaaatctgctagcattagctttctctccattgctcattcaccttggtgacccaggcatcgggctcctagtcactgttctcatcaaggaccaagacaccagataccccaggccccagttttcttccttcagctaccacattccttagaacccagaaatctggcttcataattttgttcctcctctttctatgaaagacttagctatctgcctttatttgtttgtatttaaagtaatattagccatacttgttccttgtacttctcatttctctctcgctggacacccacacatatgccaaggaacctgtggctgagggggagatgctgttctgaggttgaggctttgtgatttggtggagaggtaaagtgaagaatggtctgaggttgagggaatacagagagaaggaaagatgttatcatttcactggaacagaattgggtggaaagttacaaccttaaagatcacaaggtagaggaggatgagctctgccttccttaaatacaacctgcccatctcccttctacccgtcctcatcccgccttgatccaaaagctgggcaagcaaagtaaaaccaatttccaaaagagaaaagtcagcagcatgccatttactggattagcagccaactgcatcaactaattaatacttaaatccaccccatcatctcccactcattttgcaagactgtggaggaaacaaagaagtaaaatatattactaaactatgattagttattctgtaacatatgagaatttatcaatcccaaataggattctccttaaatagttatcttagagggttatacacttattttaatgaacctgtcccattgctcaaaatattaaaaacaaacaaacaccattcctcctagaattaccttcagagagagtttggaaacgccttgatttaaaaaaaaaaaaacaaaaaaaaagccttcctttattgtcacgcctcctttgtatatggacatttgccatatttatcacccacctcattcattaa

SEQ ID NO: 16843 - DNA, 12567 bp, Human
acatggctgtgtcatgggcgtgtgtccttaactttggcaaaataaacttcctaattgacttaaactagcctcagatattctgggttcacaagggtaattcacttaatcggccagtgtgcgcagccagcccgcacctgacagcacacagacccctttgtgtgtgcgagtgatgagagaccacagaagaaacactctaccgagtgagcccagggaaagccagccatctatgcctgtggccagctgtctacacccgcacacccaggagattgcagaatggtgcctcttagccttcaaggccctgttttcctgcctgtctgcaccccctgtgtgggccaagccttagtttcttcatctgtcctctctctccaatcccaggactctgactcagggcacgcaggcctctggctcctgttcctgaaagcaggagatgaaccctccatgtgaaaggtgcatccctctactggaggatgaagcgtgatgactaggcgtggggactcaaggccaggagaaatggccaccagtcaggacctgggcagggctgggggcggcattttggctgaaaccgtaagagacttttaaaccagagcaactccatcttgtatagaggctgggtaaaataattctgagacctgctgggctgcattccccagaggttagacattccaagtcacaggatgggataggaggttggcacaagatacacgtcataaagaccttgctgatgaaacagtatgtggtgaagaggccagcaaaatcccaccaaaacctagatggcgaccagaataacctctggttatcatgactgctcattatatgctaattttaatacgttagcatgctatgagataccctcaccagtgccacaacagtttacagatgccaagacaaggtcacagttaccctatatggtctaagaaggggaggagccctcagtttctggaattgcccttccttttctgggaaactcatgaataccccaccccttatttagcatataatcagtaaatagccataaaaatgggcaacctgtagccctgggggctggtctgcccatggagtagccactctttattcctttactttcttaataaacttgctttcactttactctatggatttgccccgaattctttcttgcccaagatccaaaaccctctcttggggtctggatcaggacctgtttctggtaacaaaaccacctggggtgtcggcaagacccaccccgtcccgcctggttctaggggacctgacctgccaggtggtccctccaaactggtccgcccacaggattgggacgcccctccctgtaccctcagcctgatgctgactgccaaccatgtgggcagacctggcggctgactggctgctcctggggacccccttcatagcttctcaacaggcactcgctcctgctgcctcgcccccaccccagcccacacaaactcctctccatcccctaccccgaccaacttagcccctcacctaaccctccagcctggggctcgcgtgccctcccgcagccccaaccccaggttgagaagcctcttccaatcccactccccccaccctgacgctcgcctgcccgcccctagccccaccagctgtccccattccactccccacccccaagtaaccccccaactccccaccctccacactcccttaacctcccctaaaagtcccaccccaggccaacaagactcctcccttcgctgggctgtggaccacatcctccccaccgcccagtcagcacccgctgcgcctgtccccggctcgtccagagccttccaccccctgccgccttccttccccaagccacccccaacctctcctaagaggcgccgccccagtcccggccgccgaacactccctcgcccagcattcccctcccccgccgccccccagcccccgctgacgccacaaagtccctaggcctcccgaccccaggtccccacgccccgggccgggccgcagcctcctgggcttcgtgggggcagacccagcctttcccggcagcgagcgctcggccaggtgcactaggcgctgtgcgggccccccttccccgcggtgagtagcccccaccccgccgcctaggctaccctcctgtggcgcctgggccacgacctaagcctaacccggtcctcctcgccctccaacgcccggccttcccgcctccgccggccgccgcgtccctggaggggctagcgcgcttcaacaaggtaactctaccgggaccctagcggaccagagcgggaaggacagccatcccggcagccagagccagagccccaggcccgctgccgctgtccctgcccggcttcggtcagggtgggctgggtgcctccgttagggctcttggggggagtcggagggctggcgccgggtggttggcgtgcagaaagctccgagaaactggacgtgggacagagccggggaagtctgagacccctagacgccctcgctttaggggatggcagaacggaaggggagaatcgtgcttgcagtgtagacgcgattttcaactccttctgcaactcggtccccatagcaaccccgtggcgtaggcgaaagtctgtagatctccactgcgtggggtcgcgagtgttgagattgcagggggcatctatgtgcatgcttgtgtgcctgtgcgtgtgtgcgcgcgtgtacctgtgtgtacatgcatgtatgtttaccgatatgtgcatctgtgcctgtgtgtgctgtgtttgtggatcagtgtttctgtgcgtacatgtttgtatttgtgtggtgtgtatgcgtgggtatgcgtgtgtgcacatgcacgtttgtatacatacatgggtatgtgtatgggtgttcgtctgtgcgtacatgcacacgcgtgttttttctgaaccccacctcactaccgaatggaagagagcttttttcctctgatagcccatcccttcttcctttggtgtacggggttttgttaaagaaaaaattctgacatttgaaaggctctttagtcaggctacttgcaatgggagagttgcgccagcaaagacagctggggatgtatgggggagttggagtggggatctgggtggggtcagtggatggaaagtgattaagggaaggctccaagggtaggggcttctccctaagctgacctagcaggcttctccagaaaggcaggttgaaggcctagccggcaacggtctgtcggggaggaggagctgatgagatgtggagctgggggtagccagcagcaggcggaagtggacgggtagggtccaggcccagtggagaggagaggcggaggggcctgcagagcattggtcagggagggtctgtgtagtttctggggaggcatctgtgtctgttgttgacaaggctaaaaatgatgactctggactctctaactggactgcagtcctagccctcctctgtaaagggaggctgtacaggacggttgcacactgccggcgcccagatcatcgggctgctccctccaactctctccagagtccctcaagcgggaacctgcctcgtgtctcccaggagccatggaggctgtggaactcgccagaaaactgcaggaggaagctacgtgctccatctgtctggattacttcacagaccctgtgatgaccacctgtggccacaacttctgccgagcctgcatccagctgagctgggaaaaggcgaggggcaagaaggggaggcggaagcggaagggctccttcccctgccccgagtgcagagagatgtccccgcagaggaacctgctgcccaaccggctgctgaccaaggtggccgagatggcgcagcagcatcctggtctgcagaagcaagacctgtgccaggagcaccacgagcccctcaagcttttctgccagaaggaccagagccccatctgtgtggtgtgcagggagtcccgggagcaccggctgcacagggtgctgcccgccgaggaggcagtgcaggggtacaaggtaggccacatcggggcccaggtcaaggggccggggaggaggcatccagggggacaaggtgacccagatcatgggggagggaggaggtgtccagggacaaagtggcccgagtcaggggctggggaggaggcatccaggggacaaggtggcctgtggctgggtaggggtgtccctggggacaatgtgggcctacactgtatgatgcaggcattgcaaaatcttacctctcctctcagagtattttgggtggctctgagaaccaaactgatttgagacagataagcagaagcaaagcactgaaattcattccctgtaagctttccatgacccaggagtcgctcccaaggagccagaggcccatggaagcatgttagagccaaacatgtacctgaggaggatgagggttagtttagcagggtccctttgcacagatttctctggtttcggctttcccgcccttggtaagaacatggctttcctcctggcctagggcagtcctctctggcatggtggctgtgccttctgctcttaggaaggccgagggtcacagcaattcttacacctgcccttttttaagtgccttcagctcaaaataatccaaggtggcacattctgggtgacgtattttgatcccctgcccctcctgaggagggtctctggggtgggtgcagtttcagcgagcacaactggactctaggcaggaggtagggggatcgctgatcccaaatcctgcggtttgtgtgtcccacagttgaagctggaggaggacatggagtaccttcgggagcagatcaccaggacagggaatctgcaggccagggaggagcagagcttagccgagtggcaggtgggtgcccagggctgtccagtccctttcctgctgctgctccatcttcctgcatttccacgtctgtgtctgcccgtggggatatgctgccgcagtggcaggaaaagaagaaagttgcctctacccttctaggttctgtggctggcctcagaatgaaactgacttaagacagatgaacagcagagaaaaagataaaaaggcaattttaaattacagatgcacacatagggtggagagaaggggcctcaaaaatcagactcaaagaggcagccagagggtaggggctcagtaccacaaaggaggcagccagagggcgggggctcagtaccacaaaggaggcagccagaaggtgggggctcaataccacaaaggaggcagccagagggcaggggcgtaggtcagcaccacaaaggaatagggcttgggggcctctgggctggggaggcaggtgatgttggttaagtatttaaacaagtgtctcaggtgaagagttgtttttggaactctctttctggtatagatgccttgaccactggaaattccttcatgaaagggcactttttaattttttttttttttttttttgagatggagtttcactcttgttgcccaggctggaatccaatggtgcggtgtcagttcactgcaacctctgcctcccgggttcaagcaattcttctgcctcagcctcccaagcagctgggactataggtgcccaccaccatgcccgactaacttttgtacttttagtagagatggggtttcaccatgttggtcaggctggtcttgaactcctgacctcaggtgatctgcctgcctcggcctcccaaagtgctgggattacaggcataagtcatcgcgccaggccaggcactttatttttttaggcagctaatgggggaggcaaacaggttttcctgcttctgcgggttctcaatggcctttagttaaccttaatcctaatgcctgtcaaaacacaaaattaaaacagatttagagatctttgttgttattttttgtttttttcttgagtcagagtcgctctgtggcccaggctggagcacagtgatgcaatcatagctcactgcagcctcaaattcctggactcaagtgatcctcctgcttcaacctcctgagtagctgggactacaggcacttgccaccaagaccagctttttttttttttttttttttttttttgtagagacaaggtcttgctattgcccaggctggccttgaactcctgagctcaaactatcttcccgcctcagcctcccaaagcactgggattacaggcgttagccactgcacccagctaagagaaaagatttatttgcaaggccactgagtgaagaggagggagaacagctcttaaacctgcctcccaagtgatacagcttgggagtctttatgaactacggaggcagggtggtccagcaggcccattctgtgcaggtgtcgtcggggtgcatggcatttcacaggacacaggtaccagaaacggcagccttagcatgatctgaggttggaagttttggccctctcacatcaaaaggccacctcgggcactgggacaggtccacttgaagggcagatggtctcaactggtttcagctggacaggagctgccccacattcctgaagcgaccagtcccatggtgacctgtgaatattatctataaagagccagtgaagggtgggcgtcagcattcagaggcacagccttcagcttcatggaaaaaggaaaaacaaaataacaaaaagcaatcagggcaggctgacctgatcagtgaaccccttggtttcattagcaccagtgactccattctggttgggtctggtcttctaggacccagcgcaggagcccagttcaaaacagtggcccctgaggatcacctgagcccaggagtctgagacagcagtgaaccatgatcatgccactgaaccccagcctgggcaacatagcaagaccctgtctctacaaaaaaattaaaaattagctgggcatggtggtggtgacacatgtctgtcgtcccacttccttggaaggctgaggtgggagggtcacttgaggccaggaggtcaaagttgcagtgagttgtggttgtgccattgcactccagcctgggcaacagagcaagaccctgtccctacacaaaatttaaaaactagctggatgtggtggtgcatgcctgtggtcccagctactcagatgacttgagcccaggaggtcaaggttgcaataagtgccactgcattccagcctgggcaactgagcgagaccctgtctcaaacaaaacaaaacaaaaaacaatggccacccataaattttgtttaacatgcccaagaggcttatctgggggtggacattctgaacctcctcagagcaagggtgcatgggtgtttggatgtgtagaagttgcagttcggggctcggagggttacactcagtgtatcacaggatggcagaggtgggggcctctgtcacagttcctggtccccaactaaagctccagttgctggtgatcttgtgggtcaccagggccctggggagaggtgccagcatccctggagctgagccacctgctggcaacatgctgggcttctccactcctgcagggcaaggtgaaggagcggagagaacgcattgtgctggagtttgagaagatgaacctctacctggtggaagaagagcagaggctcctccaggctctggagacggaagaagaggagactgccagcaggctccgggagagcgtggcctgcctggaccggcagggtcactctctggagctgctgctgctgcagctggaggagcggagcacacaggggcccctccagatgctgcaggtgagccagtaggcttggcaggcagggtgggatgtgagctctgacaggcatgggcagggggcgctgggcttggggaagaggcagccaacgggaaagggctgttagctcccagtctgctagtcctggaggctgggtggctgaggccaaggtgcgggcaggcctggttcctcctgagcctctctcctaggcctgaagatgccgtctcctccccgcgtcctcatggcatcatctctctatgcacgtctctgtcctaatcatctccttgtataaagacaccagtcagactggattagggcccaccccagtgacctcaactccctccttaaagatgctatctccaaacacagtcacattctgaggtcctgagggttcaggcttcaacctgtgaattagtggggacacaagtcagccccttacaggttccaacctgagacagtgtccccatttccttccaagtccagagaggtggcttgggacacctggcagccaggtgtggctttgggacagggactccatgtctcggtgtggaggaggtgcactgtcccaggagtgagttgtgtggcaacggcagtggggaggtgaagcagccagcctgtctgccgggaccagcctgtgtgccatggccctggagagggggcttgattacggctgataagacgccatctctacaaaaacttaaaaatattagcagggcatggtggcgtgcgcctgtggtcccaggactcaggaggctgaggcaggaagactgcttgagcccgtgagttcaaggctgtagtgagctattgcgccactgcactccaccctgggtgatggtgagatcacatctaggaaaaaaaaaaaaaaggaaaaggaaaaacaaagcagcctgttcacaacccactacattggtttgctgaccaactgagggaaaagcccctgcagctggtagaagggtgctcctatgagcagagggccaagcgcgccacctgcatgagagtccctgcctagagttagggtcacgctctggcaactagaaatatggcctttggaaaacaagtcccttgtagcttccaggccagagaagtaaacagtgatctctttagggaactctgaatccctaaagaggctacagaaaatccccaggtgcctcagtctcttacccacccccctccctccccaaactgcacccaattgcgcccccaccccattcctgctgagtgggctgcacccacctgaaatgggagaggagggtcagtgttgagtggccacttgcctggaaggggtccctccgcctctcctgagttgcaggacctcaggcgtgtggccgtgggctgacagggtagctcagcttaggtgaggcactgggggctctggtggtagtgggagctagggcagtggggaaggctcaggagtgccatgaagctcaattgtgggaagggaatgcccaggggacaggatgggtcttgccctaagacacggacaagaagggagcagggacattgaggtgagccaggagcttggctcactccccaccctccgtccctgtcttttgcaggacatgaaggaacccctgagcaggtatgtggtcccctcaggcaggggcgggggcagtggcagcggtgggcgggggggacaataagactgtcgggccaggggagtcaataagactcccctgtgtgtgcccaccggaggaagaacaacgtgagtgtgcagtgcccagaggttgcccccccaaccagacccaggactgtgtgcagagttcccggacagattgaagtgctaagaggctttctaggtaagtgggcacccagggccaggacctctgacccaggatctcttggcgatgccccactgtaccccctagcctcggaagccaccaatggggggggttctacaagtgcactgcctggtgacggtcactggctattcactgtgccttcgtagggcggcgttactggtggttctaattcatgggatgaatcttgttgagttcccagtggtctctctgcccagccccctgtaccttattgccaccaaggcccacacacaattggtgtgtggaagcatcaagtaaccccagattcacagcaggggaggcctctgcggagttaggggaccattggccacatccaccactagggcccggggactcccacctttgaccctgaatgccccacacctctccccatctctccaccaccacgcccatctacagaggatgtggtgcctgatgccacctccgcgtacccctacctcctcctgtatgagagccgccagaggcgctacctcggctcttcgccggagggcagtgggttctgcagcaaggaccgatttgtggcttacccctgtgctgtgggccagacggccttctcctctgggaggcactactgggaggtgggcatgaacatcaccggggacgcgttgtgggccctgggtgtgtgcagggacaacgtgagccggaaagacagggtccccaagtgccccgaaaacggcttctgggtggtgcagctgtccaaggggaccaagtacttatccaccttctctgccctaaccccggtcatgctgatggagcctcccagccacatgggcatcttcctggacttcgaagccggggaagtgtccttctacagtgtaagcgatgggtcccacctgcacacctactcccaggccaccttcccaggccccctgcagcctttcttctgcctgggggctccgaagtctggtcagatggtcatctccacagtgaccatgtgggtgaaaggatagacacagaccgggggactcgggcactgctcctggctctgcagaaggtgtgggccttctgcttactgcaggccacctgccagggttctctggcatcacgctggcagccattagacacacaggggggtttctcaaattctaaatataattgtgattagaactgtcaaacattaagagggtatactgacagatgcttcctagaggaaacttttgaaagcccctgcgttctgagtggaccgatttctaaatccatacctacacaccaggaacagcgtggtcacgttttttttagccatgcccccacccccactttggaatgacaggaatctgtggctcccagcccccccaggggtttaggttactctgtcaaagaagtagaaatatcctatggtggggaggagcgggggtggttgctgtgtcagggatggtcccaggctgcccatagaaatgtcctatgcatcctattgggtccttcgatgggggaaaatgggaaaggctgaacccgtaaaaagcctcagagctgcccacccccatcccgttcgatccccaaagttgcacgagcaggggcaaaatcccaaagagattaggatttatgtaggggcctcttttccacagcgcccttaccttttccaaggaaccccccacccacccctgcagggtcaagcactttaacagcctgtgtcagtcactagcaaggcagaattccagagtaagcgtactcctacctcgacaaagccggagtgtctgcgcgaggggctgcctggaacagcatgcccctttggagtggttcccgcagaaagaatgtgggcctcctggagagctggtcctggagggatgcccccgtcccatcccccaactccaatcattctgaccttggcctgccaaggctgtgagggccgggccttccgaggatacccgccctgggaagcacgggctgagggggtgaggacgcactaggggtatggcgaagggctccaatgccccaggctgcggactcccttagtccttgcagttgcttccgtgtgccccgccctgagtccccatccctccttgccctgccccctgctccatccctcccctgcgccccgccccctgtccccatccctcccctgcgccccgccccctgtccccatccctcccctgcgcctgagtcctccccagggcaggggtaaaagacctggccacaagaaccggagcggtggtgacgccaggtcagcaagtgaaagctctccaattccgtcccgcccgcgggccgcgtgactggcagcggccaatcggaggcaaaagcgggttgttccaaaaaaaaaaaaaaaaaaaaaaaaaaaaaaacacaaaacccacccagtcgcttcctgtttccgcctcggctcctcttcctgcgggaatccgggatccctacgtcccgcgtcccccgagcgctcggagcctacgcgcccagcgctaccgaaacccagagtcctgcgccctggagtccccgcgccccggagcccgagcacccgggagtcccgagcctcgcgccccggagtgcccgagcctgcgccgccgcacccggataccccgggtccccgcgagctgccgaggccgcccgccgccgccccgcggacagtaccgccttcctcccctctgtccgcgccatggccgcccccgacctgtccaccaacctccaggaggaggccacctgcgccatctgcctcgactacttcacggatccggtgatgaccgactgcggccacaacttctgccgcgagtgcatccggcgctgctggggccagcccgaggcccgtacgcgtgccccgagtgccgcgagctgtccccgcagaggaacctgcggcccaaccgcccgcttgctaagatggccgagatggcgcggcgcctgcacccgccgtcgccggtcccgcagggcgtgtgccccgcgcaccgcgagccactggccgccttctgtggcgacgagctgcgcctcctgtgtgcggcctgcgagcgctctggggagcactgggcgcaccgcgtgcggccgctgcaggacgcggccgaagacctcaaggtgctcctgggcgggggtggcgtgcaggggcgtcggggagccggggactggggaggcctgggcgggtgggaggtttgggggactgctccgggagtaatctgtctctgtctagggcggggagctca

SEQ ID NO: 16844 - DNA, 7381 bp, Human
  misc_feature (1)...(7381): n = A,T,C or G
gtaccccttccaccctggcgagaagcaggggccagaaattcacacaagtggcatggctcattgattgtgggagactctggggggctcctagctagtgcattatgggaaccaggctgtggaggttgcagggctcgctggctgggagaagctgaatggataaagaaccctggccactgcagtgcgtgctgatggttggctggcacgtagaggaggtggcagggctgggtgagcagcaggagccaggttagtggggaggcccgagctaagcgcaggggcaaattctgcgggtgggagagccaggagggcatggggtgcatggtgagatgaaaacgatgtgtgcttgtgacaaaaagcccagaagaggcagtaaggagggaggagtctatcccttatggagagcacatggacttctgggtgggtgtcctgcagttcccttcctcttgagtctttttaactgggggtccggtgtgtttgtgatcaatgacatgtatgcgtgtgcatgtgtacctttgcaggtacacatgtgtggtgtgtgtgcatttgcttggtgtgcgtgcatttgtgtgtgtgtttgtgtgtgcatgcatgtgtgtgtgtttgtggtaggtttgtgcacacatcctgcatacctttgtgcctgggagtggcatgtgtgtggtgggtgtcgctgtgcatgatggagttgcagccgtggtgcatttgtgagattacctcggtggcctaaattggggattaggagggcatcctcaggtccttcccactgtctgctcgtctgcccacaggcggctgtgccctaaacaggaggaggccattcacgcctcgcctgagttgtgtccaaggtgtgcgtgtggccaggggtccatccgcttccctctagcccagcccctgaacacagctgcagtgcacggccccactcctcagctctgctccccatcccaactcgaagacgctgccctggccctgtgtgtgcagctcatgtggactgggagggcagggcaggtgcaggtcttggggcaagagctggagctgtcttttccttcctgcacagccgcagagcaggtggatggggctgcttccctgcaagggcccagggccaggccccctggggatttattcgtggcttagaagggtggggccagaagcaggcgtagtggggattagggactcagcacccccagctctcagtccagcagacagacccaccccaggctgactacagaggctgcacctcagcaaacaggtaggccctgttcttggggaggattcccaccaggcaaaggccagctcccgggccctcacctgccacgtgtccaagctaggatcctgtttgcctttcccttgggggctgggagggaggcctccaaccccctctggcattaccagcatcacagataggagtcccaagtcctatgagaagttcctggaataggtgtagattcagtagatctttacaagaccatatctgcagggcaaggtaccagaggacagaggcggggacagggacacttccattccagacctagcagcccagcactcagcaccatgcatgggagcaaatggctggactcctgggtggggtgggggtctcagagcaggctcccagagggcttggaggtgactccaccaggtggggacggcagctcccaggtagggtgtcatcagagtagacagcattgcttgctagggacccctggggaggctgacagggtcagtgggtttcagttggggggctcccctgctgagaacccagtaaagccggccttccattcgtctcccgtgtgcccagagcctggtctgagggccgccctgtgcatgccggcccttccaacgtggcagagctcagggggaagaacacccaggctctcaggagactctcaggccaatgtctccatccctgggtcagccctttcctgccatgaattcaggaaggcagaggcagctcagcagatggggactagaggccgcactgctatccacagcctctcttctcacccccaggcatgtcgggccccaggcctgtggtgctgagcgggccttcgggagctgggaagagcaccctgctgaagaggctgctccaggagcacagcggcatctttggcttcagcgtgtcccgtgagtccagggctctcgtggaggggtgcgtagacctcaaggctgctgagtagtcctagcaccgtgagcaggccaggagcccaaacccaacaggcacacccaccctgcagactgtccgaactcttgcacactcccccccacacagaacctgaggttatcacactcctgctgtcctgcgtgcctgtgtctcccttccctgggtctgttgagtactgataactgggccacagtgtttctttctgggagaaccctcgccttgtaggctcctgcgccttcccagtggtgtgcttcactggctgcctgcatcctggggctcaagtgctgtcgggactgcaagggaaacgctgggtggggcattgggctccgagcagcccccgatgggtgacaggtctctctgctagataccacgaggaacccgaggcccggcgaggagaacggcaaaggtgagtggggtggggccctatggctggagcacccccagtgtgggcagggctgctgggccctgcagctgtgttggctgtgctgcccgtctcctgcccccatcaatccctaatctgtgagatgggtccttgcctccaagggccggtgaactcaatcagggtgtcagcgccacagcgtggtgtcgccttccttgggtacagtgtgagaggccggccaaggcctggggctgtcttcctcccaccttggaggcggccacagtgctgctgtccccagccctgtcctggactcggcacttatcagcacttttgagctgtcttctggggtcctggtaaaaagggctactctgcctgcctgattcaagacaagggacccccttcccaacagcacccccgccccttgccgtgcaacccagtggtctccagtcaccccaccacatcgtcccctctgtaacctgacggtctccagttcccccaccaccttcccccagaacctgttggtctccagtccccatcccatcaccaccaactcccaactccccactggaacccagcagtctcgtatctccatcagtgaggacagtgtgagaaatggtgtctggctcaggcacttggcagcacttgaggggtcctcagatgtctcctgcccagcaaggatctgactaaagcagtcgtgggtgtgggaggggcctgcaggcatgcctgggttgggggcagctggccctgggcaccctggtgcaggtccagtctgccctctggatggcccctcctcttccccagattactactttgtaaccagggaggtgatgcagcgtgacatagcagccggcgacttcatcgagcatgccgagttctcggggaacctgtatggcacgaggtgggccatgcgtgggtgtgggtgggctcccagggttgctgttggcaacagggatccaggtagtgcctgctgcctggccgccatccacaccacccaccccatggttatgaatgtggccaggttgtggcccagggccaggctcccacgtctgtggcccacagtggctcttttcatgaggctgctgggcccggtcctgccaccgtgcattgtcctggcagggtgaagggtgcacaggacacctcatgctcactacaggcaccttggggagtgggtggcctctgttccctgtaggcggggcagggcgtgggggtagcaggtttgagatgctgtcgggtgctgggtccaggccaggcctaggctcagctgtgggaggagaacgctgggcccgggagggcctgggtgtccctgaagctcctgtaggcctcagagagccctggcacccctgctgacctggcacctctccccagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggtgtgtgctgggcagggttgggggctgggggccagggcatgccaggctctgattgccaccccctttttaggagcagcggctgcggcagcgcaacactgaaaccgaggagagcctggtgaagcggctggctgctgcccaggccgacatggagagcagtgagtgtgccgtgggatcaccagggaatgccaggaggggagtcagggttctgaggtctgtggcaccagggaccctgtgggtccccagacctcctgacacctggagtccctgtgagggtcctcagacctctcaactacctcccaacacctagagtccccgtgagggtccccagaacccacccccagtcaccaagggtctcattgagggtcctcagatttccctctgttacccagagtctccgtgagggcccccagaccccccatcgcccagggtcccatgagatgtccccaaccttctagccccgggggtgtcatgtgcatcctcttacagctgttgcctcttctctgggtctgactgcagcccacaagaagagggcatttaatgttctgctgtgtgtgtagaggatagtgtagcccctaaccagagtcctgatgggtgctggtgtccagacccaagttctggggctccagagagagcaggagtggtgcctgaggactgaggcccagggggcggcccttccctaccctgcacaggcccggctgggctggaaagctgtcccacagccgcagtgaggacagccgcaggccagtgggctgctctgnnnnnnnnnnnnnnnnnnnncaaggagcccggcctgtttgatgtggtcatcattaacgacagcctggaccaggcctacgcagagctgaaggaggcgctctctgaggtgggcccatccttgtgcctacctgggcaaggcccaaggggaggcctgggggccaggcctttgttgtccatgaggccactgaggttagatgggacagtcctacccaagcactggcatgagacaccgaggtccacggtggagggagagcaggaagcccagcccttcctggataccagccctcccaactccctttcttcctcactggcaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctggggtgacccccgacccagcctcgctgggctgtcccctgtccctatctctcactctggacccagggctgacatcctaataaaataactgttggattagaaactccataaatgagtggaatgtggccccaaggttggtggggccccatcatcccgatcgggccctgagctccggcagcccaccctaaccaccagccccaaggagggccacaagatggcctctgcctaggcatctgctgcctgccggctcgtggctgctgccccagggcagcatgatgcttgactggcaggcagggaaggtggcagggctggtcccaacccacctggcaggctggcaagtggggagcaggaagcggctgcatggggcagcctgaggctgcaggggtgggccctgagggctgcctcttggtgcccgaccctgtgggtctggcatgggccagaggttccaggagaggcccctgagctctggcagctggaggttctagatctcgaggtctaaggggttccctgagggagatgcccctcccctagctgccccaggggctgtgtgtggtgtgtgaggagcctcctctgctcaggctgcctccctccttccccagtgctcccccagcttgcctgtctaaggcagcacagggccgtgctgccagccacccctagggtcagccccagccctgttctgagcctaggtgaggtgcctctggggtggggtgtagacagatgggtgggagagaaggaggcaggcagggtgcccggccggaaatgggggcggggagaagagtccccgcccagagcccagactgccggaggatacaggccagagccgcctggactgggcggctgggcaggggaggggaggggagggcccaggcagcccccggtcgcttgctccagggcaggtggactgagcttcggaggctggggctggcctctgacctgcttgggcttggagagccctgcccgctgcccttgccccccaggacaatcagggattcagaccctgaggccgaggggggaacaatggggcccttgagggcccctcctccagcccccattgtgcttggtggtgagaggtggccctggctcggccacacaccctcggggaggaccagcatccaagcaggtggaagggctctgagggagactggaattttctggcctggagaaggtagggtgctggggtccatgtatgtacctcatggggctgggggctgttgccccaggagacagcctcacgctgtgccccttggccttgaggccccgaaggagggagggcttcctagggcccagccataggagggtgcactccttgcgcctgccaccccctcctgggctccgctgctccacgcagatggtggggtggcccccccactccatgtctgtgtccttcaggcccagctgccttcaccgcagggtgggcaccaaccggtggggtctgctctgggacagctggcaagcgggaggggggtgccttcagtacctcccccagcagctggggcccctcaggtagtgatagggctggcctctgaaacaccagccagctgcattgtgtccaggcccagtcccccaccctcagcggccacctggaggtgagggggccagcctgcccctggtatagacagacctggggccctgctcagtcccctccatagaaggccacaagccactaagtttgcactggggcccagcctaggtctgaagcccagcagaccctgtggtcaaggatccaaccccagtgcctgtcagtgctgtgattaactgggtggaggccccccgggggtgctggggcaggccctcagtgcaaggaaggggcggcgtggctgaggagggggaggcccacacccctctgggagggcggagcaccccagggctgctgcgcagggaggccacagcccaggcgcgggggcccccatcccagagctggatggcagtgagcccaggattcctggctgctgggcgttcaggagggaagagacgggttcgtggatcctgcgggtggagggcagggacagccttaggaggctggggtaatcatcaccccctcactcccagtatggatacccgccagggctcggtttctggagggtgtgtggctcagctcca

SEQ ID NO: 16845 - DNA, 70088 bp, Human
tgtctcaagagcctagctccccgagtgagcaattcctgtcccttttaagggctcacaactctaagggggtccgcgtgagagggtcatgatcaattgagcaagcagagggtactgtgaatgggggctgcatgcaccggtaatcagaacgaaacagaacaggacagggatttttacaatgcctttccatataatgtctggaatccatagataacataaccggttaggtcaggggtcgatctttaactaccgggcttaggtcaggcaggcccaggcctggtttcgggtctggttcttaggcgccgggttacctgcctttaatttcgcttctctttccttttctgagtataaaactatatgagaggttctgtctctcttctctcagttcaagcgattctcctgcctcagccacccgagtagctgggtacagtcacgcgccacccatgcccggctaatttttttgtatcttttagtagagatggggtttcactacgctggccaggctggtctcaaactcctgacctcgtgatctgcccgcctcggcctcccgaagtgctgggattacaagtgtgagccaccgcacccggccctcatttttacaaatgtaattgagtacttgtttgtgtacactagtagacgatgtgcttcttgagagtaaagcccaggtgttctacatccatggttcaattaatgcattggtatcttttccaacctatggcatttgagatacaacttcaaaaggatctgctgacagaaatagggcaaagtggttctggtattttttttttttaagtttttttctcactaatgttcttatgatttcgctgtactgcaatgttagctgaaacagcacagatatcaggaatggcattgttaagactgaccttagacaaaaaccctgaagtgagaggttacattttgggttctcaccatactcttcccccgctcttgtcctaattgtctaaagcttgcttcccttcctcatcgtatcagcctcccacctgaatcttcccttttcctccttcacactcatctttcttgtgcccctgtcccccatttttcccttttgtaagccattttcataaggatccttccaaatatttcccctattgattggacaacccgtaggtggcagactgttctgggccaaggcaaccaagttgagcagggccagcaatcagtgtcgggaacttctgcagggcacttcagaatcagtgttgggaacttctgctttctatttttcacggacacagacaggaacacagatatgcgaaagcaaaacaatcaaaaagcattttcatttgtttttcaggtagtaggaaagagttccagattcccatccttctgaagccaggagggaggttcctaagaggaggttagggcaagatggagacttctttttaaactagtagatttcgcaaattgcaacacatacattatctagtccacgcaaaggacaggccttggggacacggcacggggaacgtgttccacctggacgactgaatcagaagtctctcccccatcaattgaacgcctcattatttttctttctgtcttttctttctttttaaggtaaatgaattgcttctttttcgttaggtgaggccggcagagaacaagaagagctgaaacggaggcgaggttagtacccagcaaagacctgtggcgaggagagacaatgaagaggaccacgggactggaccctgagaaaggcagaggagacgctggctggtggggcccgcaggcggacagccacgcaggcaggcggaaggctcggctcggcctgggaccgctgcagacccggcctccgcgcggggccgaggcgcctgggtgggaccgaggaggcggggccttcccggcggacggatgatggacagcctgactctccaatcgcgtccttaaaagggtgcgggcaggccaatgagcggacagcgagggccggagtggggctgaggcttcggtgcagagctggagagccgcggctgggaccggagtggggagcgcggcgtggaggtgccacccggcgcgggtggcggagagatcagaagcctcttccccaagccgagccaacctcagcggggacccgggctcagggacgcggcggcggcggcggcgactgcagtggctggacgatggcagcgtccgccggagccggggcggtgattgcagccccagacagccggcgctggctgtggtcggtgctggcggcggcgcttgggctctgtaagtgatgccaggaccagggctggggccggggagtggggcccccgggcccgacacacgcccatcgcggcggtcgcaggccaggcgcgcgcactgagagccgaggtggggagggggcgcggcctgcgctctctggggccgaggggacccagcccatggggaacgcgggcctccgcgactggccgggaaggcgcagagcctctttcttctctttcctggatcctggagtgcggaggaggaggggagagtgctttaccttgctccttcccggggggcggtccaggggagcggacccggcgggcggctgcggtgagccctcgcggcgcaccctgccctctcctcgtggtgactctggatcgtctaggccctcccggattctgactcaggaactagggttctggcgttcttcacctttgggaggtggcggaaagttgcaggtttttcatttgtagggcctttgttgatttgtttcctgttaagccagggttttgttgtaagttccctttcccatgctctcattcagttttaagtctccgtaataaaagagtctcatttccgtggtctgcaaaacgccaataaaaaaatattgttacttctaggttagaatgcaaagagcttggaataccagtgagatggcctggcttaaaagaatttggtcaaatccatcataattccagacgtagccaccataatttgacaagacatagagcattaaaaagcataattttcctaaaggaaaaaaaaagctcctttttcttaccaaatattgtgactcaagcttaaggtaaacctcgggctcaatttatgggaattggatgacttgttttatggacatctgaagtggtatctgccacaggacttttctgtgttgttgttcaaagcaaagtacttgttgctgtctccgaatttagttaaataatagttataaagagggccagctgctaagaaaccacgtagatttttttcattccctttgttttcaaaatgtcagttatgatttagcatcacagtatctgaataccagagtttactcagtaatttctttcttcatggaaaagttcttaatataatccttggatcagggaaactaggtgaagttctgttggatcaccaactgttccacttaaacagtgattccaggggctgtaaagcataaatgtaaaagtctccctaccctccaggggttgacagatgatgacacactttgtgtaagacacaatccattctgtattttgtcttagaaaaaaaggttaaaagtgtgtttgttggtggtggtatttgtgtttaatcaaacaagtagaaaatagcctaaaattaaggtttatcagaaatatgcttcagacagaattgttatgcatgagaggtcagacattgctatggaggacaaagcagttagggtgatcttaattaaaatcagggtattaaacgtagaaggagtgcaaaactacatagtagtgaaaagatcactagagtaatagccccatacaacttggacgtaactcttcagtaatgaagatgaatgttgatatgtaaaaatcagcagctgatgttattggttcaacttagaaaattattgaatctaaaattcttgccaaatcacctcttttctggtcatggatactgcacataagagtttatcttttacaggatagcttctaaagttttatcaagacagttactcagcaaacattcactgagcaccttttaagtgcttaacacttaaaaggtgggaggttaggtctcactgtgttgcccaggctgctctggaactgaaactcctgggctccagtgattcctctgccttttcctcgcaagcagctggggctacaggtgtgtgccactgtgtagggtcagaagcacattggtaaagatgtactgtgggagcttgaaggagggtcattatctcagactgtagttcaggctactggaggaagggagtttaaactgggtaggcatgggggaggggcagaagtacatacagagttatgaatgaacctgttggtagttcagtatagtgggaggttggagtgtatataaggggaatggtgggagttgaggcaggagagcctgccaagggcaccagcttacaaagggccttgtctgccacacttaatccaatgaggatttctctgtctattgagatgtgaaggatgggttagagtggggtgaggctgaagccagagaaggcagaggactattgtaataatcccggggaggatgatgaagatctgaattcaagcattgggctatgaagagaggacacatgttgatgcgccacttagaaagtacgtttgatagagcttggaaacattgatgcaggcttgaaagaggaggtggataaaatgatcataggttttgggcttgggaagctgggcatatttttggccttttcacagatggggaaataggagtcttgggggaagaagatgatggagatacttttgaatatgttgagtttgagatgcgggtaagacatccaaatggagatgggcagaaaacaattggatagacagttctggaggtgaggagaaagttctggttggaaatggagatttagagagttatgtggctaatagttaaagcttggattgtttggatgagggcatccagggaaaatgcactgaagaacatagcagagagccaaagacggagttttggggtatatgaaacctgacaaagagtctctgtgagtaagagaaaaaccaggtgagtttggtatttcagcattgtcagatgaagagagataaaatgtgataagaattcactgaatttggtaattgaaatgagcacatagtatatgaggactaaatctcagtaatttgtaccatccatgtcagtaaatggaacctccatacatctaattgtgcaggccagaaacctagggtccatccctgattcttccctgtccttcacatccaatcagttctcccatctttaaaatgcatctggaattgatgttttttctacctccactcctagccttttagtcaaagtcaccaccatttcttgcctatattactgtgatagcctcccagctgctcttcctctttttccccctctggagtcttgctctgtctcgcccaggctggaatgcagtggcacaatctcggcttactgcaacctccatctcccagattcaagtgattcttcttgtgcctcagcatcccaagtagctgggactacaggcatgcaccaccatgcctggctaatttttgatttttctatttatttttaaatttattttatttatttattttttgggggatggagtctcgcactgttgcccaggctggagtgcagtagcgtgatctcggctcaccacaacctccacctccctggttcaagcgattctcctgccttagcctcccgagtagctgggactacaggcgcatgccaccatgcccagctaatttttgtattttttagtagaaactgggtttcactatgttggccaggctggtctcgaactcctgacctggtgatccacccgccttggcctcccaaagtgctgggattacaggcgtgagccaccacatctggctgatttttttatttttagtagagacagggtttcaccatgtttgccaggtctggaactcctgacctcaagtgaccggcctgcctcagcctcccaaagtgctgggattacaggcatgagccaccacgcccagtactcatcttggttcgttttaatccattcttcacaaaactgcaagaatgattttgttaaaatgcaaatcagatcatgttgccttcttttttaaaatccttaatggcttcccattgcacttggaatgaaatctaaacttcccatggcctgaaaagctctttgtgatctggtttctgcttacctctatgacctcaacttgtaccacccaccacccctttctcactatattcaagccacactgccatctttctgctctgtgacactcattcccacctcctagcctttgaactagctgttctgatgttgcccagggctggctcctttccatcacagaggctctaagtttcacatctttagagaggcctctctgaccaccttattctagggtacttacctgttactatttgctggtttgccgtttacttccttattgtaatttctatatggtttttcttctcttttttttcctccatcagaatctgggacagacaaatcatctgtcttgtttatagaagtattcctagtgcttaacacagtggatatggtagatgctaaaaatatttgttaaatggcagtgaggcataggcatgtcttgacaacagtttgttaggagtttgcaatatgtagttatgatttagcatggtatagtaggtcctcaatatgtgtttatgcaagaagaatatttttccaaagtgtgatttcatgcactgcttatttctcattatcagttcccttggccttttacttatttactagtcaggatagtaaaatagaaacttagtcttataaaatatgtatattttttactccaactccaggatatccactaggcttagatgctgccaaaagaaaaagataaatgttaagtgaaagacagctatgtgcaaaagaacataaaatgcaagtttgtgttttcattaagtctaatttatttacttattcaacgtaaatgaacacctactgggcacaaggcactgtttatgtatgggatgcagcagggagcctagatgctagtgagaagtgacagacaggaaacatctactcaaataaataataccaaaggacagattaaattcccaacaatcacaacttttaagaaaatatgattgatctaatatgaaaatttgcagcaaatttttgaaaaatggaacatcttatttgtattataaaatatttttaaaacttataagggatatgttatagggtttctttaaagattggtctttcccactgagttttaaaaacatgatttaattgggaaaaacatagcttttcagaaatattgctgtttcccctctatccagtagatgctggtctacctactaaatatttctcaccatccactttgcatccacactggagctaatatagtacagccacagtcatgtctctactggatgattagagccttctaactggagcctgactgtttttgagttatatcttttatctgagaatttgaattatttgtgtaagacatacatctcatgtgtacctcaaccttggaaagatttttaatcttgctctctaagaccacagatgtcattttaaaagggagagtaaaatggtaagctttggcatataatttattatagattagtctttagccccatcgaagacggtataattattagaagaactagaagcatctcctgaggtctcaagtgtcatatggctctgagacttgacccctaaggctggtgatattaagccttcatgtatcttgaatgatattccttttttccttttccactcttactttgctaagtcgtttgacattagcagtgccctagagtccagacaaaagtctttggaatttttgctgccgtaagaaagcagaggtcagttggctccgttcaccatagtgcataaattgagaaattgtggttgtctcctgggatctttatatctttgcctttaaacccctttgtttattcattatcttttttctttcttttccttttttttttttttgagacagagtctcgttttgtcgcccaggctggaatgcagtggtgcaacctcggctcacagcaacctctgtctcccaggttcagtgattctcctgcctcagcctcccaagtaactgggattacaggcataagccaccacgcccaactaattttttttttttttttttttctgaggcagagtttcactcctgttgcccaggctggagtgcagtcgcgccatctcggctcattgcagcctcttcctcccacgttcaagcgattcttctgcctcagcctgccgagtagctgggattacaggtgcctgccaccacgcctggctaatttttttgtatttttagtagtgatggaattttgccatgtcgggcaggctggtctccaactcctgacctcaggtgatccacccaaagtgctgggattacaggcgtgagccaccgtgccctgcccaaattttttttcttttttttctttctttctttcttttttttttttttttgtatttttagtagagatggggtttcaccatattggccaggctggtctcgaactcctgacctcaggtgatccacccgcctcggcctcccaaaatgctaggattataggcatgagccaccgtgcccaacctattcattgtctttttcaatgcatgtggctactgtaattttttattcacttaacaattttttcttgatcccattaggcctttatccaagatgatttcattgataaatcctccttcagtaggtttcttcttctaaactcagagtctctagaaactgtgataccttatgatacctctgatcttattgttagaacatagagcttgagtaattttgtagcaacagtgatacactgaatccagtacttaggtttaattgattggagttagaaatgcagtatgtctttgcctatcctgtgtattgcagataagattgccccatagaatgaaatctatgacttaagttttgttaggagcatgctgcaaccaactgaacagaccttgatgaacttgcaatgaacattttttcatactgggaccctgatattctactttaggatctggggagtttattacgtgcattttaaaagatgctgttatcggccgggcatggtgactcatgcctgtaatcccagcactttgagaggctgaggcgggtggattgcctgagctaaggagtacaagaccagcctggacaacatgataaaacccccatctttactgaaaataaaaaaaaaattagctgggggtggtggcgcacacctataatcccagccacttgggaggctgaggcatgagaatcgcttgagcctgggaggcagaggttgcagtgagctgagatcgtgtcatcgcactccagcctgggtgatagagtgagacaccctgtctcaaaagaaaaaaaaaaaaagatgctgttattaaaattaagaaatgtgttcttttctctccaaacattaagtttacaatgtggagttatatacatttaacataatcatgtgcttcttccagataacacttggtaaacttgaaaagatgaaaagttataaggtgttatattgtcagcttagcttcaatgagaacctagtgaccctgtggccagacagtgtctaatagttattctctagtcaagtccaggttatcattgctatatactttcttccaaagggtgttgctgagaattaggaagcatagatagaggactcaggttcctaagagaaatgtggtaaaatgcaaatatttgaaatctcctagatgtctgaaaagagaagagaaagagagtgagtgagcagttagggagatgttttaacttctccctctcccttttctgtttcttagcccttagaagttagggcatagaactaggttcatgttatatcttctgctctgctctcatttattgagtgcttactatgtgccacgcctttgctaaacgatttacttatatactcctcacagctctgtgcaataattatttttattaattttatagataagaagagtaagtttcagagagattgtgtaacttaagggtcttaagatcacacagctaatacatggtagagttgagactcaatttccaaagcacatgtttgcaaccaccctgctgtattatagaattttttcttcaaagtctctaaacattttggggaagattctggaatgtcttaagtgtttacagagtggctttttagctgtcctggggcatccagatttcttctttggggtgatgtttgtgccaagatccctcatgccttgatgctgctgactctgttaaagaggaataaagctgccgtgttgaagccatcctcaccaatcatgcagaatctgtttgtgccacccaatactctaaatgctcctcagggatttttaatgatgttcttttttttttctttttctttctttcttttcttttttgaggcagagtctcttgatatggcccaggctggagtgcagtggcacgatctccactcagcgcagtctccacctccctggttcaagtgattctcccacctcagccttcctaatagctgggattacaggtgcctgccaccacacctggctaatttttgtgtttttagtagagacagggtttcaccatgttggccaggctggtcttgaactcctgacttcaggtgatccgcctgccacagcctcccaaagagttgggattacaggtatgagccaccatgtcagctgatgtggttcttgtaggttcttctcactcatacctctcccgctatcaagagcacaagcatgaatccattatactgagtgataccatactgggctcagaatggttccttgcccctcattacacattacatgtggaagaagccactaagccttgactttcttcctttgagatgagttcttctctggaggctgtgcaggtccttttgccattagactcctggcatgcttgccttacagaatgtccaaacaggcccaggcatccaaaccaaagtctcctcccttgtacctcttcttggctcctctgccccattgacagaggttctgtagccatgttgtctgccacaagttggaggtctagcacttgtctgttaactcttgggaactttgagtcttgatcattttcagctattaggaatttaattctttttttttcttcagtgactgcaaatttagaagaactgcagtgaggcttgctgaaccttgcacactaatgaaattggtgaatggattaataatgaacagaggtgatgctaatttgtaatcaggttgaataatatggatttaagaccagaaaatgggccgggtgccgtggctcgcgcctgtaatcccagcactttgggaggctgaggtggacggatcatttgaggtcaggagtttgaagccagcctggccaacatgatgaaaccccatctctactaataatggaaaaaattagttggatatggtggcacacacctgttatcccagctattcgggaggctgaggcacgagaatcgcttgaacctgggggacagaggttgcagtaagccgagattgtgctactgcacttttgcctgggcgacagagtaaaactgtgtcttttttttttttttttttttgagacggagtcttgctctgtcgcccaggctggagtgcagtggcgcgatctcggctcactgcaagctttgcttcccaggttcatgccattctcctgcctcagcctccaaagtagctgggactacaggcagccgccaccacacccggctaattttttgtattttttcagtagagacggtgtttcaccatgttagccaggatggtctcgatttcctgacctcgtgattccctcgccttggcctcccaaactgctgggattacaggcgtgagccaccgcacccagcctaaaactgtgtctcaaaaaaaaaaaagggggatcagaaaatgctaaggaggcaggaggatcacttgaggccaggagttcaagactggctggggcaaaatagcaagaccccatctctacaaagtaaaaataaaccaaaaaacaagttataggtccacagtttttttatctgtaactgcaaagccacaaatactttgaaaattaagttttttcctaagtttgatacaaattctttggctgcaaaattcaacctgaagtagtaagatactgtttacaactgtgatcctatttggtatgactaattgtatttttcaccgcagagatattaatgtgtttgattgtgggatgctgccctgtactctctagggactactacataatatatagtataggtattgtattaattttttaaaatctgaaaaattctatattctgaaatacacctggccttaagacttttcgattagcttgttggcttgtacaatatcttatctcagaaatttccttctactcttgtaagtactaagaactacaaaatattgcctgggcaacatggcaaaactgcatctttgggaagattgcttaggagtggaggctgaagtaagccatgtttatgccactgcactccagcctggacaacagagggagaccctgtcccaaaaacaaaaacaaacaaaaaaaatacaaaatacagtttagttatttattttttcatttttagaaatgtggtctcactatgatgatcaggctggagtgcagtggctggcaattcacaagtatggtcaaagttccctgtagcctcaaacttttgggctcaggtgatcctcctgtctcagtctccaagtacctgggactacaggtgtgtgccaccaaaccccagctctttttagttctttttttgagatgagtctagctctgttgcccaggttagagtgcaatggtgcgacctcagctcatcacaacctctgcttcctgggttcaagcaattctcttgccacagcctcctgagtagctgggattacaggcatgcactgccatacctggctaatttttgtagagatggggtttcgccatgttgaccaggctggtctcgagctcctgacctcaggtgacccgcctgccttggcctcccaaagtcattttagttctttaaatgttttggtccacaaagctagtgtgctttccacttaagagctttcattgaaactcctttagaaatttatgctactttggactcagcctgtcttttattcaaggaattctaaatctgtgaactggcacacgtttgggaattgattgaagggtcctgactttctgtttttatgattcacattagactttttgttcacttgacctagaacttttctgtttatatagatcaagtaagaatttagtaggtttcctatctatttcacttgtaggaataccgtgaccagctgatcaatgccatagatctgtgagagtcagacttccagctgtgccttgactctgctgtccatcatggtaatcatgcctaccttgcttttagcagttcagtgctgccatttggcccctgtcatcccatgatccaattattcccactgcatttacgtgtcccaatttagtgacagcagttcccactgtaagttctaggctatagataagagtgtcacaaagttcttttaaaatgctgggactcccctcacagatctacttttcacagtcatgtggtgaaaggtgtgtcctctggctgggcctggtggtttatgcctgtaatcccagcactttgggaagctgagatgggtggattgcttgaggtcaggagttcaagaccaggctggtcaacatggcaaaaccccatctctactaaaaatacaaaaattagctgggcgtgatgatgcgtgcctgtaatcccagctactcaggaggctgaggcacaagaatcgcttgaatccaggaggtgaggttgcagtgagctgagattgtgccactgcactccaccctgggtgacagagtgagactctgtcaaaaaaaaaaaaaattagccaggcttagtggcgtgagcctgtagtcctaggtacctgaaaggctgaggcaggaagattgtttgagcccaagagttcaaggctgcagtgagctatgattgagccactgcactctagcctgcaacagagcaagaccctgtttaaaaaaaaaaaaagatatgtcctctggacactcacaggtgagtaagtagatcttaaaagataaatgcactgtaggccgggtgcggtggctcacgcctgtaatcccagcactttgggaggccaaggcggacggatcatgaggtcaggagatcaagaccatcctggcttacatggtgaaaccccgtctctactaaaaatacaaaaaattagccaggcatggtggcgggcacctgtagtcccagctactcgggaggctgaggcaggagaatggcgtgaacccaggaggcagagcttgcaacgagccaagattgcgccactgcactccagcctgggtgacagagcgagactccatctcaaaaaaaaaaaaagataaacccactgtaacactccagtctccctaggcctttgaatgccttcctccatagtaagccgaggcaggcctggcatttcaagttcatttactgagggccacattttggtccatgtttcagccagcaaaccaaactgttagagccctttctaacaccctgagttgcgtaacattaaatgcagaatctctgattagtgggcccatatcagtaaatttggcctaacccaacttgacgttccctccaccatgatcccatacccttaatatccattcccacacatattccccagatttctgtttatataaattagaaaaatcaaatagtttttttagagtatgtgcaccttcatggttcacattttgtacctcacctttaggagcctcctgagacttaagtctagttatagatctagaagcaaagagaggcgttgggggtaggtcctgaggagaatcagcagtgtcttgcaatgcagctgcctcaggggaggccattaaagtttcctcaggcacagcaggtttaattgcctcagatgtgggtggatggctgcttccactggcaaaaaagactcataagaatttagggattcaatgtttccagctccataagggagttcccacatttctccattccaatattcaggatccctttccttcccaatcaatgccctcactttagtagcagacaccctgcagacgttgggaattcagtttgtgctgtagttgagtcatttgcagaataagattctggatttgattttcagcaatttcagctctatggctaacagagataaggatatctttcagacataaagttttctgttcagatatgtagtgctcaagctgggaatttgaatccctgagctcatccatttcttttctcactttgtccattgtcattaggagtaaccaacaaatctcattatactcattagtttgacaaaaatgtttaaaggtatagtatatgtggtcacccagaaccttattcttatacgtgtttgattaaaagtacccaatggtgacattttgcatatctccattgccacatcatacccatacttttactactggaaatagtcattagtgtcctttaatccagttagagagccaagtcctgaaaccctagaatcaattcagagaactcatccttaagattctgctcctttagagccactcttaaaaccaaaattagggttctccagagaaacagaaccagcaagatgtgcatgtgtgtgtgtgtgcactctctttttctttatataaatatagatagataacctatctatatcttgctggcatagatagatagataggaattcgctcatatgattgtggaggcttggtaagtccaaaatctgcagggtaggctggcaggctggagacctagggaaaagttgcaattcaagtccaaaggcggtctgctggcagaattccttctttttcagggatggtcagtctttgttattgttaagacctttaactgattggataaggcacacctacattataatggagggtaatctgctttactcagagtcccccaattgtaatattaatcttatcagaaaacagcttcacagaaataactaatgaattttaaaagataagccatagtggagatctcaaattgtggtttcccatgattgtaaacaattctattctttgttgtctctattttagcactttctctttacatctcaacttggtgctatctgacttcctcctcctctcactatttgacactttgataaaggccatctgatattaccaaatcaactaacctgtttcagccttttctttccagacctttttgctttccttaacatggttgaccactttgatctcatttcctttgcctttgtgacattactcctggttctcatctctcttccctgtcttcttcaagtcttcatcctctgcctgtggccccaatgttgattttccttaggcaggttctgctctcagccctttgctagtctcactgcatgcttgtctttggtaatttcgtccatttttgtctgtttgttgacagtgaatatgtggcagctataggcattcaatacgtatttgttgaataaatggtgactcccaaatatatccccagtgctctgaactgcagaatcttaccaactgaccattacatacaactggacatacccatttgaatgtccagaggcacctcaaactctgtatgctcagaactcaactctatatatctctcctcctcaaactgtgcttcctccggcatgccactcgctattgttattgcttgctgctgtcctatttgtctttccctcaagtcagccaagccaaaaatttggtcttcatcctagaatccttccctttcctcacctcacctccctggatttaatcagatctctgccagtgtttaccttttatttctgaacccactccctcctttccattgtcccaggacaaatgccagtcattttaagttcatgttactgcaagaggcttgagactcctagatcgtctctctaatggtagtcatcttcccttcaggtctgccctcccaactgttgccagagggatctctctcttgggcaaatttaattgtaccactcttctgttaagatcctccatctctccccattatctctgggatgtacttaggtctgccatccccttccttgtactttattgattttttgcaacatttctgcataatactgctgttttatgtctccttgaattcgtgtatgatattttcactcttctgattacccttgtcccttatttacctggctaactcctatttagctttctcatctcagatgtaatctcaaggccaagcactttgcctctaagcttcctctatctctttatctaaaattatgtttttatatgattgtctccccaaatacaggaactgtgtgtcttatatactttgggtctccaatgcttaacataatgcctggaacatagtaaatgtttagtatatattagatgaactgttgaactgtactcaagtggaaattacaaacatcagagcagagagggtgaaaataaggaagcagaacctcccagaacttaagatcttaagagcagggtagtaatcagtcctcaactttgtactgtagacactggatttgatagtgatgtggctcagggccaggatgaggctggggagggaactgggccaagatcaggaaggggttgaggggtggtgttcaataagatcgtaacgtcagtttaacttacagtgaactttataaacgctggggggctagtatattttagcagatcgggttgttagtacattctctccctgtgctgagatagattgttctcacaagattgcccagggaatatgggataagcccagtagatgtttattgaatgacctcaatggctctggccatcaagctatcatagcctaaaacacccctttcttcacagtaggaatataactgacaggtgcattggattagttacattacctcttcactgggcagtgatgcagtgtgctgacaatgacactttagatatgaggatatggcctagaaacattgattggcctttttctggatcttaaagagatttcctggatggagagcctgtcatttagagtagattatctctacagagaaccaatatcatccattgagtactgagatttcttgtgtttttttgtttgtttgtttgtttgtttgttttgagacagagtcttgctctcgctcaggctggagtgcagtggcgcaatctcggctcgctgcaagctccgcctcctgggttcacgccattctcctgcctcagcctcttgagttgctgggactacaggcgcctgccactgtgcccggctaattttttgtatttttttagagacgaggttccaccgtgttagctaggatggtctcaatctcctgacctcgtgatccgcccgcctcggcctcccaaagtgctaggattataggagtgagccaccgcgcctggccaagatttcttgttttaaaattcattacctttttttgatttaactaaataatcaggtctctaccagatttcaagatatttagtacgctaatgttgaattgaaagaaccttggacttgagtcagtgcacaaaaatgaacatgaagaccacaaatactcatgtctgctaacaacatagtgatacaaataagatgtccgtgtaactactaaccccattatttactgatctccattgctgtactttgtatttttcctactatttatagctggaaatatattgatatggtttggctctgtgtccccacccaaatatcattttgaattgtaatccccagtgttggaggtgggaactggtgggaggtgattggatcttgggggtggggatttctcatgaatgatttagcaccatactcttggtgctgttctcttgacagtgagtgagtgagtgagttattgcgagatctggttgtttaaaagtatgtagcacatcctcctctctctcttgctcctgctcttgccatgtaagacatgcctgctccccattcaccttctgccatgattgtaagtttcctgaggcctccccagaagccgagcaaatgccagcatcatgcttcctgtgtagcctgcagaaccacgagccaattaaacctcttttcttaataaattacccagtctcaggtatttctttatagtaatgtgagaatggaccaatacatatattttggtttttcggagtttttttgagagagggtctcactgtcacccgggctggagtacagtggctcaatcttggctcactgcaacctccacctccaggttcaagcgattctcccacctcagtctcgcgagtagctgggaccacaggtgcacaccaccatgcccagctaagctttgtattttttggtagagacagggtttcaccatgttagtcaacctggtcttgagctcctgacctcaggttatctgcctgccttagcctaccaaagtgctgggattataggtgtgaaccactgcacccagccaaagggactaatacatacacatacatatatacatatatacatatatatatatatatatatatatatacacatatatatatttatgtttattctttcttggcgttcctgctgcagtatgaatctctgccaaggcccagaaaagtgactgggacatagaatgaattcaggtgtttgttgaatgaatttattggtggtgtgcagagtgttaccatgctttgttggtttgttaattgaaagtttttaagtagaagagcttttgaattttgaaagaataattaaagctttcaaaaattctaagatgtaatttaccttatacagatgtagaaattgagctctcaagttctctgtatgtgctgccttcccataaacattaaacattgccatgacacccagagaagccccagggagcctggtaagcagccatatacctggggaatatagctagagaacttttgttttctgcctcactctcaaaagtgtctggatttgccccctcatttgtcatatccctgttaactacagtcactactctaaacatctactttggctctctttccttacccctcttatctgctcagaacctccttaccagaaaatgtagcaactccacaatcttttcccacccttcaagcaccatatccttttatagtttcactacgacagtttctggagctcatcaagtcttcccatccctccctgcttttgttttgtattcgttacttcctggctgcttccctctcccgctccaacttggagtccatagttcattgttataatcattcctttgtaaaggctcctacttccccagcccttctgtgccatcattgcacttacctggcaatccctcaaccctgggaaaaccctaccatctctttttacatccttaagcatttgttgctttaattattgccctctttagatcattcttactacaatacaaacatgagctagaatttctaatcttaaaaaccttctcttggttctatagtcctctttagctacatttctgggccgtaactcttagcaaatttttacaaaaatggactatactcctttctttgtatgtacaccctcccttcccactttcttctgtccagccatcccacagctgcctctgccactccattgaaacttctcctatcaggatcaccagaggactccaggttgacaaaccatattagttcttccctatagccaccttatatgacttctcagtccctcctctcttctcttggctttacttacaccacattctctggttttcttcccctctcacagtctgctccctttccgccaccttttcagggtcttttctccctccctgacctttatagtttgatgtctgtatgacttcggcttggctctcatcttcctctacattattttcctatgtaatagcatcttctcctgtagtttaaaatactgcctgtatgctggtaacttccaaaatttatatacaattcagacctctctgaacatcagacctgcatatccggttacctgcttaactccatttagaggtctcaaggtctcattgacattgcaaacttaacatttccaaaatggcaggttgctttctattccttctctccagttaaatctatccagttgctcaagctagaaacccaggagttattctccattcatcccttctcttcactcccatgtccaatctaatagcaagaagtcctgtatgtcatccctttctctcaccatctccttgcctctagtctaggtcatggctgcagtacacagcaccagaattactgcagtcacttctttggtttttgttttgagacagtcttgctctgtcacccagactcaagtgcagtagtgtaatcacggcttactgcagccttgaactcttgggctcaagcaatcctgctgcctcagcctcctaagtagctgggactgtaggcatgtgccaccacgcctggctaattttttttttttttttttttagagatgggggtttcgctatgttgtccaggctggtcttgacctcttgggctcaagtgatcctcctgcctcagcctcccaaagtgctgggattacaggcatgagtcaccacgtctagcctgcagtcactttttttttttttttttcctgacaaggtctcacttgtcacccaggcgtgctgtggcatgatctcagctcactgcaacctccgcctcccagattccagcaattcttgtgcctcagcctcctgagtagctggaattacaggcacacgccaccacgcctggctaatttttgtatttttagtagagctggatttcaccatgttgaccaggctagtcttgaattcctgacctcaagtgatctgctcgcctcagcctcccaaagtgttgggattacaggcatgagccactgtgcctggcctgcagtcacttcttaactgctttcccaatttcagtccgtattcccctccactccattttctacatagcagcaagaactattttacatcaggtgctgtcattttgttgtttaaaaccctttagtcttggctgggcactgtggctcatgccgataatcccagcactttgggaggtcaaggcaggaggatcacttgagctcagcagttcaagaccggcctgggcaacatggtgaaaccctgtctctacaaaaaatataaaagttagctgggcctgatggctcacacctgtagtcccagctactcaggaggctgaagtgggaagattgcttgcacctgggaggttgagggtgaagtgagccatgatcatgccactgcactccagcctgggtgacaaagtgagaccctgcccccagaaaaaaacccttgttgggaggtcaaggcaagtgtatcacctgaggtcaggagtttgagaccagcctggccaacatggcaaaaccccgtctctactaaaaatagaaaaattagccaggcgtggtggccctcacctgtagtcccagctactcgggaggttgaggcaggagaatcactttaacctgggaggcggaggttgcagtgagcagagatcatgccactgcacttcagcctgggtgacagagcaagacaaaaaaaagaaaaaaaaatctttgatcttatcaaattgttcttgttttccataatatcaaaaacccggcatataaatatataacaagtataagagtgtatcgcctaactatattatgggcagataccttaatagtatctttcaaataaaaaagatacttgccaacttttaaaataaatatatatggagtgcctgagggaatttcctaaggagtccatagtctatcatcagtctaccataatcagaataggaactatagtttattttggaatggattgtgaagattttctctcactctgtgggttgtctgtttactctgctgactgttccttttgccacacaaaagctctttagtttaagtcccagctatttatctttgtttttgttgcatttgcttttgggtcttggtcatgaagtctttgcgtaagctaatgtctagaagggtttttccaatgttctcttctagaatttttatagtttcaggtcttagatttaagtccttgatctatcttgagttgatttttgtataaggtgagagatgaggatccagtttcattctcctacatgtggctagccaattatcccagcaccagttgttgaatagggtgtcctttccccacttgatgtttttgtttgctttgtcaatgatcagtaggctgtaagtatttgggtttatttttgggttctctattttgttcctttggtctatgtgcctatttttattacagtaccaggctgctttgatgactgtggccttatagtatggtttgaaatcaggtaatgtgatgtctccagattgtatgcaggctcttttttggttccatatgaattttaggattgttttttctaattctgtgaaaactgatggtggtattttgatgggaattgcgttgaatttgtagattacttttggcagtatcatcattttcactttttttttttcttcgagacagagtctcgctctgtcgccaggctggattgcaatggcgtgatcttgcctgactgcaacctctgcctcctgggttcaagcaattctcctgcctcagcctcccaagtagctgggactacaggcgcacatcacgcccagctaatttttgtatttttagtagagacggggtttcaccatgttagccaggctggtctcgatctcttgacctcgtgaccctcccgcctcggcctcccaaagtactgagattacaggcgtgagccaccgcgcctggccttcgcaatattaattcttcctatccatgagcatgggatgtgtttccttttgtttatgtcatctgtgatttctttcagcagtgttctgtagttttccttgtagaagtgtttcacctccttggttaggtatattcctaagtattttgttttacttttttgcagctattgtagaaggggttgagttcttgatttgattctcagcttggttgctgttggtgtatagaagagctactgatttgtttacattaattttgcatctggaaactgctgaattcttttatcagttctgggagctttctggaggagtctttagggttttctaggtaaacagtcttgtcatcagcaaacaacaacagtttgacttcctctttactgatttggatgccctttatttctttctcttgtctgatttctcgggctaggacttccaatactttgttgaagagaagtggtaagagtgggcatctttgtcctattccagttctcagagggactgctttcaacttttccctattcattattatgttggctgtgggtttgtcatagatggcttttattacattgaggtatgtaatggacaggcattctaagccctttacaaatattaactcatttcattcttgtaataactctttgaagtcggtactattagaataaacttaaaagtatgagaaactgaggcatggagggctttttgcacaaggtcccacatcactctttcttgtctcgggtaaccctgtgattcacatagttgcagaccacatagtcacaccagaagtttttcaggaaacctttctagacatcttgttaaaaacttacaaaggggacaacttttgatgtgtaaaacaattaggaagcatgtccagagtctaagtgttctttaaaaaccaaaaaaaggccgggcacagtggctcatgcctgtaatcccagcactttgggaggccaagacgggtggatcacctgaggtcaggagtttgagaccagcctggccaacatggcaaacccctgtctctactaaaaatacaaaaattagtgggccatggtcgtgtgcgtctataatcccagctacttgggaggctgaggcaggagaaacacttgaacccgggggtcagaggttgcagtgagccgagatcgcaccacttcactccagcctgggcgaaagagcgaaactcagtctcaaaaaaaaaaaaaaaaaagaacctccaaatagcagtttgcccattttctccttccaagttcacatatagaccttaataaaagttatagactccaacaactagtaaatatttttttccacttgtttcgttaaatttatttccattaaattgggagtaagatcaaaacagaataatgtttactgtcatcagtttaagaataaatgttgtgcttactccgcagaggcggatggatccactacttctccccccactgcaaaatttggttaagatgtggaaactgatgataccatatgtgcaccaggacggtacgaaaagggtttatgactcacttactgaggctttttggggagagcagggcaggcttcccatgcaggtacaagaatggcttgagaaagcaggaaaaggatactggctctccttttatggtgataagttgctgagtctggagtgaaggtccttatatgccccttcagccaggtcttggtttgaacttcccacctgttccaaaggatggctcacttgggctttcttattagcttgccctgaggaaaggggtacagcttgaaagctcttggcagtcaaatatcaaaaatgatgtcagactctttattacaaatatatttttaagtgcttgtcattgtttatgttatggggcaaaaatcttgcattgtactaaacaccatgtcactaatagtgtgaatagaagattcagcagactaatgtcaagaatgtttttggaaccttgaacacagggaatatcctgtgtgtcttttaaaaacacggaaaatacttaacatctctattttgtttgggttaacactgatgatgctgaaatgttgggtattgattgcctgggtcactatgggcaaagaagctttttttgtttttgtttagttttatgatattactgatttctgtgttttgtcatattctttttgtattttattaaacatgtttttaataaatgggcactcttattttcaaacttaataaataggactcattttactatgcatatcctgggttttaaattctgagctaagaaacaagagatagaagaaccaaatttgggtaaaattcagagtcttagatgccagaagccagggagacgctggaaaacaattattgagatgtgttataggttaactgatagttggaagacaacatgcctttcaggtttgtggtttactgcctttcattaattctgacacagtttttaatattttaatatctctgatattgggatatgccttacaattgttggcgagtcatagccagcatttttatttcttggggacacagaaaataatgtgtcttaccctcagtggtgtcttcaattacatgaactatgacaatttttacacctttataagtcttttaaaataaaaaattcatttatacttcagaaaaaatacctatgattagaccacgagttaggggagactttgcagtggtgattgccttggagttgccttgacggaagagtgggagttggcccaacgggagtgggttggtggagaaggcattcagactgagagatagcatatacagcatattataaagagtgtgctgtgttggggaaagggctagaagtttgatgtggcaaaaatgtaggctctgggatgagatgagaatgataaactggctggaatggtaacctggagccagcctttgaaaggctctgtgtgccgtgcgagggagttgaggctgtcttggcatgttaggcagcattgtaaagcagctctccctccctgtttgcatcagcaaaggggtgggcagcattggcaccaataacagaagagtgaagacaatacatatgtcgaataagatctctagcacagagttctccaaaatggaaagggctgcaccctggaatcagatggaagggagaactttaccaagggggtgctatttccttctgctctgttgtgaatggagttggggttcagtggcctgttttagaagcctgtttgtgggcaagctgtgtgacaaagttgttgaaaaatgaggaatggctttcagagggcagtattaatccatttggatggaaatttaggagtggaacatgtgtttctaagctgtttttggctttttcctaagggctatatattcttaaattaaaggtgatttatcattcttagtttcctctaaaatataactttttgtagagggaggctttatcacaaaatttaagaaaaaataagtttgttattcttgctgtggttttatttttataagaaatttgggaatttgatccttcatagcagaaatttgttcagtttgggtctccaaacaagagacacagaaaatttgttcatcagagagccactgagatatatagagagttagaagatcagtcaggaaacattaatggaaccggaattatacaatagaggaagaaaactgcaaatatttctgttgtttcagcctaattttaacactcattaccatttgcagcccataagcgaattgttttgcatagagcctgcattgctaagccagtagaaggaactagtcttttaaaaacattttctaatttcattcccttttatttttgagacagggcctcactctgtcgtctaggccggagtgcagtggtgcgatctcagctcacagcagcctcaactatccaggctcaggcagtcttcccatctcagtctctcaaataactgggatttacagcatgagccaccatgcctggcaaatttttaaaaaatgttttgtagaaacaggggtctcactatgttgcccaggctggtctagaactcctaggctcaagtgatcctcctgcctcagcctcccgaagtgctgaatgaaccaccacaccaggtcttttatttcacgtttaaataaaaatgttagatagtagtatgttgacatagttcaaaagttaaaaaagaatacatgataaaaagtcttcctcctagtcccctgtccctttgctgaggaactcagtgttagtatcctgtgtatggttccagagatattttatggagatgtgagcaaatctataagtgatagcatctcatacacatggttctacagctgcttttttttttaacagaagttttactgtgatataattcacatactgtggaattcacccatttcagttgggattcagtggtttttcagtgtattcacagtgtgttgcagccgtcattacttatataatattagaacactttcatcaccccataaagaaaccttatatccattagggcttagtccctcttcccctagcaactactaatctactttctgtattagaaattttatatggatagaatcagataatatggggccttttctgtctggcatctttcacttagcataacattttcagttttcattcatgatgtagcatgtatcaatatttcatttctttttatagccataatattccattgtatgaatataccacattttgtttatctgttcataagatgagggacatgtttttctcttgtgtatatacttaggattgctattgctgagtcatcataactctgtgtttaaccatttgaggacctgccaaactgtttttcaaaaggctgtatcatttctattcccatcaacaatgtagagagttctaatttctctacatcctctccagctactggttagtgccatctttttgatatagccatcctagcgagtgtgaagtggtatctcattgtggttctaatatgcctttttgctaatgacttagtgatccttgagcaccattaagtgcttattggctatgtatgtctttggagaaatgatattcatgtacattacccatttttaaattgtttaatctttgcaatgttgatggtaagtgttctttatatatttgaatacaagtctcatatatgatttgcaaatattttctctcattctgtggatgtcttcttgctttcttggtagtttaaagcaaaaaattttaaattttgggtaagtccaatttacctattatttcttttgttactcatgcttttggtgtgttatctaagaaaccattgcctaatacaagatcacagagcttactcctatgtttttttctaagggttttatagttttagctcttacctttaagtctatgttttatttgagttaatttttgtatatgatgtgctttacattttgtacttttcatttaataatatcttgggagatcattctattccagcactaaagaacttcctcagtttttcttatgatactatagtattctcttatgttgatatatcatagctactttaaacagtctctcattgatggagatttacacaaacatttgggtttggaaattatctcaaaatgacattgtggcttgaaagttgtttcatatcacccttctcaaaaatacaatttcatccatttcacagatttggttgttccaggcaactcatgctattcagaagccctggaataaatcccagtcctttgggtagaatgaccccaaggaattcaagatatttcattccattaaatgtttacagtaagtcaggaagcaaaagtttctttcaattatctgaaaatatatggaaaaatacttttggagggacaaggtgctctaaaattttgttgtaccgtctaagctacagtcagtttcagatgacttaatggcatgtgttcttttactcttttgttgaattgttgtctgtgtgtataaatcaaagtgagtagtaatctaaacttcaggcaatacaggcagccaactcagtaagatataaaatatccagagattatgaaacatataggtttctttgttaaagaggaggcttaggggaaaatcttgaaatacatcaacactttcctaatctgcagaggcatatttggccactggaaagtaaacaaaaaaaggctaataggaagctaagattagtatggcaaaacccattccttcaacttcttgatctttacctgtaacacagttcttcactaagagactattcttattttatacactgatcaagtcagtgtgatatcacaaaaaaataacttcagaattgtttaaattctgtttctgttctctatgatctggataccttcaataagttactttccttttttgggctagagtattttcatctataaaatgaacgtgaactagatgagttttcaagcctatagtagaacaattaattagaggtgaaatagaggctactactggaggcaagctgcaatcagcagtggccacagctggcctgatctgcatggagtagacagtaagaatgttaaaagcatttacaaaagttcaaaaataatcatggctggagacatctggctaggagcaaatagtccgacatacctgagtggccccagagggcacactaagttacattatgttcctaatgtccacacaagttctgagctaccaaataaaggttaaatggaatactgtagttctttcttttgcagttttattttgatataatttctcatttacagaaagtttcagatagaacacaaagaataccatctatccttcacccaggtttttcttttcttttctttttccttttcttttcttttcttttcttttttgagacggagttttgctctccttgcccaggctggagtgcaatgccgcgatctcagctcattgcaacctccgcctccagggttcaagcaattctcctgtctcagcctcccaagtagctgggattacaggtgcatgctaccaacgcccagctaatttttgtatttttagtagagacagggtttcatcatattggttaggctggtctctaactcctgacctcaggtaatccgcctgcctcagcctcccaaaatgctgggattaaaggcgtgagccaccgtgcctggcccacccaggtttttcagatgttaacattttattacatttgcttaaatctttctctccccttcctccccctcccaccttgtatatgtgtttctgtaccacatggaagcagtaaaaatgccgttcctttatttataaataatttaacatgtatttcctgaagactaaggacatcatgttatataaccacagtgtaattatcaaaattaggaaatgaatattgaaacagtaacagtactgttatctaatatatagagtttatttggatgatgcccgttgatccaataatgtccattagagcagaagaaaatccagaatcatgtgattcacttagccatcatgtctctttcatcacctttagtctgcagcatttcctgagtcattttctttaaagttttacattaatatttttaatgtatattatataagccagttacatagtagattgcccctcattcaagtgtgtctgatgatttaggctatccatatttggcaggaacaccacggaagtaatgttctgttcttctcagtacctgatctaaggagaaaggtgctgcttatttgttccactgctggtgatgttgactttgatccttggttaaggtgttgtctgccatgtttctccactctaaagtaactatttttttcccctttgtaattaataactatcttatgggtaattctttgaaactaggcaactatcatgtttctccttaaactttcactcaccatattatctttttatgaagacagaaggaaaataatacattttagtaagagtcccatcaaaatggttgtgatgtttaaaaaaataacttcaaggaacatggagtagtcatttgacagatataatcatgtagaattacttactatcagaaattaaatgtatgcgccgggcgcggtggctcacgtctgtaatcccagcactttgggaggctgaggtgggcggatcacttgaggtcaggagttcgagaccatcctggccaacatggtgaaaccccatctctactaaagatacaaaaaattagccgggcgtggtggctcgcgcctgtaatcccagctactcaggaggctgaggcaggagaatcgcttgaacctaggaggcagaggttgcagtgagccgagatggcaccattgcactccagcctgggcgacaggacgagactccatctcaaaaaaaaaaaaaaaagaaaagaaattaaatgtatgcaatacttagtttttaaaaatatccctcacatatctaaagtcaatttgcaggtttatacatgtaaaaataatttcatttgttagtagtattgtttttgaaagatttagagatgagtcactcatggaaatttttctatttttccagtattggaggcagaatgaaactaacaaaaatcctttggggaaaaaattattccaataaattttccagtaattattccaaatgtctcttcttttcctcccttttttgtgtatctttacaactcaaccaaaaagtccactgttactatatcaagcctgcttaagaatcctccgtgatgcccacttcctacaggatcaagttccagctcatctgaattcagactaccttttcatcttaaaacttttcctctattccagccaaattcatcttcataattcatctttaaacatcatctcatgtttttctgtctctgcaaaatgccctttcaatctattttgagtcttctcagtataccagataaaattcaagtgcatctttcataaaatattccctgacctcttcatttttcaaattttgactttaattagctacatatagtctatttgctacttcagggggatggtttagtaggaacttaccttagggaagataaggtggcataaataacaataagatacagaccaggcagtgctgactccctgcttggagggccattttcccatgccctgcactgtgccataccctgcacactgtaggacacaaagtttgttgtacacattcttgtgtatatttccatgtacagtatctaatgagactcatcccactcagaacttaggacttattatatattcaataaatgaattgttcagttgatactgtcttttaaaaattctgataaagccagcatctcaataggaagcaggggcagatgtttccattcctccctcatattttactttctgttcaagggtgagtgtttacactttgaactctttctggcagtgatgaatcagtgctgattaatcaatactcttttgccagatttttctaggagccagagagagcttgactggggtcaggcatccatttaagggcaggttggtttccttattttaggaaaaaaaatagtgcttatatgtttcattaatcataacttcactttacaggaatccaaaaaatttagtgttatctgttcactccttttgaagtgttctttgagagctctctgaccaccaggaagtgtagtaggtgctaggcacactgaagccaagtaaggtgtagttccatggctcaaggagttgtgagtctaacaggggagctgaagttaattgcaagggagattgtgcttttcactgaaaggtgtgtcttcggtagactacagccatagagtcgtgtgagaattactgaagagtgtggcagaagaaaaggtggtaagatcagggagggctttaccaaagtcacgttcaggtggagtcttgaaattctgtaagctttcagaggtgggccttgttccaagctgtgtgagtatagccctgaggtaagctggctgcgtggcatgttgaaggaagtgagagcaagctgataccagctcgccaccaacagcctttgccaaatgtaaagcaggaaaaggagggttactttgaaaagcctagtgtgccatgctgagaatgatggactttatgaagcaatggaggagcttttaaatgtgttttcaataagaaattgtcatggacaaatcagcattgaattcagatctcattaaaaacgtgtccaaaggataactcgacagtaaacatatctcgaaagtacccatggctgtaaaaaaggcgaagtatttctttctccatttaatttaccctcccctgggtgattggtttgtggttaggccgtttgtccagctgcagcagactggttttacaccctgaagtaaacttgaatttcttttttttttttgagacggagtctcgctctgtcacccaggctggatggagtgcagcggtgcgatctcggctcactgcaacctccgcctcccaggtttaagcgattctcctacctcagtctcccaggtagctgggattacaggtgcccgccatcacgccgggctaattttcgtatttttagtagagatgggatttcaccatgttggccaggttggtctcgaactcctgacctcaggtgatccacctgcctcagcttcccaaagtgttgggattacaggtgtgagccactgcgcctggcctttgaatttcttaaaaccaagcagaacagtgattttcaagctctcttcattagattctagcagctggagtttatttatttatttatttgagacagtctcactctgttgcccaggctggagtgcagtggcgtgatctccgttcgctgcaacctctgcctcctgggctcaagcaatcctccccgctcagcctcccaagtagctgagattacaggtgtgcgccatgaggctcagctaattttttttatttttggtagagatggggtttcaccatgttgcccaggctggtcttgaactcctgagctcaagcgatccacccacctcagcctcccaaagtgctgggattataggcgtgagccactgcacctggcacagctgcattttagagcttccaaatgcttagtgcgtatttcatttgtttccaaagtacattttaaaccattaaaatcacaataaaaaatagcacacacacttgtgggtggttatatgaataattcgtggactttggacaccaatgtcgtgttaactcaggctgccagtgcagtcttcagaataaagtagatttttgtaatttctctgccgacatgtaaacttatacaagtgtgttattgattaagaagctgagtagagcactgccctggtattttgaaaagttcaggttcatgcatgtgcactaataatgtattttacaagtgaacatacctatacctacagtcaatcaaatgccaggcaaggtgtggctcgtctgcttcaggcatggtcttattgtataatagcatcgtaagtgaagtcccaacatctcatttgtatgctgggtagtaattacatgtttcaaatcacctgggggccttttaaaaatcctgatacccaggccataccccttaccaattaaatcagaattcctggaggtaggggtgggacccaggcattagtattcttttaagagttagactgtttagagcagttatggtttacagcaaaatagagcagaaggtacagatttcccatctgtctcctccatggcctctcctattattggtatcccccaccagagtgatacattgttacagttggtgaacctacagtaacacatcattatcacccaaagaccattatatttacgttagggttccttctttctgttgtacgttgtatgggtttcaacagatgtacaatgacatatatctattattataatatcatatagagtaatttagtatttttcagtagtttcagtaggcatcagtatttttaaatttttaaaaattttttgctgtattttggaggagaggaatatattcttattgccatcgaccgtaggcgtattctttccaatctcttgttctgtccttctagtaataattgtattggcttttctggtttcagttaaattttggttcacatatcttcaaacatactataaacctgataagatttgagagcccagaaagataagtttaaggtacagtggtctttttcctgaagagcaattttaatatgccatttcagcacctgggaagtgtaaaatatgtgagagtgttattttcttatctatcagatatgcctccagagctttcaacatgttctttatgttaagcattttagtcccctgtactctagcagaagtaaaatctgatttttcctaccaaaagttccttattttcatctgcttgctaagaaccaagaaatgtttggatgctttatgcagatgatacaattcaaactaactgcaactggggcatttgtgttgcctgcttcatgttttgagcctttagtatttaatggaagccctgcgctgtggaaagtctcctaatagcactttgtgcatcccaggggccaggcacggtgcttctgcagccgcactgtagatgtttgtttatttgtctccactaggctgtccagtacatttagaggctgagtctcagtgtgtgtttgaaagaatgaatggttgattgaagaaaggagaccatttgcaggagagagagagagatgaacagtacatatatagaggagggcaagaagaaatcccagggctttagagtcaagtgattagttcagtgactggcctgattcaggaccctttgagcatttctcatttgagaaacagaaagatctttgttggtacaaaaaaggttaaggatagatatgtggccagctggacatcgatcatgagcggaaggaattgactccgagagggatttggtaatcttgtgtgttagtaaaagtacatggattttttttttttacagtctcactctgtcacacaggctggagtgtagtggcacaatcacagttcactgcagcctcaacctcccaggcccaggcagtcctcctatctcagccccctgagtagctgagatcacaggtttgagccactatgcccagctaatatttttttgtcaagacgagggctggtcttgaaactccagggctcaagccatcctcctgcctcagcctcccaaaatgctgggattacaggcatgagccaccttgtctggccagattttttttttttttttttttttttggtaatcaaatatttcaaaaggtgagtctcctttggggtgattctctcacacagaaagatgattcttggaggaaacatatctaagcatcctccaaggtagtgtcagcattcaaagttgatcctgaattatctctgcagacactttttgtgttgggcattatgctgaagccatttgttgtagagcaagttgatttttatggctgagcttatctgaatttagtttgatatattgtattctttatttattcattcattgattcactgattcattcatttttcctgacattcaaacaaatgtttcttgaacacattgtgaaagggccaggcatttgtcaggtaatgagggtataatggtaaacaaggtagacacagccctttgccctcttgggggtgcagacagccggtcatttaagtggggtgtgaggagagcatttacaaggaaaggacaggatgtcggggagcacagggtggggagtgtggggcagacgctaggaggaagtcccttgagattaaggcctgaagcataactttagacaaagagtgcagaagagtgtgttcctgactaatgaaaagcttagtttattaatacttagggcttgttgaatggaggatacttttgcagccttcccctactttgtgccatccagccaagagaggtccacaatagcagccctgattcgcgggaggaaagagcccacttcagctgcagggtggccctgttcccaggagagatttgagtctgaccccacagtggcagcaaggcagctctgtgcctgtgttatctccaccagcacacgtcattgagtcagctttactttatccagcctgattgtagaagtcatagtagacactgtgagggaatcgtgtggaattttcactggagcattctgaaacttaaaaagtaaatcttttattgctttactaatgtcttcctgtgtctgtctttttaaaaatttttattgtaaaaagtaaaatatataccaaagagtgtatgtgtgtacagtttacactatcagtattaaaatgggcacccatgtactcatgaccagcctaggaaataaaacattaccaatagtgtgtacctttcacatcctgcctcctccaccctgtcccagttgtaactactaccctgaatttgtatttagtgttctcttttgttcctctcttctagtatgttttaaaaggtcatatttatgcttattaggagatattacagtatcagactcttgctgtgtaccaacaaagaacaagagataggtcagaacgctgtttaaataaattgcttgattgtactcttttaagcaggagtttatagtggtaacatcaaagtgcttaaaaaaattcaaaacaaaagcctttttcagtttcaaggaaaaccttaacaaggtgtgttaaaaagataaggtttttagaggttgggtgaggtggctcacacctttagtcccagcactttgggaggccaaggcaggtggatcacttgaggtcaggagttcaagaccagcctgaccaacatggtaaaaccctgtctctacttaaaaaaaatagaaaaattatctaggcatggtggcacgcccctgtggtcccagctattcaggaggctgaggccagagaatcacttgaacccagaaggtggaggttgcagtgagttgagatcgctccactgcactccagcctgggcaacagagcaagattcttgtctcaaaaaaaaaaaaaaaagataaggtttttacaaaccagtatgctataaatggacccagtagtaacatgacattgaattgcttcaaccagtaacagcttcaagatccctgcctatgttccctgctgtgaacgtgtttatttgttcctaataatactgccacagtgtatttcaaattattttatggtatgagagtttgaatttacttggagtaagatcatctcggcatgtagttgggagacattatttactctattgtttcagtaattcagaatattgaaataggtcagtcatgtcaggaaatagactcttaggtgaaccattcttgaatttgcctttttctttgtgattgtgatggatattgttttgttttctatctttgcttttttttttctttctgaaatgttctggttgtccatccaaattgtaagaatattacattttgaatatcctttgattattgtaaaaatgacccctagtcagatgattccacagactttttgattacttgtcaaatgactttgcgggcttttttcatttgaattgatttcctattttaagggtcagtgtcacttcattgctaaatgatacctttgagcaacatggtacattttagaaaccttattctccagagtactctaagagaagggttgtttggattttatttgtttatattcttgccctttaaactctagcataactcagcaggattcggtactccttatagaaccgttccccagagagaaagtaagctcagctctcatttccatgttgaagtttgtatgcaagtttacatggagctcagaatccaaagttggcaggatatgaaaatgtttgtatatcatttaatctattttatttcatttcatttctgtgtttttattcccaaagcaattggttttattcaggaatcaacagacttttttaaatccatctataagtttttgaaccaaagctttactacatttcacagccatttttgccactatgccataattataaatccttggcctcaaagaaacctatttaatatcttattcagattgagattctagtctttagtgacatggaatgtagattagaacaatagtttctgtatatctcaatggtctttacatttgcatttttagccattttaactagcccctaaaaactctcttttatgactctgtggatgagctatctgaattcaacaataattttactatgtattcccataatactcctagtcatttaaaaaaaggcaggggaatggacaaagcaaatcattcccaattgtttaagaaaccagtgaactcatcccttgcttggactgcatagaatacagcctgagagggaaacctgtgatttagtttctctctttacccacacaggagaacacttctgacaagatgccattcgtgctcaccgtagttggtcagaaactgcggctctgtgcttggcaaaagttaatttggattttagatgctgtgtgcaaggaaaccatgtgcagttttaagcaaggatcttcactgaaatttctcgctgcaatcaactacgcagagtgcccagctctcagcatttgacacagttggccactcttcccttgtctctcatggcatcgtgatttcctgggatacctttggtctctttgtccatagcattctctatctggggtacactcacaataggcagaggaaaaacatggtaaccagggtggctgctgcaacatatttgagggggtcagggtaggcaatgaggtccgagaggtagccaggagttagctcatgtaggactttgtaggccacttgaggactggcctgatctggctgatgggaaacccatagaggattttgagtagaagagtgatatgatccaacctgaattttaatgagatctctttggcctctctgtggactagttgctgtgaagtggggaaggctgaaggaggcagacaccaattaggaagctatcaatacttaatccaggtgaaagatgacagtggcttggaccaagatggtgacaccaaatgaggcagagagagatcaatttctagataggtttcttttgttttgttttgttttgttttttgagacagagtctcgctctgtcaccccgcccagagtgtagtggtgtgatctcagctcactgcaagctccgcctcccgggttcacgccattctcctgcctcagccttccgattagctggtactacaggcgcccgccaccacacccagctaattcttttgtatttttagtagagacggggtttcaccatgttagccaggatggtcttgatctcctgacctcggtgttccgcccactttggcctcccaaagtgctgggattacaaacgtgagccaccgcacccggcccctctagataggtttctaagtagagatgacatgtgtagctgacagcttggaggaaagttgtgcaaaagagaggagtcacaaaacagtccagggttttggtctcagccactagaaaactggtgttaccatttactgatttggagaagaccatggaaaggaagtttggggggtgggaatcaggagtttaatttggacatattaaatttgagatgatgccaattacatccaagcaaagttgaataggctgtgtgtgtgtgtgtgtgtgtgtgtgtgtgtgtgtgtctgtgtgtgtgtacaggtgtcatcagcatttgaaactgagtgaggtcaccaagagaaggaatgttaaatagatacgcagtcagagaaatgatctgggctcttaatcatatagaggtcaggagaaccagggaaggagcagtcaatgagataagagaatcaagagggagaggcattccaaaagccaaactgttaaaaaacaaaaaaaaaggttttagcagggagtaactttcaaaggttttagatagggcaataagacaagatttgagaattaaccatggaggtcattgcattccttaacaaaaacagtttctatggagtaacggagatgaaagcctaaattggatttatccaagagaacagaagaggagagaaattggacacagtgtgtacagacagttctttcaagattgataaaataaaggaggacaaaggggccagagctgcagggagatgcagggtcaaggttttttttctctaaacctgggatataaatataaatatgtatgtttatattgctgctggtggtaattcagtagtgagtgaaaaattcagaagagggagaattgctggatcaataaatgtccttaggtaggcaagagatgagatgcaatgtgcagtggagaggttcatcctggagagggatgcagacagacactttctacataggagtgcagggaaagcagaatgggcacagatgcagggaggtgggtagctatggtgtctggacatagggaggttctcttctcattgcttctgttttctcagtgaaataagcagctcagtcattagctgggagtgagaaaccagaggaagtggaaatttgaggttagagaggaaggtttaaactagtcctctagggaaatggaaagcagatggattagggcaatgtgggtggattgctagacagcattaggagtccctttaaggttagtgaccatacatttaaggcgaaaatagtcagtgggattgtgtgcttttgtccagctgtggtcagccaccctggtggagatgcatagtggatagagaattgaatttaaccaggatagaggttccaggtgaaggccctgaagggagaggcaagagagctgattgtgtatgcaagggggtgagtataatggtggcctatggggtttagtctgagtaaggcaaatgaagacatgctgggattttagtttctgatgcagcttagggatcagtgaactcagggttttggaggatattggaaagctaagaggtggtcaattagggagtagagaagcctgaaactacgattctggagtgggtgcaggtactgatgattgggtctagagctagtgattctcaactggggggatttcacctctgaggaggcatttgcaatgtctggagacatttttggttgtcacaactggaggcagaggagatactgctgtcatctagtagaggccaggggtgctgctcaacatcctacaaggtatagcacagtttcccacaacaaaggattgtctgtggcagttgtcagtagtgctgaggttgagaagccctggtttagggtataaaagaaaaacttcagctgaattaaatttaaaggagtttaactgaacaaagaatgaactgcgaattgggcagccttctgagccaaggtaggctcagagacgccagcgcagccacgtggcggaagaagatttatggacagaaaaaggaaagtgatgtacagaaaacgggagtgaggtacagaaacagctgcattgattatagctcagcatttgccttacttgaacacaatttgaacagttggctacatttgattggccaaaactcggtgcttggcccaaggtgattggctacggcctgtttacacctacacttgttatagttcacagtgtacagaaaaacccttaggctgaacttaaaatatgtaaggaggcagctttaggctaaacttgattgaacaggtatgaccatagaaatgagtggctggggtaggcctgatcttacccagattattggagaagataaacagactagggttttagaaggtttatcttacaactgatgaaatctccaaaaatgatgacaagagtagtattagagaaaagcgtagatagccagggatgggaggaagttaatttctcagtgtgtggcatcattttctttttcttgagctagctgatgggctagctttggatttcataatcctggctaagagctacacgttcagattagccaaagagtgttgtgtgttttttaaaaagccacctgtttattacctaactttggtataatgaaatctgtgtcttaaatagatgcctaaaagccatttgggaatttggttagtctttttgctcaaaattctgtgactgtaaacttggacacttggtctaattccatctttaaataatgtctcgggatgacaagtcttgcagctaggcctcgaggaagggatctggtttaagaaaatccttgaagaaggctgggtgcggtggctcacgcctgtaatcccagcactttgggggggccggggctggtgaatcacctgaggtcaggagttcgagaccagcctgggcaacatggtgaaaccccgtctctactaaaaatacaaaaattagctgggcgtcgtggtgggtgtctgtaatcccagctactcgggaggctgaggcaggagaattgcttgaacccaggaggcggaggttgcaacactgcactccagcctgagtgacaagattgagactcggtctcaaaaaaaaaaaaaagaaagaaagaaaagaaaatccttgagaaactttatttatagacttttagagactgtggctttccagtactcatcaccatggagaaaactagtcaaaatcacacagagtgaataagggttgcaagccagtgctgcttcctggaataagctggtccactagtctagtcttgtgctttgtccttcattttgaactcaagtgccctggggctgcttttctgcgtacccacaatagcaaggaactcttttgtttgcatctcctctgaaagaaatgcttgttttgaggtttggaccgcaaataataatctattgttccctgtaataataatccaccctctttcgcagaaaaaaaaatctgcttgatgcagtatggctatcagtttatttaaaagaatagccaaaagtgcccattatgtcctgagaataaacatttgcaagatggttgggaggaatgggggagtactcttgttctccttggctgagagtcagttaagtcttcaaggagaaaaaattctgaaaatgaccatcagtcctggctgacaatactcttccttattctgcccgtctgttacattctaagaattattgcaacactgcagatatttattccaaacgatttctttaaaaaatatggaagatgggtatttttaagttaccaattttgggccaaataagttttttttttctgactttcattttgtctgtgaaagcatttcttttatagcagtatgttcaaattagcaatctttaagaatttggcaaatacttttaacagcaatccttaacaattcctgcagttgcctactattgcagatcttgaaaaaagagccatttttatattctaagtggtagacacatttcaattactatttcctgggcttaggctaactgacaaaacttgatgggtgaaatgaaaatgtgatatacggtgtaatcagctgtttacttacctagcacagtgaaatcttatggtaggtatgattgcactaacaaaaccaaaacatgcatttttcttccttaagttctttataagaaaaggatcagttaaataataaatgtggctttaaaatgaagttatatcttaggatagttttaattgcattacatatggatgatgagaaaagttcagtgtgataacaattgcgtaacagataagcatgagaactacttaaagaaataaaaatatgcccatcacctcattaaaaatagaccatcagggaagccaccaagaagtccttcagtaggtgaatgaataaactgtggtacatccatacaatttgtatattattcagcaataaaaagaaatgagatattatgccacaaaaagacacggaagaaagttaagtgcatattactaagtgaaagaaggcaaccttaaaaggctacatgctgtataattttaactagataacattctagaaaaggcaaacctatagagacagtataaggtcagtgtttgccaggggtgtggggggaaggacggcaggaataaattggtgtagcacaggggatgcttagggagtgaaactattctgtatgatactgtaatggtggagacgtcactattcacctttgtcaaaatccataagatctacaacactaacacaaatcctaatgtaaactatggactgtggttaacaatgatgtaaccatattggctcatcaattaaaacaaacgtataacactaatgccagatgttaataataggagaaacaggttggccatgggagagtgagggaatatgagaattctaccttctattcaatgtttctgtaaacctgaaactgctctttaaaaagtctattagtttaaaaaaaaaattcaatataaccagactaataaaaatatcttaactaaaaagcaatacaaacctaaactgtcagcaattattctgtttatagtgctattctgattgaacttagctgtagaatattctgccagaaatatgtaatggcagtgaattactgtatatatctagtaactttgctgtatcttttcttgtctggcaaaaatgcacagtggtattcatgttaagtcctactttcaactacccttattcctttctcttcagtgacagctggagtatcagccttggaagtatatacgccaaaagaaatcttcgtggcaaatggtacacaagggaagctgacctgcaagttcaagtctactagtacgactggcgggttgacctcagtctcctggagcttccagccagagggggccgacactactgtgtcggtaagaatgcttgacttctcttggctagtcctgcctcacaggtttctttactgctgtataattggtgatccatttttctgatggttcatttccaaaatgagtgtattttttatctgttatagacttcaaggcccttcttttgcttcaggataaaataagttcagcatctcttaaatgcgtctggtttccttgtctttgatcagttcctctccaccatcaaatcccattctgaaattgatcttaattgaccacactgactctaatcaggatttatcctgcatcttttcatcttttattgccccatatttattgatatttgttttatgtattatcaaattttatatatatatgtatgcatcttctgatttgattatctttttttaatttagcgtatagtccatctgatttagcaatattgatttgggagcttactatgtagtgggttatgtagggccttcaaaaatgtctaaaacagaatccttgctctcacctagagatgattaggaggaaggctgatatatagatgactttggagtaagataaaggatgtaacagaaatacagcaccagagcattgaaaaaaggttatttagtaactagtggagtgctggttattaaacatgaactgactatcttggttctggtctgtaaaatggagacgataaaacctcccacacaagggtgttaggaggataaagtaagattattcaagataagtgctcaggagagtgtctagctcttgagttactaaaatacaccatttgttgttactgttgctctcccagcatgtggaatgcccttcatatattggcacatattttagtactgttgcatgtttcaggttgtcagtgtttagcaaggacagtctgtcatctatctttaagaatgcccaattcttcttctgaatggtgagttacattgttgatcaccacctagatgttgggcccatcatatgcctatgccatttaatcttcacagctctatgaggaagacagggtggggaggatgggagacactgactcaagagttattcacctgtggccataccacacaggttagaattgtttaaacttcaatacggtatgatttcccttatgtattatttctctctcaggtagaaaaatctgctaataatatttacggcctcataggttttagggattacctaaggcagtgcttctcagtattttttaaaatttatttttaaaaggagccttttcacatttttcttaatctctgcccccttccatgaaattttaatattgtagatatcctctgcaactgttttacatataaaagagaaagattttctcaaagcttcccacccaagagccagtgtttgctcccttgggggagaatctcccctatggagaatgcatagtctagaggtctttataagagaggccttcccttacagtagccataagggtgagcacaggaatccatacagataccatggaaagacataaagaggcattctctgcttcacgtaaatatggcatcagcatagaacatacactaatgttcccatagaggcaagattaaacacataagtttactcaagagagtccaaagaactatttaaacatttaaagatttcccactgaagtcttctgcaagagtgggtgtgagagccacccagaggtaataactttcttttaaagagcggttccatttatgctggaaacagtcttgtcgtgtaggtccatgaaggtttacataactcaaaacttaatattaagaacatgctgtaattctgattaatatttttagctaatcaatttatacttacacacgagtctgattgcagttaatcccagcatgttcagttattgacataggatcctttaattccaaaatgtcgggacacatttaataagatgagtgggttgcttttttgtttttataggttttacaggaaaagtatattcaaacccagtatattcaaaagccatactgtggatggcttttttggcccatggccttgggatccacatgtctgaaactgaactcattttttctcccttctgtttcccttttctgctttttttttttttttttttttttttaggttaattgtgttcatctgcagatgagttttgtaatcattttgttttgttttgttttgttttgttttgttttgttttgtgttttctgtcctttccttccctgtcccttaccacttcccttctgcccccaagaaataagaacctttgctggttcttcctactttgtttctggtgtctagctttttgtcagccttcctgtgtctctgctgtctattgagcaatgttaactgtgtgcctggtcttgtgcagtagccccttgttattcttctgcttctgtttttctcatctttcaatccaaccctcatatgccagcaggtgcatagtcttagaacagctctttcaccttgccactgcaggttatcaggaacctagattcccattgtggacaacatttgtctagaattaaaagctcattacaatttggcccagcctaccactttagcctcacttctgttctcttatggcatcacttccagtttagtaaaaatgctttgtgctttgttttcctacttctgaacacttgtcatttaagctgtaccccatttttaccctctgtctcctccataatgcctctttttttttttttaaccttttagcccttaaaactcactacccttatctgggccattcctataatacagatcccttaatatgacagttttcctcttcttcctgaatatgggtgttttaagaggacttgcctgtcttacatctttagtatacctcatagctttagcaccatggcttgtactttaaaaatattgattgataatgattctagtcttttctgtgaatttttcactgttttatttccatctctcactggtttgaccaagacgttattcctcagtttgattcagcaaactatgtagttcctgctgtgtccaaagtgctaaggagtacagagataaatacatcttatcctctgccttcaaatggcccccattcaatgagggagcctgactgagggagctgtctcagacccagtgctgagaaacagcatcatgtagctcatccccgctggttcagaaatgcaaggcagggaatatgtggagatgttgtgggaagggaaggcagagagcaggtgatggaaggattcatttgcaaagctgagagtttatggttcattttctagtgaagaagagagagtgaagaactttgaacagataagacatgatctcacctgagaggccttaaacattggaaatagcataagctttgaaatcagagctgagtttgaattccatctctaaaacctgtgactttgggaaagtcaccaaggtttcctgagcctcacattccctatttatgaaatatcaggtaggcgaatctcaccttgcagggtggttgtgagggctagagagttgttgggagacagttttctatgggtctttcacgtttttgcacaccttgctagcaaaggcactggctgcctttgttctggactttttttatacagtaactagctttggaaggcagagatgatgttaccctctggagcaaaggacaaatttgtgtattcttgagtatagtaaaggtagtgtctcctttcagggctgaagtcagacatgtcttctgccccttgtaagagaatagtgttccctgagcttggggttcctcggctgtgatgcaacgcctctgcctgcacaacatccatgtgagcccctccatgtcatggctatgggacttgcggggcaagagaaacaaacacatgctttctgctcataaggttctttgtttctgagtcttcttcatgggagtgaagatttcacaggagtccgtgtcttctgtcagcacctatgaacctgtggccaactaactttgttagcttgtaagtagggtaaaatctcagacccttcacggttcttaacaagcatttaggtcatatgaaatgcagggtaaatatttgataaatgttataataataaccattattctttatcagtgatcatttaggcattgtggaagatgatgagttagacataccagttaagaggccatagtccaagatgatgaaaacataaaaacagatattgtcagtgggaaccgaatagagagaagagagaactgagagaaactaatgagacattgacaatattgggggattaactggataggaagaaagagaatcaaggatgacttcaagatttatggttttggaaagaaacagtagccatcagtgaagacacgatacatgaagaggggaagatgaagtttgtaagagagggtgacaagcttgggggagaggggcagccaggtggtaaagtgagtaggcaaggagtctagagcttaggggacgctattgatggagagagaggtttgggagttaagaaaatctagatgatcattaaatcataggaatggatgagtctgcactggggttttcaccgtgctcaaagggttctgaaaatgttctgtttgaattgctaatagagctggtttctatccccagctccaccatcaccccgtccattaaccagaacaaagacatcaggcctccagcatagctgcttggattagagccaagtgtgaggatagatcccctcccactgggccttaaccctgcttccaggtgctgagtttgacaaggtttactttgagaagacagttcctttgctgaaagcaggactgaggagagactgaggagtggaaagagaaaggggctaaaggctgaactttcaaaagccggcaagagtatcttgtgttatctgggctttgttcctttcacacacccatgacttttccataggaaaccagaaggaagagggcgaaactcagattagctgatctgagatatttaggattcttctcctttgtgcttctgtgtatcttagtggtaagctaactcaacactaagctttctgaagccttgggaatcactgggctcaatcatggtgttactggaagaacattggctttgaagactcagatgggcctaaattttactctgggtccccaatttactatcattggtaccttgggaaaatggcttctcttaagtctccattttgtcttttataaaattatgggtggtaataattatatcaatgaaatattgagaggattagaggtgatatatgagtctgattcttccattgaaacctggcagggttgagtgccgtgatctctaaacttctgtctggcttagattccataacttgtgatttgtaatatgatgttgcatttctttttttttttttttttaattgatcattcttgggtgtttctcggagagggggatgtggcagggtcataggataatagtggagagaaggtcaacacgtgaacaaaggtctctggttttcctaggcagaggtccctgcggccttccgcagtgtttgtgtccctgggtacttgagattagggagtggtgatgactcttaacgagtatgctgccttcaagcatctgtttaacaaagcacatcttgcaccgcccttaatccatttcaccctgagttgacacagcacatgtttcagagagcatggggttgggggtaaggtttatagattaacagcatcccaaggcagaagaatttttcttagtacagaacaaaatggagtctcctatgtctacttctttctacacagacacagtaacaatctgatctctctttcttttccccacatttcccccttttctttttgacaaaaccgccatcgtcatcatggcccgttctcaatggtcgctgtctcttcggagctgttgggtacacgtgcagaaaggctgtcacttcacacttggaagattgcacagcggccaggcagaggcgctcctcacttcccagacggggtggtggccgggcagaggcgctcctcacttcccagacagggtggccgggcagaggggctcctcacatcccagaggatgggcggccaggcagagacgctcctcacttcctagatggggtggcagctgggcagaggctgtaatcttagtactttgggagaccaaggcaggtggctgggaggtggaggttgcagcgagccgagatcacaccactgcactccagcctgggcagcattgagcattgagtgagcaagactccatctgcaaacccagcaccttgggaggctgaggcaggcagaacactccaggtcaggagctggaggccagcccggtcaacacggcaaaacccctctccaccaaaaatacaaaaaccagtcaggcgtggccgcacgtgcctgcaatcccaggcagtcggcagcccgaggcaggagaatcacaggagcccgaggcagggaggttgcagcgagccaagatcacggcagtacagtccagcctcagcaacagagggagaccgaaaaaaggaggagagagagggggagagggagagggagagagatgttgcatttctttccgtatgaagtctttaaaagaacctttcatagcatgcacattacagagtttaggaattctgcctttgagaatagttcatgtgttccttttttctaattgcagtttttccactactcccaagggcaagtgtaccttgggaattatccaccatttaaagacagaatcagctgggctggagaccttgacaagaaagatgcatcaatcaacatagaaaatatgcagtttatacacaatggcacctatatctgtgatgtcaaaaaccctcctgacatcgttgtccagcctggacacattaggctctatgtcgtagaaaaaggtacttccttgagtattttggcagtaataatgcagtctcctttatctcatgtttggttggaaaacatgagttgcatttcatggtgggtttggagggaggatttttgccatacagttgtgctccctgttgccacgaacctgtggctctaccaaacacacttggagctgggaaacttgttgctcattctgacccagagtggctgatttctccatttttattcctaccgtctggtgcctattggtctaatttcaggagtatgaatttttcagtgttaattagaagaaagaccaaattcattatgtttggatgtgatgggcagtgggaaagaaggagattcatactgttttatattctccaggagaaagctttcaacaacagcacagttatttcttccttttgattttgagaacaaacaggaaatgcaggttctggtgtctcatttttgagacaaagtctgttttgttggagagtagatccaggtaaattcacacctccggtttttctttagagcactgagagggattgtaggtgtagaaatgcttagttccatagttcattctttctcatctaatattcacatgtcatgaattacatagtaataggatagatagtaggatctcatagtttggataataaaagagggtacggtaactgctaaatgaagatacttgctcgttaatttaataaaattccatgttttctctctgtagcaatgtaccttaaaactattttgttctttctctctagagaatttgcctgtgtttccagtttgggtagtggtgggcatagttactgctgtggtcctaggtctcactctgctcatcagcatgattctggctgtcctctatagaaggaaaaactctaaacgggattacactgggtaagaaacactgtttttttagggcaggggtggagggagggaatcagggtttatagaaacttctgtatttaatgaaaaaaggattttaaagaattaactactattttctttcatgtcagaatcaggcagtctccttaggaggtgttctaacatgggcaagtggaaatcagtgggcctgctattaaatgtggaatatgattctaatctctgttccagtttccttcttaggtttggtgagatgagctgctcagcagtctgtgctctgtgtttcaataccatccactatgcaattagtattcttaagacatcacttacccaatttaagagtttaatttcaatttcttgctaataaactcacaaggtggttctttccagttaggaaatataaaaccctaattaagaagttgtgagctggaattagtggcatgtgcctgtaagtcccagctacttaggctgtggcaggaggattgcttgagccgaggcgtttgaatctagcctaggcaacatagcaagatcctgtctctttaaaaaaaaaaaaaaagaaagaaagaaagaagaagaaaaagcagtggttttaataaactacctcccccagcccagtgtgatgatggtgcagggcttttcctttttgtagttcccctaccccactccaagcttaagtagctttattgctttgatcattcttagctagattcacccaaaatgggataataagaattgatgacaaaatatatcagcaataaagaaaaatagactttctttttgtttatggcttctcagatggaacacgtttaagcatagggtgtgtatctaattaaaggaccttctcttttccccactccagctggaaagctaacccatataagctatgtagaactcatgtggtaagactgggagcagaggctggattcaagttgatatagcatgagcagtgttgcagatgcacagatctaactttagccatcctgaagggactctgatgtgaaaggattgcatgtcctgaactctcttgctggtggatggtgggaacctctatctatgggctctgctgatctagagtttttaggagtgctgtgttttaacaagtttgagtgttcaaattcagatattacttgcttggaatgcttctattctgctgactgtatctgccccccttgcatggtgagtgttttatgattaaatatagttggactattggtttcaacatgagactaatccagggtggtgacatgccggtctttgtagttcttgcttcggggttaatgaggggcaggaaagagttccttagactcctgcatggcatcatgaatgctgctgttcttcttaccttggtttttttcctcctcctctaccttttctaccttggtgtgctgggatcagatcctgcttatcttccacttcttaagaaaagctgacatagaagacacattgggactataacagggctgggtctcctcttccactcccactagacacatggtaactaatcacattgcccattactgttaatattcctgtgtatgtattcagcccctctcccttgttgatgactaaccagctagctctgagctaacccaacagctattatgatttgtccatgaatatgtcacatgtttgtattggaaacatgttgagcatactatctggatgaaattggattgtgaagttacatagagtttttatgcacatctgaatatttgtgctcttcatgtaaaatgccattgtgtatgtgtgtgtgtgcattagttttcttttttcatatatgtattatgttatcaataattaagatcctgactgattatgtattagaataattaaaccattttggttcagagcatgtagcctcccatttcacagaaggaacagtttgcagaatgcatggtatgctttggtcttagtaatgacactttaaatgtgattctccccaaactcctaagttttaaaagtatatatcaaaaggctttaagctgtactgatgacacatctcattggaaaatccctacgctgtaccccagctttcttacttcctggcattcactttccctgattcatttatgagatagtgcttgttgttaaagactactgtcaccgtgaaaaggttcagcctgtgtgacctggcattccctaatttctcattcatgacttcctgagtttttggggggatttgattgtggtattggtagggaataaaaatatggagagaacaagataagccaagacttgcctggatatatatctgtaatttaaaacatacattcagaagaggtttgcctttgattataacaaaagtgaattgccattaagctaataaaaggtaccatagagcttgttcccttaaacctttatcccaaaggagggttgatggcagggggaaaagacaaacagcaaaaggataaatgtgtattgtaactagaattccaatatgatttttgtaaactgggttgaagaggttgtaccatatttgtttctgtgcctcccccagtgatgagttcattgacttagaagaatgagtgagtgtcaggtatagaaaatagtttaaaaacatgtgatcgttttgacacccattgttatgttgtcttttgtttttatatatctgttgcttcatcttgccgtcagttgcatttctatatttttgtttctatttatttattattattattttttacatttgttcttcaaattgccaattcatcagctgcagtacatcagagagtttgtcaccagttaagcaggctcctcggaagtccccctccgacactgagggtcttgtaaagagtctgccttctggatctcaccaggtaatggctgattgcgattctgcccactgcactgttccctacagcttggtgctctgtcacttccttgggtgtggaaaagaatactgagctatgagagacagagacagagacagacagacagagacaaagagagagtgggagtgaggaattaaagggctggcctaggaagaccacaggaaaatatgtggtgaagaatctgcttgagtaaagatttccatgaaaccaccaataacataaattgtttactaaccatgtagcttccttgcctcaagcagaattaggaaatggctttgtcagtaaaagattctttaattgcccaaggaaatgaatctaatgaaggagattctttctgtattgaggtactctaagataagaaattagcaaggaaaagttggtattcttagtattgataataaaaccaaaattattttctatggattctttagaaaaaatggaaagtaagcatttatctgaataattaataggcttgatgaacaaggaatggttttggtttctacttgtagaaagtacagaagagaaacaggttttatttggaagttagcatataatctagctttgtgtgttttggctgtagtattttaattataactgtggcttggcaaaaattccatagcttagttcagtttgatttttctggggtagaaagcatgctaaagaatttggccagttatagctttgtcctaaaaaggtgttagctggtgggaatggatttaagaggaaataaagagagtaacagtgttttgtgggaaaagtacccatagtcttattccatagttgttatatgtggtgaggaaactaaggcattgtgatgttaaattactaaaagcacacacccagttagtgacagaactggggctagaacccaggtgtctagatagcatgttctctaccacagcatcaggctcattacttgttcctgttctatctgtctgtctctctctcacattacataatatatgtcagatacctcagtctactaatttgggttgtgaacaggaatatggttgtaaatgaagacatgaaagttacatacacataggcatagcatctaaaaaagcattggaacatttttattccgcccttgaagcactatggaagttgcttttttgctgaaaacaaaccagaaaaaagaaaaagaaactgtggttttcaagacagtggaacacaaattatgcagcactgtcatccccaaaagaaaggaaacagacaatgtgagccgtgttattgccccagtgtactgccttgaagcagtttccacactgcagtgtaggtggggaaaatggaaactgggcccagctgtctcactcaattgagaaggcggaaatcagaatttggggaggtcaaggaggctaagatttatgaggctgagtaccaaagaaggaaccatagagagagcgtgctaggatgagcacgagcacttcagagatttggagcggggtccccttgagtctttgtctgattacagagttgtatacacataggagaacactctctgaaaccaggggaagaactacctgaaatgcagtaggttgcacaatgcctggtgctcacacaggtgagggactagtttgtgttcctaagagccagagtagagagacttataatacacagggtattggttggggttctcaaaatggtcatacctaaatgggttaaattagtaccagaataaaggatgctatggacccaccataacaaagcttaaaaggaagcctttaaagaatcaaactaatccaaaagtaatttagttgcattttacaacaaaatccaacacgctttatgctacaacaaaattcagcacccaacaatgtacaatttacaatgtctggcaccaatcaaaaactaccaggcatggcctggtgcggtggctcacgcctgtaatcccagcacttagggaggccaaggcgggtggatcacgaggtcaggagttcgagaccaacttgaccaacatggtgaaaccctatctctactaaaaatacaaaaattagccaggtgtggtggtgcacacctgtaatcccagctactcaggaggctgaggcaggagaatcacttgaacctgggaggcagaggttgcagtaagccgagatcacaccactggcactccagcctgggtgacagagtgagactccatctcaaaaaaaaaaaaacaactatcaggcataaaaagaaaccaaaaaataaaacacataagccagatatagtggtgtgtacctgtagtcccagctacttgaaaggctaaagtgggaggattgcttgagcccaagagtgtaagaccagcctgggcaatatagtgagaccctatctcaaataaatagatgggtggaaagaaggaaggaaggatggatggatggatggatggatggatggatggatggatggatggatagatttaaaaaaataataatttaataattaattacaataaaaaatcaggagaaatcaatcagaaacaaattcagaatggatggaaatgatgggattcataaacaaagaccttaaaatgagtattatcaatcttattagtaaacttaaagatgtaaaggaaagcttgaacccaatgaggaaagaaatagatatctaaaacagaccaaaatggaacttctggaaataaaaaaaaattggatggtgttaacaacagattagacactgcaaaaaaaaaaggtcaatcaacttgaagacatagcaatagaaactatccaaaatgaagctcaaagagaaagacagatggcagggtgaaagtgaacagagcctaacacggtgaaaacccatctctactaaaaatacaaaaaattagttgggcatggtggcacgtgcctgtagtcccagttactcaggaggctgaggcaagaaaatcacttgaacctgggaggcagaggttgcagtgagctgagatcatgccactgtactccagcctgggcaacagagcgagactctgtctcaaaaaagaaaaaaagaaaaaaaagaaagtgaacagagcttcagtgagccaccggacaatatcaagcaatctaattagaatccgagaagaaaaagggagagaaaaaaatatgtaaagaaatagtgaaatttttagtaaatttaatgaaaaacataaacacacagaaagcaatagcgaaaattgctgggcgcagtgactcaacgcctgtaatcctagcactttgggaggctgaggtgggtggatcacctgaggtcaggagttcgaaaccagcctggccaacgtggcaaaaccccatctctcctaaaaatacaaagattagttgggcatggtggcaggcgcctgtaatcccagctacttgggaggccaagacaggagaattgcttaaaccacagaagcggacattgcagtgagccaagatcgcgccactgcactccagcctgggcaacagagtgagactccatctcaaaaaaaaaaaaattgactctttacagcaaaaataatgacagcattttatgaggctataacatgtggaagtaaaatgtatgacaacagtagtacaaaggatggggtggaaggatggaagaatactgttgtaaggtccttatattatccatgaaattataatttgaaggtagactgtggtaagttaaagatatatgctgcaaattctagagcaaacactgaaaaaaataaaagagatagatacagctaacaagctctatctccgaatggcaatactgataagaacaaaattctgacatatgctacaacatggaaaatggtaaatgcggatggtaataatatcaacgttggcatcagaacaagaaatagaaccagagatagagggactttttatgatgataaagcgatctacttacaaagaagacatagtcctaaatgtttatacttgtaatagtagagcttgaaaataagtaaaactgagagaattggaaggaaaaattgacgtatttacaatcatagttggaggtttcaacaagaaactttaatgtaatcatttcaaaatactcagttaatccaaaagtgagcaggaaaggaggggaaaatgagcaaagggtagatggggcaaatagaacacaaataatgaagtggtagatttaaactcaaccagactgatgattgtattactataaatgggctgagtgtgccaataaaaggtggagatggacaaattggatagaaaagcaagaaccaatcatatgctgtctgcaataaaccactttaaatgaaaagatccaggtaggttaaaaatattaatacaaggatgaaattgaaagcagagtcttgaagagatatttgtacatccatgttcatagcagtattattcacaagagccaaaatacagaagcaacccaagagtccatcagtatacaagtggataaatagaatgtggtatatatatacacaatggaatattattctgtctttaaaaggaaagaaattctgacacatgctacaacatggatgaatcttgaagatatgccaagtgaaataagccagccacagaaagacatactatgtgattctactaatatcccataccctacagtggtccagttcatagagacagaaagtagagtggtagttgttggggaaggaagaatagggagttgtttaattggtacagtttcagtttttgcaggatgaaaatatcgtagagattggttgcacaaggatgtaaatgcacttaacactactaagctgtacactttaaaatggtaaagatgctaatttttatgttatatatattttaccacattttttaaacagtaaaaggatggaaatgatatgctacattaacactaatcaagagaaatctgggtggtaataatatcagaataggcttcagaacaagaaatagaaccagggataaagacagactttttatgatgacaaagtgatctactcatgaagaagacataatcctaaatatttatacttctaataatagagcttgaaagtaagtgaagtaaaactaagagaattgaaaggagaaattgacatattcacaatcatagttggaggtttcaacactcctttctcagcagttggtagaacaggtttacagaaaatcaaaaaagatgcggaagacttaacagtgaaaccagtttgagctaatagacatttataaaacactccttccatcaagagcagaattcttactctttttaagtacacatgaaaattaaccaaatatagaccatattctggttcataaaacaattctcattaaatttaaaagggttggaatcatatagagtacgttctctggccacaatggaattaaacagaaatcaacagaaagatacctggaaagtctcaaatatttcaaaattgaacaacccatgagtaaaacaagaagtcacaagaaaaattagaaaatattttgaactgagtgaaaataacatatcaaaatttgtgagatatagctaaagaagtgctttgaagatttgtagcattaactgtttatattagaaaaaaataaagctctaaaattgatgatctaggcttctgtctgaagaaactagaaaaagaagagcaaattaaacccaacataaacagatagaattaataaagagaagagctgtggaaaaatcagctgacattctcattgtttccctgtaggtaatctgtcgcttctctctggctgcttttcggatcttctttatgcctttggtgtttggcattttatatactatttaattatagattatcccttgttgcatctgcttgtaatttcattggacctcctgagtcttaaggttgatgtctttaataaattctaaaaaatttctagtcacaatctctttgaatttttcctttctgcattttatctatttatctttttatggaactctgattatatgtgtattatactttctctatgctctaaatctcttaacctctcttgcagatctttcattgtattgtctttctgccattttctgcataatttcttcatctgccttcattcactaattccttagctgtgactagtctactgtttagccccttttaaaagtttttaaacttcaatttcatattacaggtttattttctagaaattttatttggttcttttttaaatatacctggctaattttgatagttccttataacttcatattttcaactatcttatttaagcatgttaaatattcttattttatacctcaaaactgataattccagtgtctgtagtctttattgatctgactacggtttttgtttctatatttcttgctaatggtggctattttctcatctcatgggtgttttataatttgaagactgtacttacgttcttggcactttgtacaaattgattgagtcttcatttaaaatatatttactcatgagaagatttgtatttcttctgcctgtgtcttggatactaccaacccagtgagaagaaatgcacaggaggtaaaaaaattttgagaacttgaatggtagactataatggccccacaaagaggtccacattctaatctctggattctttaggatatgttaccttacgtatcaaaaaggacttggcagatgtgattaaattgccttgagatagggagattgtcttgggttatctgggtggctccattgtaaccataaaggtccttagaagagggaggcagaagggtaagcatcggggagagactggaagatgctatactgctgactttaaagatgaagaactcatagccaagaaatacaggcagcttccagaagctggaaaaagcaaggagacagattctctcctagaacctgtggaaggcacgcagtcctattgacaccttgatcttagcacagtgaaacacatttcagacttctgacctgtaaaactgtgagataattaatatgtttttaacacctttaaaattgtctttattctcctccctcaaacttgattgcgaatctggtggggtaggattcccagttggaaatcattttccttcagcattttgagtcattgctgattgttctggcttccagcattgtggcttagaagctgatgccattctgattcactcttagggcagaggaaggtagggtcatctacctgagcaaagggagagtaaagaccagaaccaaactggggctcttccagccaagtggagtgggaggctgggttgggaaggtgttagataggcactacctagagtttagagtgttaaggcactgtggaaaaaaataagaaaattttttttctttgtgaagcttagttttgaatgagattggtataaagtaatttttgtatatgtatttgaggagtagttggttttctagatccttttctggatatcgttgatgctctgtatgcaaaaggtaggtttttgggttatgttgttaaacagtgattgaatggaatatttatgtatttgtcaactatagtgcatagcatagatagggtaatgtttcaagaagtagttatgtgcgtttttcctttagtcctcacaacagtcctccagggtaagttcttctgttgtctctattttacacatgaagaaactgaggcttagttaggcaagtcacttgctcaaggtcagtagttagtggctgagccagatctgtctggttctaaggcacatgtatattttatcctgtccaatttttttcacctctgctttgataatcagtatttgtctcatttatctcagagaaagtcataatacatagctgtgtttcatatttatattttacttaaaaaacagtggaataaatactaaaaaaaaaggtgttctgtcagtagtcaatgagcacatggtaaaaatagatgttctttcttagtgattcgtgctaggcttttggggatgactcctctaacacctgaaggactagaatcaaattaaatagggctacaggctacagagactgtgaaaggtgtactacaggacacaacataatgactcctgagcagttaatttgtagttagaagcaggtctctttgcttttctagaatcctttcttcctggaccttctcccccaaccttcaccagttatggtttttttattggaataaataattaattttggtacaagtaaacttcagaggtaattttatctctagttgtaactaaaataataggcctatattaagcaatgtgtttcttgaaacattttcaatagctaaggcctattcatgcagaaagtagctgaaaacatactcagaccaatttttcactttattgttgtaattctttgtgtaaaagcaaagataaataaataaatgaaatggagggtggggagggtgagtaccaagagatagagtaaaacagctaggttaatgtaggttttgttgttgttttccttctttattatacccaaaagtgaatgtcttaacaatggtaggttcatttcaaagttgatcgtggttctgtggatcctcttgaagtcctgagcagcctcatttgccctcaaaatcgaggtgctgaggcatgttccatagagactcagggctccttccacctctaaatagcactcagaatcaaacttcatagaggtgttctagattgagctagatctgtcagcagaccccaatctcaacctacatctgcagtttctctgcatcctttctttcatccatcccttcatccagcacctgtgttctgccaagttctaggaagttaacaaagtccctgacttaagaccttattatattctaagggggaagaggaatgaggataacatcaggcagtggtaaacagtttgaagaataccaagtccatcagcaggaagggatttcttcagtgttttcccatttactttcatgagatagttgtattcttttgacatgaaagacagtactgtctcacatgaaagacctcattgatattttaacatttacagactaaaagataattctgtgttctttttcctctttactttctctgttctcattcttttctactcacataatatatcaattatctactgctacgtaacaaaccccccaaaatatagtggcttaaaacacgcactatttatttggctccccattctgtggattggtcgagcagattctggtctggatgagctcagctgatctctgctggctcacttgtgcatctgcagttggctagaaggttgactggtagctggacagtctacagtggtctcacttacagtctaaccattggcaggctgttggccaggcagacagaggacagctgggccatgcatctctcatcagccatcaggctgactttggcttcttcacatggtagtggtggctgtgtgggtcccaagatcagtgagagtggaagtggcaaggtctgttgaggtctgggtgtggaaactgcacagcatcactgctgcctcattctgttagtcagagctgatcacaagatcagcccagattcaaggggtagagaaacagatttctactcttgattggaaggacctacagcattatgttgcaaagagtaagatgcagagaaggaaagagtttgtagccatttgtgcagtcagtcacacattgtaaaccccttctcccatgaacataccctaaaactcttagtgagtttttaggaattatgatatggggttttattatctaagaatttatataatttaatgttgggagttccgtcctattcttggaaatagctgttaccagggaacagttagtttaattctgttcctagtagaaaacagtcttttttttgtttttttgagacggagtctcgctttgtcacccgggctgaagtgcagtggcgctatcttggctcactgtaagctccgcctcctgggttcacaccattctcctgcctcagcctcctgagtagctgggactccaggcgcccaccaccatgcccggcgaatttttttgtatttttagtagagacggggtttcaccgtgttagcaaggatggtctcgatctcctgacctcatgatccgcccgcctcggcctcccaaagtgctgggattacaggcgtgagccaccacacccggccgaaaacagtctttttaacttccttttgttttttggtggggttagcatttaacttgtagctttctgagatgaatatagagggtctgtatgattattaaccatgtgatctgttaatatttcctatgacagccattatagactaaagataaacacacagagtttgactatttaatttacttgaccagttacctcagtgcattttaaagtatgtttgtgtaacaagacgttcataataataactaacatgtattaagtactgtctgtgagacactgcctaagttataggtatcatcttatttaattttcataacaacaaaaaacaaaaatgtagatattattagtagtaccattttagagatgaagaaacttgtgcttagaaatttacaaatgtgcccagggccacgtgaccagtgctcttctctaaggttcaacaaagacgatatcataattcagactgcagatctgccaacattcaaatggctctagtcctcgagtgttattttctaactccgcttttagatgcaccattgtatagcccttacaactgggcctgtcccttctgtagatgtgggagtagctgaactccacagaaccccaggttacacactaaggacacaggttgttagggctcctggatgagggtaagtgtgtttattttaaaccacgtgcttttggctattgagcttatgatttcaaaggtgaaagcttaagcacgttattagacttctcaaggagagttcccctagattgggagaaaagttgacattgggtaatattaaatctttcttttaaaaccagggctattttgttgttgtttacaattttaagagtctagactgaaagagtcatgaaatgcagccacctatctgacctcttcccccaacagttagggaattcgctctgcccccaggccacccaaccttcccttgctctcctgaatgggaccctgacaattccctggaattgtaacctcttccttactgctgaggctgagaagaggatcttttctactttactccatttagggtttttctttatatctgtgtagattgtggctttttgttttttctttttaattttattttaaaacaggaagaacagttatctgatattaaaaatcaaggaagcaatatttgtattggtcacaatacgctcagactaaaagaattatgctgtaagtagttgtattgaagaatatttgaagtgcttttaaactatttgtttaaaactatacctatttgtataacgtgaccagatcaaattgattgtatctttgggtggcaccaaatatgttggtttcttgcatggattgattattctgaagctcatgatttctgtgggtctcaggtgcgtggaagttcccatcttagtccttaagactcttaccccaattgtaagagctgaggaattctgtgatagctattaagataagagatattcctaagaaggaatatattattacagaaattttcaaacatcaaaaaggtttgaaagaataatgtaacaaagccccatgtacttgctttaactattgtcaacgtatgtccaatcttgtttcaaagtcagtcctggatgtatcatccataagaagtcttcctgaagacattcaagagggaagtctttgctttggaaccctgatgtgatcacgttaatcattgcttctatgcctgtagctgaaggaaccgccagcgttttcagtcctctaatccttctgcttcccttttccagggcccagtcatatatgcacagttagaccactccggcggacatcacagtgacaagattaacaagtcagagtctgtggtgtatgcggatatccgaaagaattaagagaatacctagaacatatcctcagcaagaaacaaaaccaaactggactctcgtgcagaaaatgtagcccattaccacatgtagccttggagacccaggcaaggacaagtacacgtgtactcacagagggagagaaagatgtgtacaaaggatatgtataaatattctatttagtcatcctgatatgaggagccagtgttgcatgatgaaaagatggtatgattctacatatgtacccattgtcttgctgtttttgtactttcttttcaggtcatttacaattgggagatttcagaaacattcctttcaccatcatttagaaatggtttgccttaatggagacaatagcagatcctgtagtatttccagtagacatggccttttaatctaagggcttaagactgattagtcttagcatttactgtagttggaggatggagatgctatgatggaagcatacccagggtggcctttagcacagtatcagtaccatttatttgtctgccgcttttaaaaaatacccattggctatgccacttgaaaacaatttgagaagtttttttgaagtttttctcactaaaatatggggcaattgttagccttacatgttgtgtagacttactttaagtttgcacccttgaaatgtgtcatatcaatttctggattcataatagcaagattagcaaaggataaatgccgaaggtcacttcattctggacacagttggatcaatactgattaagtagaaaatccaagctttgcttgagaacttttgtaacgtggagagtaaaaagtatcggttttattctttgctgatgtcctttctgcttgaaataacagtcaccatacagctaaaggagaggagtttctttccttctaagtaggcagaaatggtatcattatgttgccgctctccaatctcccagagctcgctctctagagaatcaccttctttcgctttttttttttttttgaggtagagtctcactatgttgcccagactagccttgaactcttgggctcaagtgattctccctcctcagcctcccgagtagctggaacgaactatagttgcaccactgcagctggcaagaatcaccttctttataaagcgtcagtcatgcttccagcaagaggcagcatcagtcatggctttataacagcttcatggtgcctcaaagactgttgaggttaatgagagcctagattagacagtttggctgtccttccctaaaacttgttttctcctattcactactccccaccgcacttaaaatctatgagtttttactttttactgggaatggaaagtgtggtgaagatcattcaacacttatgttgtcatttctcccattttctgaatttttttttaaatttccccccttttaaaattgttcgaaagcccacagttatggaaagaattactgtctagatggtctgcagaacgtgtttggggtgagtgggagtgaggggcaatgttactttttctccctgtagtttggagtccattatgagctgctgctttttcttctcgtcatcttctggggatgtttgaaggctgagttccaacagaattcacaaagggaataaaacaggattgagattttgaggtgtgcacaaggtggtaagataaagggcatatgagcttcaaaactaatgctgttgcatacatgaagccttttgttttttgaggagctatttttgttattcttgtaacgctccaccttacatgccacgtctgtgtgagtcaacagggatcaggtttggtcaccacacatgtctgaagctgggcagcgtctgctctgtgttctgtgtggaatggagaaaaaaacggctgccctgctgccttccatgttcataggcccagcccaagagagtgacacacagtgctggccctgagacatttccacaaagtggtcaactctgccttgcatcctaaaactttttgggcatctattttgaaaactataggagcctttggaaggcctcttatgtttggaggggaagggtgttgagattgtcaccatccttcaagctgagactcctggtgagcctttgccaccatgaaaaccacatagctgaccagggctgtgcttgaggtacagaggacacacattgtagacaggcctgtgtcatgtttccttacagtcgttttttacagagaaaaggggcattgtttt

SEQ ID NO: 16846 - DNA, 37388 bp, Human
tagacttctaaagtgtatctagaacctgtacacttcattttttggccactgccactaccctaggctaagccatcaccagctcttgcctgaattgctgtcatagcctctaatttgttctttacttcagctcttgccctttcctagtctattcttcacaaatcgattagattttttgcaaacacaaagccaatcatgctgttttcctacttaatactctccaattgtttcctatctcatgctgaagaacattcaaattcttcatcatgacttctaaggcctcatggtctggcctggccctctctcaaagaacatctcattctgctctctttaccaccacattctggtcacactggcctccctggagatttctacctggctcaagccatgcttctcacatgtaattcttctgcttggcactctgccaactcttccccgactacatctttgctgagcttttggtctcatctgaaatgtctcctcctcaaagaagctgttctatacaactccatctaactggagttccctaccctgctgtgcacaaatttttcttgatcacttcacccttttaagtagccttcatagacttatcactattgataattacttagttgttgtttactttatatcatttattttctccatcatattgttaattctgtaaaggcgcaggccatttctgtttgttccttgctgtatgtgatgcttcataggtatgtagcataggagatcctgaatacattttctgtcatccttaccctgactttatcttacctttttgggtttgttttccttatgttcttgttttcttactttgtattgaaatgagagaaaaactcacaacccccaggctctactcaaggttgggggccagaggaggtagagcttcctctgctcctgtctcttccacccgccatccactcactcgccattagtactgtgtgttgtgggcaaaagaaaagctttctactagtgtttcttcccagggaatgtgggattcatcctggaatgccaaaataaggatgaattgtctaaagagaaaaccagaatgcctttctggaccaaagattgaaattgctctgcctaataatgtaaacagtttattttcactgactgggggcagagtgttccttagcgagattaatatgatactagctgcttttttgtcttcctctggcaaaggctagagataacaaaaattggggttctagactctagggaggaaggacaacattcacagctccatttgtaggaggtgaggagggcccttgagaaaagtggggtgtgagcgagtataggacattcaggagagagatgatcagtaggggacaccctgggagaaagagattctgagctcttttcttttctccggagccctgacccttgagcagtggcacacagagtgtcttcctttattctctggtacagtagtcatgtttcttggcacagtgccttggaccttccatacatgctttcttccctccagagccttcgtctaagatgctggagagtagcttatagcctgggcatcaagtttgtcgattctccccaggacccttttctttataggtgccacatgtcatgatttatgcacaaacatgatttgcctgacagtgcagtctgggcctggaataattttaattaatgggaaaatggtcctcaatacaccgattagacctcttcaggtacaacaagataaaagcctgataatttggatggagtactcttcttaaatatctactctgtgcacggcagccaatgggaaagccaggctctctcccacctgatccaatgagtaattaagagagggctttttcttccctacctctcccctgcctccaccccgctccccaactaaagcttaacaggttggtggcataatgtggagacttttaaggggtgtcatcctaggagcttaggcaagagccagggtatcttctctccgctccccaagcactgttcaagtgggtttgaaaagcaggcaagtgagggaaggaagaagctagaagcaggcaagttgggtaacggctctcggcaaagttcgagaagtgcctatggccatgagtgagctgggcactcggaagcccagcgatggcactgtttctcatctgctcaatgtggtggagagtgagcttcaggcagggagggaaaaaggcgaccctacggagaagcaacttcagatcatcctggaggatgcacctctctggcagagattcaaggaagtcactaatgagatgattgtgaccaagaatggcaggtgagtttatctgccgccccgcgtgggctggcagggcttggcaggagagatgagaccccttgaatattgaagaggctgccgctcttcactcagaggcggcgggatctgattaaacatgcttacaggaacgactgtctccaatggctttcctccagccaacttaattaatttatctgagatcatcagaggatgaagccacctgtcttatgtgcattttaaatggagaaattctggggaaattaccataaagtggggggcatgccccattgggatgggaaaatggacttaaatgtcagaaaataatattaatttgtgactagctgcataccctatcgcagacctgagccccaactccgtccagataaggtgaaagacaactttatttggaagctggatgatctcctcctaagtatagcaaacttgccagaaatgtttggctagttgaagattggaagcaaaagggcaaatgtaaactcattgcctatcacttcatctgcttccccgtgtgtgtttgtggtgagtgttcatttgagattgtgtgtgtttgtgatgatatgaaagctgttgcagtaatagtgaatgaaaacatattattctgctttagagaaaagaagatgccttctttcttatcagtgcaacaaatttagggattaactgaaactgatctctggtggcatttctcagattctattaaacctagtctgctaaggggctgtccaggtaatattagaagatttcacttcgtagaggagacgcaaatattttgaaacaaaatctcaccgctcgcagcttggccaaactggctccaacattcagctggtgttcacatagcttttcatacacatggtcacaaaagtacaaaatgctgaaaggcattttcagtaggcttagttttggctgaactctaattatgacaccctcgagagaattctgataaaagagaagagccgaggccatctgaacttctttctgtcaggcttttgtccttgtgcaaagtgcttccgttcctgatgtctcggttttctatattttaataaagcacagtatagaaaatgaactatttcttgtcaatcttgaagagttatgaactcgagagctgttacatggcattaaaatgctttctaaaatgaaagccatacctgaattagggcatttcaagaaattgcgattataccagtagcaggaatatcaaccttgcttgatttttatattttctttctcaaaatgggttccacacttatttcatatagatttattgcttttaatattgttactgtaattatagttccttctcttgacctgtatttacacattatttttagcttctttcatagaagaaaacataaaacatagttttaatttcacagaattacaccaaattcttaattggatttagtctctgaccctttaaaaatgggcaaagatgcaactgtaaaaattttattatatctgattataggtagaacattctgcttatttttctttgtattattggatactaattacagtaatacctagccttatgctattgattgggctgtcaaattggccatttattaaagtaaaaataagtacaattaccaagtcaatatatggttcatctatttcaataaggaataaataataaaagtttctgaaaccatgataaattccaatttaataatatgttacattggaatgtacttttaccatttaagaaaagttttatcttgcctttttattgcctatgtaattttcccctatatttaaaatgtaatattcttcacatcagcccagtgtggtggtgtgctcctgttgtcccagctacgcaggaggctgaggcaaggggtccttgagcccgggatcagtctgggcaacacggtgagaccctgtctttaaaaagcaaaatgaaatccttcatctttaacgtcatttaatattagctacatgaacaatattctttgtagaaaaagtctgattgcggtgaacttggctgttcttatctatggatgtcctgctgtgtttgccgtcttcctatagatgaaatctttttcttaaattctcctaagctctcggagccctttagggtcaagattttgccaggagatagaaagtttcctttatactttgattaaagaagggaagacaagtccataagaaattgatgtacttaataatgaatgaacttggtctgaaattacccccaacctcttagtttctcagattaaaccattagtcacactttacctttgttaatatagacatctttcttgcttcatcttctttactcccttcttccttctctcttttctccctaactatttattcctctatgcctcctttctacccattctcctatgtctatagactctttgtgtctccttcaaatccttgccctccacatcaactcccgcacctggtgcaggtagatttgtggcccttccctgtggagaagaatgttcctggtatggttacccagtcctagcctttttcattcataatgtcacctgggccctttttcattgacattgtcaccttgactttttaaaaaagcatcatttggggtggtaactcctatacacttgaggtctcattgttctgcactaaaatagcaaatcttgaaatagcgtaagatgggccgatgaaagagtgaaaagactcattgtcaagtggagatctactttcacatatataaataggaagcttgcctctgacattgatcagaagctgtaaagagaaaggcttttctctgaaaaacacggaattatctccagaaactgggatcctgatgttggcctctcttctttcgttccttcctttctctctctctcttcctccttttctttctttctctcccctcccccattctactacttcatttccctttcagccttttcttcctccctctctttttaaaattgaaaactttcagttattcatagttaatagtcctttagatataacagtaataagtataatacctccttagagctcatttgagtcatctctagtgtatccagccagtattccctttcatgtccatcctttaagctggaaacttatactttagtttgcagaaagaattcatttcagacttcagaggttaataaattaaattgcttgctagcatggcagctcatgtctgtgatcccagaactttgggaggctgaagtgggaggattgcttgagcccaggagtttgaaaccagactgggcagtatagggagacttcttctctacaaaaaatttaaacaactagccaggaggcccaggtaggttgatcacttgagctcagaagttttagaacagcctgggcaacatggagaaaccctgtctctccaaaaaatacaaaaaattagctgggcatggtgacacctacctgtagtcccagctacttgggaggctgaggtgggagatcacctgaccctggggaggtcaaggttgcagtgatcacaccactgcacacgagcctgggcaacagagtgagaccgtgtctcaaaaaaaaaaaaaaaaaaaaaaaaatcaaatctcttgcttttgttttctttacttgtaacattttcacctaaggggaaaatgccatatttcttgtcatcataaaataagaggtgggaattactaagtttaaatttgccgattagtttcgatgattcaccagtgcttgatgattaaggggtattggtgcagtgccactgagttgctgttcatagtctccagtaagggcagtacaagagaggagaaaagtaaagttgcacatcaggccaatacatttccatgtccctacagcccatgggtatttttctctgaagtttaaaattacagctcaagaagatcatatgtatttatgtaatctgcctttaaccaggccaccttgcttccctaatgctgttgtttttttcccttcgtttatttatctttaattgacacctgttgctattcttatgcctgctcaccttcacataaatgtcagcatccatgcaccatgtatgtcacacacacacacacacacacacacacacacacacacccctctaaaagttctgatgagtatttgataaatagtagagttttgaggagagatggaggaaagtgtttacaagtttaactttttgaatttgcttttaactctctgctgttccctcacctgtaaaatctgcctcatctctgcccctctttcttcttgcaaacctcacttctcatagcctcctccagcagcactgacttctggagattccctgtcagtgaaataaaactggaaagctggtctcataataaaagcccaacagtttatgggcaaagcccaaccacctgtggttcttcaggtgtggttttcttgaggagtgcttatttaccctgccacattttcctctctttctctccaaggaggctttctctccagggtggattaagtgaaattatgctgttacttagggactgatttacatatttcttatccctcacactctgggtttctctatgttagctacatctaggaaaaaaatggggaaaaaaatcaccttgattggaagtgcagttaattcctgaaaataaagcctgatcacgagtggtaatcacagatcaattagttactggatccctagataatgcatccctgtcattgtgagacaaaagaggggaaagtggggtgggaggaggggaacttggcttggaggcagggtgagttccattcccagttacaagaccttaggcaagttgactgacttttatttattcctcattgccataatagggaatgtattaaaaaatgtattaaaatagggaatggattaaaaaatagtcatttctcagtttatttacgtagtgataaaaacaaaaaataattataaagttcttggcaaatgcaatactaaagaaaatagagcaattaatcattctaccatttcccagatatgtcctccttctaagagacaagacactgtgacttctttgtttttattaacagctttgtgatgatataattcacatgccatacagctcatccatttgaagtgtatagttcagtggttctcagtaattcgcagagttgtgcatccatctccacaattaattttagaacatttttattgcttcaaaaggaagccctgcgcccttagcagtcacctcctctggcaaccactaatctactttctgtttctatagagttacctatttcatatcatggacatttgatatcctgggaatcatacaatatgtggtcctttgtcaacaacttcttttacttagcgtaatgtggtcaaggttcatcaatgttgtagcatgtatcagcacttcatcttttttattgacaaatactccattgtatggatataacacattttatttatccttcatcagttcatggacatttgcatttttctacattttagctattatgcataatgttgctatgtacctctgtgtacaaatgtttgcatggagctatgttttcatttttcttgtgtatatacctaggagtggaattgctggattattgagaaactgtatatttaaccaagtgaggaactgccagagtattttccaaagtggctgcatcattttacatccctgccagcaatgtatgaggattccaatttctctacatcttcaccaatgctttttattgtctgcttttcatattgcagccatcctagtggccatgaagtggcatctcactgtggtttggattttgcatttctctgatggctgatgaggttaagcatcttttgattgatcatggcttctttgaaacatcaggtacagctctgaccatagcatgaaagatggaaagccattacacattttcttattctggaacgaaaagtcatgctacactctttatgagacctcacataatatagttgagagagttaagaggagggcactctaacctattagcagtgaggataataattggaattttccccttactttgcctcagccactttggtcttctcttttagtttctgaatagagtggggctatttaaatctaagggccattgtacttgctatttcctttgcctctaagtgcacctcctctaacattttgcatgagtcattccttctcattatttaggtcttagctcaaatgtcacttcctgttcagatatggctaaagtagcttctcatcctttagtctccttctgtgacatcatgcattttagttccttcatgtcactcttgcaatttgaaatgattttttttttaatagagatggggtctcgctaaattgaccagactggtctcaaactctaggcctcaagtgatcctcccatcttggcctctcaaagtgctgggattattggcatgagccaccacacccagccccaaatgatcttacatgttaagaaacaacaaagatttattgacatgtttgttgcctgacttctttgttagaatgtaagcttcatgaacaagaagatactgggtctgcaatttttgtcattgaattcccacctagaacagttcctgggatagagcaggcactaaaaaaccatttgtcaaatgggcaaataaatctctaagtaggtattaagatttgggaaaactttgagggggacttttcctttcactgtggctcaaccatgttagctttgagaagctaataagaaaggaaaagagagtaaaaaaaaaaaaaaggagtagtgaatgaaatgtaatgtgtgctttctgagtcccagtttcctcatctataaaattggcataataacctccttgtgggtgaagtaagacttaagttgtatttcacttaagtgaaatattcacctacgcaaagtcctaggtgcagagtaaaactcagtacagccatcccttggcatccgcagaggattgtttccaggcccctgcaaatatcaaaatctgaggatgctgaagttccttatataaaatggactagaatattttgcatataacctatgcacatcctcccatatacttaagttatttctggattatttacaatacgtaatacaatgttaatgctatgtaaatagttatgccatattttttttttgtattattttttattgttgtattatttcttttcaaatttttcaatttgcatttggttgaatctacagatgcagaccctgggaatgtggaggcctgactgtacatgataactattatcattagaaaaacaatcttgcggttaggcactgtggcttgcacctgtagtcccagcactttgggaggctgaggtaggagttgagcccaggaatttgaaagcagcctgggcaacacagtcacacacctttaaataaaaataaaacaaacaaaagtgtctcgccttaagtcatttcttaaatcataagtcagaactttatgaaacatcctgacatttcttatcatgaagacaccagccatgctctcatgcttgaacaattgcatcattactctggcaatttagtgcatgagtaatatattatatgttttatgagtttttgttcttacttttatgtgtactatatagtcttattgagaaaagttttggtactttttttttttgagacacagtctcactctatcacccagcctggagtacagtggtgtgataatagctcactacagccccgaccttccatgctcaagtgatcctcctgcttcagcctccccaatagctggaactacaggtgtgcaccaccatgcctggctaaattttgtattttttatggagatggggttttgccatgttgcccaggctggacttaaactcctttggtactttttaactttagtatgcaaaatgacaattatacacatgccactcttgtgttttctttaaaataatataaaaagtaaactttagtacttcagaagaaacactggaccagaacacagagaccatgtctccatatacctcgtataaacgggtctgactcctggctgtcagaataaccctatatgatccctagaatcatttctgatgcccacttttatgattctttgcaaacggcatttgtgttctcaggatccttctgttttctacacttggccaatattattaacataattgaaaacattaaaatatatcgtaaaagggaatcgtttaatctgatagtaggagaaaataaaagacaataatccttctattgaagaaagaacaaaagaaaatgcaacatgaagattttacatcacacaggcagccgccctagaggaggtgtatcattttagttaatgtaaaagtgcaatcatctcactaagggacgaggagtgttgaggtggataatgcagttctcagcgaagacctggatttggaatgcatcgtctgatgcatttttctccctagaaattttacttaatttatatacttgtcctagcctcccatttaaattaattttctctccttgaacacaccaacacagcctcataaagttgttgtgaagaactcactgagttagttcatgcaaagtgcttattcccatgcctggcacctagtgagtgctctgtaagtgttggccgtattaccattacacccaagcccttcggctggcctggccttgctttggctccaaaatcttaccttaggcagtgactttggagttggaatcacaaaggacatcaactctgcctctctcctgcctagcaggcagaaactacttctctgtgctgtttttctggtgatatgaagtctaaatagaggccaagcatggtggctcacacctgtaatttcagcactttgggagtctgaggcaggtggatcgcctgaggttgagagtttgagaccagcctggccaacatggtgaaaccctgtctctactaaaaatccaaaaattagccaggcgtggtggcacacatctgtaatcccagctactctcctggaggctgaggcaggagaatcacttgaacccaggaggcagagactccatctgaaaaaaaaagaagtctaaatagaatagggagtaactgctaatggccgtggggtttcttttcgggatgatgaaaatgctctagacttataagccagctacttggatagtttctccaaatatttgtgagagtaaacttgttgttattattctagcatgtagaagaaggatcgatgaatctagatctgcatgtctcaaagtgtgttctttggacacaaattctcataaaatgcttagttaaatgataatcccactgtcacatacatttagggtgtgcacgtccccacgctttcttcaaaaagtcccatggtgtacatgggtatgttaaaggccctgcctgaggcatcctggaggaaagaactggtctcactttgtacagttaagagttcctctcactgacttaacatgtaaccctgttcttgtttttttgagacagggtctcactctgtcacccaggctggagtgcagtggcaccatcacagctcactgcagcctctaactcctgtgctcaagcaatcctcccacctcagcctcccgaataactgggattaccatgcccagctaatttcttttttttttgagatgggggtgtctcactatgttgcccaggctggcatgttttgctataaatgctattactattattcagaaatagtgttctttgtgaggttgggaagggctggtcagtggcatcagtgtgccagtgggaaatctttgaagagagctttctgtggggatgtggcatttgatacatcttgggcttcaggttcctgttgtgtcaaatgactccatcagtggttttcagactttaaaacggagcatgttttaaagtgaaaccctagtattaaattcatttataaaaagaagctccagtagaattggggttgtggacttgggccctgtttatttggcctcctcacagggcattccgtggaaggtctcagtattgagaggcccctggacaaggtgagagttcctctaacgtccctcctgtggctaagtttctgcctttccttttagacggatgtttccagtcctaaagattagtgtcacagggttggaccccaatgccatgtactccctcctgctggactttgtccctacggacagtcaccgctggaagtacgtcaacggggaatgggtgcccgctggcaagccagaggtctccagccacagctgcgtctacattcacccggactcccccaactttggggcccactggatgaaagctcccatctccttcagcaaagtgaagctgaccaacaagctcaatggaggcgggcaggtacgaatgaggcgggcaggcctggccacccgctccggcctccccacaacaccaatcaagaaatatcaagggtgcatttaggcaattagaggtgtcctcaccagcctcttctcccacagaagccaattattcccgggagtccaaatgtaaacaagaataaacagctcttaattggtgctttcagtttttaatggacttcctgatgttaagagagtgagagagcagtggtttacttaatcaccggggcccttttcatagtttcgtcttgtgtgctgtgctttttacccagctctaggagggagatgtttgtgggtaccagggttttgttagtccctctccccttttttagtataagtggcatgctggcaatagacaaataccttcataaaaagctgcttctaaatgaaataattactacctccacttgggcattatgataattatcaatagaatattgaatcagctttggtttttcaggaaaaaaaaatccaaacaaaccttccttaaacaaggaaggttttatttcaggtctccaattagagtaaacaagcatttggggctttttcctcttgttttctgtgttaggattgtgaatactagtctgctatagaaggttgctagttactttctgtaatgtaggcagtttctggggattggagacacagatgggagtaaagggtctggattcttctctttcccacctgcctgtttggctttccctcagcctcccaccctgtgcccatgtgccccttctctgatctctgtgctcagatggcagggaccataggagttcatgtgtccagaggtaacactacccgagtctgtgatactcagaagcttccagttccttattaaaacgggaaattgaacagtaaattgttactgcctaccagatttcacagcaggagactgtcattacacctttcatttgactcagagagagtgtagccatcagatgccagattttgccattctttagtcacttggaaaatgcacccattgtcagcattttgagttattaggattcctcaaatgaaaaaaaggcaaacaatatattttgatggattgaaatccacactgttgtgctgaaaataggggaaggaaaaaaggaagccaagattttggcagaaaactgaacactcttaagaataactcctcagccgggcgcggtggctcgcgcctgtaatcccagcactttgggaggccgaagtgggcggatcacgaggtcaggagatcgagaccatcctggctaatgtggtgaaaccccgtctctactaaaaatacaaaaaattagccgggcgtggtggcgggcgcctgtagtcccagctactcgggaggctgaggcaggagaatggcgtgaacccgggaggcggagcttgcagtgagctgagatagcgccactgcactccagcctgggtgacagagcgagactccgtctcaaaaaaaaaaaaaaaaaaaaaaaaaggaatagctcctctctgacaacccacccctcacccttgtaaaggcttcaatgttatgcttcctggagcttctggaaaattcccttcatttgtttcttagaggtgtggtggcagctcaggtggcctaggatttgaaatgtgtgtccctaaccggggtggtgctaagcttgggaccaactggagatgctggctcctttatcacctgcgatacacggggctttgcttttctcctctttctcttctcctgcctcgacagataatgttgaattctctgcataaatatgaaccccaggttcacatagtgcgtgttggaagtgcccatcgaatggtaacaaactgctccttccctgaaacccagttcatagccgtgactgcctatcagaatgaggaggtaagagtgtgtgtgtgtgtgtgtgtgtgtgtgtgtgtgtgtgtgtgtgtaactgtcacctgggagatcatggcaggatgggcggggggggtccttttagatgaaaggtgggttttccaggatttggatacactcagcagacatgaagttaaacaatggagtagctgctctccctccctcttggctgtttgctaaaggctcaccagcatgtgctctcctggtgccaacaaggcacagctgtgcattgtcatgaaactcctgagttctgttgaaactctggagtctttgttgtcaggaccctatgtgtccttggcctgtgcagagctgagtgtgtcttgagtgggtacaattgggcaggagctgtcaggtctcctgctctagaagcaagtctgtagcaagtgatccaaacatgcaccctcccttgggttttattatgctatcattactgcttgttaatgttcaatatcagcacagttagtctgctgctgcccagtgacttgagccgcctggctgtgagggctgagtggttagcgcctggcctgtctgtgagctgctttgggtccgttcacatgatctgctgataatcagaagaacccagggagggttgaattctttttgattaaactttaaaaaaattttttaaagacaatatttatttatttaaaaacacataataaactgacagtacagaagtatataaagtaaacatgaagactacagggtaaagctatacgggtttcttccgcttttggaaactcactccccatggacacgacgaagaataacttagagtgtgtctttttgacaaattttctatgtatatgtaaatatatatgtgaatgtagatttcctcacataaattggctcatgttgtatatattattaatctgcaaatttctttttcctcagtttaagggtgtattatgattacctttctatgtaattatacctaggtatatctccttttctgtagtgcctgcagaatatttcattgtatgaatacactatttcacgtaatcagccccccaccaatggacatttaagttgtttccaactgttttcttttttttttttgagacagagtttcactcttgttgcgcaggctggagtgcaatggtgtgatctcagctcactgcaacctctgcctcctaggttcaagcgattctcctgcctcagccttccgagtagctaggattacaggcacctgccaccacgcctggctaatttttttttgtttttttttgagacagagtctcactctgtcacccaggctggagtgcagtggtgtgatctcagctcactgcaacctctgcctctgagattcaagtgattctcctgcctcagcctcccaagtagctgggactacagacatgcaccaccactcctgggtaatttttgtatttttagtagagacagggtttcactatgttggccaggcaggtctcgaactcctgacctcaggtgatccatccacctcggcttcccaaagtgttgggattacaggtgtgaaccaccgtgcccggccctttattttctattatagataatgctgcaatgaatatcctggtgcatctgtcatttgcttgcgtgggtgaacacctagaaacagatagacatggccaaattgcttccctcaaaatggcatctctatttgtagccccaacaccatgatcaacactattatcaatctttgtcatctttgacactctaataggttaaaaaaaataagatcttggccggacgtggtggctcacgtctctaatcccagcactttgggaggccaaggcgggcagatcatgaggtcaggagttccagaccagcctggccaacctggtgaaaccccgtctccactaaaaatacaaaaattagctgggtgcagtggcgggtgcctgtaatcccagctactcgggaggctgaggcaggagaattgcttgaacctgggaggcggaggttgcagtgagccgagattgcgccactgcactccatcctgggtgagagagcaagacttggtctcaggaaaaaaaaaaagatcttgttgttgcttccatctatatttatttggaagctttaaagacagattttgggctgccactcagccaactgagtcagaatctccaaggatgatgctcagattctgtagatttaaaagtctccccagaggattctattgatcatccaggtttggaagctactgtcttgtgcctacaggtgaaatgaagttgcagatttaactcacatcacagatgtgcagagaaaatgtcatttctataagtaaactggcctcttggcagagcccctgcagccagtcaatggaaacagaaatgaactagctaataatgtaaacagtccctcagctggtggccagtctttcgatgataaagtaattccattttgcagatagccctctctcccagcttttctccctgggctggagtctgggtctatgaggggaggtatggcctttgtaactctgggaaacggggtggtggggggtgcatgtggaattggagaccatgtcctaacctcctctggtctcccggcaaggcccctgcccactggtgtgctgttggtttagttggtggtgtgcggaacttgtcatttggctgctgacttggtaaaccctcagaagcttttcctggctgcaggtgctggacagttctctttgaaccacctgactggtcatttttgacccatccagcaatctcccggcctgactcgctactcctgggtcttgaacatgctccatggcaatcaagctctggaaagcctagccccagtgcctccctctgccaacaaagcttccctgccaagtccatgcagatgcaccccgagtggcgagtgggcgtgggggtgggtgaaggaggccagtgtttcctttgcaccccctgctagcttcttgtatgcttttctacctctccaggtttaagccaagagaaagaccaggttgtacctatctgaccccacacctctttttcctctttctcctgatttcttctcacaagttctgagccagaaggagttgggctctgtattagcccattttcacgctgctaataaagacatacctgagactgggtaatttataaagaaaaagaagtttaatggactcacagttccacatggctggggaggcctcaatcatggtggaaggcaaaagacacatcttacatggtgacaggcaaagagaatgagagccaagagaaaggggaaaccccttataaaaccatcagatctcgtgagacttattcactaccacgagaacagtatgggggaagctgccctcatgattcagttatctcccaccgggaccgtcccacaacacgtgggaattatgggagctacaattcaagatgaaatttgggtagggacatagccaaaccatatctgggtcttattttgctttccttcttccatcaagtctcagatccttgctgacataaatattctgtgagctgggtgtggtggctcatgcctgtaatcccagcactttgggaggctgaggcaggaaaatcacttgaacccaggtggcagaggttgaagtgagccaagattgagctactgtactccagcctgggagcaagactcccgtctcaaaaaaaatatatatatatgtgtgtgtatatatatattctgtaaatatttatttactcaacaaatatttgctgggcattactacatgctggatattgttctagatgctggaaatactgcaatgaataaaacagatgaataccctgtcttcaaggcacttacatcccagtggggagagatgaaaaataaatatttctttgtctctatctatctgttttatctctatcacgatcactatctatctatacgtcagatgtctctaatgagaaatgaagcaggctcaggctaaggcagatacagagagtgacagtgaatggcagtgatagtttgctttttgcattgacatggccccatgtgtaagtgattatttatgaatgagggactcgatgctagatggcactcatccagaggggcaggatcacacctgtgctgctctccactgtgtaccaagtaactagaaaagtaaatcacatgtagtaggggatcaaggattgttgaaaaaaataaatacatgagtaaaaaaatgaatgctaggtttcgcacatcagggctttgctcatttccagtgttttgccctttcttttctcactttacatggcattagcattttcaccacatgcaatgataaaatgtcctttgccagagacagcgcagtggtgattaagtgctggagtaagcaaagatggaaagggcctctgcctctcagagtgctgggattacaggcataagccatcgtgcctggtgggaaagggaaggaaaagagagggaattaaactggttttacagaagacaaagggttctgtttgcccatgtgtatcctacttttactaacacttcttgtctttgtaaatgcaagataacggctctcaaaatcaagtacaatccttttgccaaagccttcttggatgccaaggaaaggtaagtaaagaaattttagtgaaatcttctaatgaatgatttatgcaaatacaaatgtggaatttatgattatcttgaaaggaactagactagtagcactttcattaccttttatagaaataggctttcggccaggtgcggtggctcatgcctgtaatcccagcactttgggaggccgaggcgggcagattacgagatcaggagatcgagaccatcctggctaacatggtgaaaccccgtctctactaaaaatgcaaaaaattagccgggtgtggtggcgggcgcctgtagtcccagctactcgggaggctgaggcaggagaatggcgtgaacccgggaggcggagcttgcagtgagccgagatggcgccactgcattccagcctgggcgacagagcgagactccgtctcagaaaaaaaagaaataggctttcaatattcaattcaatattcaacaacatctagaaaattcaaatcataattatctattcgttataatagggatccgggagaactgttaactaacaattttttttaaagacctgttttactatgaattcttgaaagtagcacaatcacattaaaaaaattaaatgatttagatttataataattcactctgcctttttcctaattacttctgagtagcatggcattaataaattgcttttttaaaactacatttagcctaggaaaagtgaaaaatggagacaggttcacatttcctctgctgagaaaagaagtcggagacttctgggggtatgagtgatgattctgctacttcggggcagcgacctgccatctctatatcttttctttcttccttcctttctctcttttttcctttctttctttcccttctttccctttccttcttttccttccttccttctttttctttcttcctttccttccttcctttgcttccctcctttccttcctttccttcctagctttccttcttcccttcccttccattcccttcccttccgttccctccctcctctcctctcctcccctccctccctccctcccttcctttctttctccctctctttctttctttctttctttctttctttctttctttctttctttctttctttctttctttctctctctctctctttctttcattcttccttccttctttcttttttttttttgagacagagtcaggctggagtggcactatcttggctcactgcaacttctgcttcctgggtgcaagcgattctcatgtctcagcctccctagtagctgggattacaggtggccaccaccatgcccagctaattttttatgttttatttttagtggagacagggttttgccatgttggccaggctggtcttgaactcctgacctcaggtcatccactcgcctcggcctcccaaattgctgagatgacaggcttgagccaccgtgcccagactctatgtcttttgcatcccaggaaaaagaagatgatggtgcttatcactgactttttaattgacaaagcctacagtataatatgattatctttttaatgttcagattttattgcttgagtttcaaatcttttaaatagtttttataactgtctaatctttcctgttcaccttaaaggctctgataaggctctagattaatggacagatgttcataatgatgcatcacatgaccctgtcctgtccaatatttgaatatattattattattattttagagatggggtcttgctctatcacgcggactggagtacagtggtgtgatatagctcattgcagccttaaattcctgggctcaagctatcctcctgcttcagcctcccaagtagtggggactacaggcatgtgccaccatgcctggctatgtgttttttttaaagagacaggggctctcagtatgttgcccagacagtctcaaactcctggcctcaagtgatcctcctgcctccgcctccttagttgctgagattgcaggagtgagctactgtgcctagctccaatattggaataaattatgatgatatacaagacacacttataacgttttcagttaacaaaaggcctaaaggataaactgatatgtgagatgacacaatctagattcaaagtgacagtagcatggtataatacaaagaatttaggactttgagtaagaggtcctgactgaatccttgctctgtaatttactggctgtttgttcttgcataagtcagtttacctcctcgagatccacttttctaatctacaaaattagaaaaatatgttaatatttccctcacagggtcattggtggatctagcatatcacatatgtaattgtgccatggaattgtgctgttattattgcttgaatcttgtcagtcaggagcaatatccccaaattattcagatcaaaataaacagggatagctgtaaatgtggtaaagaggggtaaacagtaaaactgcaactccaagagcaattgcacaagtagagacagcaccccgaaggaaggagaatggggaaggacaggagcttaggaaaaaggtgtttggttttcttattctaagaaattgattgctcttcaaggagaattttgggtatgctttatagtggacatacataaaaagttggacagccatggtgcattttctttactctttcagaaatcacctaagagacgtaccggaggctatctctgagagccagcatgtgacctattctcactgtgagttgggtgtacatgaggcgggaggtgcgtggggctgtacctggagccagctccttccacactcagactctttgcctgtcaggactgcttaaggacttccaaatcaaaacccaacacacagtttattctattaaggacaaatttgtgccctttccagaattccagagagagagccaatggtcctaggcttaagagacttaaaaaaatcttaggcaggagataagaatgaaaatgatgaatttcttagactctggttttcttgtcagtaaggctctgagccctcaacagtgtgttctcggcttgcctcctaacgttatgcttgccactctggtctctctgttttggagttctcctgttcttagtgtttgctaattttggagttggttcccatagcaatgtgtcatgcaggctgtagcctccatggggaagagtctttatttgtgggctggaaggctgtaggaagaggtggagtaatatagctgggattctgaaggtagtgttggatgttcccatcagggtgttaccttgtccatgtcccaggatggtggagggaatcctctgcagctgcaatgcaacccacgatcagtgacatcagagtaggaaagttaaccctgatgtctgaaaccctctttaatttggattatattggcttgcaaagatcccttatgcagtttgccagctgcagagttctttacttcttccttcccttcaatcttactgcaccttccataacagacctgggagtatagccgcataaagagaagcagctctcagaaaagcactcttttttttttgagatggagtctcgctctgttgcccaggctggagtgcaatggcccagtcttggctcactgcaacctccgcctcccgggttcaagtgactcctctccctcagcctctcgagcagctgggcccacaggcatgtgccaccatgcccggctaatttttgtatttttggtagagatggggtttcaccatataggccaggctggtcttgaactcctgaccttgtgatccgcctgcctcgacctcccaaagtgccgggattacaggcatgagccattgcccccggccgaaaagcactctttaaaaatgactgtcaacctaaatgaaaaaactgaggcaacattaatataagtaaaaagtttatttgggtcaagtttgaggactacagcttgggagcacagattcaagttcccctgaatatatacttgggttagcagcagttacaagtggatttttaaagggaaaaataagaggtgattcataaactgtctactgtaacatgagctgctgattggttatatattgttctttgtatcacacattccaggaacgtgaagataatgggtgaggcagctagtcaggaacaaaaatgcctttaaagaattgcccccaggcatgggtgcagggggtgcccttgactgaagctgctcctcacactcacatccctctgggtctgataaattttgcatgcctcacataactcagactgttctgagctgtttttcttttatcacttccccctcagttttttcctttaggtggaatgaactggaataaaaacctcgttttctaggttagggccatgtgcagaaccataggagttcaaagttcatgtgttgcaatcttctcagcaaacttcttgaggtgtgtacattatatgtggcaaagtctggttctgaggggccacttgcctggttttgcccgctgggtgcatgaatcttgattctgttagtcagatggggaccccttgggccataagtttgtgcaactctgggaaaatgaagatgacaaaaggatttgttgggaatgattgtaatatgaactttgtacaatttgcttacttgtacttaaaaagtattaagcgaaggcggtgggttctaatatcaagctccatttcctcattgccgaagcccaggtgacaatccttagccaatgttcttaaggaacagctctgtttctatctgaatccccatccactgatcccttagctgaggcatggtcagcgggagaacaagcttcttgttttggggcctgcagtactaagtctcagtctttgcccataaactcactcgaaatagtcttctgttcagaatctttctacaaaacattttgcagtcgtccaaaatattctgcaaaatgcttgctgcctgccagtaaataagtggaatgaaaaagaagaaaaaaggaaaaaaaccccaaaaccaaaaaaaaaccccaaaatgcttgctgtcaagttgtgctaggccagctctccctttctgtgctgtcagaattctctttgtggggtggggttggaaggcatcatgatatctcttgcttagagtgagaactgaaggcaccttcacactcggcagaaatagagaggctttcactcttcctgcgtaaccacattaatcattccctaccttccctggtagctgaaggtccatgagttacatatacgtgtaatgcctcctagactgccttttattttaattaagcctgaagcaccttaactttgcatttctattaacttctgcattcagatagtatttctttttatttatttatttatttatttttgttatactttaagttctagggtacatgttcacaacgtgcaggtttgttacatatgtatacatgtgccatgttggtgtgctgtacccattaactcgtcatttacattagatatatctcctaatgctatccctccccactcccactaccccacgacaggtcctggtgtgtgatgttccccttcctgtgtccatgtgctctcattgttcaattcccacctatgagtgagaacatgcggtgtttggttttttgtccttgcgatagtttgctgagaatgatggtttccaccttcatccatgtccctacaaaggacatgaactcatcgtatttcatattgctatattccagtgttgctttagaggttttccaccctttgatagagtcctttgataggactgtaaccacctgataggttcttcctgctggttgcacaaaaagatgttactgagaaggggtcctgatccagaccccaacaaagggttcttggacctcatgcaagaaagaattcagggcaagtccacagagtaaagtgaaagcaagtttatttagaaagtaaaggaataaaagaatggctacttcataggcagaacagaggcatgggctgctcaactgagtatacttatagttatttcttgattatatgctatacagggggtggattattcataagtttttcaggaaaggggcgggcaattcccacagctgagggttgatttctcccctttttagaccgcatagggtaacttcctgacattgccatggcatttgtaaactatcatggtgcttgttgaagtgtcttttagcattctaatgcattatgattcgcatataactagcagtgaggataaccagaggtcattttcattgccatcttggttttggtgggttttggccggcttatttactgcatcctgttttatcagcaaggcctttgttgtatgttgtgctcacctcctatcttatcctgtgactaagaattcctaaccacctgggaatgcagcccagtaggtctcagcctcactttacccggcccctattcaagatggagtcactctggttcaaacacctctgacacaaagaccacagcgttgcaataaagaaagagtttaatagacatgaatctggccatgccattttggggacagagctcttactcaaatcaatctcttcaaaaacttgtaggttaggttacctttttcagaggcaatttcagggaagaagtgggggtagctagacaataggtgcttgctgctgattggttggatcagagatgaaatcacagggaattgaagctgtcctctggtgctgagtcacttctgggtggggccacaggtggggttggtgggtccaggtggagccactggtgtcagatatgccaaaaacctgaaaagatatctctaaaggcctatcttaggttctacaatagtgatgttatctgcaggagtaattgggaaagttgcgtatattgtaaagtctggaataatggctggcaatcatttgtgtctacatcttagcagaattcaggctcctctatgctcctagcctggtagtctttcattagctttacaaaggcagttgagttttagagaaggattactattatttaaactataagctaaatgtctcccaaagctagcttggcagcttgaaggctaaaggcaagagggagattgggtagatcagaagtcttcaactgccaaaattttctcactgatacaatttttgcaaaggcagtttcaggactggtcatgcatttccagagaagccaagttagctgctcatgggcaagggcagtggcagctaggggatggtaccaccacacaggctggcaccatcacacaggctggcatcagtgtcatttacaagaattgtagctgtgtaaagtagctggtcacctgatttttggtgtgggagttcacagactcagtcttggtgtattcctcttgtctattttagtgggaggctggatcttttccaatccagatggagtgtgcacagcaggaaactccaattaccagtatgccgctcctctgcctctgcctgctccccacacccaccatggctgtgagcactattcgggtctccgaggacaccggcaggctccctacccttctgcgtacatgcacagaaaccattctccctcaggtctgtgactctgctgattaaacccttggggtatgggctggggtgggggcagtcaggagaaatggataaacagctaggaaaaggagtagctaaagatggaaccccgtcatctaatatacatctatgatatgattgtttttgtgttttattttattgttattttatgtacaaatatttgattaactaggtataacaatcttagttttttttaaaaaaattatttcataaaacccccagtctcctggtttctaatgagcgtgaaaggccaggacactgatattctgagcagttcaggcagatctctaaaagccatgtcaagttgtgtgggtctgaaacactcagctcatcaccttcgcatggctcttttctatagttgcattcatggctcagttcagggaatactgggtctagcattagggaattattaggaaggtctctgggaagctggatccctatatgttcaggccttagtctgattcagttggagacatgcaaacccaaccttagtattttaaaataatttttgctgtctgtttgttttaagttagcagtattgtttgtgtgcttttttctcattgactattgccttttccacctttgccttatgtaggcccagaccttgcctgattattagatttgtagaaagaagggagaaatgaaaacaatggttactttttcattaaattattcatgcaacaaatatttattgaggatcgactatatgccaggctctgtttcaagcacaggaatgaaatggacaaatgccctgcccttacggagattctatactaatatgaaaagattgacaataaaacaagtaaagttcatggcatgggagacagtggagagtatttggattccagcctccttccttcctcagtgacaccctgagctctgcatttgtagagggtcctcctggtcaccagctacctgtccctgtgtcccttagcctgctattcttggcaacctcaacagttgctgccaggtggggagattatgtagcttaccaatagcagaaactgagcagtggctcactctacttcctcattctttcctgcggtcagcatcaaatcacatcttctgagcacctactgtgtaccatgttcttctaggcagtgggataggaaagtgattaagacatagtttcagggccgggagcggtggttcacgcctgtaatcccagcactttgggaggctgaggcgggcggatcacaagatcaggagttcgagagtagcctggccaacatggcgaaaccccgtctctactaaaaatacaaaaactagccaggcgtggtcgttggcgcctgtaatcccagctacttgggaggctgaggcaggagaattgcttgaatccgggaggcagaggctgcagtgagccaagattgtgccactgcactctagcctgggcaacaagagcaagacgccatctcaaaaaaaaaaaaaaaaaaaaaagatatagcttcttccctggaggagctcggggttacacaaatacgtaaataatgaatcctaatgtaatgcagaaacatcacctgggaacttgttagaaatgtagactttcaggctctactcctgagtcagggtctgcattttaacaagatcaccaggggattcataagcgctctagaatttgagaaacagtctataaaacacataagtcagggtgccatgtgaatgaaggaaaaagagcagctagatatgcctggtggaggagcaaaggctgcccagaggggttaacatttaaatggagccttgaaagatgaatagaaaaggacagagtgggagtgggcaggggtaaaaggtggaggatgacatgtgccaaaggcagaggtgcagggcattccaggtagagagagtgggctgagcaaagatacagaaaggggaaagaccctaggttgtctgggaacagctttggagcagagtgtagggggagtggggacagatggaagatgtaagagttagggctggagagcttggaagtgccagatcgtaaaaagaagagacatggccaggtgtcttagtcccctttgtggcgctataacaaaatacttgagattgggtaatttataagcaatagacctttattttctcatagtcctggaggctggggagtttaagattaaggtgccagcatatggtaagggttttttggctgtatcataacattgcgaaaggcatcacatggatggtgggggaaagagggggagagggcaggaggctaaacccatccttttatcagaaacccattcctgcaatactgacattagcctattcctgagggtagagcccccatggcctagtcacctcttaaaggccccacctctcaacactcttgcattgggaattaagttcccaacacatgaaccttgggggacacattcaaaccatagcaccagagatagacgttggaatcttccttctctctctcccttctcccccttttcccttccttcctccctccctctgccttcttcctctctcttatttgtatactatttatgcaaatagagattcaaagaaatggaagacattcttcccccacccccataaaaactgtatatattcaaggtgtacaacatgacgttttgatatacatatgcatagtgaagtgattactgctgtcaagcaaattaacatgtccatctcctcacatagttactttttttcatgatgagagcacctgaaatctattctcttagcaaatttccagtacacagtacaatattattaactatagtcttcagattgtaagttagatctctagacttattcatcctacacaagtgcaactttatatcctttgaccaatatctcatttccccagcttcccacccctggtaaccactgttgtactctcagcttctatgtattcaactttcttagagtccacatataagtgagatcatattatgttcttctttttgtaaaaaggtatgtttttttcttaattttttttttttttaattgtagagatggtgtctctctgtgttgcccagagaggtctcaaattcctgggctcaagggattcccctgccttggactcccaaagtgccaggattacaggtgtgggcaccatgccgggccaaaaggcactgtgcttgagatatttaaacctactcagggatggccgagaagaataagttcctggacctcagaaatctcatctggggcactggtggcccttaggcttagcttgaggggaggctggtatggtcccttcttaaaagagagtgactgtggtgaaatgagttagacagatcggtgttacccagggcaaatcattctaccaccctgaggcgtatctataagatggagttaaggagtcactggtgtgaagattaaactatgaatgacacctggcatatggttgacattgaggaaacccacgtttctttttattttctatttccctgagaaagaactaacaaactgttggtgcctgtagtgcaagccatggttatattttgccctaggataatgtcactggtcaccatctttatgtcttctacatttgctatcaattcaactgttgttatttccccaagtgaatttgatagaaagctcaagcaataatctgcaagttttctcgggacctgacagctggacttccttatcctccacaccccatgccagcatcctgtctgtaccccacaccaacggaccaatcaatccagggcccaggtaagaccaacaccatcaactcgctcattggtcgtcttgggggtttactttagcactggggactcaagttcattctttttcctagggtggcttggtctaacctattgtcttgacttctaaaacactaagaagtcaaggtggcaacagggtggagttctttcataaggggagaaacagctcagtcatatactgtttcttttatttagaaggataggccgggtgcagtggctcacacctgtaatcccagcactttgggaggccaaggcaggtggatcacctgaggtcagcagttccagaccagcctggccaacatagtgtaaccccatgtctactaaaaatacaaaaattagctgggcatggtggcgcatgcctgtaatcctagctactcaggaggctgaggcaggagaatcgcttgaacccaggaggcagaggttgcagtgagctgagattgcgccattgcactccagcttgggcaacaagagtgaaactccgtctcaaaaaataaacaaataaataaataaaaggataaagacattatggcctgggatcatttgtcttaaaccagtcagaaatactttaaactatggtggtagcaaatagatactgactgtagaggaattgaagaggaaaagtataaatatacactgagaagtcaagacccatgattgtccattttcccatgagtcacccatcctaaaagggggacatattgtggatgcctggcctcacgaccctggtaacagagttaagtgtagcatgggggaccccatggtttaatcctcacactagcaacctgcattaagttctgacttctagaaatctgagtggtgaagtgggaagagaaggcccctttgagtctgacaggcaggggtttgagtcccagttctacctcttagtagtgattttgtggctttgggcaattttcttagccttactgagcttcagctttcttatcggtatcatggaaataatatgacctactttgcagagttactgtgagcatcaaatgcagaaatgagaaaatgcattaacgtgctttgtaagcagtaacattctgtgtaaatgtcagctattatgttcaatatggttatgcagaattttgagaaggtccaaagtggattcaaaattaaaagatgaggcttggcggggtgcggtggctaacacttgtaatctcagcactttgggaggccgaggcaggtagatcccctcaagtcaggagtttgaaaccagcctggccaacatggtgaaaccccatctctactaaaaatacaaaaattagccaggcgtggtggtgcatgcctgtaatcccagctacttgggaagctgaggcaggagtatcacttgaactcaggaggcggaggttgcagtgagctgaggcactgcactccagcctgggcaacaagagcgaaactctgcctccaaaaaaaaaaaaaggatgggatttgggaagacatcagatgacttgtgatttgtaagtccagaaaaagttaggaaaggttaggagaatgtagtggcttagaatcacctggggttgttgttaaaatgcagaatctgattggtaggtttgggtgggggcctgagattctgcatttctaccaagttcctgggtgttgctgatattgctgtggcccacaagggtgtagagctgtgctgtccagtgcagcagccaccagccacctgtagttgtcaaacacttgaaatgcagctagtccaagttgagtgtaatactcacataggattttgaagatttagtgtgaaacaaagaataaaaatcccagttttttatatatatatataaaaaaatataaaatatatataccactatattacatatatttttatatttttaaatataatatagacttatatataaaatagataatatatattttaatatatataatttgtataaaaatatatattttaatatctataaaatatatattaaaaatatataaatatataaaaatataacagtatatgtaaatatagatgttattatgtaaatattatgatgtaaatatatacatataaatatatatatttacatcaaatgcatgttgaaataatattttgaatatttttgttaaataaaatattaataaattaatttttttctaaatgtggctactagaaaatttaaacttacacatgtagttggcatttatggtttgcattttgacgctgatctagaggatcatttgcatttgacactgatctagaggatctgagggaaaaacattgatttgggctgtggtaggaagtgagaaagagagtgaagatgaggttccctgaagatattaaacaatcatgtgccaagttgtatactagatacttacatatatataagtcatccatatataagtcatctgtagtactcaaagacaactataaggcaggtattaaaattcctattttgctgatgaagaaactgaagctcagaggccttaaaaacttcctgaaggttctgcagtaagcagtacctctcagagcccatggttctcccactggcccaggaggcatcagaaagggtctgtaagagataatgtagaagagcatcttctgaagattggggccagaatccccataagctgagctagctcagagagagctcagaggatgggctgctgaaggtttcatatggtccaaagaggcctgtagcattgaaaaatggcaccaggtgaaggatggcattgccaactctggcttccctgttggtgtgtttaactcattcctgactccataaatattttgttagaaacaaaacaaaacaaatgtattcaatattgccattggataataagcatattatcaagcaatacagtgttgggcaatgcagaaactctaaaatgtaagaaacatagtgatgactacaggccgaaaacattgggttcattgcacctgttccaactgcatctatattaaggtgcaagcttggctgtacattacagtcacctgggaaacttaaaaaaatcctcgtactcaggctgcatgccagatcagttcaatcagaatctctggggcaggggagtggggtgagagtgggatccaggcaccaatattactttaaaaaccccccctagtgattccaatgtgccgaatgtgcaatcaagtgtgtgaacctgtgctacagaactagagaaggcaaagaaaatgttgtagctcccagcctttcagccaggcaccagagctcacaggcggagaccaggaatggaagaattaatgttaacaaccaccatttactgagtactacatgctaaggaccatatactcctcttatttaatccttgtagcaatctctgtaaggtaggtaaaattatgaatccacatcttgaagatgagaaattgacactcagagatattaaataatctagccaaggccacagagctaattaagtggtagagctgggatttaaacttaagtcttctgacagtgatgtttcctggttattatgccacattggccagggagagatcatatgcagaaatcatacagttttaatacctttttttctactgccctgccaattttacataggctgcaagggagcccagataaatgaaattctgtgtctaaaaccaaataattcgctggtggccgggccagtaccagaatacttaatcttatcattattccaccatactttgctgcttctcttagcttttctgcagaaacaggaccaatctgcgtcatagctagaaataaagccatggccagaagccctcctgtaaccatgcccttctcagcactgtgtacatgcttgtcaggtggcactccttccttggagtgccagtgaacattcccttcccctctttctctgtctctgcagcccctacccgtgcctgtggaccatcagcaatggtgccggaggccccagtgggccaggcccggaggtgcacgccagcaccccaggagcatttctcctcggaaacccagctgtgacttcacccccttctgtgctctccacccaagcacccacttcggctggtgtggaggttctgggggagccctcgctaaccagcattgctgtgtccacctggacagcagtggcctcgcatcccttcgcgggctggggtggcccaggagcgggtgggcaccattctccttcctcactggatggttaagcaggatcctaggagcctctttgcacagcgatccttccatgtgtagagtgcttagaaaccccatcaactgatctagtgagtcagactgtggaatctcccttcccactagctggaggtggaggtgggttattacagaagtcatactgggagagggttcagtttggatgatgctagttagatcatttgcatctctccaccattttcttctgcactcccattttctctgcagcttattcttgccatgcttaggtgacagaagtttgttaagtaccatccttgtgccctgcctcttattctcaaatcgttctggaaagcctcacttccttttctgtggagaaggtgcaaagctgttaaatgagctcagagtttacctagctaaggccactgcttcctgctttgtgaagcctggaaagtatgtgtggccacagggctcaggttcacacttctgctttgagaccaggatggggtgtaagccatagagtaaggttaacaaaaagaataaagctaatcatgtattacaaacagcagtgtgcccagacttgtggaaatgaagtcatgtcactcctctgctcagaaaccttcaatggttcaccattaccagtggaatgaagtcaattctcctcactataactgggtgtggtagtttaagcctataatctcagcccttttggaggccaaggtaagaggatcgcttgaggtcaggagttcgagaccagcttgtgcaacaaagtgagagcctgtctctacaaaaaatagtcatgcacacaaaattagctgggcatggtggcctgtgcctatagtcccaactacttagaggaggatcgcttgatctcaggaggttgaggctgcagtgaattatgattgtggcattgcactccagcctgggtggtagatcaaggctttgtttcatttgaaaaaaaagaaagaaagaaagaaagaaagaaatcctactacgagcgatcacaccatctggcctgaaaccacttccccagcttaggtccctctgttatcctgttggcctcctatgtattggtcaaggcaggcatctctgttctctgaacattcattgcactttcccacctctataccttgcctgtgccttagtgtcctcttttttccagttcacctgtgcgaatccgacccacctcccagagcctggctgaaacgtcactccctgcatccaacatctgatctgctgagatatgtctgatctatctctgctcgctgttctcccgttgtttttgcctctgccatagagctcacctcattttgccttgtatttttgttacctgtgagtgtgtctctccctattagactgtaagcctctcgagggtgaggcctagccttcttgtctttgtaacccacagcagctggtactgtgccttgcctattgtaggtgcccaataaacatttgctgaactgaattggtgtaatgtgcatgtgtgctacaaggacggtgtgaagtggctggggggcagatctcagagacacatgccccatgacacataggtgcatccgtgtgggagcctaggaacatgctggctgttagttacacgggcttctcatctgaggcaccaccaattgtcagtgaatgacaatcatatatggagacagggtgtgttagagtggttattcccaaatactggttcttggatcccctaagtcaggatcacctggaacaggggacccttgctagacatacagattcgtgggtataccccgtacctgttggatcagaatctttggggctggcgttcaggaatctgcatttcaaacaagagctccaggcattggccctgggctaggtttggaaactccttgcctagaagagagaaacaggatgataaatactccaggaaccttatttcagatgagtttttacctctgccccagccaaggtcattgctataacccgtgagcagaatcagtttcgtgagtcttcctcctctttttctacctactactggatgtgctaataaccttgggagtgaggtttccagacctgggtgatgagcagttctccaaacattgactttagactgcactggctgagcagcccttctcagggccgccacttgaggagtctgaagttccacttggagcctagcattggctcagctgcttccaccactattccatcagctgaacccgtgcaaacccagcccactccaaggcttagtctgaggggtccaaacatggtactattgagtccttggctctttctatagcgaaaggtcctttaacatgctatggtgtcacaactggtgtcactgcccaatatttctgtgctgttctgttttttggatctcaggaaacaatactactccagctacgtggtgtccagggaagactcattgcctgacttcaggttgcctggccagcgctctgggccactagttggcgtgtgagtggccaaggcacaatggatccatgcatttggaaagctgtctggtcagcatgcccctaaggcagcattgttcctgtttcccagtccctttacaataccattagaggtcactaaggtattaatatattagtatctctgcaagacagtactttggtaagttataacagatggtcatttctcaatctgctagaactttaggctactgtggcctgtaattgccacagcaggtctgaccaaggcctctttactggtcactgcagcaagtcttggcaccaagtccttcacatgtcctgtaccaagagctcagcaagtgtaattagggaataaaaacccaccttgagtctcacccttcctgcacttcccctagcctggagcagacagaagacctggcccagggacacagaacagaaagaagctcgtagcctccattatattttcatttatattgctcaggtgaatggggtcctctgcagcatgataacatgagcattagctgagtttggggtgatcacgtctctccgtcttgtaggatactcagcttggaacctgctgtgattcttaaacacacacaccatgatagctggttccacaaataggatctctatttgctgttagctatctagccagagacactttctatttttttctttaaatagtctagggctaatttctgatcagaagaaacaacactagttacataagtcagtttagtaagtgacagattagcttctgtaatgtgttagacaaactttggagttttgtataccatttccttgctcatgtatcttctctactcaactcactataaaacaaaaatggtgcctttcaggttttctggactatttcatgaaatttaagagaaactgaaatcccacctgaatagaagagttatgcaatacttttagccagatggtagagattctaactctccctgaagcctggcctattggaaagtgtcccctactgtggggcctttatttgagtctgtgtgacctcaccagccctcccttccctggat

SEQ ID NO: 16847 - DNA, 98302 bp, Human
acttggattgctctgaaaaagtaaagggtgtttgcttttactgttcaggctggtagagcatgatttttacaacatttaggcatgagcatttaatctgccccagcagctacaggaaggccttaggaaatcctagttttctcagaactaactgggcaacaaattgaaatttcagcatttccttccatttacagcttaaggtcttccatctttccagctgccacacacacacacacacacacacatttctgaactcttttcttccatttatttaacattatacctttatagtcttaatctcttgcctatatacaaaactctaatactcacttacatataaatacactcacacacacgaatcacatctacactttttttttttttaaagagagaaaaaagtaaaagaccaaggtagagagagggtaaaaggaaacatgaggacagaagaaaaagaagtctggcctgagtgaatagagcttaacagcccactacaactggacttgccctgcgagggcctaccccttcctgcaaatgagttgagccgttcagctaccctctttcaccccagcctctttgtaatggagctcacttatgcaacagctgttcagggtgggagggttcttcctctgtatagaaattggcccttttgaagtgtggctcaacaactctggcattttcaccactataagcaggccgcaggttagaacaaaacaaatggagaaagagcaataggaaaatgagcaaatgaatatatcagatttcctctatttcaattttctttttagaagacctatttggagactgcttcctgtcaccataaaatcctgaacatttgtcttgaacatgaacactccaaaagaagaattccaggactggcccatagtcagaatagcagctcatttaccagacctcattgtctatggacatttctccccagagcgaccctttatggattattttgacggagtcctgatgtttgttgatatttcaggcaagtgcaaaagggatgtttgtttaatgtggatgagcaacaggctcgcgtgggaattcacatgcagagcttgattgcagagtagggaggccattctggagcccttgggctgtcacagcagatgtgctccactgagaacacaagagggaggaaatagcttgtggccctggctctctctcatcctcccttactcaggactgccagtcataggcatatctttaacatgctcaagtcccattctttgctccagtatctctgccccaacttcactgactcatcctctccagccccaagccccatacacatcccagtcaaaattgacctcaggaaatgatctccctagatgatgtttacatcttactaataaacttgccacctcttcagaagtgtttgaaatgtgtgtgtttttgttaccacggaatgaaaattttattcccagttaaagaagttgcagttatcactgtacagttgagaatttggaagaaagaaatatctggagccttttcctgacccctaaaataatagctagaggaggctgcatgtctgacacttgaccagccacaaagatccttaagaagaaactctgcctgtttttaaaagctgaggccgccgggttcggtggctcacgcctgcaatcccaacacttttggaggccgaggagggcggatcacaaggtcaggagttcgagaccatcctggctaacatggtgaaaccccatctgtactaaaaatacaaaaacgagcctggcatggtggcgcacgcttatagtcccagctgctcggaaggctgaggcaggagaattgcttgaacccgggaggcggaggttgcagtgagctgagatcacaccattgccctccagcctgggctacaaagcaagactctgtctcaaaaaaaaaaaaaaaaaaaaaaagctgaggcccgctgccttccagggtagtcctcttctggctctgtttgattcccccaagcagccaaggaaaccagctgcacatttattccaggttttactgcaatgactgagaagttcagcagtgccatgtacatggacagaggggctgagcagttggtggagatcctcaactaccacataagtgcaatagtggagagtaagtgttcccataggtttctggcttgagaatatttcaattcattgttttttccgtagttgtcaattataacctgatagagtacaattgcttagcactcctcctcttccccatgaaatgtgtataaaaccagtcttttttgaaatatgatatagtataactgaagaaataaatataatcaaacctcactaatacagactatttgagggaagggatgttttgtgttagagggctgaattatacactgcttttaaaagaactgtagtagtaatacttttagttatatatccaagtatttatatttatttttatttatttatttagagacagagtcttgctctgtcgcccaggctggagtgcagtggcacaatcttggctcactgcaaccttcgcctcctgggttcaagcaattctcatgtctcagcctcccgagtagctaggattacaggcgcccgcccccacacctgtctaattgttgtatttttagtagagatggggtctcaccatgttggccaggctggtctcaaactcctgacctcaagtgatccacctgcctcagccccccaaagtgctgggattacaggtgagagccagggtgcccggctatttttatttattaatttttttttttgagtcagagtctcactctgtctcccaggctggagtgcagtggcacgatctcagctcactgcagcctctgcctcccaggttcaagcgattctcctgcctcagccacacacgtagctggggttacaggcgtgcgccaccatgcccagcaattttgtatttttttcagtagagatagggttttaccatgttggccaggctggtctctaactcctgacctcaggtgatcctcccacctcagcctcccaaagtgctgggattataggcgtaagccaccatgcctggcctatccaagtatttttaaaagccagcatctataaaacccaaagatagtcattaagagattgttgtatgagtagataaatgatttataattagcttctcaataatttgtctcctaatgatggatgctgaagcacttagagtgaactgaaaactttagtccccttgtcaacctctgcctgccatcttgtttgcattgttaattcaaactattcatgaagacaacggtttactctgttatggtgaactcctggcctagtgttttatcagactctgagttccttagtaatatcttgatgttacccactagacaaaatttaatgcttcataaaagcaggaactatggttgattcctttctgcatctgacttggcacaacaggtgcttaaccaatccatgatgatgcgtaactaaaagagagaatggccatttatgccataccgtctaaataaacaaaatacaaagttggtaataaccaaaaatgcaagtgactatggttgtgattttcccattccctgactcctagtttttgtggagtcctgtcattcatccacccacccatgcttacacaagccccagcctataacatatattgatcaataaattaattaaaagcattccattatcgtgggaggagggcagctgtcttcagacctcatcagaaaccctagctgcctttctcctgtctttccccattcacagaaatggagcatagatgtaaactggttccacgtactcattctccacttgaggaaacagactcaaatgggttaagtggcttgtctgggatgagatctttagtataagcctattctctgaatcactgttcttttgacctagtttctattccactaagaaagaatgatgtttttttactacctttaaggaatcagggtttgatttaattttttttttttttctcagaagtgttgatttttggaggagacatcctgaaatttgcaggtatgggggcttactaagatagaaggggtaagaaaggagtgctgaggtgcctgtgcttctgtgttggggacaaaggaggcatcctagagaagggagtggccaggagataggctgaggaatgcttgatgagtaagtttctatacagatctcatacaaaatagattgatccccagggcaggtcaaaagcccgcggcatgtctctctctgaaggtgatgcactgctagccctgtggagggtggagcgaaagcagctgaaaaacattatcacagtggtaattaaatgtagcctggagatccatggattgtttgagacccaggagtgggaagaaggcctagacatccgagtcaagataggtaagcatttgagaaggaataaatcctacggcagctgggatagggtcttgactcctggggcatctctctctcccaaagagaagtagtagaacatggtggctcagccccatgatgccctgaactttggcatcaggacaatcagaatgtgaattttggcttcctcacataccagttgagagaatttgggttaatcataatatctacctaataagctattacaaaaagtaaattagttggtatggtagttaatgcataggaaccacccaataaaatagtctttatgactgctactgctgttattattattccatcttgctgcttgtcaaggttgtgcagtataaaacaaaatagagactagcttgccattacatagtttcagcaacgacatgagactggtcaccccctacctcataagaatgaggtgtaggaaaagcttaacaggtcagcctgcaacacagctccagctttacacaaggcttcttaaagttatacatataatatagtaatagtcacacatatttccttattacattgcagacattacacactatgcacgtgcaaacattacgcacactatatgacagtcctgagatacaggcatcattgtatccatttcatagatgaaaaatgagattctgagaggtataagtaatgagtaacagagttatggttggtgctgttggtgttagcttccgcctaactaaactttgcaaaacttagaattctcacatgtcatacctgataggatcatcagcagttatacaattaactgtttctcagccttctttaacctaggcccgcttttgatgttgttaaaaatttccaaataaggccaggtgcagtggctcacacctgtaatcccagcactttgggaggccaaggtgggtggatcacctgaggtcaggagtttgagaccagcctgaccaacatggtgaaaccccgtctctactaaaatacaaaaattagccaggcgtgatggcgggtgcctgtaatctcagctacttgggaggctgaggcaggagaattgcttgaacccaggaggcggaggttgcagtgagccgagatggcgccattgcactccagcctgggcaacaagcgtgaaactccatctcaaaaaaaaaagcccaaataagttaaatattttgttgaaaaaaaaatcaaagttattataatactgaatattttttctaagttagtacccaaggagtctgatgtgttatccttcttgagaatgatgggaacccagccccctcttgcatgctgattggctgttagtgaggtgggtcccagcacctttttttagagtaagtccaaacatcagtgtgtttcagatagaaaacaaactgtatgtagaatcaggggggagtcagccctgacaaatcagtatagcagagagcgaagataaaaaataaacattgattgtattacagtcatttgaaagaaatgtgtgtcacttacagttcatttatacatatattttgtgtacatgtcatattatacaatatcttcttctgtcacttaggttccaaaactttcatttaccaacttaaaagcaatgagagaaatggttgttgggatgggatgtgtaactgtcaaatgcatacttcctttcccccaccctttgttgtctaaaattcaaccctaagggattatttttagttacagcttcaatctctgctaaaatgcaaattctcccaaaataagaattattaaaggtattccctgttgcccttaagtatacataattgaagaaaaggtaaaaataactttggggactggtaggaccatgtagtgagataatgttacagacaggcaaaatttagtggtagaactttctagctttggaagaaggggagctttggaaggcccgagcccaaaagaggtatgccataattcctatgtaaagttttagaagtgagattttgctctgagatagtatagtcccaccaagattatggtttttccaaaaacctgtgctgctgggaaataatccagaacttcttgtgcaaacctattccttgccttcttgccaggactggctgctggccacatcagcatgttggtctttggagatgaaacacacagccactttctggtgattggtcaggcagtggacgatgtgcgccttgcccagaacatggctcagatgaatgatgttattctgtcaccaaactgctggcagctctgtgaccggagcatgattgaaattgagagtgttccagatcagagagcagttaaggtgggtgtgatgctgctacttacagaaagttctgccagcctgtaacagaggccccctgccagaagagtcactgggcacgctggtttcataaagctcctgggctggagattgggatggggtcagtctgggttaggctacagaggctttagtccagggcagctcctctgggaggagcccaggctggtgagcttgaggaggaaatgattaggcttctttatgggtaactgaggatatggaatttggggattgaggccttttgaggggctagcgaccttgcttaaggaaccagaagggtctgccggttcatccaggagcagaggggaatagttttaaaggctgtcattgaccctcactttctttacccaacaccctcctaacccaggatgagggatcactgaaggtaaaggttggagttgagcaagtgcggcgaagttcagtgatagaagagagacttctcttcctgtggctctgcctagtagaaaacattgtggttaagttgcagattgactataagcagaactgtccctgggatatggacaattaaaaaagctgtgctttgagggtatgaaagtggaagaaaggtgtgctgctagatgagccaaaggaatgggactacgcggcagaaagaaagaaaagacagagaatccgtgcagatgctggtcaagataggaggcactcccacactcatgcatcagcctacaaccctcaccaccaccacccactcctcactcttccagcaagacatatccagcctgcatggcctagctggcttatagcaatagcccattcccatgctcttcaatcattctttttttaaaaaaaaaaaacggagtctcgctctgttgaccaggctagagtgcaatggcgtgatctcggctcactgcaacctccgcctcccgggttcaagcaattccctgcctcaaccttccgagtcgctggaattacaggtgcccgctaccacgcccagctaattttttgtatttttagtagagacggggtttcaccatcttggccaggctggtcttgaactcctgacttcgtgatccacccacctcagcctcccaaagtgctgggattataggtgtaagccaccacgcccagcctctcttcaatcattcttgatacctttaaaaattgttttaactttgaattcatgttagacttacagaaaagttgaaaaaataatacagagtttccatatatccctcacctaccttcccctaatgttaacatctttcataacaagactgcaatagtcaaaaccaggaaattaacattggtacaatactatgcactagttaaagaccttatttgaatgtcaccagttttcccactgtggtccacttagtggaatgttccaggactgtatgcatgatctcacattgcattttgttgattttttttttttttttttttttttttgagacggagtctctctctgtcgcccaggctggagtgcagtggcgcgatctcggctcactgcaagctccgcctcccgggttcacgccattctcctgcctcagcctcccaagtagctgggactacaggcgcccgccagtacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccttgttgatatttttgagtagtctcctgcagtctgtaacagcacttcagtctttccttgtcttttatgaccttgacacttgagagttgtcagttattttgtcaaacatatctctgtttagttttgcctgatgctttctctctctctctctctctctctatatatatatatatacatatatatatatatttttttgagatggaatcttactctgtcacccagtggggagtgaggtggcatgatctcagctcacttcaacctctaactcccagtctcaagcgattctcccaccacagcctcctgagtaactgggaccacagacatgtgccactacacctggctaatttttttttttttttgtatttttggtagagacaggatttcaccattgttacccaggctggtctcgaactcctgagctcaagcaatctgcccacctcagcctcccaaagtgctaggattacaggcctgatgttttctctttattggaccaagtttatgcttttttttttttttaaccaagaataccacaaaaatgagatcgtgccatcctcagtgtgtcatcacatgtgtctcatgatcttgatgtcttatgactggtgatgctcctaattcctttttggccatcagcccccgtcctttaacacttataaggaagaaatggtgtgcagtttaaccaggttttatttgaattaaaatgttatgaaggaaaaaaagcaggaaaaagttctaagggcagaaaagtataagattagtcccccttggaatgaccctctctgtacatataccaaacattgagatgtgagtgaacactgtaattggaaagattttttagattttcaatttaaaatttcaattttacaaatcaaatagtcttggtgtttaagtgtgccaatcactgttcagtcaaaagcatactctctttctgctaagaaattacacttcaaaggattaaacagttctcagaataactgaaaacttctcatttgcttttatttaggttaacttcttaaaaccaccccccaattttaattttgatgaatttttcacaaagtgtacgaccttcatgcattattatccttctggtgagcacaaaagtaagtacccaccatggaaaaatgcctttgcctctaccagtggtcagtagggtcttatatcaatgccgacagcttcattactggtgggtgggctcctcaacacagctcctggtccttaccagcacacaaaggggacctacttcccattctccgggacagcaattctaagtatgacactccccacaccatccacctctccctaggcactgactcctttccctcatccatcaaacattaataagtatcccctaggataaaagaaaaagtaaagcttctttccgtgctgctttcccctcctaaccttcaccaataaacttctaggaaaagtaatctgtaaatgtatttatacctgctctcatgtccccttatttatttattcatccaataaatattgattgcaagcaccttgatgtctgtgctcacctgctcttcagtcttgcaccgctgacacctagcttctacgctagtcccctgctgtctactgagactgtttatgtcaaggccaccaaggaccattaatttgccaaaccaggtgacctcttctcaggcctcatcctagatggttgaccatagcttatgctcttttcttggacactaccttctcctttttccttgagttcaaaagtattattcttttctagttttgcctttacgtctcaaatcacctattttcagtcctctttgcttagtttcctttccatgtcttaaatgttggtgacttcaggtatctgtctttgaccttctagtcttctctactcacttcttagtgaaccatttattcgtgcttaacttccatatgagtaagatgaggcaagtgagaagactgtatcacaaaacttaagcagacactcactctcaaggtcctgcaagttgcttacatcacccgagtctcagacctaacagccagaattcgcttcagtcttttgtcctgaattctaggacagatttttgtcctgaattcataaaaaacaaacaaaataccctacctatgggcgacttccactggatgtcaaataggcatctaatattaacgtatctgaactttagctacttacccttccctgaaaactccatccaagtgagaaacatcagaaacatctttgaatcattctttctcatcatttatgtacaggtctggagtattttagatgttacaaatagaagactgtacttttacaaagccacaataggcagtggggtggggagtggggagactgtacaaacattgatcaggaaaggccaagaacctcagaagctccagagatgaaggagaaagcctcatgacattacccactccttgagctttactaatgccatctcctgggtcttaatggtaccttctataaagggtttcttcaggccttactttgagcaccataatactgcaatgcaattcctttttttttttttttttgagatggagtctcactctgccaccaggttggagtgcactggcgcgatatgggctcactgcaacctctgcctcccgggttcaagcgattctcctgcctcagcctcctgagtagctgggaatacagaggcgtgccaccacacccagctaatttttgtatttttagtagagacagggtttcccatgttggccaggatggtctccatctcttgacctcatgatccgcctgccttggcctcccaaagtgctgggattacaggtgtgagccaccgtgctcggcctgcagtgcaattctgatgttataaccacctggagttagtgcaggatttcattggttgaatcctctacaaacttcagacactagctgcaagctctgggatccccagaccaccggcacttctgaccaactacctacaaatctggggatctccttaatgccctcaggttcagtaattcactgaaatgactcacagaactcagcaaagtgctacacttacagttatggttttattataaaggctacaaatcaggaccagccaaattaaacacacacacacacacacattttttttcacattatcattttcttccctgctgaaaaccctttgccatttctgtctcccttattttttgactccctcaaactcattcctaccatctcttatcagtctatcctagagcataaaactatcaatctttatagtgaagggaaccatagagatcatgaagctcaactactcttttcccaggtgaggaaataggaggcaaccagggcagcaaagtgacttctccagggtcacacagtgaagcggtatcaagcctgagatcagaaaccagtcttcttaatgttattcctgctgccctttcaactctaccatccccttcattctgtcaccatgctcctctcttgtcattccctcatttgtttgttcccatctcctgtggcaatagttctaaaccaagttcagaagtgaaaatctccctaagtcccaaagcgtcatgtcagtttgaacaaggttttgagctacatgtgactgaattttgggaaacctttaacctctaagagctcctctttggatttcccctggccctttcagcccctaggtgtcccagagtctcctgacaactgtaaggacaagaaggcccactgcccaagagaatagggactgggagcctcctctcactagcactgcagagccaaacttccctctctgagcctgcaccctccttctgccttcttagacctcctgaggcttgcatgcacgctgaagcctgatcctgaactggagatgtccctacaaaagtatgtgatggaaagcattttgaagcaggtattttcaaaattgaatttactggctttggggatgtcagggatctggacagctggaattttaagatttaagaaaaaaaaaacagcagctactagtaaatagtaaaatgttccattaaaataaaaagacttcctttttttttttttttttttttttgagacagagtctcactctgtcacccaggctgaagtgcagcagcatgatcttggctcactgcaacctccgcctcccgggttcaagcaattctcctgcctcagcctcccacatgcgccaccacacccagctaactttttgtatttttagtagagatggagcttcaccatgttggcctgactggtctcaaattcctgacctcaagaaatctgcccgcctcaccctcccacagtgctgggattatgggcatgagccaccacactgagcctaaaaagacattctctatatgtaggtgactgtgaaattcattgttcaaatctcaatactttcaaagagatcattattcataattataatatgacaacaggcataaaataggactgcgttgccttatataattgcgcaaatgggagctgttgcaagcatataagaacatgcgggcaccctttctatatgccacatagcagaaagacttcaagtggatgaacattggtacactatttctccaagtcatttgcattagctcttaagttttgagatttaacaatgcaggtaattagaatactctgagctacctccaccctccaatattttctctttttattctcttaatcttggttctctcaaatttattattccatgtgaattataactatctcttatcactcaccatatgccagtcactctgctagttcatgtatttattctttacagtccttggtagatatttttatcctcattttatatgcatgagaaaactgagacccagagaacactacagcctttcctgaggttgtcaagtaaaagatatagctaggatttggaccctggtctatctgacttctacaatttttgcacaggctatccaccctcctaatatatgcctgctttaatacttagtcccatcaaaatgctgttgtgtcctggaggaaatctttgtaacaaaggcctgtccagtgggtagctgccttcatagagtgaattggagaggtatcagaatgcaccctgccaccttcagcccattgtaaaaacattacccctagtgcctgcattgcttgactcttcatggcttttgaagcttaaaaaagtcaccccattctcccccagccattctcaagagatataatacattatgcttctttaattgcaaccagttgaaaacaaggtctttagcaatggaatataagatggactctgtgagtcactgggaaaattccaggtaggaaaaatgtttacctggtgaagaggtacagctaagagggttgaaaataagaccaaagacaaccttttacaactttaccaaaaccagaccctgaacccaaagaagagaagtccttaaagataccgtagtcctcttttccaagccaaaactcagaatacatagtctgacagaagttttttatttatttgtgaatgattttatttgaaaaatcaaggccaggctcatgcctgtaatcccagcactttgggaggcccagacaggtggatcacttgagcccaggagttcaagaccagcctggacaacatggcaaaaccccatctccacaaaaatacaaaaattagttgggtgtggtggcacgtgcctgtagccccagctactagggaggctgaggtgagaggatcacttgagcaaggagacggagcttgcagtgagccgagatggtgccactgcactccagccttggggacagagcaagaccctgtctctaaaaaaaaaaaaaagaaaagaaaaaaattagcacattggttaattagaaattattaaatctcttttataaaaagaataaaattacatgaaaccaggaccttctaggcaattaggaagcatggctgcattattccctataccaattccttctttaatctagaaaatgtgtttcacattgtcgttgaagaatctgacacttctgtgctatttcggggagaaagtgcagtgattttcccccattgatttgctatgtatttaattaacaaaattcagggatgatgattggcagggataatttgggaacactctcctttctttcttttttttttttttttgagacagagtctcattctgtcgcccaggctggagtgcagtggcgcaatcttggctcactgcaagctccgcctcccgggttcatgccattctcctgcctcagcctcctgagtagctgggactacaggcgcccgccaccacgcccggctacgtttttgtatttttagtagagacagggtttcaccgtgttagccaggatggtctcgatctcctgacctcgtgatcttcccgcctcagcctcccaaagtgctgggattacagatgtgagccactgcgcccgacccaacactctcctttattttccctgtgcctgttgtgttggagagaagaggggaactaaatgaaatataccaccaccccagagaggcaggagagtgtggcagattaaatgttagatgagccaagcgtgatggctcacgcctgtaatcccagcactttgggaggccgaggtgggtggatcaccaggtcaggagttcaagaccagcctgaccaacatggtgaaaccttgtctctactaaaaatacaaaaattagccaggcgcggtggcacacacctgtaatcccagctactcaggaggctgagacaggagaatcgcttgaacccaggaggcggaggttgcagtgagccgagattgcgccactgcactccagcctgggtgacagagcgagactctgtctcaaaaaataactaactaactaaataaataaataaatgttggatgaggagtctggagatttggattctagtttattgtgtccttatgtgaccttgggaaagctgtgttacttctccatacatcagttatctaatcggtaaaatggggataataatactgatttcattttgtttgaacgtagagtaggacagaatgtgaaaacattccagaagatacctaatgaaaatggaagtttgaattacatagcatgctattcttatccctaactataaaaataagagagccaaactcccagatggcatctgtggacctgcctggggcctggaggaactcatcaccctgaagggaaagacacaaacctggctggctttgccacctgctgattgtagagtgctagagccttgaacaaaaataggtggtagcctggtagtagtcacagtgggccttgggcaatatccagtgctgtgctagcttcaggtctgacccagtgcagtctcagtgatggtagccacaagggtgcttgtgtgaccccacccccagctccaagcagctcagcacagagaaatagagactccatttgtttgggagaaagtaagggaagagaacaaaagtctctgcttggtaatccagagaattcttctggatcttatttaagaccacaaaggtggtacctctataagtctgcaagaaccatagcattactgcacttgcggtgctctgtaatatagatatggcttagatcacaacacccaagtttttttgaatatatggaaagccttcccaaggagggcaggtacaaacagtcctaaatgtcaaagactacaataaatacctaactcttcaatgtccagacactgacgaacttccacaagtatcaagaccatccaggaaaacatgacctcaccaaaggaactaaataaggcaccagggtggagagacagagatatgtgacctttcagacaggtaattcaaaaaagctgtttgaggaaactcaaagaaattcaagataacacagagaaagaatttagaaactttcagccatgttaactaagaacagaagagaaaagacccaaataaataaaatcagaaatgaaagaggagacattacaactgataatacagaaattcaaaggatcattggtggctactatgagcaattatatgccaataaattggaaaatctagaagaaatgtataaactcctatacacatacatcctaccaatattggaccctgaagaaatctaaaacctgaacagataaataacaagtaacaagatctgggacccgaagtattcactgctgaattctaccaaagacttgaagaactaataccaaccgtactcaaactactctgaaacatagaagaggagggaatacttccaaactcattctacaaggccagtattaccctgataccaaaaccagacaaaagtacatcaaaaaaagaaagctacaggccagtatctctgatgaatattgatgtaaaaatcctcagcaaaatactagcaaactgggttcaacaacatattaaaaagatcatccatcatgatcaagtgggatttatcccagggatgcaagggtggttggacatatgcaaatcaaacactgtgatatgtcttatctacagaatgaaggacaaaaaccatattatcatttcagttgatgctgaaaaagcagttgataaaattcaacatcccttcatgataaaaattcccaaaaaactgtgtatagaaggaacatacctcaacataagaaaagccatatagaatagaccgaccactagtatcataatgaatagggagaaactaaaagcccttcctctaagatctagaacacaaggatgcccactttaccactgtttttcaacataatactggaagtcctatgtaatcagacaagagaaagaaagaaatggcatacaaattggaaaggaagaagtcaaattatccttgttttcagatgatcttattatatttggaaaaacctaaagactccaccaaaaaaccattagaactgatacacaaattcaacaaggtcacagtatacaaaatcatcatacaaaaatcagcatttctttttctttctttttctttttttttttttttgagacggagtctccctctttcgcccaggctggactgcagttgcgctgtctcggctcactgcacgctccgcctcccgggttcactctattctcctgcctcagcctcctgagtagctgggaccacaggcgcccgccaccacgccccgctaattttttgtgtttttaatagagacgaggtttcaccgtgttagccaggatggtctcgatctcctgacctcgtgatccgcccgcctcggcctcccaaagtgctgggattacaggcgtgagccaccgcgcccggcccaaaaatcagcatttctatatgctaacagggaacaatctgaaaaagaaatcaagaaagtaatcctgttaacaatagctaaaaataaaataaagtacctagtaattaaccaaagaagtgaaagatctctaccgtgaaaactataaaatgttgacacaagaagttgaagaggccacaaaaaaaaaatgaaagatattccatgcttatagattggaagaatgttcatactacccaaagcaatctacagattcaatgcaatacctaacaaaataccaatgacattcttcacagaaatagaaaaaaaaaattctaaaatttacatggaaccacaaaagacccagagtagccaaagctatctgaagcaaaaagaataaatcaggaggaatcatattatctgacttcaaattataccacagctatagcaacccaaatagcatagtactggcatgaaaacagacacatagaccagtggaacagaatagagaaacaagaaataaattcatacatctacagtgaactaatttttgacaaaagagccaagaatataaaggaaaagacaatcccttcaataaattgtgctgggaaaactggatatccatatgcagatgaatgaaactagactcctatctcttgctatatacaaaaatcaagtcaaaatggactttgagacatcaaaccatgaaactactacaagaaaacattggggagactctcaaggacattggagtgggcaaagatttcttgagtaataccccacaagcacaggcaaccaaagcaaaaatggacagatgggataacatcaagtgttttttttttttagaattattttatcagataaaaaattagtttcattgatgagtttttttaatcttttatttttatatttatttatttatttttattatacttttaagttctagggtacatgtgcacaatgtgcaggtttgttacgttatgtatacatgtcccatgttggtatgctgcacccattaactcatcttttacattaggtatatctcctaatgctatccctcccccttccccccagcccacgacaggccctggtgtgtgatgttccccaccctgtgtctaagtgttctcattgttcaattcccacctatgagtgagaacatgtggtgtttggttttctatccttgtgatagtttgctcagaatgatggtttccaacttcatccatgtccctacaaaggacgtgaactcatcctttttatgggtgcataatattccactgtgtatacatgccacattttcttaatccagtctaccactgatggacatttgggttggttccaggtctttgctattgtgaatagtgccacaataaacatacatgtgcatgtgtctttatagcagcatgatttataatcctttgggtacatacccagtaatgggatggctgggtcaaatggtatttctagttctagatccttgaggaatcgccacactgtcttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatgtctctgatggccagtgatgatgaacattttttcatctgtctgttggctgcataaatgtcttcttttgagaagtgtctgttcatatcctttgcccactttttgatggggttgtttgatttttttcttgcaaatttgtttaagttctttgtagattctggatattagccctttgtcagatgggtagattgtaaaaattttctcccattctgtaggatgcctgttcactctgatgatttcttttgctgttcagaagctctttagtttaattggatcctgtttgtcaattttggtttttgttgccattgcttttggtgtttcagtcatgaagtccttgcccatgcctatgtactgaatggtattgcctaggtttcttctagggtttttatggttttaggtctaacatttaagtctttaatccatcttgaattaatttttgtataaggtggaaggaagggatccagtttcagctttctacatatggctagccagttttcccagcaccatttattaaatagggaatcctttccctatttcttgtctttttcaggtttgtcaaagatcagatggttgtagatgtgtggtattatttctgagggatctgttccattccattggtctatatttctgttttggtaccagtaccatgctgttttggttactgtagccttgtagtatagtttgaagtcaggtagcatgatgcctccagctttgttctttttgcttaggattatcttgacaatgcaggctcttttttggttccatatgaactttaaagtagatttttccaattctgtgaagaaagtcattggtagcttgatggggatggcatggaatctataaattaccttgagcagtatggccattttcatgatattgatttttcctatccatgagcatggaatgttcttccatttgtttgtgtcctcttttacttcgttgagcagtggtttgtagttctccttgaagaggtccttcacatccctatataagaagctgtaacagctctatagaaaaaaatctaataatctgattaaaaaatgggtaaaaggtctgaataaggccaggcgcagtggctcacagctgtaatcccagcactttgggaggccgaggtgggcaagtcacgagatcaggagttcaagaccagcctggccaacatggtgaaaccccgtctctactaaaaatacaaaaaattagctgggcgtagtggtgggcgcctgtaatcccagctactcaggggctgaggcaacagaatcacttgaacccaggaggcggaggttgcagtgagatgagatgtgccactgcactccagcccaggtgacagagtgagactccgtctcaaaaaaaaaagatcgaaatagacatttctcaaaggaagacatacaaatggcaaacaagtatgtgaaaaatatgtgaaaaggtgcacaacatcaccaatcatcagataaatgaaaatcaaaactacaataagattatcatcttaccccagttaaaatgacttttatccaaaagacaggcaataacaaacgctggacaggatgtggaaaaaagggaatccttgtacactgttaatgagaaagtaaattagcacagccaccttggagaacagtttgaaagttcctcaaaaagctaaaaatagagctaccatacaatctagaaattctactcctagatacatactcaaaagaaaagaaatcaatatattgaagagatacctacactcccatgtttactgcagtgctattcacagtagtcaagacttggaagcagcttaagtgtccatcaacagagaaatggataaagaaaatgtggtacatatacacaacgaagtactattcagccataaaaaaaatgagatctgtcatttgcaacaacgtggatggaagtggaggtcattatattaagtgaaataaaccaggtatagaaagagaaaccacatgttctcacttatttgtgggagctaaaaattaaaactattgggctgggcatggtggctcatgcctgtaatcccagcactttgggaggccaaggcaggcagatcatgaggtcaggagttcgagaccagtctgactaacacagtgaaaccccgtctctactaaaaatacaaaaattagccaggcatggtggtgcatgcctgcaatcccagctactctggaagctgaggcaggagaatcgcttgaacccaggaggcagaggttgcagtgagccgagatcgcgccactgcactccagcctgagcaacagagcgagactccgtctcaaaaaaaaaaaaaaaaaaaaattaaaatgattgaactcatgggggtagagaatataaggatggttaccaaaggctgggaagggtagtgggggatgaggaggaattgggggtggtcaatgagtacaaaaaaagagaaagaatgagaaagacctagtatttgctagtacaacagggtaactatagtaaaaaataatttaatcattgatatggtttggatttgtatcccctcccaaatctcatgttgaattataatccccaatgttggtggaggggactggtaggaggtgattggatcataggggtggattatacccttgctgttctcgtgatagtgaatgagttctcatgggatctgattgtttaaaagtgtgtagcactccccctgctctcctctggccatataagaagtgcctgcttctccttcgtcttctgccatattataagtttgagtcctccccagccatgcttcctgtacagcccatggaactgtgagtcaattaaacctcttttccttgtaaattacccagtatcaggtagttctttataacagtgggagaacggactaatacaaccatacattttaaaaataactaaaagagtataattggattgtttgtaacacaaaggataaatgcttgaggggatgaataatccatttaccctgatgtgattattacgcattgcatgcctgtatcaaaatatctcatgtaacacaaaaatatatacatctactatagacctacaaaaattaaaaaattttaaatttttttaaaaataggagagccaaaaagaacagtagttatttcccttattgcaatggctcatattggcatgaggaagccagcagttggggtaatggagtggttgctggccaaaaattagcacatgcataagtccccactggaagagagggattttgattatatttccatctgctccacttcaggcatgctggctctgtcatgttgtacctcacccattctgaggtagacattccctagatgatttcgggtatgaggtgggggcggtgttgggggagggatccactgccaaggacacctacagaaagctgctctctactttgcagattgataacaaacagcttcagggctatttatctgagcttcgcccagtgacgattgtgtttgtgaacctgatgtttgaagaccaagacaaagcagaagagataggcccagccatccaggatgcctatatgcacatcacttctgtcctgaagatcttccaaggccaaatcaataaagtcttcatgtttgacaaggtaagtgtgaactatgggatgggaacctaccaatagttttaggttagcattcatggacaagcacattggtgagaatagacacaggaaatttaacctagaggctgggcgtggtggctcacgcctgtaatcccagctctttgggaggcagaggtgggcggatcacttgaggtcaggagttcaagaccagactggccaacatagtgaaaccctgtctctactaaaaatgcaaaaattagctgggtgcggtggcacgtgcctgtaatctcagctactcaggaggctgaggcaggacaatggcttgaacctgagaggcggaggttgcagtgagccgagatcgcaccactgcgctccagcctgggctatagcgtgagactccgtctcaactaaacaaaaaaagaaatttaacctagaaggccagtctttgtttataattataacttctatggtggatatggcacttactatgtgccaggcactgttctcaggacctgatctctattgactcatttcatcctcatgaccactctgagcagtaggttgctcttgtcattatcctcattatatagatgaggatgctgaaacacagattaggataccaggacaaggcgagattacgttttgcttatgatcatcaagctagtaagggggaggctgggattcaaacccaggcagtctgccatccccgtctgagctcactatgctgggctacctctcactacgctgggctacctctcactacacataagtctccagctcagtgcatgatgtattacccaggggtttcaggtcaggagtctttagtaaccatcttaccccagaagcttgtttccaagaaagcccacttgccatgtcaacacctccagttccccttttattttcatccatggcagggaggggactgcctctggctcccaggtgttttcgctctgttcttttttttttttttttttttgagacggaatcttgctctattgcccaggctggaatgcagtggcatgatctcggctcactgaaacctccgcctcccgggttcaagcgattctcttgactcagcctcctgagtagctgggattacaggcatgcgccaccacacctggctaatttttgtatttttagtagagatgaggtttcgccatgttggccaggtgggtctcgaattcctgacctcaagtgatccacctgcctcggcctcccaaagtgctgggattacaggcatgagccactgcacctggtcttcactctgttcttaatcaattcagagaaaagtgatgtgatgaacaaatgaccacagatgcatatgtgagaattgatttcccatctcaattccttttgtgtattaaaagcagagcacttaattactgccccacatccactcactcactaattcaacaagcatttactgagcatttcatagaagacgaaaagctagggctgggcagcagagatgagtaacacatatattgacacaaccaggcaggaagcatgcattctatatgagacgaactaactctgtgctatgggagttctggaaagggattacttccagcctggtgtctccagtaccttcttcaatactgacccatgggtatcataagaaaagagtgtagaatctaagagaacagtctttcgtgtcttgcagacatggctccaaagattcccagctgtgagacttagcaagtcattgaacttctctgagccttggtttattcctctttgaatggggatagtatttgtctcaaatgattgtggaaagttttaaataatgtaatatgtgtgaggcacttggtgtaatgcctatcttagagtcagtgtgcaataaatgagagctgtcattccattgctagggggaatcaaaagctcttgccaggccgctacataaatttgcaggcaaaagctccctgcttcccccaaaggggttgccctctttgcacgtacctagaagcagtgtttcccccttcatgtcaaggcagatcccagtcctttttaagatctaacagttgatcaaattcttttggagagggttgaagaaattgaggtattttagtgttctttgcattttatcaggatgtaacatgtcaaaaactcaaaatttcaacccatcaccctttattcacaatgcccttttcttacagacaacagcacctgactgaggtcattttttaagtgactaatactacaaatgccaagttttagagttgaatcattgcatggaacagttagctttatgataagaaaacctacttacagcctaagcctttatccctaagaataacagtatctgcaaagtactttatagtttaggatgactttttgaatatatataacacattaattcttttagtagccaaaaacatctcagcaggtctacagtatatccattttcagagagataaacggaagttcctagattgtaatagacttatctaagtttccacacttgagaagtggcttgaggacagagactttctgattccagagctggtgccttttccactgctctgtgctgctgcttcatagacttaaactgagcactttgcagcatggaccttggccacaggagagagtaggccgaagcatgcacacagatagctcagccctattcactatatctggagcaaaacaagcccttctcaaggctcaagccctcctgttgatgatgcagtagaagtgtttgaagtgtactaaaaataaaatactgtgagagaaatcatgataaaatctgattcagaagccaaaaattgccgccggctctctgttgagccttctggccagtccagtttaaagcacactgtccatcagctgtggttgctgtctctctccctcacagggctgctctttcctctgtgtctttggcttccctggggaaaaggtacctgacgagctcactcatgctctggaatgtgctatggatatatttgacttctgctctcaagtccacaaaatccagtgagtattgaccctggtcccacccagcggtccctgacccttttgaggcataagtagggagggcatgcagggaacaggaaagaaagaagaattaattaagaacttagtcctgtgtctcaaactgttgttcctccttcgcatctccgggccatgtagaaatgccataaactaattccaacgggtagagaaaatcctttcccaccctttcccaacccagacattatttcccacccttcccactttctctacgctcattatctttatttctttccccacaaatcttgtctcccctgcaccagaactgtatccatcggtgttgccagtgggattgtcttctgtgggatcgttggacacactgtgagacacgagtacacaggtgtgctgggtcagctcatctccagctttctttctgcaaacacagcaccttgccactgggctttgcgggaggaagcacaaaaatgagtgagacatgagccctgccctcagaaactttagagtcttccagatggagccaagccatggagccctcaatgcttgcagagtgtgcatttctggggctatgtatgagtagagaaatatgtagtcatgagaggggagcagtgggaggctatatgttgatggaatgaggggctcctgtaatactttcctgttaacattaaatagttacttctcttaattcctggaataagctagaactccttaaaaattatgaatgttgatattactgaaaaataatgacactctcaaaagagagtagtaataagtaaatcttatctccagatttcacaactctattacttcccttttccatcctatcagggtttaagattttcagcaataatgcatctaaaatactgaatatatgtaaaataccacgatagttatgtctgaaatgatacaatgtctgagatgttcttcaaaagtacacagggtggggagtgtatgggggtgaggatggggcaggattagccatgggctaatggcttgttgggatggggtgatgggtatatggaaattcattatattttattttatggtcaaatttctccacaataaatagttttcaaaaagagtaccttgttcagaagtattcaagtttatgttaaagtgacacatttgctacctcatttgtagtaatattaattgaaggcttacaagcagccagctgctgttgaaagtgataaacgtgtattaactaattaatcttcataaaccaccctctcagagagttactattatcatccctattttataggttagagaatggaggcatgaggagttatttaaagtaattgtcccaagtagtttgcacatagttaggggtagagctggtgttcaaccctgcacagtctgccttcagagcctgtgcttcaatcctccatgcacgcctcttctagcccatttactaaatcgagaaatcgccaaatgaaggtttattcataggagcatgcagacacaattttatgtctcatatggagatcagtaccccaggcccaagcatgtgcttgtccaccttgtggcagaagaccaactgacaccttctctgagagccttcagtgctgtggccatcccacttacagagcctgctccatactcaagccccttccatccctgagcaggtcattctcttgacctcccaagtgaggcagaaactttgctaatggctaactaactccctgcacattttgtgaatagccattggctgaatatgggtcttgagactaggcttctgtgtcactcatgaacagcaaagggagtaaagggtaaaaatgctatttggggacaatgtttcagattacattcagttcaatgcctgttatttccctgatctttgactttctctttcttgctatagtcattggtcaaaaagtcaacttagctgccaggatgatgatgtactacccaggaattgtgacctgcgactctgtcacctacaatgggagcaacctaccagcgtacttttttaaagagcttccaaagaaagttatgaaaggtgttgcagattctggaccattgtatcagtattggggccgtactgagaaagtgtgagtgtggagcattaattttgaagtatattttagtaaagaagcgggagaattatgatagcaaagcagtcacccatttaagatttggagccagttcaagaagttgaaatctatgctttccccagaccaaggcccagacttcaaaatccttaatctttcctccatctgactgacactatggcatggtggaaaatcccattctctcctcagatctgagaatatgagggtaattcttcaaaggttgtacaaaccaaacaaaaaatcctctcatttgagtatctatttgcacccaaatgggcccaatcaccaaccatttaatattatttactaattatgtcaactgtatgccgaggcattgttagggttaaaagagtataagatattatttctcctctaagtctttagtgaaatacattccccaaaagctcagcatagatttatgggtgtcactttgaagcttaaaatccttcaatggctttcagtcattttcatggtgatgttcaaaatctttgcagtgacatacaaggtaccacctgcctttccaacctcatctcctcctgttccccctcctctgggttgtttaagtagattgtcctcatcagcacccacctaatcctggtctattgggaaaaccgcagtcaatttttgaaacccagctcgagggattcatagacattcctctatgaattccccatcccagctagacagttaagctctttccccctttgtcttccttcttcctcttccttttttcctcctatagcatatgcttctattagaacactccttgccctatatcacaattattcacttcctacagttttcacttgttacactgtgaactctttgaagatactaattatttctttattcttatatccccagtgcttggtatacagtaggtcctcaataatgatgaataaatgaatggcacagagagcagaaagttgttattcattagattagcaagctggaatcgaggtcttcaagagtcagataacagaaccagggctgcagttgggtcaaggtgtctttattattcccttcagtattcctgaggcttagcactgtgcttggcatacataggccatcaataaagtgcagtttgaatacatgaatgaataataatttttagtgagtacttattaaacatcaggtactttacctcaaaatatataatccagtcttaatattgaccatacgagatagaaactattataatttccattttataaattcaaaaactgaggctcagagatgttaaatgacttgtctatggccatatctatagtgagcaatggagtcaagattcagtcacaataatgtgaccttacgggcaatcacaaaacttcagtggtgtgcaaaaataaacatttatttttctcacaaatgtggggttcaattgatcttggctggatttggttgatcttgtcttggcttattcacgtgcctggggttcaacagactgttggccaacctggcggcctcagttgggataactagggcaatctggctctatgtgtctcatcttccatccagcatgtttgtcctggcaatactggaggagcaagagagcaggcccaatgcaaaagcatttttcaagcctcttcctatgtcttatgtttgcagatagtccattgacaaaagcattcacaaggctgagtccagaatgagaggactctgccaagttacacagcaaagggcacagatacaggtactggggccattaatgcaatcagtttactatgcaaacccaggactatctgatcccaaagcctgtactcttcatgatttttctgtaccacctctgcagataaaagtggagaaatacacacacagtatgaacagggcctagttcctgcccagaaaactcacaatcaagtggggaagaccaacatacacaaacttagctgtatgttacatgggaacctttgatatatgctataagagaggcataacaaagtagtattgtagttcagagaagggcataatccattttgactaaaaggcttcttcaagagatagtgttatggagtgagcaaacatatgcaccctggcctatgtttggatactgtcagtatcctgtgttaccacctgctatggggtcttgggcaattaaactctttgtgcctgaatttcctcactggcaaaatgaacataagagtagtacttttttttttttttttttgagatggagctttgcttttgttgcccaggatggaatgcaatggcgtgatcttggctcactgcaacctctgtctcttgggttcaagcgattctcctgcctcagcctccagagtagctgggatggcaggcgcaagccaccacgcccagctaatttttgtatttttagtagagacaggttttcaccatgttggtcaggctggtctcaaactcctgacctcagatgatccacctgcctcggcctcccaaaatgctgggattacaagcatgagccaccgtgcctggccagtagtccttttttttctttttgagatggagtctggctctgctgcccacgctggagtgcagtggtgcgatctcggctcactgcaagctccccctcccgggttcacaccattctcctgcctcagccccctgagtagctgggactacaggcaaccgccaccatgcctggctaatttctttttgtatttttggtagagatggggtttcaccgtgttagccaggatggtctcgatctcctgacctcgtgatctgcccacctcggcctcccaaagggctgggattacaggcgtgagtcactgcgcccagccaagtagtacttcttaacagtgtttttgtcaggattaaagaaaatgatgcatgtaaagcacttggaactgcgccagacacatagcatgtgctccaataaaaggcgcgctattattgtttgagcaattggtggaatctttgcaggatgtgtgactctgcaccacattgaaatctactgggtcgtatatcaggtgtctgatctccccagaaaggggtttctctaccagtgcagactcaacaagcatttattgaacaatgtgccagatgctatggaaacagatgctacctgagttctttggattctccactaccaagtcagaccttctcctttctccttcttttggcgtttgcgacccttgagtcaggggatagactcttgttagcaattgagaaggaaactttctgggaactaagaactaatcactcttgctctcaatatgtccctgttttgaatctagcatctgttcttttgttcttctcttcagcatgtttggtatggcgtgcctcatctgcaacagaaaggaggattaccctttgctgggtaggtagtaggccttgattttaaacttctttattgaactaaaacaaaacatgcagaaaagtacatcaatgataactgtgcagcttaatgaattatcacaaaatgaaaatataatcatcatccaggttaagaaatagaaaaatagcaatacaccaggattactctttccttcttcctttccccaaagtcttctaacaccctcgattacttatgcctgtttaaaaaattgatacagatggaatcatacattgtataattatatacggcttatatatactttctcttactcaatggtatgttatataattcatccatattgttgggtgtagctgtaatttattctatgtcattactatgtagtattccatttttataaatatacaacaatttacccattctgttgctgtgcaacatttgggttatttccagtttttggttcttatgaataatattgccataaacattcttacacaagtcttttggtgaatgcatgtatgcatttctgttgagtacaaggtaggagtaaaacgtaggactgaaattgttgggacaaagggtgcaattttggtcgattatgccaaatagttttccaaaatggttgtatttatttatattctgactgagaatgttaagagagttccagttgttcttcatctttggcaacaacttagttttatcaatctttatcctttcaataattctgttgggtgtatagtggtatcttattatggtttccatttgtatttccctgatgtggttgagctccttcttcataagtttattggccatttggatttatttatttatttatttattttgagacagagtctcactctgttgcccaggctggagtacaaaggagcaatcttggctcactacaacctctacctcctgggttcaagtgattctcaggactcagcctcctgagtagctgggattacaggtgtccgccaccatgcccagctaatttttatattttagtggaggcagggtttcaccatgttggccagactggtcttgatctcctaacttcaagtgatccacttgccccagcctcccaaagtgctgggattacaggcgtgagccactgtgcccagcccagacatttttttaaagtacctgtacaatttttcacctatttttcaactgggttatattttgattatcttttggaattatttacacattctagagatgggtcctttgtcatttgtttctactgtatatcacttttcccactctgtgtttgcctttttactctcaattatgcatttaataaacagaattcttaactttaatgtaatcaaatttacctgtcttttatagttagtgcttctgtatactatttgagatacctttccttacccaaaaatcatggagatatttttctagcatttttttcagaaattttgtttttaccttttatatttaagtctacaatccatttggaattgatatttttgtgattcctggtgatagggaccttattgtaagaaagataactcgagattagacaggggagtagacctaaaatgaggaagggatatacctataagagaagagacccaaagaagattgacctgtggattctgaaggcagccacttctagtagcacttgtaatttccttctgtcagacacgaacatccccaaaagtcttatcataagttaaatcttggtcctaactgtgtcaaggcaattaagaggaggctctgtctcacactttggagaaatattgggccacaatcttggtgtcagcagagcctgaaggagggcaacagttccagaactgcaaaaaaacacttgggccagcagaaatgcctcactttcactgctttcaggtagttttcagggtcttcaagccaatcacttcatttaagtccagattccaaaactcctgaagctagagagaaggaatacccactctcaccctcctcagaggccttacttttcatcctaggatatacttattttactaactgacagcaacagaatcctaaccttctttctacaagattgcagacccaacatgacagtcacattagaacacattatgtggatatttcttttttttttcttttgagacagagtctcactctgtcgcccaggctggagtgcagtggcgcgatctcagctcactacaacctctgcgtcccgggttcaagcgattcttctgcctcagcttcccaagtagctgggattacaggtgcacaccaccacacccagctaatttttgtatttttagtagagacggggtttcaccatattggccaggctggtcttgaactcctgatctcgtgatctgcccgccttggcctcccaaagtgctgggattacagacgtgagccactgcgtgcagcctatgtgtatatttctcagtctgatctagttgcccttttgcactgattccaccagtatgacataaagatcaggtccacatacctttccttcaagctataaccaaacacagattgtcagaggctagcagcatgggaaatgcccttcttttacaagggctgctataaatgaaattgcaacagcatggttgacaacaaaactataataaataaatagtggctttttagggtaaaaactgcatacaacagtccccgatattgaggctttgcttagatagaaacaaggtgcatgcatttcaagttaaggagacaatctcattttagaatccagctaaagatactccataaggttctaccggtaggtgttctgtatgaatagaacacagggagctggaagagtcagctatgcaggcttttttttttttttaagcttccttaggaaactttattttttttgagatggagttttgctcttgttgcccaggctggagtgcaatggcgccatctcggcttactgtaacctccgcctcccaggttcaagcaattctcctgcctcagcctcctgagtagctgggattacaggcatgcaccaccacgcccggctaattttgtatttttaatagagacggggtttctccatgttgaggctggtctcgaactcctgacctcaggggatccacccgcctcggcctcccaaagtgctgggattacaggcgtgagccaccgctcccagcctggaaactttattattttttatttatttattttttattattatactttaagttctagggtacacaatgcacaacgtgcaggtttgttacatatgtatacatgtgccatgttggtgtgcagctatgcagcctttgaagcctcatcttctaagttcctatgtgagcttcattcaggccaaagaaaaacacaaaacatctcacgaaattgaggttcaaatgcattttcagaaagggaatatttcacccaaaagaagcaatacagtctgctaagtagttctcactaagccatactcagaaatgtatattaccaagcaaagcacttagcttctttttattaaatgtctacacttgaattaatggtccttcaacaaagacattagataatacctggatatttatttgttctatcagtgaataacaaaatgggcctccacattcatctgcccagcacagaaggaatagttagctctcaatgagtctccaacttttttgacagaaattgctcactgcttagaaattacaattcttacagctccttacagcagggtttcagatttcacccagggctgttacagtatttaaaaacacacaagaaaaataagggttgtaacccaaggtgatttttatttttttcttttccaagttttccatattttctacagcaagcatatgttagttttataatcagaaaaaacctataatctattttcactaagaatttaagttgctcttatgatagaaataatctgtacatgatttctgaaggcaaattgaattttatccctggtaatgctttttgtagccctgaattaagtataatcttcatttacagagggcaaatttcctttatcacagaatcagaaataaaaatattttatccataattgtttaatgtaggaaaactaactttaataaatttatttcctaatgtaatagtctacatattacttctagtgtgttgaataaaaacaaaaaacaaaaaacaaaaaaaaacaagctttagggttagatagccttggcttaattcctggttgtgtaatctaagcaaatctcagttttctacactataattaaacattataatgaggattataagaatactttctctcacagcttctaatcaaatgaaactgcaaaaccacatggttagctaaaaagctcccaggaagatttaaacaattttgaaagtgcataaggcttgaagaaagtctgtgaacaatgccatggaaattccaagtttttttttttttttttagatggagttttgcttgtcgcccaggctggagtgcaatggcaggatcccggctcgctgcaacctccgcctcctgggttcaagcaattctcttacctcagcctcctgagtagctgggactacaggcacccgccaccaagtctggctaatttttttttttttttttttttgtattttcagtagaggcagggtttcatcatgttggccaggctggtcacgaactcctgacctcagcagatccgcccacctcggcctcccaaagtgctgggattacaggagtgagccacagcgcctggcccaaggatatttttagaaggagggtttctatgtgactttttatatctctagactattttacgttgattgagtttgctcttttttaaaactaaaaataacaggacgtaataaagagatcaactacttcatgtatactatgaagaaatttttgatatctaacagcagccaagtcttaatgtatgagggattaccaggatatggaaaaagccagatacttatgaaaattgagtacctggcccaaggtaagaatcacaggtgagtgtcttggaatgattgttctgtgtgaacccatagaatcctgatttattttgatgctcctctccttcctataacttgccttatgtaaattatctataacctacaattattggatgccatgacccttgtgctaaatagataactaacaataaacacatagagctaagaaaaagagaaactgggctgacccatggatatcctgatttaatgccaggaagggcttggttatttaaagtttcctaagtaatcccaatattcagacagatcgagaacaattggcatagatgttgagatcaaggctagatttggtctgcagaacaaacacttaagtttatccagctagctgacagtgtagcaggaccagctgcagacaaaacccctcagacaccgagatagtgaagggagtggctttaatcagctgggagaatcggcaggctagcgtctcaaaatccgagctcgtcaaggtgctcaacttctgcccttttaagggctcacaactctaagggggtctgcatgagagggtcgtgatcgattgagtaagccagggggtacgtgacaggggctgtgagcactggtggtcacagtgaaacagaacagaacgagagatttcacaatgtccttccatacaatgtgtggaatctatagataacaacagttgctaggtcaggggtcgaattttaactaccaggcttaggtcaggcaggcccaggcctggtttcgggtctggttcttaggcgccgggctacctgcctttagtttcgcttctctgtccttttctgagtataaaacaatataaaacaatatgagagggtctctctcttccctcatttcccccgtttgagactctcactttttattagtgggagttctcactcttatttttgccacttatgccttcttgtgcaatagattgatagtgattcatatagtacacttgtgttgaggcattttggtgaactaaggtagcaatgaagctttttatcatttgaagaagtacaggcagcaagcaagggagcagtaagcaggtttctattactattataactcctatataagagttttaaatcctcctagtgctgggaaccaccttctaaacatggcttcagggtcgaatccgtgctacactcgtacgggcatatgtgccagttttgtcatgtttttaactatgtctttaactacgtctttaactacttgcctttgattatctatgtgtagacagtaattagtaaggttaaatttttatagacctctctttcagctgctagaagtagtcgagagccaatctattttgatagatagcatttcttatctgagtttcttgccgggccagaatagtcaaggcttgactggttttattagtgatgatttctaaaacagcttgcaaccgtatgattcagttgagcatgtaaatgggggtctggtatacccatgagccatcttgtgtctaagtggcaggcctatagtattgtataattttttaggtggtcattcatcatctttttaattatctatggctatgtttcgcttttcgcggaaagcatagacagggaagcccaggagttcgcctatttgtatgggcagtaggaagaaagatggtttaatagtgccaataacacaactacctgtccactggtcaggcagcttagcgtaggttctatgtccacgtatccagtatagcctagtggggggctgtctagtcccggtggaattctgggtgggcttaaacggtctgcaactttggaaatttactgaatggatttttatctgtgtggtttgaactccaccatgtaactgtttttgtggtaccattatacagtttttgtcctaggcaactaagtcatcctacaggatgagtgaattctttccttttttcagctatgcaatattgtctaataattgagacttttagaacctagaaatgatcagggtgattcttttgggccgggaattcatcaggaactgggtctgtaggcactaattctcgggcttcttatgccattgatctcttattacagtttctccacaaacgtaacatgaggtgacatttagagactgggctacatgctcggctaattgcaaaaacaaatttctggtttttcctggagtctctggtactggcacatttagttaatcatagaaagtctgaaatactggttccggagagagtttacgaacctcctcttttactaaggtatttactctaggatctagtccttttttatcgacgcccagagatacgtgtacttctttttttctaccttgggtttaagggatttgtaattactaatttcaaggggttgcagcttccactcgtacaggaggggctgccttctcctttttggagctaaacagggtctttttcatcctttttctaagtagcctagatgacacaagaccagtaattacacacatttgcacatgagcttaattcgtggcagatatacttatttcctgctgtgtaacttttttttttttcagtttaaagaaccgcatcttattctatgccgattgctattgatagtggcacaagcattaaattttagtgttacatgcttggggatccctctttcttctgtcttagctattactttacttgtgtcacctagaaaaggaccagtccttaatttattttaaaaaactgtgatcattggaggcttaaaatgggtcataacacacatcaggttggttatttcctaggctacataccttggatagaatagcattatacaaacaagtttcttttagagtcctcgtacacttataataaccatgaaataataggactgtagcaatcttttgtcctacctcagtgacttgatgtatatactgggaacagttctcagtctgaggaaggtcagttgaagtccttactgtacaagtccaaattttaaggaaaatgagtcccgtgatgagttttctcatgcttcggccgtgcgtggaccagtcagcttccgggtgtgactggagcagggctttttctgagtcactttgcagaggttggtgaagctgctcccatccacgtacagctcccagtttactgatgtttaaggatggttttggaggttgggcccactagaataaactgagtccaacacttctacacagttatgtttaactgggctctctgataccaggagcaaggtggcggggtttagggtgttgcaaacttcaatggttatgtggggattttcacagagcaagctttggtatctagttagtctagcattcattagctaatgatgtcctttggtactgattaaagtcaccacagcatgggggggactttatgtttaggttttgcctaagagttagcttatctgcttcttgtgctaacagggccgttgctgccagggcccttagatatgggggccagcctttggaaaccccatctagttgttttgagagataggccactggccttggccagagccctacagtctgggttaaaactccaactgccattttttttttttgaagataaccattcttttttttttttttttaagtgaactttctttatatctgtggactagactgtctaaggccacaagattagaagttactataatacatgttacactgttaacttttagcaaactttacttttgttgaaaaccttgtaagtttgggatttcaattatcctttgctatgagtaagaccttgtttagtctaaattaacttagaattggtatagatggccctttttttttttttttttttttggcacatagagtgtgcactttcgtcaggtcaggtagccccagggctggggccgacctgagtttttctttcaactcatgaaaagcttgttgctgttgtttgtaatagatataatttatctaatttacatttttattaacatcactcactaaaatattgacttaaattttgtagctatttgatttcaagctttaaattgatctggtattcctcgtgggactccaattgcgtctaaatggacgtgagagtcgaaagacctataagggggcttctctcgctttacgatgtcttatttttcctccctcttgttgatgaaatgccagggtgaaagggatagccaactggactaaagtataagtgccactccagttattcggcagagtgcccagtaaaggtccaccacaataccaccacacatccgcttggggatgaacaagggctgactgattgataagctcttgaaaattcttaagctcattgcatcacttcaggtctccaaggaatcctaagtttcctctctgtggtgagagacatgaagtgaacttagtgttgggagacggaggctggatggccctcgggggctgacccacagggatagcagagagagtttggcatgacttattactccaggctgtagaatcctggaaaagagctaccatgcagcccacgcctggtggactggaggaccactttagtggaagggggacaatgagggcctctggcctgccatgtgcacaagcataacaactgcttttgtttaatgtgcagatggaatatttgatccatttcaaccaggcatttgcatcttggtatgctgtcttaattgccaaagtttgttttaagtctttaacttctatgatcctctagtaaaatgaatgtttcctttaggacctatttttattagtttttagaccaaagaaagctaaacaccattttatatttaataatacttcttgtatgatttttataccagataagctaaattttacctttatattagtgtgttattaatgttaaacttaattttaataaaacctcatagacatatttatccaatttttcatgtttgaccataaggtaagtttttacagactctttttaaccttttataatttttgttaaagagcaggttggtgcttcaagaaaaacctgttgcatttttactttaatgtccagttcacagaaaaactggatgatacctttttatctttagctaattagtttacacacagaatttttttttacaattaacattttaaaacttgcttaaactttcaaaacaataatttttttaaccttttaatgtaggtaaaaatccacattcttatgcctccttctaatctttttaccaaaagtatattttacttttcttatgcaccttgcacataaactgtttcttcaatagtactcaggaggccttattactttcaaattatacaatattttttgcataaattttttataacatcgttttctatgactttcgcagataattctttgacatgtctcaactttctgacttattacaaatatttctttctttaaacaacagttaatttatttcaagacaagaatttaccatataacactctttttacataaattttgccttcccacagctctttttttttttttttcctgttagcaaagcagctgctgctacagattgaatgcatctgggccatccgtgggttactgggttaaggatttttgataggaaggcctcagtgctttcgggatacgcccttatttacactaacaacaaagtggtattagagtgttacagggttacggagaatacctttaattatcaattttaggttttaaatttaccttggcttttaaagggaatagggtacactatttttttcttaactacttggatatttctctctatttttctttctctctttgactttctgtctctctctctccctctctctctctttgactttccttttgcctctgtttcttcctctctttctgcctctcttaactactgtgggggcgaagggggtctaaaaccagctgtaattgtctacgtacagaaactggtctgtgtgccttggcttacaggttaccttgtgccatacatttgaaacaagggacctgtctaggcttccttctgatggccaacccacctctaatgttggccagtctattttacacaaagttctaagtttttctagtgtcatagtaacaccgtaatctcccttaaatcctttcttgaaatttttcaacatagtttctagtagggtgggcttatttgtgcctgacccatgtttcttcgagacaaaacaccactctcacaccacatgcacaccacaaaacaaagaacgggtaaaaagggcacgcacacacttttgcagtttacactaaaccaaaatcaaaaccaaaatcagagtattcagaaatccaagccaggtcaaaaccaaaaccaaagtatcaagcaatctaagtcaagtcaaaaacaaaaaccaaagtgccggaacaggcacaccgtgggtgatcagatcaggccatgcttccactcaaatggagtgggaatggagtgggcaagttcccaagaccagtcctgtcaagtaattcaaaccaagtcaaaaccaaaaccaagtgctgataaaggcacgccgtgggtgatcaggccatgcttccactcaaatggagtgggcaagttccaaagactagtcttaccaagttttagttgtccggactccaagtgccaattccttcccggtgttcagccactctgttgatcctccacgggggcctgccacacactgctctggcgaggtgtcccaccggggcaaatgcctacccaggagagctctcaggatccgcgtcactctggctggttggagtccccagcagggatgttccacagggcaggctaaagccgcctaaggagctgcctcgaccatctgttaatcaccttgcttcccggtcagggaaccaagaaatgtagcaggatgagccgcagacaaaacccctcagacaccgagatagtgaagggagtggctttaatcagctgggagaatcggcaggctagcgtctcaaaatccgagctcgtctgatgctcaacttctgtcccttttaagggctcacaactctaagggggtccgcatgagagggtcgtgatcgattgagtaagccagggggtacgtgacaggggctgtgagcaccggtggtcacagtgaaacagaacagaacgagagatttcacaatgtccttccatacaatgcccttccatacaatgtctggaatctatagataacaacagttgctaggtcaggggtcgaattttaactaccgagcttaggtcaggcaggcccaggcctggtttcgggtctggttcctaggcgccgggctatctgcctttaatttcacttttctttccttttctgagtataaaacaatatgagagggtctgtctcttccctcaacagggaatcactagttcaaaccatttagtcctaagactggagatagagaataagaggtctttggatttttccctggaagacagatctaatatacttgtctcatgttgtttatttattttcatataaggaatattatgagggctatctttgggacaatccattctacttcctcatggaagtagatagtatggtattcaataacagtggtgatgaccaggacaataatgatggtgactcatatcccttccccacctaacctaaacagtgtgaggggaaaatgcttgttaatcttataatattcttagctgtatctctatcccacattaaagttaggcctgagaaaggccagttttaaaatatctttatcattgctgaagggataattcacaacagtcagaagacatttgtttattcatgtattcaatcattaattgaattcctactatgttcaggaactactaagtgctgtattcactagccggggcctctgtaaaaaagtactacaaatggatggcttacaacagaaatttgtctcatagttctcaggggtaggagtctgagatcaaggcatcttttcttctctggaccatgaggaagaatctgtttcatgcccacctgctagcttctggtggttgctggccatctttggtgttccaaagatggcttgtagaagcgtcaccctaatctctgccttcatgtcacatggcattctccctgtgtgttgtttgtgtccaaatttctcctttttataagggcatcagttatattggattagaggcctaccctactctagcatgatctcatcttaactaattgtatctgcaacgactctcttttcaaataaggtcacactttgaggccctagaggctaagaatttaacatatgaattgtggggacatgtgtcaacaagtgccaaagccctgaatatcaataaagtctgctctctgccctcaaggagctctcacagaagaggaggagagagataatgtgttagtcgttttcacgctgctataaagaactacctgagactgggtaatttataaagaaaagaggtttcattgactcacagttccacatggctagggaggcctcaggaaaattataatcatgacagaaggcaaaggggaagcaaggcatgtcttacatggtggcaggagagagcgagcaagggaggaagtgccaaacttttaaaccatcaaatctcatgagaactccctcactatcatgagaacagcatggggggaaccgccctcatgatccaatcacttcccaacaggtctctcccctgacactcgggggttgcaatacgggatgagatttgggtgaggacacagagccaaaccatatcagatagcattaaaagttgaatatagtgagggcaacgatagagtcatgcaatagagaattgtggaagttcagagaagaaagggtatgtagtcaaccttaggacattgatgacagtttccaggaggctacacctgagctgagacttgagatgaacctcaaatgaggggcaatgagaagccatagcactctgggctgaggagacagcataagcaaaggcatggagaggagaaatagctctgggtgtgcagggaactctcacctgcttgctgttggtgaagggtagattgctaggcagagagtggcaagaaaggatagaatgaggctttggaaagtcttgtgtgtcacataaaggaggcctgggttcatgccgttaggcaatgggagctcccagtcagagggtcatgacctggatgggggtagtggcttgctattgtggtagtatagggtggcagtaggactagaaaggagagaattagctaggttaaattaatcagggcttaggaacaggagaagagggagtatatcagaagcagcaataaagaaccattgcgagatagcttggaaaatctccatcattatagctgaatatgagaagacagagctttccttcaacctctattattttcaaaaatatatatttaaaaactctcttctgtttcttgattttctcacaaacaggattattgccatttcattgaataagatcagcttccatcaaactttctataccatccagatgttcatggccaatgtcctaggcctagacacttgtaaacattataaagaacgacagaccaaccttcgaaataaagtcatgacactgttggatgaaaagttctactgtcttcttaatgacattttccatgttcaggtaactagctagtattatacttctgcacaaatagccatgggcaggcacagcaactcctctctggtgcattgtgacttagcatctctttggtctgtatatctggagtatccagatggtgagtaaatggctcccaatcctctctggatgtgcatcaacattcttgacatattagaggtatcttgaaatatcatactcaagaaaatccaaatggccatctgctgactaatttttttcttacctttctatcatagctatactagctactctgggacacaaagtcactctgttcctacaagtgatgccagtgcagactgtgccctgtcttttcctgaattatctaacacaggggtcctcaacccctggtactagttcatggcctgttagaaaccagaccacacagcaggaggcaaccagtgggtgagcaagtgaagcttcatctctatttatagccactccccattgctcacattaccacctaagctcctcctcttgtcagatcagcagcagcattagattctcataggagcctgaaccctattgtgaactgtgcatgcaagggacctaggttgcatgctccttatgagaatctaatgcctgatgatctgtcactggcttccatcaccctcagatgggaccatctagttgcaaggaaacaagctcagggctcccactgattctatctacattatggtgagttgtataattatttcattatatattacaatgtaataatagaagcaaagtgcacaataaatgtaatgcacctgaatcatcctaaaatcatcccctctgccgcagttcatgaaaaaattgttttccacaaaactagtccctggtgccaaaaaggttgggaccacttatctaacacatgaggattttaagacacagaatagttaagtgttttgcccaaagttgcatagccagtagttccctttgctattttcccatactcaatattctcataattctttgtacagttccctatttctcgggagatttccaggatgagcaccttgaaaaagcaaaaacaattggaaatattgtttatgaagatcttgaagctggtaagagcatctgtgggtcaagaagtagggggaagaaaactgggcaaatcaccacaaagccaggtggtttgaggagttcagaccacattggcaagaggcttttgaaggatgtgaaggctttgtcctaaagtgcttcattctcctccatccttccaaacctcaagcaaaaggtctgtttagaatttagatgccttgaaaagagtcccttaacattactcctaggagtctggcctctctcagcactcattttttcatcctttgttgagatataatgtaccaaagtggttacatatgcaggctctgtcgtcagaccactgaggtttgaacccccaggcctatcacttgctacctgagcaacctcaagcagtgacttaccctctctatgtttctgctttatcatctatcaaatggaggaaaataatagtacgtagctcactgggatgtaagtttaaatgactagattatatgtagaaacacttagaacagtgtctctttcataagaaacactcaacaagtgttagctctctcccagtaatatcacgactgtctgctatatattgatcaccaaatttatatttcagtccccacctctcttataaacaccaaaaccatattcctaagagccttgtatatattccacttggatgtagtgactcacgctgagttgagtgtctaatgccaaattcatttttttactatagtgccctttcttcctcatcctgatcctgatccttgatttcattagtagcaaattatgccattctgtatcatttaaagttatccttgccttcttttttgcccacattcccgcatttactcactgccaagtcctactatttttacctcagtctctggaatctccttgtcctcccttcctattgccatagttcaggctcttatcattttttcctggactatttccatagctttccaaaaaactctgtgcttcacacctctctgcttcaattcatccttcatataattctcagagtatatgcaaatcacaccaacccatactttatactctcgaaataagtcccagtggtaataagataaaagccaaaagattttttttaacctagagaaatggtgctcatctttcaatgtcacctctttggtgagaacttccccagatcactagacatgactaattcttcttccaccaggcttctgtaaggctgtgaacacatttctagttatactatacactctatactattatggcatattgccattcattacttatatatctgtttctctctccctcaggaaatcgtgagcctctttttttttttttttttttttttttgagacagagtctcgctctgtcgcccaggctggagtgcaatggtgcggtctcggctcactgagacctccacctcccaggttcaagcgattctcctgcctcagcctcccgactagctgggactacaggcacgcaccaccacacctagctaatttttgtatttttagtagaaatggggtttcagtatgttggccaggctgttctcaaactcctgaccttgtgatccgcccatctcagcctcccaaagtgctgggattacaggtgtgagccaccacacctggcctgtgagcttcttaagaacagagagtctcttaacatttccatatcactattgatgagaaatgtgcctcataattgtacataataaatgatcgatataagttggtggcattgtattatatttataatacagctttcttcttttgtacttcaggtcataggcaagacaatatcagtagtttctaagtgtcagggcttagactgtttgcatcacaagtatttacaagaagctcctttaaaaatatggatttgtgagttctaactctaaagattaaaaaagtaggatgtggattgggcctaggaacctgtttagttgtttgcttttgttttaaaacttttcagttggtgctgaagcagaatcttgtttggaaactgctaccaaagctgtgtttgattatgtactgacaagtctttggaccattaactatctgtgtgaccctgggcaagttacttaacttctctgtgcccaaattttctcagcaaatagattcaatagtaccactttatatggatgttgtgaggattaagtgagttaattatgtaaagagcatcccgcagtacttggaacatagtaagtataatgtaagtgttggctttttttcactttaaaaagaacccaatcctcattttagattagaagaaaccaggccaatgttttattattgaattcatgattttttgttcctgctttattctcttcaatttatgaataattcattaacaaggctatcccaagattaaaacttaaatttctatctgccccatctttttaaagataccagtcaaactcaaaacaatgtagtgcttacctcctcattaattaaactgttctcagggctagtcaaagggctaagtatttggtgacagaacggggctgcaggagtagacttaggtatgtgtgaacaaggcaggttataacactttataatgactgtcaagcacaaagagaaagaatgggttaactcaatctcttctcagagggaaacaaaaagcagccattagcagtctggagcagtgagaactggggagccggttttctgcattgtgacaccttacacagtggtaaggcagagcctgctacgtaagtggttgacgctaaaatgtaggctccgtattttgtttgagactgtattcccagtacctagaacagcacctgaccctgatagatgcacaataaatgcttaatgagtgaataaataattcagactacttaggggagggtagtctatatgagaaaagggacctgtgatctgttttttaagtgcaacacataccacatttcaagctagaatagcatcggctgccagcagggcgaggactagttttgttcagcacctagcccagggggtgctcagtaagcatgtgctgaatatatgctggttgaataaatgtcaagtagatttccccaggacaactgtattgttcaatagattaaaatgactcataattaacaaaccagttatttttatgtaatgggcacttcagttagcttttgtgggtacccctaaaactccatctattctccaaatttgcactatctttacacaaagctttgaccaagtaagagtccattccagccagctctgtccaaatagccacaaattctaagttaatggaatataaatgaatgcaaagttactggaaagaaaagattgaacttagttctttcgctgcatcataagcaaaccaggaagctcaatggatacatatgcatacccatacatgtgtaaaaaaacctgacgtcctatggtgtttctctttctctttctgcatcttgtccagatagtgaaagaggaaaggattatttttatcattgatgaggcccagtttgtggattcgacctcctggagatttatggagaagcttatccggactcttcctatcttcatcattatgtccctgtgtcccttcgttaacattccctgtgcagctgccagggccgtaataaagaacaggaacaccacctacattgtcattggtgcagtacagcctaacgacatctccaacaagatctgtcttgacctcaatgtgagctgcatctccaaagaactggactcgtaagtaacctctttctattctgaactctcgacatctgcatacattccctcggtctagacttcatcagatttcttagtatgtgtcttgatgtgcctatttcagtatctttcctggccccaccttttaaaaaatttttcttttctttttttctgttttcttttgagacagggtcttactctgtcacccaggctgaagtgtagtggtgccatcatggctcactgcagccttgacctcctgggctcaagccatcctcctgcctcagctttctgagtaccagaactacaggtgtgcacctccggtaaattttttatttctgtagagatggggtctcacagtgttgcccaggctgatcatgaactcctgggctcaagcaatcctcccatctcagcctcccaaaatgctgggattacaggtgtgagccaccatgcttggtctggtccaccttttgaaggagccattcataatgcttggtaggatggatgttgctcaccttttccatgttgcctccctgttacgccttcttaaactttgcttagtgaaaagctctatttccctttcatcatggggggtatgggtatactcactttaacctgcagtgactaagagcattgttatgggcaagtgacaggaaaggcaaactggtaagcgttaaagaccatgacctgccactaagcaaggtcttacctggctggcaatggtgtggtctggtattggtgttctctgtctatggcagatgtggaaagctgactcactggtgagtgctctctgagcttttcagtgattcctctcctggggttttctttgttttttgtttgtttgtttgtttgtttgttttttgttttttagacctagtttcgctctcattgcccaggctggagtgcaatggcacgatctcggctcaccgcaacctccacctcccgggttcaagcgattcttctgcctcagcctcccgagtagctgggattgcaggcatgccccactacgcccagctaattttgtatttttagtagagatgaggtttctccatattggtcaggctggtcttgaaatcctgagctcagatgctccgccctcctcggcctcccaaagtgctgggattacaggcgtgagccaccgagcctggctctcctggcgtcctgacagcagtcaccttaacaacatagagaatgttttttctttagctggctgtttacagcccatcttagtatctgcaatgaggttgccctgcttctggaagaaagatgtcttgaacaaaggctcatttaagataactccaggcaccaatttggcactcattctttctgtcggtctctctctctctctccccctctctctgtttaaattatatagaacatgtatatctttccaaagccaaaaaggtacatccttagtcttgcttccctcccttatcctataggtaaccattttggttagtttttggcttatccttccaatgtctgttttaaaaactataaatcaagtgtgtgcacacttattgtgtacacacatgagtgaaataaaaagaaaacaaagcaatgcctcaaaactgaaaacaaacagaaacaaatgaagaatgacaagaaattattttcaagtgattgagaagacttacatatttttccttcctaaaagatgtatcttcaatgtaaacagattgccttgttttcactacaggtacctgggggagggaagctgtgggattccattttactgtgaagaattgcttaaaaacctggaacatcatgaggtactcgttttccaacaaacggagtctgaggaaaagacaaataggacctggaataacctgttcagtaagtcctgcggtgatggttctttcttactctgttctgcctaacttaagtcttcattcagagaaggtagcaaaaatgggctattccacaggctgcttcctgtagagtcagaaggttctggggagccaggaattactggatccgatattccagattgtaagcgaacttaacattgcctgggactcactggactcggctaaagattgtctaactatggccgggcgcggtggctcacgcctaaatctcagcactttcggagcccgaggcaggcagatcacttgaggtcaggagttcaagaccagcctggccaacatggtgaaaccccatctgtactaaaaatacaaaaattagccaggtgtggtggtgggtgcttgtaatcccagctactcgggaggctgaggcaggagtatctcttgagcctgggaggtggaggttgaagtgagctgagattgcaccactgcactccagcctgggcaacagagtgagactctgtctcaaaaaaaaaaaaaaaaaaaaaaaaaagtaactatagtagaaatgaaagaacattgacaaatcttaaggcccagaactgaagggccgctttgatgttatcttcaaaaagcctttccttttttgccagaggtaaaattgctagtacgaagtgagttatcaacaaagatcccgtgctacacagatatatacagggatgaaatctgaagtgatggcatgaaggaggccagttggaatttttaggaaaataattttattgcagggaaaagggtgggggccagagattacaagttggaaagcagagaattaaggctagatagagcaggctttaattgggactttttttgtttccactcccttggtgtttctgagttgctagattcttaagctctaagtcttgaacatgtgaggcaaaaagaaagccctgccatgggacccactgccacgtttttccttgggtcctaaggtccctagctggtctgacttctttccaccttcaatgtcatcttctgtttgttttacacataacgtctaggggttttaactatatttagcaggaggaatagggaaaaacataccaactctctcttcctggaattggaagcctcttcatttttttgtgactcaaattaagtaatacgatgatttaacagctataagcactacgtgtattaatattactaaacctagagggtcaaaacgtattcctctgcgactaaatttaaagacaagaatataggtgtgagatcagtgtcatgatgaggtgaatacggtgcaataaaggacttatggtgctgctgtctctatgtagcaggatagaaaatcaccacctaaaggtgacaatgagggaaatttcataaaaaagattcctcttgcttcctaaaaacccctgcctcctgggtgaatgaatgatgctcagatgtccctatccatgtttcagtctgtgctgcatctgttgcctctcacttcttgttcaatagcatgactacaggaccatgtggcccccaagggcacatctgtaggagaaatgagacagatggttgtctgagagaacagggcaaagctctaccttttttttttttaaggaacaagaaacattagcttgctttttaaggaaagatcaattttttttttctttctggatgattgtgatgaaaaaatggagaagactttctctggccaaattagttttaaagatgatagtggatcattaaatagataatgactgctatgattattatttttagactaaataattccattataataatattaagatgccaatggattaaaggaaagcgatatgtaaatataaatactgcagagtaaatactatttctaaattttatacatttgtttactttgtttacttgttcaataaatgtttatgtagtatccgttatgagcttttttttttgagacagagtctcactctgtcgcccaggctggggtgcagtggaacgatctcggctcactgcaatctccgtctcctgcgctcaagcagttctcctgcctcagcctcccatgtagcaaggattacaggcatgcaccactaccgcccagctaattttcatatttttagtagagacagggttttgccatgttggccaggctggtcttgaactcctgacctcaagtgatctgcccgcctcgggctcccaaaatgctgggtttacaggtgtgagccactgcacctggccctgttatgagctttttaaaacacaatcaggtgtcttctctatttaaaacccttcagtgtcttttgtgtcttaattttaaaaaactgaaattaaggagagattctggttacataatattgtgaatgcactacaggccgctgaattgtatactttaaaataattaattgcatgttaggtgaatttcacttcaattaaaaaaataaatatgatacataatcctggactggatcctatactggaagaaaagagaatgttaaaggatattatttgatcaattcacaaaattgggatatggacagtagactaaagtattgtatcaatgttaaatttcttttttttttttttgagacactctgtcgcccaggctggagtgcagtggcacgatcttggctcactgcagcctccgcctcctgggttcaagcaattctctgcctcagcctcccgagtatctgggattacaggcaactgccaccatgcctgactaattttttttgcatttttagtagagacggggtttcaccaccttggccaggctggtcttgaactcctgaacttgtgatccacccacctcggcctcccaaaatgctgggattacaggcgtgagccactgtgcccgaccaatgttaagtttcttgaaggtgataactatattctagttatatgagagagtgttggccaggtgcagtggcccacacctataatcccagtactttgggagtctgaggcgggcggattgcttgagcccaggagtttgagaccttcctgggcaacatgacaaaaccccatctctactaaaaatacaaaaattagccgggtgtggtgtcgcacgcctgtagtcccagctacctgggaggctgaggtgggaggattgcttgagccagggaggttgaggctgcagcaagctatgatcacaactctccactccagcctgggcaacaggagtgagaccctgtctcaaaaaaacaaaacaaacaaacaaacaaaagagtgtcaatatttttagaaaatacagagtaaagtatttgggagtatagggtgtgatgtatgtgacttatattcaaatgcttcagaaaaatatgtacacatagaaggaacctaggatatagtaaatagggcaaaggctgacaacaggcgaacctgagtagggagtacattctgtctatcacccttttatttctttcacataattgaattacgagattatccttttaatgtatttatctattgtttaatgtttgtttcccactagaatgtgagcttcatgaggcatggagttttgtgctctcctgaatccccaatcctaggaaaattcctagcacctagaggcaatcagttaatactggttgagtgatggaaagaatggttgtctcaatgctaggtcctggaaggggaaataagcataaaatagcatggaccacgtcatatccttgagccccactctcctactccccaacacacacacacacacacacacacacacacacacacacacacacggccccctttttggtatgctatcctcccttggctttcctgaccccacactcctcctgttcccctctctgaccagtcctcagataatccttggctctctacctgggtctactcctcctgggacattcttcaagttctatccttaaccctttcctcttgctagcttgccagaattggaaacaactctctccccagttgttttcatttactcatctatttctcagccttcgtgtgtgtcgaaccctaacctcacccttaattccacacccatatttccaattgcccattgaactattccacagattcccttaaacttaataaatctaaaacttcatgcattatcctcccgctcaaccacccctccttctgtacttcgtgtctctgtcacttctatcactgtcttgcttaggccccatttcctccatatctttagtatttgctttctccttgctgaaccacttgcctggttctatccatcctcacttcttgacattccattgttatagctccttacatagtcttccctgtcctagtctctcgccttttccatatgctgcttccagtggtaccttcctaaatacgactagttggattactactatctcctcttcagaaatctgtgacctttccctcttgtctataaagtccagtcttcatattatggtgtttaatgccctccatgctctgctcccaaactagctctccaaacacgtctcccacatagcacctgagcactccaggccctgcactttagtcacgctgggccgctccattcccctaactcgctaagtactctgaggttcctgtgccttcgcgttggcctctcctccacttgccgcttagaatatctcttcatccttcaaggatcaaagtacttcctcccctgtcaagcctttctgaatccaccaagtctgatttaattgttattttctgttcccacaacatgttactctttgctctttagctcttaagtcacccatcctgatgttataattagttacttatgtatctgtctccacagatttttaagcctcttgagggctggaagcatgtgttattcacattgatagccttcactggatatgatgcacagaaagtccttaataaatatgtcctgtattgatgtgaactctggtgcttactgtatgtgcccaatcacatggcactcatctactgcctggcagtccagctcttagtgtacatgacttagagctccaggaaataaggaacttggttttattcaccttcctatttccacctcacctagcacagtcttgccgctaccaaggactacatgaatggctgaagggatagaaaaataatgcattttggagtactaggaaaccaaattactaggcacatttactattcaaacttcaccatttaaaatatctctgatagtagctatgtcctaattagagtacagtgcctcacagaatgtgtttgtaactgagtgtgggtatgtaaatgtatacatacaaatatatgtttatgtatatatataataatacattctgatatacattatgtatatacataatacatatataatacattctgataatctgactgtgaatcaaacgtttgtaaagccttatatcctatggaagacatcaatagtgccaattcttttggttgggcagggttggcagagggagacaaaacatttttgagtacatctagattttcatgaatcagttttacttagaataaggtttccagcggcctggtgcagtgtggctcatacctgtaatcccagcactttgggaggccgaggcaggcagatcacttgaggtcaggagtttgagaacagcctggccaacatggtgaaacctcatctctacagaaattagccaggcatggtagtgggcggctgtaatcccagctacttgggaggctgaggcaggaatcgcttgaacctgggaggcggaggttgcagtgagcaaagatcacgccactgcactccagcctgggcgacagtgagagactccacctcaaaaaaacaaaaaacaaaacaaaacaaaacaaaaaaaaggtttccagaatatttggtgagccaatatacatctctgcccagtcttcctcatatgagatccatctcaaagttcattggaaaatcagaccttataagacaggataatgactcaacttttcttcccttttatacccctgtagagtattccattaagctaacagagaagttaaacatggttactctccatagtgataaggaaagtgaagaagtctgtcacctcacaagtggtgtcagactgaaaaacctgtcacctccaacgtcattaaaaggtaagaaaatctggccgggcgcagtggctcacgcctgtaatcccagcactttgggaggccgaggcgggcggatcacaaggtcaggagtttgagaccagcctggccaatatggtgaaaccccgtatctactaaaaatacaaaaaaattagccaggcacacacctgtaatcccagctactcgggaagctgaggcaggagaattgcttgaacctgggaggcggaggttgcagtgagccactgcactccagcctgggtgacagagtgagactccatctcaaaaaaaaaaagaaaagaaaatctgacctggtatttattttctagtccctaaactccactttggctttctctaggatgtctgtttttaaaaggaaaaagaaaaacagcaacattggttgtttgtctgtttgctctgtactgcctgaagcagtgagaaggctcagggtaggcttggctttgctcctaagagccatctttccccctgtgtatattctgggatctgcataaaagaatgaaatattgtacattttcaattaaacagaaaccaaataatgagggagaaaatctaatactgagatacttcctgtcatccacttttatgagaaagaaatgacaaacgagtttatatgaaagacatattattggccaggcacagtggcttactcctgtaatcccagcattttgggaggccaagtcgggtggatcacttgaggtcagaagttctagagaccagcctgaccaacatggagaaaccccgtctctactaaaaatacaaaaaaaaattagccgggcatggtggcgcatgcatgtaatcccagctactgaggagactgaggcaggagaattgcttgaacccaggaggcggaggttgcagtgagccgagatcacgccattgcactccagcctgggcaacaagagaaaaactctgtctcaaaaaagaaagaaagaaagaaagaaagatgtattattattcttttaaagaaaaatgactttcaaggaatgttttagtatgaactcagctccaattcatgccatccataagcaactttcaatgtttagaaaggtggcctagggacatctcaaggtcctcagtcttcaaaagagtgccatttatgtttcgttagctgtgtctactaatgtaagaaggcagtagctcacacctgtaatcccagcactttgggaggccgaggcaggtggatcacctgaggtcaggagttcgagaccagcctggtcaacatggtgaaatcccatctctcctacaaacacaaaaaattagccgggcatggtggtgggtgcctataatcccagctactcaagaggctgaggcaggagaatctcttgaacccaggaggcggaggttgcagtgagccgagatcagccattgcactccagcttgggcaacaagagtgagactccatctcaaaaaaaaaaaaagaggatggactagcttagtttctactgtgttttttgggcaagttgagaaattctaattttgtccctaacagaaggacatcctggtcaaaatgtccagaaagtcacatgagctaccgatattcaagcttagatgaaaagttgggataggagctgtgaactctctgacacttggtcatgacacagagatgataatgtatgtcatgagaatacataaatttctagggcagatagagagaaaccaggagtttctaggagaaaggggaggcagagaagaagatacaaaaggaccagctgaggaagtcaacaaagcacaggaatggcagggcctgctccttctgacaatagtgattacaatgtcctctcctctcctcacacacacttgtcacactttagcacaaaatcagaacaccatgaaatagatcttaattttgtcaggtcattgtgctgtgtgtctttctaggccataagcctgcatctttagtactcccagcacaagtgctatccacaaattaggtactaaacaaatacttcttttgacttagcttggctgagtttcttgcaacaagaactgtagagcaggatggttgtccacctgctctatattaaatacagcatattagataaagataaataactagttttctactgtgtggccttctacctgcagaaatctctctgatccagctggatagcatgagactttcccaccaaatgctggtgagatgtgctgccatcattggcctgaccttcaccactgagttgttgtttgagattctcccctgttggaatatgaagatgatgatcaagaccctggcaaccctagtggaatctaacattttttattgtttccggaatggcaaggagcttcaaaaggccctgaaacagaatgatccctcatttgaggtgcactatcgttccttgtctctgaagcccagtgaagggatgggtgagtagcacctggagtgacccaatttcctcttaaggacccatctagatcaaagaattgacctatgttaggtagaaggggctgatctgttgcccactgcctggctgaaaaaccctttttgctctctccagatcacggtgaagaggaacagcttcgtgaactggagaatgaggtgatcgagtgccacaggattcgattctgtaaccctatgatgcagaaaacagcctacgagctgtggctcaaggaccagagaaaagccatgcacttgaaatgtgcccgctttttagaagaagatgcccacagatgtgaccactgccgaggcagggacttcattccctatcatcacttcacagtgaatattcggctcaacgctttagacatggatgccattaaaaagatggctatgtctcatggatttaaaagtaacctacttcattttaaaattatcctaactgttcttgggaaatctagagactaagatctagaaggagtgggtgtggatcttgagggcttcaagtctcataagcggcttgggcacaaagaatgatgagacttcagcagcctaggccaatggggaagagaaaagtaagggaatgtacctgtattgagtctagcgaaccaatctcactataactgtcagggagggtttggggataggggctctggcaaaatgggatgtgaccagaactcaaactaaaatatcccacttaattcacaccaaaggatggaatccaaaggggggtacaatctgacacgatgacatggtgtttcttggcagataagaatattattgctttgttggtctagtttgaaacaggttccagtgggtaaagaacatgactgagagagaattagccagggctaagcaggtcagggctccagaaaacagggcttggtttcagggcaagaattcaagaccatcggagaagcaaaagttaaaaagttacaagccaataataccaaccagccatgtgatctgagaaaacatagcagaggattcagggggtgtaaggacccaaagactcagtcactatgggcatgatgggtgtcagacacagagcaacaccaccaattctagcccccattcatggtggccagggagctcctaatgggctgcctactctagtcagaggaccttggtgattatggctaaatctggttgggaaatcagaggctacaagtagaggactcctatattataaggatattaaaaatcaggaagaaatgtatctaaactgcctagtacatagcaggtgcaaaataaacttttttttctcattcgttctccatttcatgtgccttctcagtggatcctcatattaaccctttaaggttgatgagggttgttttcattgtatagattttttaaattgtggttctggaagcttaagtaacttacccaataccacagaatgagtgacaggctttattcaatctgccatcagtctaattcctaagttcatcctctgctcattatacctgagctcccccaaatgtggggttggattttaggtaatacttgccagaagataggaagttcgtagacacagcatgaagtagaaatcaagagaatgagaaagttgcagctttgcacagtgggacgagcatgttgttgaaactgcactaacactagtccatctccctttttggaaaacaggaatcaggctgtaggttcagagccttaggatctggaccatgaagatttttagtcctctgagagcttgagtacaaagaggataagacttcagcaatagtctcatctgcactgggcagggaagatgtcaggggaatgtacacctacctgagtctagttctattactagcatttattaaattctctcttgtttgttatatttttacaaaattggtaatattattatcacaaaagtggtatgtgtgtaatattatgttgaaattgaaatttgtgccagagcaccaagatacaactaatgctgcaattcaaactgaggcagtggatatacagaatttacaaaagaaatagctgagaatcaattataatcttggatccttcgcccagacctaagacatagaaatgaggaagaggatgtagagggtcaggatttgtgaagagatctctttggtgagaactgatgaggtgctgtgtgccctcctcaagtgggttgtttacttcatcacctcaagcctggtgaggtgtcttccttagaatcagaggacatagaacactggggcctgcctcatgcctaagaaggctgaagtggcctgtggctgcattgggatcaagctgccatcccagactgtgggaaaggatgtgtgagggtttctcatggatcagataaaacccacctgggagaaacagccagtctggaaccattttaagttcttcccagggtgcccttgggagggtaacaagacccttgggtgtggactgctagaatgagacagggataagggggacagactggagcaccgagaagatgcgctgcctgaattaaggaagctttagtgaaggatcccacacagggccctattcaaagaaccaatgaaagtatcagtaggagatgaaatgatggaaagagatgagggaaaggggaaagaagaatatttgactgtgcggggtcagtgagtcatacatatacacacacacatacacatgtacacacacatacatatacatagatgcattttttggtagattgatgttttattttgggggataaaataagctaaaatacactgacagctagaatataggtcagtttgagcagctggccttgagcaggttgactagtgtcatcaaagcaaacaatttcagttatttgcagattttccaatcaactggcagttcagctctggaacatatatgaccaaatgtctctgaataatgtctgctggtatcccttccatcagcacctccacctgagtgaggccacagctctactatttctcttatcagaatttttcacctgttcagaaggctatcgactcgacaaactttagagactttgtaaattccctaaatgtcgtatcacaaaacagtaatcccatggccgaccgtcccacacaccttcagtaattccagtcaggggcaaacatttttaatttagctgttctttctagtcattacctccatatactaaatggtatattaacattgcttttactgatttttaagaaaatcaaattctgacatctgttttctggctatggcagatgaggatttaactctgttacaccactcctcggcccctctcccctatattgtcatataactggcattagataagccaatgaagtgtttacattattaagactatgtaaatgttgtccattacaaaccaagtaatatactgtgaatagatttcttaacaaatgtttatttttcctagggttactaggaaacgttttttttttgcagtgtcttccttaaaatatcctgctttaatctatcctagacagatagatactctgtctatcctttatccctgaacctcccaaagtgtggagtataacctttaggcaatactggtcaaggacataattgggaccaagtgtggtggctcacgcttgtaatcccagcactttgggaagctgaggtggaaggatcacttgaagccaggttcaagccagggctggttcaagaccagcctggacaacaaactgagactctgtctctacaaaaaactaaaaataagaaaattagccaggtatgatggcacacatctatagtcccagtttctcaggaagttgaggtgggaggatctcttgagcccaggagttcaaggatgcagtgagccgtgatcatggccactgctctccccaaaaggggaaaaaaaagacataattggaggagattcagggctactgcattatgtgtgaatcagatagggaggaagctggtagctggtccctttcaattctcttttgatcctcatgtccttcttaagaactgttattttctaagtcttgattcattccaacggtttaccctcctgggggctgtccttcagcttcttccacctatttcatcagtgactactcttctcactcctttatcttctacagatatgttgaactttcattcagcatttcatttactcattccacaattatttatttatgtgccaggcattgcttactgctctaggcatctgaaatgcatcggtgaacaaaacagcattctgttggagaaaagtagacagtggagaacaaaaacataataaagaagtaaatatctgggtgcagtgactcatgcctataatcccagtggctttggaggcttgaggccaagggttcaagaccagcctgggcaggatagcaagaccccatctcttaaaaaaagaattagccaggtgcgatggcttgtgcctgtagtcccagctactcaagagtattgcttgagcccgaaagtttgagactgcagtaagccatgttcaccctactatactccagcctgggtgacaaagcaagaccccaactcttaaaaaaaaaaaaaaaaaaaaaaaaaggaaagcatatagtataagcgataaatcccatggagaaaaacagaaaagaatgttgggtaggaggagcgcagagccatttgggtgacttcactgcaaagcaagattcatgtaaagacagaggaagtgagggattttgctgtgtgagtggctggggaagactgttctaggcagaggggtagagaatgcagtgaccctaagacaggagcgtggcccttccattctatacatgttgaatttatacttttagagatcattttattcttgccaggcacagtggctcacctgtaatcccagcactttgggaggctgagacaggtggattgcttgagctcaagagttcaagacaaaccagagaagcatgatgaaatctccctctacaaaaaatacaaaaaaattagctgggtgtggtggcaggtgcctgtagccccagctactcaggaggctgaggtgggaagatcatttgagccagggaggttgaggctgcagtgagctatgatggcgccactgcactccagcctgagcgacagaacaaggccctgtctcaaaaaaaaaaaaaaaaaatcattttattctcatttagttaggtaaaatgtcctgaacctggggagacagaagataaacccaagaggtagtctgacatcttgaacctaaagtcttagttttagttctttgaaaccataaggtgggcaggtgatatctttgcttttctcttttcatttgagaacctataggcatttgtatgtttttttcttttgatttttacagattctccttgtagtaggaaactcttaatataatatctcctttgtaaatgaaaaaaatgagaatcaaaaataatatgattctggttgggcacggttgctcatgcctgtaattgcagcactttgggaggccgaggcaggcagatcacaaggtcaggagattgagaccatcctagctaacacagtgaaaccccatctccactaaaaatacaaaaaattagccaggcatggtgggacacgcctatagtcccagctacttgggaggctgaggcaggagaatcgcttgaatccaggaggcagaggttgcagtgagctaagattgcaccactgcgctccagcctaggcaacagagtgaaactccatccaaaaaaaaaaaaaaatagtaataataatatgattcacccaagcaataaatgacataatgacaaagagcatacctcatatgccctgattctatttgctttatctatccaatctttgcatcccattctatcaccattaccattttttttttttgagacagggtcttgctctgttgcccaggctggaatgtagtggcatgatctgggcttagtgcagcctcaaacttccaggctcaagccatcctcccacctcagactcccaagtaggtgggactacaggcacatgccaccatgtgctgctaatttttttttcttttcttttttttttttttatagacaggtcttgccatgttgcccaagctagtctcaaactcctggactcaaacgatcctcccacctcagcctcccaaagtgttgggattatagggatgagccactgtgcctggccaccattacaactttaaacataaaaaatacatagaatgttgaagaaggaatagcattttcattttactgattgatttattttcaacaaacgtgcgtttatgcaacaaacatttattaagcgtctaccatgtgccaggaagtgacctagatattcggaccatagtagtgaaaaatggtagacatttattatcaatttttattttattattaagatagacatgtctcttcttataaatttgaattttaatggcaactgacagacaatgaacagattaagtaataaaatcttcaaggggccttgtagactttgataaatagtctaaatttcagtctaagtgaattggaacacattggaaatatatcaattagaatgagtattggctgcatataataaggacctagctagtgtggcttaaatttatttattattaaatgtattgtatttatgtatttctcatgtaaaaggcttgcctcatcactgggactagtatggaggcttcatgatcatcagggtccttggtccaaaacagctgctgaggctccagccagcatgtttaatgccagaaggagaaaagaagccaaaacatgaaaggatatcccctcccttttaaaggatcttctaaaagtcctacccagtatttcctcttacatcccattgatcagaacctactcacatgactatatccagttgcaagggaagctgaagaatgtcgctgtctattactaatgagaaaagggacaatggagattgagttgggaaaccggcagttcctgccacagagatctgaatcatgctttttaaatggtactgccttctctacagaaagagattgaaaaggataggaatagaagggagattagttttttgcagttgtccaggtaaaattttggtaatggactgaggtggtgctgtagtgaagatggacagaagacgatgaattcagatatgtttttgggtatggtcaacgggactttctgatggactgaatagggaagggggtaagaaaaagaaaataatcaaggatcttgcgcaggtttttgtcttgagaaaatggatatatgacagtgatgcttactatgttaggaaaagttgtaagtgggtataagtttctggaggagagattcgagagtttctgtttgaatcatgttaattttgaaatgcctattacacattcaaatggcagttgccaaggtggtatttgaatatatgggtctgtagttaaagtagatgtcgaggcttagatatataaaatggaaatccattagcatatgaatgtaattaaaagtcatgggcagatgaaactgcctagggagaaattgtgaaaggagaacggagcccaggaccaaactgaggtttaccaccatttagaatgttggtagacgaatagtagccaattaagtaggcaaccaattcccttataacacacaaaacaatgtgtgctaaaagaatcagtgaaaagggagagtggtcacttgtattaaatgctgctgagaggtaatcaagtgcagacaaagatgtagcctttggatgtggcaacatggtggccacaggtaactttaacaacagcagttttagagaagtagggggacagggtcataattcaatatattcagctgctagtcactaaggaatcaataaatagtaatctaggagaagaggtggccaaattgatctctgtgcagtacaataaggactatgatacaggtctgcacagggttgacgggcacacaggagttggggtacttatctatggaggcaagagcacagagggctttcagaagaaggtggtaacttcttagatgttcaaactgcatctataagatgtatggagtaatgcattagcctgggagccagaaaacctaagttctagtcctgcctccaccactaacagatgtatgacctgagacaagttcattcccctctctgggattctttcttctgcctgaagggagaaatggctggactagacaagcctcatttgttttctgttttaagatcattatggaattttctaacctgttcaagtctgcttagactgaggtttttaatttaagattctctgcccttcagttaaccttttggggtatttcatttaattatctatatttctccactggaaattgatgtcactttcttcaggtttaattcatagtttttattgcagaataaatgagttaggataatgttattagctatcacaaaccccagcatttctgtggattaacacaagagagtgattatttcccccttatgaaataatccaatgcaagtgttgaccaatggctttgcatgcagttagcaagggacccaggctcctcccaacttgtgggtttgctatccttcaggttcttagaattacttgctttcttgtggaaagagaaggcagagaagacacataaccatcttagcctagaggtgacatatattacttctgatctaattctattgtgagaactcatcacgtggcttcacctaagatgcaatggggactaggcaatgtggtttctggctgggcagcaacaactccgaaaagggaacaagagtcttgggtagacagcagatatctccactgcagagaacatttcaatgacccatacaactcatttgtttattttctagctgaagaaaagcttatcttgtccaactcagagattcctgagacatctgcattttttcctgaaaatcgcaggtagaggcatatatcattgtttaggaagtagagcataaataattgtcattaaattcagaacactattagaatcatttgtctggccagtacttttgacctcttagatgcaagtgggaaactttggggggtatgcatggtgagtttagtcagtagtatccacactaggttttattatcctgctcttttgtttttaaagatattttattttatttatttattttttcaagatggagtctcgctctgtcacccaggctggagtgcaatgccacaatctcagctcactgcaacctccgccttctgggttcaagtgattctcctgcctcagcctcctgaataactgggactacaggcgcctgccaccacacccggctaattttttgtatttttagtagagacgggatttcaccgtgttagccaggatggtcttgatctcctgacctcgtgatccacttgccttggcctcccaaagtgctgggattacaggcatgagccaccgcacccggcctaatttttatatttttagtagagatggggtttcaccaggttggccaggctggtcttgaactcctgatctcagatgatccaccagcttcggcctcccaaactgctggaattacaggcgtgagccaccgcgtctggcctaaagatattttaatatcaaaagtgatactgtataagttactattatttatttctgcatatggacagtcctgaagaaataagagaaaagatcttgaatttctttgaccacgttttaacaaaaatgaagacatctgacgaagacattatccctctggaatcttgccagtgtgaagaaatcctagagattgtcatcttgcctctggcccaccattttctggctttgggagaaaatgacaaagccttatattacttcttagaaattgcatctgcttatctcatcttttgtgataactacatggtaagctgtttctacccagaccacctccaccctagagacaattcatagaacatagagccagaaggaagctccagcatgctttctgattacttcacgttgtatattcccgacagcacccctttccactgaaaatcacattgcttagaagggaaatgatctaagattgagaaaagagaattggaatacattgcaactagcattgtaaattatttaaaatattgccacctttagaaacttgccatgaattgtctacctgtatgggaggtaagggggcacatctcattcccaaaatgatgcagagaggactctcagcatagtcttcctcaagtggcatttaccctctgttaagcctaaaatacctgtgagcacaaaatacctgtaggtctttggataagtgcaattctggttttttgttttgtttttgagatgaagtctttgtcacccaggctggagtgtagtggcgcgatctctgctcactgcaacgtctgcctcccgggatcaagccatcctcccacttcagcctcctgagtagctgggactgcagacgtatgccaccatgcccagctaattttttgtgttcttggtagagatggggttacactatgttgcccaggctggtcttgaacacctgagctcaagggatctgccctccttggccttccaaagtgctaggattacaagtgtgagccactgtgcccagccaattctggttttaatattgtgatccccaaagaggctctccctgcctttgtcatcatgcaatgtgtgctagattattacacataccattagaccaccaaagcactagtgaatgtttctctagggtaattataaataaggttccagggcactatgcccatagaaatgaggggatttgatacacatgatgaaataaacagaattcattgttaagtaagttggaaatcactgagctgaatacaggtaaatagatgcctttagatacttcagggcctttgatatgctgagatatatatataaatctgttcagaggacacagaagggtaaaggccaggctaggctgaagcatactgtgtttctcaaacttatttgcccttagatctcttttcatggagcagctggctgggctaaccttccatgaactcacttgaggaaatgtctttctgggcccttgcttcatctgacttcagccagcttcaggaagagcttcatagaccttccataatttacagttgctactggtcacagcagcctaatcaaccctcctaccttagatttatataaaattataaaattaaactgttaaaaatgtcactaagttcctgtccttgaaacatttatgttaagaatgaaagtctcctgcatatttcatgcacatattcgaggtgatgatggggatgtagccaatgagtcccaggaggaggaggcttaggtagccctgggggccaactttctaaaacctatgcataccccgtttcacttgacaagaagacaatgattagaagcacagcctcagtgcaaggtcccagaatgtgacatttgtaccccctctcccatcaaactccagtgggactggggctggtggccaactcatcatgtctccctctttttttgcctcccacacatacccaacaggatgcatgagactgggagatactgcctcaccttattatattcttcaagtctgatcttaccttggtgtgcacacgtgctaagatttgcctaatgatgttgggaggtgaagctgaagtgatgagagttgtgcagggacttacttcctcatccacctcccaaaatgaccctggcaaaggaagtgggggtgattcataattcatttaaaaactgaagaccaacttctcacagatgtggggatgctgttcaagggaagtggatgtgttgttgggaatagggaggttggggatagaattattgagaggaagaaactggcttgagggaaacttcgggtaaggcaacctagatgatagtgtgaagaaaggtggagatttccagattcattctcttgatggagtgatccagcagacaaaggtaagcatgaaggtgagatctttacccatcagctcctgtctggaatttggaagcccattttaatcagtggagctggggatggaagtggaggtggtaactgaaatggctcctgcatctcttacttcagtagagtctggggcaatggcccttctgtgggctcaatccctgctgaatcaacacttttctactccttgggctggttacaggcatacatgtatttgaatgaaggacagaagttgctaaaaactctcaagaaggacaaatcttggagccagacatttgagtctgccaccttttacagcctcaaaggtgaggtaagaaaccattaaagacttgaatttatctgttatatatcttaggcctttccatagaagtagaagtcatccctatactttctacaccctcctcccatctcttgccacagacttctagccaagactctagaaactcaaatccctgggctccaacctcctcaccatggcttaccagcaagatcttccctgtcttccaggtttacatctttttttttttttttttttgagagggagtcttgctgtgttgcccagcctggaatacagtggcgtgatatcggctctctgcaaattccgtctcctgggttcaagtgattctcctgcctcagcctccaaagtagctgggattacaggcatgcgccaccacgcccagctaatttttgtattttagtagagatggggtttcaccatgttggccaggctggtctcaaactcctgacctcaagtgatccgcccgccctgacctcccaaagtgctgggattacaggcgttagccaccgtgcccggcccaggttgacacctttatgaaatatttttgttacaatctctaaaaatggacctgaatgggtaaacattgtctcagaggtagacaatgcacaactaagatgctaaatcctagtcattcaaccacccttcatgcatatatccaatagacattttctattatgccaggcacaggaagattttgtttctggtccataaattaccttttttgataagaatccccaaaatatggattgttgggacctactaattaagttagaatcatcgttttcctcttttcctctcttccctcccacctccctgtaggtctgtttcaatatgggccagatagtgcttgccaagaaaatgctgaggaaggcactgaagctcctcaaccgaatctttccttacaacttaatctccttgtttctccatatccatgtcgagaaaaacagacactttcattatgtgaatcggcaggcccaagagagcccacctccagggtaagggaaggagctggggagagcagactgtttagtctcactccccagagaggcctacacataatccaagtcagcccccaaagcctggcctccagggggcacaaggactcctgtttggctctgaccattcactggggagggggcgagtgtgggaggtgctcccataccagggttgccacaaagtactttacaggcagtttttgccaaagggaattttgatgactcaaacataagggacctcgttgtaaggtaagttctagggtccgtcctaactcatctagccctttaacccccatggccatccgtgttctcattggatggaacctgcaccactgctcctgggacctcagtcacaagccctcttccattaggtgctaagacactgggttttgccccgccccaaagaaaaatagcaagccctgaagacatttgccaaaggacaaaactcccacccatctaggaatctcaatagggatatgggttacatggggggtatccgttggtcaaaattgtactgttaagatttgggcatttcaatatatataaattctacctataagataactataataataatgagtgggaagaaatagtgagtggagaggtagatgaaataagcatgttgctagttgttgaaggtaggtgttgagtgcattttgctcatcatactcttgtttgctgtgtgtatgcttgaattattctataataaatgttttcaaaaatattccacctatctagcaattcatggcaaaggagatgcctccttgttgggtacctggagagctgacagaggacacctcttccatcttgggggagctctgtagctatattactataggttctgcctaagatacaaacatctattcctacgagcaagctactacaactcttttgcaaccccatcagaaactgccttccccagcttccaaacatgttcctttaaatgtagggaatcctgaggtgaaaaggaaatgtaatggagctgagctcctgtgcacgttggaggtgggctcctgggaaaacctggctgtttctggaaaccccaagaggaagggctgggagatgttcagcagagatctctctgagaaggcagtggtctttgcattacacatagggttgcaggatgcctcaatttgaatttcagataaacagtgaatactttttttagtatacatctatcatatgaaatatttaggacatatgcattccataaaaattattaggtttaaaattcaaacttaattgggcatcctgtattttcatctgctaaaacaggtaatttacacatttcacattttgtaaaaggagtaagaagtacctgcacaaagggaaaaggtagaaaagtgttgaagaagaaaaaactgaggagctgttggcttaaaatatccacaggtcaaaaggttctcatctcaaaaatgagtatgacatggaacaacatttaatgtcagagtgtccatgaccctcacgaatgccctataagagattttacccagggctgggtgttgtggctcacgcctgtaataccaacgcttagggaggctgaggggggcggattgcctgaagttgggagttcgagaccagtctggccaacatggtgaaatcccgtctctactaaaaatacagaaaaaatttagccaggcgtggtggcgtgcacctgtaatcccagctactcggaaggttgaggcaggggaattgcttgaaccagggaggtggaggttaaagtgagccaagatcgcgccactgcactctagcctgggcgataaagcgagactccgtctcaaaaaaaaaagagagagagattttaccctgtccatgtttcctaagaacctttaaaaaaaatcatttccacatcataatttagaaagtttattttgccaaggttgaggacacgcctgtaacacagcctcagtaagtcctaacgacatgtgcccaaggtggtcggggcacagcttaattttatacatttggggagacaggagacatcaatcaacatatgtaagaagtacattggtctggaaaggtgggacaacttgaagcaaaggcaggaagttgggagggagcttccaggtcacagataggtgagacaaaagttgcattcttttgagtttctgattcgcctttccaaaggaggcaaatcagatatgcatctatgtcaaagggcagaggagtgactttgaatagaatgggaggcaggtttgccctaagcagtttccagcttgagttttccttagtgattttgggggcccaagatattttcctttcaaaatgcaatagttaaaaatgctcattttttggccaggcgcagtggctcacgcttgcaatcccagcacttcgggaggctgaggcaggcggatcacctgaggtcaggggttcaggaccagcctggccaacatggcgaaaccccatctctaccaaaaacacaaaataattagccagacatggtggtgtgtgcctgtaatcccagctactggggaggctgaggaaagagaatcgcttgaacctgggaagcagaggttgcagtgagctgagatcatgccactgcactccaacctggacaacagagcgaggctcaaaaaacaaaaaatcctctttttttttttttttgtaaactaaaaagtacccaagacaggtatcaatcaatctgtaagtttattttgccaaggttaaggacatgcccagaagaaaaaaaaacacaaaaccacagaaacagtccctgtttgagactgcagtatttaaaggggaaaagtgggctggaggaaaatgagggagggcgtgataataatccacatgttgcaagagaataggagcagctaggggaatagtcaattatgtattgtctcacactcagtaaataggcacttaaggtaggataaggcagacatagagtagctacccgtgcagatacttaactttttatctgtagctgtctgctaaggaacaaaaggaaaggcaacttcttgcatgactcagctttcagcttaattttttccttttggcatagtgaattgggatcctgagtttttattttcctttcacacctttgttgagctgagaagtagttcctgaaagcagtgtgcaatggagaaaataatacattgggcttttgggctggaggtagatggagtttgaatcctggcaccaccacattccagctgtgtgtctttgccttaattacttaacctgagtctcaccttcctcaaatgtaaaatggagtcagttattccactcttttcttacaggattgtcatcagaatcaaatgtgatgaataatatcaatgtgctttttaaatagcttcatttagcaattacctgactcaggacagatgctttacataaattatcttaatcattataaagtaggtattatgattcccattttacaatgaagaaaatgtgctccataaaaattaatgtgcttgtttgtcagtcatggagacaggcctcaaattcaagtcagttttgattcccaggcccatagtgaggacaccatgtacctgtgctcccctaaatcatggtaatgatgatacctttcatgttccatttgtgtttaccttatccaataggaagaagaggctggcacaactttaccggcaaactgtctgcctttccttgctgtggcgcatctatagctacagttatctttttcactgcaagtattatgcccacctggcagttatgatgcaaatgaatactgcactggaaactcaaaattgtttccaggtaggggatttttgtagctgctcctttaagtttctgaatttcatttgggaagaaaagcctagtgaaagccaattaggattcaaaattctgaggatataataatagaaggctttctgattggcttgttttgacaaggccagcagttctcaaacactttggctctaggatcacttcacactcttaaaaattattgaagatcccgaatagcttttattcatatgggttgaatctattgatagcatataagaaacaaaagtcgagaaaattctaaaatattattattattatttttgctggttttttttgagatggagtcttgctctgtcacccaggctggagtgcagtggcacaatatcggctcactgcaacctccacttcccgggttcaagagattctcttgcctcatcctcctgagtagctgggactacaggcatgcgccaccacacccagctaatttttgtatttttagtagagacggggtttcaccatgttggccaggctggtcttgaactcctgacctcaagtgatctgcccacactggccttccaaagtgctgggattacaggcgtgaggcactgcacctggcctaaaatattattttaaaataaagataacaagcctattacatattaacataattaccattttcattttttaaaactctgttccgcaaacaaaaaatgggaaatgtggcattgtattaaatttttgccaatattttaacatctggcttcttagaagacaactagattctcacatctgcttctgctttcactgttgcagtatcacatatgttgcctctggaagactccagtgtatattcatgagagaatgagggtgaaagagaaaaatgttaaaggataattcttttttaaaaagatagaattataactgataacaaatatggaaagtacacatcaaagattttatttaactcactgagttgactcaatcaaaattagtaagattggaaccaagtggttccaaggagaatctgtttaccaatggatacaaaacttgtctagtaacagcataataatcacttgtattccactgaatatttacatttctatgaaaaacaaatcatatcacttatattaatatcagttttctgcaacatagttgtaagatagtccaaagaaaaatagagataactttgattagtaagctagataggatccccactaagttgtgtttttgcccattttaaggtctttcactatttttcctgtcacaaataatgcctggatattagcggggcatggtggctcacgcctgtaatcccagcactttgggaggctgaggtgggcggatcacgtgaggtcaggagttcgagactagcctggccaacatggggaaaacctatctttactaaaaatacaaaaattagctgagtgtggtggtgggtgcctgtaatcccagctactcaggaggccgaggcaggagaattgtttgaacccaggaggcagaggttgcagtgagatgagatcacaccattgcactccagcctggatgacaagagcgagactccaactcaaaaaaaaaaattttttttttaaatttaaaatgcctagatattatggaactagctttgacctcatgtggtctctgaaaaggtgccacggatccctagggctcccaggatgaattgggagaaccactagtctaggtcataaccaaagaagcctttgactggatgaagaagatatcaggagacatgatcaagaaattattaagctaaatcaaactcatctaatgagagtgaccttgctcctttataaaagtacattaaatcagcaggccgggcatggtggcttatgcctgtaatcccagcactttgggaggccgaggtgggcggatcacaaggtaaggagatcaagaccacggtgaaaccctgtctctactgaaaatacaaaaaaaaaaaaaaaaaaattagccgggcgtggtggcgggcgcctgtagtcccagctactcgggaggctgaggcaggagaatggtgtgaacccaggaggtggagcttgcagtgagcagagatcactccactgcactccagcctgggcgacagagcaagactccatctcaggaaaaaaaaaaaaagtacattaagtctgggtttcttcctcctggagtcattagttgtcaagaattaagggaaggggtcaagtagcaccaaggagctactgttggaggagcttagattcctaacctggagtctgtcctctacattagttccttttggtgaatttaggctggctctcctagaatacagaagtatttataaagcccatcaagattgacccctgcctatttcccatcctcttctagctctgtaggccatgaagtagccacaagcccagccatattggtcctcttttggttcctcaaacacagaagtttaatcccatctgtcactggatgtttcctctgcttggagggaactggtcatggccacccattcactttctaacttgtcactctgttttaataggtatgattaccatttgacaatttcttgtttgctcctgcattggttcttggtctctctcccttaccagtgtgtaaatcccttggaagcaaggacctcttcagctgtcttgttcacatcctaagtttctagaacatttgcagttgctcaagaaatttatatggactgaaatacttctccacacttggagctatatcctaagaattgtggtagagttggggtggggaaaataaaaagtcaggatagaatgtgaaccaagacatttgtcatcaaggtggctgggattgaaagcaaagaagcgctcccctcagtgctcaaaggcaggtgagggactcagcatgggagaatggaaagaaccagactgagagccagagggtggtttccaggactccgcctatctgcagtgtgaccactgaaaagccgcataaacaaggagctttatattttctctgtaaagtgaagcagttggacctccattctcttggtccaaatccaagaggtcctaggctttattacagccttggatttctcgtgcccaacacttctctcttcccccaccaccatttctggctatccttaccttctggtagcattatctggaacatgttccaaaccagaaagaaaggaattctctaagactgatgtggtttaagtatccagggacctgcctataacacagaatttgtaggctgcttattttgtcccatctgaggaattccaagaaaaaagcctctactctaaaacacttccccgaccccaatactcccaccactagagatactttatttttcctgtttgtatttttcaaagtagtttacatgtattattttgtttttgtatatataataaaactgcttctttagaaggaacccttttctcctcactattctctaagcatgtatactctgaagcaactttatctttttaaagagttgtttagagtaaccagtttctcttaaatctgcaaattagatttatttgtttgttcgtttttgagaagggtctcactcagtcacccaggctggagtgcagtggcgtgatcatggctcactgcagcctcaacctcccctgctcaagtgatcctcccaaacacctcagcttcctgagtagctaggattacaggcttgtgtcatcatgctggctacttttttttaaaatcttttgtagagatcaggtctcactatattgcccaggctgggctcaaactcctgtgctcaagtgacctctcgtctcagcctcctgagtaggtaggactacaggcatatgccaccatgcctggctagtttttgttgttgttgaaacagggtctcactattgtgcccaggctcatctggaactcctgagctcaagcaatcctcctgcctcggcctccagaagtgctgggattatagatgtgagccactgcacctgacctccaaattaggtttaaaactagtccttatttaaaaaaaaaaaaaaagccaaacaaacaaaaccaacctttctttcttttttgttaaattacaaaaattatacatgcttgttataacaaacatcacagaggtgcataaagtaaaatctctcctcccacccccaacaaatatataactactgtttacactttggagtgtatctttgcagcctttttgctctgcaattatacatctaatatgtaagctattgcttttatttttcacagaaattaaaatttttatatttcatttaaggactacatgggcaaggggccatcaagcttatcctgaatgactcagtaaacaggtagcagaaacccaatttgatttctatttctaagcccatggcttcggccaaatgtccagctctattcccaaacttaataaacaaacatttactggcagacattgagtgatgttcctgagctttctgctttgcgttctgcctcactcttcctccactctgccatttcagatcattaaggcttacctagactattcgctataccaccacctggctggctacaaaggtgtgtggttcaaatatgaagtcatggccatggagcacatcttcaacctccccctgaaaggcgagggcattgaaatcgtggcatacgtggctgagacactggtcttcaacaagctcataatgggacacctggatttggccattgagttaggtaagggctggctgggcaagatgggacatgaggatacaaggaatgccccacaatatactggaattgttttcttcccaggctcccgagcccttcagatgtgggcactgctccagaatcccaaccgacattatcagtccctctgcagacttagcagatgtctccttctgaacagcaggtatttatcttaaagcattttccaaaattagggggaggaggccgtattattgagtattctgggttcaactttagcctagtcctagggtggggaagggagtagagtttgcagtaagaaaatgtaactgatagtagtcacccttttttcttttttcagacagagtcttgctctgtctcccaggctggagtgcagtagtgcaatcttggctcactgcaacctctgccttccgggtttagacaattctcctgcctcaacctcccacgtagctgggattacaggcaacgtgccaccacacccagctaatttttgtattttttagaagagagggggtttcaccctgttggccaggctggtcttgaactcctgacctcaagtgacccacccacctcagcctcccaaagtgttgggattacaggcatgagccactgcgccaggccttgtcttttttattttaaacagaattctttgccatgcatcatctctaatctggttgctctggccagtgatcagagggtagtcagacagtcatcccagctgtgggaatcaggcctccacttctgtcaggtggagacaaagggaaaagtcttccagggaggcaaatggccagagaatagcaaccaggactagaggtcaaggccaatttgctctgactctggtcaccctgatatagaggacccaggaaagaacaatttgaaaaaagagccaatttgagattgaggttttagtcctggataggggtgtgtttgaaatctgtttaagaggtatatttggttccgaattactgagaaggaccaaggctagaccaggaagggactttactgaacctcatcctatccactgctttttttattcaatagctttgggggtataaatggttttcggtcacatagatgaattttatagaggtgaattctgagattttagtgcacctgtcacccgagcagtgtacacatacccaacatgtagtcttttattcctcacttccctcctcccctcccctccgaggccccaaagtccattatatccactgcttttttttttttttttttttgagatggagtttcgctcttttgcccaggctggagtgcagtggtgcattattggctcaccacaacctccgccttctggtttcaagcgattctcctgcctcagcctcccaagtagctgggattacaggcgcccgccaccatgcccagctaatttttgtatttttagtggagatggggtttcaccatgttggccaggctggtctcgaactcctgacctcgtgatccacccacctcagcctcccaaagtgctgggattacaatatccaccactttttaatggccactaccttttcttttccatagatacccgcaattgatccaggtgctggggcggctgtgggagctttctgtaacacaggaacacatcttcagcaaggcatttttctattttgtctgcttggacatcctgctttattctggtaagtgtgggtttgggatgtaaaagaacttgggggtgttgatacctgtgctggtgtggtgtggcagctctcaggttggggctttgggaccactaggtttctggctggtggacttacagggcagggatggagagaggctggttgtgtgagctgaagcactgtctagaaggtgccgagattgtaaaggcacggcaagaaggagaattaagtctgaaggaacctgatggatatgagctgccagttaaactgtcagatcaatttgcacctaagtgatagtggctgactgtcttactatgtgccttttaccaggggtttttaacttttagcaggatgtacttagagacttcacgctttagaatgaaggactagattgcttgaggtgagagttccaggctggtagctattggtgatttggaaaataagttacttcctgataaccttcaagtgacaccaagtaggtcacttgaagtgtacacactaaaccacaggaaccaacctgaattgttttccccacatgtgatcttgaaaggggatgcagacattgccatcaacaaaggaagcatgtgtggagagacagagaagtcctaggctgcactaaggccaggaaggattagtttaaaccccacacctgcctggtcggtactgtggaactgtagtatatatccataacactccccaataggtaggactcagcaaacacagggcaatccagtcatgaggttgttgcaatccacgggaccctctggattcatacaataatcagaggcaactctccctgcagtgggaaattcaactgagagtgactaggctagaaagatgatcacccacacctactaataactctcacccattcctctctctcttaggttttgtttatagaacatttgaagaatgtttggaattcatacaccaatacgaaaacaacagaatcctcaagttccacagtggactcctcctgggactttattcctctgtagctatctggtaacaatgtgtggcatatcactaaattcccaaagtgaaaatgttgaatcccaaggaagagttcttgaaaaatcttttagaaagtattcataatttatacctgagacagcttaagggtgtcagaggatatttacacagagagacatgttagggatcaactagttcatcccccttggccaaggacagaaaagtaaatttatctcaattacatccatgcaataaacatttatcgcaaacatatcatgttgtggtgatacagggataaataagaaaagattgctttcttcagaggggtgctggggtttgaggaagactaatgaatagcaccacttgcccacccggcacctgcccatatctaatcacatggattgacaaagccaatgttggaagacatggcttatatcttcacgaaagcgggcttcgtaatattgagcactggaattagacttaacccattcagcagcaggcagttctggaaaactgtaggtctactcacatggaggcaggcctcttgtagcagagagatcagtatcacactccctgttggcttcactggctctcaagatagagagagacacggactgagttatacttgcccaattcatctcccaaatcaccagcaagatctctccttatcattgaaggggcaagtaaagcggggaaagagttctggtgctttgcaccaaatagaggccccttacatggaaggaaatttcaggagtgaggaagcagcattctccccgcaccccattaactcattaagcctaaggctcaattcctttaacctactacgtttttaactcagttaagcatgtagctattatggtcatacccttaaggaaggagatgaatgctaaggttctaaaatgggtcagaacagaacattcattaaattatttccatgactatccccaagactgaaaatcgccccctattattttatttcctatcttaattatatgcaaccgtatggtctatcagaggtttgtgatgagactaaatgacaatatgaagacattcctatataaaatgctacaagttagaacagctccaaattggaatagaaatccaccccttccttctttctgagacagtcttgctgtgtcacccaggttggagtcccgtggtgcgatcgcggatcactgcagcctcgccttcccaggctcaagtgatcctcccaaacacctcagcttcctgagtagctggagttgcaggcacataccaccacgcctggctaattttaatcttttgtagagatgggatgtcgtgatgttgcccaggctggtctccaactcctgggctcaggtcccgtctacctcagccttcccaaatgctgggattacaggcatgagccactgcacctggcaagaaatcccctcttattattaaaattaatgaggagaaattaaaatccaaaaattgattactcttgccaattaaagttcaaaatcaaataacttaccaatgtgagttaaaggttaaggaatctaaagtccagaaatcatccaaatttatttttcttgtctatctcagcaggagaattttttaaacagctgtgtcctaggccaatgctgctcagactttagtgggcataaaaatcacctggagggcagtcggccagctctcggggtgctgagccaggcgggctaggcgaggcgcgggctggccccgcccctctggccggccccgcccctcaaggccggctagtccccttcccagagacttggctaggcggccggcgctgcggcgccagcagccctgtggtggcgacgacgatggaccaggagccagtgggccctgtggaacgaggagaagccgtcgcagcctcgggagctgcggccgccgcggcattcggggaatctgcggggcaggaaattaagggatccaaaaagctgagtcatggtccaaaaggaaacgttgatgtcaggacaaccatagccaaattttatctcaaggatgagtaacgaaagaggctttgaaacgtagaactgggagtcataggaaaaaagaagaaagtcccaaggagagtcatccactttgttagtggcaaaacaatggaagaatacagcacagatgaagatgaagttgatggcctggagaagatgttttgcctactgttgatccgatttggctttaaatatttggctattagaaaatcatgccgggcgcggtggctgacacctgtaatcccagcactttgggaggccgaggccggcagatcacctgaggtcgggagttcaagaccagcctgaccaacatggagaaaccccatctctactaaaaatacaaaaaaattagccaggcatggtggcgcatgcctgtaaacccagctacctgggaggctgaggcaggagaattgcttgaacccaggaggcgaaggttgcggtgagccaagatcgcgccattgcactccagcctgggcaacaagagcaaaacttgggtctcaaaaaataaaaaaaaataaaaaataaaaaaatcataagcaggccaggagcagtggctcacgcctgtaatcgcagcactttgggaggctgaggtgggtggatcacctgaggtcaggagttcgagaccagcctggccaatatggtgaaaccgtgtctctactaaaaatataaaaaattaggcaggcgtgatggcaggcgcctgtaatcccagcgaggcaggagaattgcttcaaccagggaagcagaggttgcagtgggctgagatcgtgccattgtactccagcctggtcaacaagggtgaaactccatctaaaaaaaaaaaaaaaaaaaaatcggattttctacacagaaaatattcaaaggattgtaccatatactctgaaggtagttccaaatgcaggtagactattaaagaggtatttcatgcaatgtaagaattgttggaataaatgtcttatttttaattactttgaagggttaaaaaaaaaatcacctggagagcttgttaactcagagatgccacacccccagagcctgtctgattcagtagacctggactgaaccagagaacctgcattaatgagaatccaggtgatactgatgatgccagtctgtggactacattttgagcagtactggcctaaatcatctctctttggtattggaacaatttcttcaagccccagaatccacagctccaagtgtctgatctccctcactttttaatttaaaaagccaaagtggccgggcatggtggcacagcctgtaatcccagcactttgggaggccaaggcgggtggatcacctgaggtcaggagttcgagaccagcctagccaacatggtgaaaccccgtatctacttaaaatacaaaaaattagctgggcgtggtggtacacacctgtagtcccagctactcgggaggctgaggcaggagaatcacttgaacccaggaggcagaggttgcagtaagccaagattgtgccattgcactccagactgggggacaagagcaagacttcgtctcaaaaaaagaaaaaaagccaaagccaaagagttcaatggtggctaatattacctgagtgtttccaaggattctattcatctcaagtcatcaaaaaaatttattatttccttgctctgtatcacataatttcctgcttttttagggagtgtgaagcaggggtaggcaggagactacacacttccagagacccaggtaaaggaagctgcacatccagagagacatttcagaaagccagcctattcctaatgggtgatactgatttttcttattctcttgtggtaatgcaggtatgccagacttcaggaatgggacaacttttacaaattttccaatagagctaaaaatcttttgccaagaagaaccatgacacttacttactatgacggaatatctaggtacatggaggggcaagttcttcaccttcaaaaacaaatcaaagaacagtcagagaatgcccaagccagtggggaggagctactcaaggtgaggcctattctccagtttccagtataaaatatgccttaaatggatctctgtctacttcctgtgctaattattttctcattatagaattcatatatttttataatagaagtttttgaaggcacttccccaaagtaagaaagaaaatataaattgcccataaccttactactcagagataagtactttttgtatattgagatcccacttttcaagtatttttctgtgtgtgtgcatgcacatttctctattttgtaatttgctattaaatatattacgaataatttcctgtcattaaattgtttttcacatcacgatttaaaaggaagcatggtactttatcttacagatatatgattgtatggcctaattattattggatagaacttttctgtatgattttattgctattgctgtgataaagcatcctggtagacaaatcattccacacgacaatttaaaaaattcaaatatgtattaagcatattaatacaagagtgctggggcgcaagagtgagcaaattaaacacctccaagagtttacaacctggcatgggcaagcccccaagagaataaagggctaaatctctggtgttgggttgacacgtttgccttgttcttgtaaacactgagcacaggtgtactagttttctattgctctgtcactcattaccacaaagtaaacagcttaaaacaacacccacttcttaacagagcctccctttgtcacccaggctggagtgcagtggcgcaatctcgactcactgcaacctccgcctcccgggttcaaacaattctcgtacctcagcctcccaagtagctgggattacaggcacgtgccaccatgcctggctaatttttgtatttttagtagagatggggatttcaccacattagccaggctggtcttgaactcttgacctcaagtgatccacccacctcagccttccaaagtgctgggattacaggtgtaagccaccatgccaaggccaaaacaacaccacttcttaactcacagtttggcgggtccaaagcctgggtggtctggtctgggatctctgcttaggagatgtatttacataagtagacataattgaataattgaacacattgttgctgttattttgaacaaactgtcatcttttagaataagaaaaggaaaatttttattttacctccacttactccttcttcaatgctttctttctttatgtagatctaagtttctgaactacatattttccttctctctaaagaatttctttaacatttcttgcaagtcagagctattagcaacaacttccttcaattttagtttgagaagtctttattttgtcttcaattttgaaggataatttcactgggtaaagaattctagggatttttttcctgtcaacaggtcatggcactgtcttcttgcttgcatggtttctgaggaaaagtgaaaggcaattctttttttgttgttgttcctttatagaagtcccttgggcttctttaaaactttttgtttttctcttttttttgaaatggagtctcactctgtcacccaggctggagtgcagtggcgtgatcttgactcactgcaacctccacctcctgggttcaagcaattctcctgccacagactcctgagtagctgggattacaggtgcccgccaacatgcctgactaatttttgtatttttagtaaagacagggtttcaccatgttggccagtctggtcttgaactcctgacctcaagtgacctgcccacctctgcctcccaaagtgctgggattacaggtgtgaaccaccgtgcctgacctaaaattttttatctttgattttctgtagtttacaaattatatgcctatgtgttggggttttggggcatatatcctacatggtgttctgcgagcttcctggatctgtggtttggtgtttgaccttaatttggaaaacatttcagtctttcttgcttcaagtatttctgatgttactttcctctttcttctccttctgatatttctattatgcatctagtataccttttgtacttatcccgcaatccttggatattctgttatggtttttcttttctagtctttgctctcttagcttgtcagttttgtaggtttctattgatatgctcttgaactcagagattctttcctcagcggggtcctgtctactaataagcctgtcaaaggcattcttcatttctctcacagtgtttttgatctctagcatttattttttgttcttaggatttccatctctctgcttatattgctcttacatgctctctactttattcattagagcttttagcatattaatcatagttattttaaattcccagtctgataatttcaacatccctgtcatgtctgcttctgacttgtgttttcaaactatgtttttgccttttagtatgccttgtaatttttcttgatagccagatatgatgtatcaggtaaaaagactttgtctaaataagtctttagtaatgtgatggtaaggtgtgaggagagggaaagcattctacagtcctatgattaggtctcagtcttttagtgagcctattcctctggactaagaacttcacaagtgcttttcagtcccctcttccttaggtgggacataatggctagaactgggtttagttgggtattcctcttccccaagatcagttagactctagtaaaacccctggaggttaggctctggttacatagtttctcctgagggcacaccttgtttagaaaaacggagtactctggcatatttcaaaatggttccttttcctcttcctctgctgaaagaatgagagattttttttcctccaatatttactgagagatcctggttgagcttctggaggtaaaacacacaaaactgtgggggctcacctgaaggtgtttggggtttttttttgtctaatttttgttgttgttgttgttggagacagagtctcactctgtcgcccaggctggagtgcaatggcgtgatctcggctcactgcaacctccgtctcctaggttcaagtgattctcgtgcctcagcctcccgagtagctgggattacaggcacccgccatcatgcctggctaatttttgtatttttgtagagatggggtttcaccatgttggccaggctggtcctgaactcctgacctcaggtgatccgaccacctcggcctcccaaagtgctgggattacaggcatgagcccacgtgtggcctaatttttttttattgtgatccaaatacacatagcataaaacttaacattttaatcatgtttaagtatgcagttcagtggtatgaaatacatttctaatgttgtgtatccatgtctgccctccatctccataactctcttcatcttgtcaaacaacaactctatacccattaagtgtatgtttgttatatttagttggtttattgtgttgtctaagtcctctgtgtcttatcttttgtataattgttctatccattattgactgttagtgaagtctccaactactattatagaactgtctatttctacctttaattttgtcagtttttgcttcatatatattgacgatcttattagatgcataaatgtttataattgttatatttttattttaaaaatataattataaaacaaatgtttataattgttatatatattttgctgtatttaaatttttattaatatattattctttgcctcttgtaagtttctttctgatttaaagtttattttgtctgacattagtatagccacctttattctctttgggttactatttgtataaagtatctttttctatcttcactttccatttatttgtgtctttggatctaaagtgagtctcttttagtatgtaattagatcatgtttttaaaaaatccattctgccaacttgtttttttgttgagagtttaattcaatttaaagtaattactgataaagagggacttgtgtgtatcattttgctatttgttttcaatatgccttacagctttttcattcctcatttcctgaactagtgtcttattttgcatttaatttttcatagtggaacatttaagttctttccccattttcttttgtatatattctatagctattttccttatggttaccatgaggattacatttagcatcctaaagttaacttcagtaatgcacaaagaactccactcctttaatagcttcccacccctttcagttgttgatgtcacagaattacatttttgtacattatatgccccaaaacataaatgaataattattttaaatgatcagtctcttcaattatgtagaaaacaaactgtggagttacaacccaaagttacaatactactagcttttgggctactaaattttaaaaacgtattaatctcttaaaaacgtagaaaacaaaacaagttacaaactgttattacaataacacttaattgtccatgtatttacctttgttgagatctttatttcttcttagagctttgactgtcctttcattttaccctacagggctcctttaggtatttcttgtctttctttcttttcttttctttcttttttttaaggcgtgggcattttttggaagaaagtcctggtggtaattaactttgtttttgattgtctgggaatgtcttaatttctcccttatcttcgaaggacgcttttgctgaatagaagactcttggttgacgggtttttttttgtttttttaatattttgaatgtattggcccactgccttctgacctctaaattttcagatgagaaatctgctcatgatcttattgaagatgtcttgtatgtgattagttgcttctctcactgctttcaagttttgtgtctttcacttttcaaaagtgattatatttgtctcagtgtgtatctctttaagtttatcttacttggagtttgttgagcttcttggatgtttatattcatgtcttttatcaaatttggaaagtttttaaccattatttcttcaaatattatttctagtcctttctctctctcttcttcttcagggacttccacaatgcatttattggttcacttcttggtgttccacaagtcccttaggctctgttaacttttcttcaatcttttttctttctgttcatcagactcaataatttccattgtcttatcttcaagtctgctccctgtttaattctgcctttgaatccctctagtgatttttttaaattttagttattgcagttttcacctccagaatttctttttggtatatttttaggttttctgtcactttactgttatttccattattttcatacatcaattacttgactttatccacattttcctttagttctttgattatctttagagttgtttaaaaatctttgtgtaggatatctgccattaggtctttttcagggacagtttctcttgatattttttcccccttgggatgagccatgctttcctgtttcttggtatgcctttttgttgttattattggaaactagacctttgaatctaataatatcacagctctggatatcaaattctccctcttccccagggttttctgggttttgttgttgtttttgttttttattgttgtaggctgtctctatgccaaggatcagcctgaggtgcaaacttaaggtcttcccagatcttttctgagcctgtgcctttccctaggcatgcacagtcactttctaattttccttttataggcagttgcttttgaatgtcctagtatttaatgtctggctgtcaaggtggtggagggtgggtggagaaaaaaataaagttgggggaggaaagggcaatagccctttaaatccactggaagtcacttcaactggagtgggaggggcttgcaatgacggggagaggtgcaacaatgactgcctacctcttccatcagaagcagcaattggtgatcagagcacagatccctgatatctcagacagggtcctttttgcccacccttgttcccacaagttgtacgcaggttcttcaggagcatgtgcacaacaactgtctgccacaggttttgaggctgggggacaggcagctgtgctaagagctgaaactgaaattaacctcagtttaccatccaagccttcctctggtatttacaagccttcagtagactccagagttctaaaatagttacattctgacagattctgccagtgtaatgatagtctaggtggggctacagatagttggtacttcctactctgccgtctctccagaatcctcttctccctagagtttttaactcccagaccggtccagtctgagtttctagcaattcatcaattacagttcaggtttttctagcctggcactggttcccacagtggtttccacttgtgagtctccatctgtttgtctctccagtcttaggggcagcagtttgccctgtgttctcacttctcttatggatccaagaatagttgttgatcttccagtctgttcagctttatttatttatttatttttgagatggagtctcactctgtcacaaggctggagtgcagtggcacgatctcggctcactgcaacctctgcctccctggttcaagcgattctcctgcctcagcctcctgagtagctgggactacaggcgtgcacgaccatgcctggctaatttttgtatttttagtagagacggagtttcaccatgttggccaggatggtcttgatctcttgaccttgtgatccacccacctcggcctcccaaagtgctgggattataggcatgagccactgcgcccagcctgttcagctttttacttgtttctaggaccaagtggttatttccaagctccttacatgcagaaatggccaattttttttcctaatttttcaacaattaacttgtactgccttaataatcataataatcaaaataattttttaaaaaaagttattgcagagaagtaatgatgggatctctcaggtcaattcctgatctcagtggaccatggtggctactctgcctgacatttattgtcttatctccaatacctactgtgtatgtctctataatgtattttctcacttgattgcttaaatccttgaaatgttcccaaatcatctgtgaaggaaataacttacagtcaaggacccctgtttaattctaatatactgttgtgggttttttttctttagaacttggagaatctggtggctcaaaataccactggccctgtcttttgcccaaggctctaccacctgatggcttacgtctgtatattaatgggagatgggcagaaatgtggcctcttcctgaacacagccttgcggctctctgaaacacaggggaatatactggagaaatgctggctgaacatgaacaaagtatgtatcatcagctagcaaaccggggtggcgatgctcacccatataaagaagcccagaagcctactgcctggttaggtttcaccaggctgccattaacaaaatatcttagactgggtcattgatgaacaatagaaacctactgctcagttttggaagctggaagtccaagatcaaggctctggagattcgctgtctggtgagggtccgttcctcacagatggtgccttttgctgtgtcctcacatgtcaaaaggatggaaaaagaaaatttgctccctccagcccttttatgagggcagagccctcatgacctaattaccttccaaaggcccaactcttaataccattaccttgggggttaattttcaacatatgaatttcaggagatgccaacattcagaccatagcagtcaccataggcctttctggattcttaccagaaagggtgacatgtccatagttcaggattgtgagcttcctcttcccctttaagttctcatggtctctctccctcatccaaatcccccttagcatgccctctctctgcccttctttgtggccactttccactttgtgttacatctgtctgcgtgtctttcctctccttgagaatgtgaactctttgaaagcaaaaaccacacttagtgcctagcacagagccctatactcagttttgttgaataagtgaatgaatgtatgagtatatgtgtgtatttaaagagggctgtgtcagtatcctagtttggacagcaagattcgtttttgtctatgggttcacatggtttttaccaaagatgttttgccttgtttgatattggactaaccttgattacaaaagtcaagaagcactaatgatttctttgttctgtttctttcctctcaggaatcatggtactcaacctctgagttaaaagaagaccaatggcttcagacgatcttgagtctcccatcatgggaaaaaattgtagcaggcagggtaaacattcaggatcttcaaaaaaacaaattcctgatgagagctaataccgtggacaatcatttctaacatgtcaaagaaaaaagattttaataagcactatgtccttgtgattatctattattgacctttctccgtggttggcccactccaggttcctacataatctcttctgttccagacacagaaacagacatgttgatttcttctctttctggagggcctacaagggtcaggagtgtcatggtttacttcttcctaatgttacaaaaaattgcttttaccattcatgttgttttagcttgacctgtttatttcagcccatgcaaaactgtatcatattacaaattattaatctcaagatggtatgacatcgtgtgttgcaaaagacatgtttctagttagtatgttaactgaaaatacttatttttaaatgtccaattgttaagtcttttggaggtagcacaatattacaaatagcaaacatttgtcatggtctacaaagacagaattagaaaagatacatgtttgtagggcctgactgcagcttccaaagccagggtgatgtcttagcccctctaaccacatgcatcaaatatcaaataaaattttaatatcagataaatatgtttaatataaaataaagatcaagttttaaaaattaaaatattaataatttttacacgggtatcttttacatatttagagtttacatgtttttttatatttaagaaataacattcattcttcatcatttcccagatgcaaaagcaaggctgtgcattttttctcctaatcacataactgagttccacaaacgaggttggacagacccagatgataccacgaggttaaccacagaggcctgatggcctggcatggagggaagagctccaagctaagaaatcagaacattaggttctaacatgagctctgccataagcacactttattcctgtctgatacatacaccctgcctgatccacataacttccctatgttagtgtacatttgtgaatactgaataagatagtgaaagttaaaaagtgttgaaaattacaatgtgccatacaaataaaaacaaactaatattagatgactgattttaaaataaacacatcaaatactaaacttcaattaagtattgtccccttcaaaactgtcatcctggaagctgcatgcttgccccatgctgcaatatagaaatcccttgctttctagttgccttattttgtactttattcattctctcacttattcaccccactacaattttccaactcattactgtatactaatccctgactaagtactggaggttaagatataaaaacatgaagggcacaattcttgacctcagcaagctcacatgtccaatagaaaaaacagatgcacgtgtaaacctcactgagcccattctactgtaatataatagagctgtgttcaaatccttcatggtggaaggagtgacacatacaaaacctggacatcttgaagactcagcggaacagcctctgattcatttcgactgcattgtcataataagctaatgccttaatcataacaattccttacatttgtacaactctttatagatacagagagttctgggacctgctcttatcttctccctgtaaaccctgaatggtgagaatggcagatgctttggcttgcctgagatcatctggccagtaagtggctgaactggagcctaagtccagaaattgtgtgcccttgtcgaagcatattcaagtccactttttctggctctctgtctgtgcaaaccatcaggaaacagtgttttctgtcttaaaaatcgctttgaccatctaaagattcaagttccctttagcttccaaaaaatggacctagttctactctttggaatcatacagaataaatttaaacttgttcctcactgaccccttcaaactcttgaacacacctctcatggttctcttgagccttctacaagctaaatatctccggttgcttctgcttctcctaccagctccttgttttcggttccctcagtatcctgatcacttgtctccgaatatattcaaatt

SEQ ID NO: 16848 - DNA, 33061 bp, Human
ttttaaagacccagaaatctttctgggcagtgcctccaaagtgtggcccctgaggtgttactgctgctctggtgaccgggggtagttgaccctatttcaatgtcaatcagaacaatatacattcctttataaacttgttttttttttgagagagagtctcactctgtcacctaggatggagtgcagtggtgcaatctcagctcactgcaacctccgcctccctcctgtgttcaagcgattctcctgcctcagcctcctaccgagtagttggaattacaggtgtgtgtcaccatgcccagctaatttttgtattatttagtagagacaggtttttgccatgttggtcaggctggtctcgaactcctgacctcaagagcctcctgggcctctaaaagtgctggaattacaggtttgagccacctcgccccgcctatactgaacatttacataatattttgtttgactaggtttctgccattaagaagatgcaaaaccctgagggagtgtacctcttcactttgcatatgggaaaactgaggctcagagaagtgaaatgactgagacctccaggtgccacctccctttcagctgctcctgccctgctccaagcaaggatgtgccaagtcaagagaagacagaggacaattaatgttatctgaggatctcggagcctcatccctgagctatgatggtctttccctccttagttgggagccccatcacgttcctccgaagctctagttgtgtgataaggagggtggaatctgagacagagaacgatggccctccaaggagggagttcggggtgaggaaaacagcaaaaccatgtgctagacaagatcttcaactgcagggctctggaggcaactgggaagttttgaaagtgcagattgaagctcagggccgctgtgggtggcgcaggaactgcagaagacaagataggattagggagggccagcaggttgccagaggcccttttccacctgctgggcttagaggggcgggactctgcccgctccctcacttggttgggtttaaatgaccactccccgccctagctgtgcctttgagtgtgtggcaagggattgcagacgggagactgcttgtcaattcagggaagtcagcctctttctgccacttaattcgcccatcagtagagatccgactttcccacggttcactgtcacccccattgcacaggtggggaatccaaggcacagaggcgtctgggccagagtcccgggactatccactcattccggggttgtagggcagcatgtgtcaggagcttgggctcgagcgtgcggggcactaattgcgagtgcagtggccacaggctcccgggcaaagtggtcaggagcccattcccgccacctccgtccgcgcgccccgccctgtcctccagcaagttggtgcacgcgcgtcctcccacagggcgcgggatgggggcggggcctccgtgttgttgtttctctggggccccgcccctcaggggggcgcggaccacgcggccggagggcccgcctcccctccccctccccgcccagcccgcccgcctctttgtatccaacatccgggtttccccgctggctcggctccgtggccgccgctcaggatccattttggactcggttcagctcccctcccccccacccctccccccgttcatggcccctccggactcggcccctgcgcccggggcccgggcccagccccgccgcgctatgcctgagtcgggcgggcgcgccccggcccccgcgtcgccccggagcccgggccgcagcctgcgccgcccgcagcggccctgagcccggccccgccgaccggcccttggagcccgaacgctgctcggggacgaaggcgcaggaagcgcgcagggaacgagaccgaaggaaggagcgggaaggagagcgcagccgccgcctggccctgcgcgccccgggagcgccgtgcggccctgcccgcgggctccgggtgtgcgcggggcggcgccgcggaacatgacggcgccctgggtggccctcgccctcctctggggatcgctgtgcgccggtaagaactgggcgcggcgtggggacgccgagagggcgcgcggggctggcctctggcgccgcgcggtgtttaccaacaaagggcgggcccggggccttgtcgccgcaccacctgtattcagccctcacctccgggggcgtgggctgggggcgcggtgggcgcccggctcgccgaacttgggggcacgatcttgtctgtgtagtcatctgcgggattctggttcctagaggcgcccctgcgatgggggccgggacgcggagcctcagggtcggagttcgggctacgcgggcgcgtggaacccagggaaagagtgaggaaaacctgagcctggggaaggcggccaagaggggtgggcagatctcattgggggtggcaggattgtaggtgcagcagcagcagcagcatgcggggagggttgcatgtccctcagagtcactaagtgtagcgaagcgaagggggcggcttcacgcagcccaaagtcccctgcatctcttgccaccagtctgcgtcgcgttaccggcccggcgggctgttggtgctggctcccacctgctccctctttccctgccgttggccccgggatgcggagtgtggtcgcttcgcgggaccgctttgtttgggcacttgggaggggagggggtgggtaagatggaaaacccaacaggtccctcttccttcgggcctccaggaggcacgtggcggggtgggtgaccagcgctcagctcgcccgcggctgcgggcgtgtggctggaggtgttcggccagcgcatgtgtgtttgggggtatgtgggcgcgggcgtaaacaagcggagttccgcctggaaagcttgtttctcctacggtccaagcaccgatttccctctctcagtggtgccggggtgcgcctaaccccggcgggcgcgccgggacgtcccctggccagtcctgggaaacgtggggagctgggcattgaagctctggcgagaaggtcggggcggctggtacccggccgccgggtcctgcgcgtctttgttcccagcccccattacacatgcagcgcgggtcccccgccgccctcggtggcagccgcctggagtctgggaaaccctcgaggggcggggccgggcgtgcaggggcggggccggagtccccacgctgctgcgggggtggggatttgggatttgcgtcccattcccaccctggttctaccttctcctgtgcgtcgtcgtgaggcttagtttacaccgaaagcgagtgagttctgtagggtagtagcgcgcgcgcgcgcagcctgagtccggaaaccgaagggcaaagaccagctggcacctgagtaccgtatggaagagggcgttgcagctctcctggagccgctttttggaggcgaagtggtggtcgtgttggactttctgcttttttttgccccgctcccttgggatgccttttccccaagaaggagtgctcgaaagtgaaaggggaggcattggtctgctagagggagggcggcagcaagctgacttgataggcagaccgcagcccacctgactgcctccagacccgctgggtgcctgatccctggaagtgctggggctcttccaagcccaggcctttaggagagcttcctcccaagacaggacagcttgagacctgggatctggggatcacaccagtctcacacctccctccttaggcagggcagggcggcatcagacccctggaaggactgtatgtcctttctttttcctctgcttcagtcacctagcttgggcagtgctgagcagtgtaccctgccagggggcagtcagagtcacactgtaaggacctgtattcctgccctgggaggaaggtgggggtcactgggtatttcttgtagtcacatcaaccagtccctgacctgtggagaactgtgaaaagagctgccccaggcccagtttggagcagacctgaccgtcctgttgctttggcttcagggatgccctttaatttcaagctcctggcttgctgtttggaataacccccatactgtgcagcacacaatgcctgctagaaggaacatctagaagagtgctgtgtgacagaaatagtgtatgaactatggatagatataaaacaacgttttctagtagtcgtgttaataaaaggaagaagaaacagctgtgtcttagctggggctgccataacaaaatactgtagactggtggcttaaacagcagaaatttatattgtcaaagttctggaagctctaagtctgagcccagggtgcagggtgctggcatggttgggttctggtgaggaccctcttcctggcttgcagacatctgccttcttactgcattctcaaatgacaggggtggggtggggcaagggggtgttttcctctttttgtaagactgtgaatcctgtcctcattacctgatggccccaccctcatgacttaatctaaccctcactacctcccaaaggtcccgtctccaaataccattacactgggggtcagaacttcattgtatgaattttggggggacacattctttccatgagatggaatgaacttcaatagtatattttactggcctggcacagtggctcatgccagtaatcccagcactttgggaggctgaggtgggaggatcacgaggtcaagagatcgagaccatcctggccaacgtggtgaaatgcgtctctactaaaaatacaaaaattagctgggtgtggtggcacacgcctgtagtcccagctgcgccagaggctgaggcaggggaatcgcatgaacccgggaggtagaggttgcagtgagccgagatcatgtcactgcactgcagcctggtgacagagtgaggctccgtctcaaaaaaaaaagtatatttcactgaatttgatatatacaaagtaatttcagcctgagatcagtattaaaacgagacattttgcattccatttttgtactgtcatcaaaatccagtgtgtgccttacagaacatcctcaactctaactttccacatttccagtgctctgcagaacatttggttagtggctaccatattagacaatggaatctcagaagggaaggtagaatttatggtgtaataaatgtcacatggtgcttgtcacaagatcagtcagtggttagttggttctttaataattcttcaagtcttttgtggtctgtgcttggccgagtgtccttgggaaacaagccatttggctcttgcatttcagtggacatcctggacactcaatgctgtatcctacaagaactcctgacacctgtctctgtactctgtacttggggttcagatcaaagggcttatgggggtggggtaaacagtattctaagtgaagtgaccagagctcttggagagggacctgcctcctgtctatcccatcaggaagtgcaggccctgattactctgataggctgacccaaagaagtttcttggccacttccttgggggagggcggagggagtgagctcatgaagtgaagtgactttcatccctcaggcctagtgtagcggtagctgccaaggacatgggctacagagccatgggccgtgggtgcccctcccagagaagagtgttttctgctacctgtccttgtatctgctgggcactcgaggctctgccctgtctgggtgggctgccttttgggaggaatgggtatcctccctagctcttaggggccctttcaaggcagatgatgtgagaaacctgcccatctttccaggccctatagctgggtaaaaacataagatctaaaccctatggcctcccatcacttgggtgggcctctactgtgtactactctgtgggtctttctgggcatcaagaatctccagaagcacctggacctctgctggcacttcacctaaggaactcctgttataaggagccaatgaagagcccacattctatacagtggtcctccatgtcatagacccctctgagaatctgatgaaagctgtggacccttcctccaggaaaatgtaaatcggtatatgtgtgcatgtgtgtgtacattgtatgcacccactctgttttgtacagatactgggaacctactgccccctgattagactccttgaagtcctggctgccctgcacatatccactgtagtagtcttaaggggcagcttgttctgcgggggaggggtgctttttccaccttggtacctcacttactttgccttttgtgatcctgccggatgttcagattctagccctggtctctctttccagaaagctgtcctcttgagtgccagcctatgcattcagcccctctgcttgggagctcagggtagtgcaaatgagaaccaaggagtatcggttcaggagtttagatccattcacggatactgacctgtcaccatggattgggatctggagggttgaggactgggtctggataatatttttgctagtgactgtagatagactctagatagtcctgaggcagggtcctggttgcatgggcctcactgtagaacagggtttctcaaccttgacactattacattttgggcctgatgatactctgttgtgtatgggtagtggtgggttgagctgttctgtgcattgtaggatatttagcagtatccccgcctctacccacaaattccagtagatcctctttaatcatgtcaaccaaaaatgtttccagatcttgctaaatgtccctggcagaggtgagagcaaaatcatctcagattgggaaccactgatctagaatgttctcacgctttcaaagaggtctacagttgtaagaagtaggggtaacggcttttgagtgcatatccatccccccactctggatgcagggttggaggtgaggttctcctcaaagcctaggagattcctgcttagtgaaatctgctcagcacgtgagagtttggttcaaaattagtggttctggtgtacagcttaccaccgaggagaatcctggcgtccttgagttttcccagaagtggttcaggtttcagggaggcggaggctgtgggtggctgggcagcctgcctgcccgcacccgcccactcgcctctgaccgttgccttaaggctggcactcagcctcttcctcccgtacacgcagaaatgccaggaagtgcctgttgctggggactctctgcctgcccagcagcccctctctgctcacctgggggcctcaggagctaaggctagccctgtctgccaagcggagcactggggttgtagcaggccgtgggcatgccccttcccctgagtggacctgccatgtggcgctccggggagccgcagaggctgtgggcctggagcccccaggccggggacaccagggcaggtgggcagcctctccccaaaggtatgggtgcaagtctctccctcagggtgtggtggccagatgggaatctgagggcagggccaggcttcctgctgtggacctggggaggtgtgggcagcgctgccttagacaggcagccgacactggaggccctggtggagcggttggtatctgtggaggcttgtctattgggcttggcaggctggcagccccctgtggctgcccccatgtttattttctactcctcccctggcctgcttcaagcttggctagggaacgcttctgtgggactctgtctgtctcatcttgaactcagtgagacacagtttgctgcactgggaagtgattacaaactggactcttagggtggaggaagcatttttcaaagacccagtttccaagtgctccacatcactggtatgtgaagtgcttgctgaggttcagacttcctagttccatctgtttttggggtctttacaaaggggactttatttccttctcagaattctttctcttccttccctccggttctatcactaattctgtgttccaaaacagacacccacccccttgttctgggctttcttttttggtctctcattctctaccagacttacgggtccatcccagccctagaggtgcctattccttgtggtcctgggggtactgctactgaatgcccaggttttctggtggtggaaatgctgctgccttcttctgactctattacattgctcagtgatgtctctgactaagacagtggtaggtactggaaatcaatggataaagcaggctgggattgttcaagggtcagccatgtctcttcccggcccaggaccaataatggcttcccgccttcggacagccccatgctttcccctggttattctaggcttgctgtacacatgcatgtgcctttttcagattctttctgggactggcagctccaactgggtgttttcattcatggacgcatgacctctggaagcgggtgtggaaaggaagcctgtcccactgggcaaatgtgaggccctcttcccaggggaatgttgtctggatgggtctgacctgctggacaatgggccttctccctggccagtttctgggctggagctgaggtgttttgtgaggcgagctcatgctctttgcatgtgttcctctgccgactatttcagttccactctgacaaccaaggaggctaaaattagttctggagaaggaaaaggaaggctggttggaaacccaagcccttggctggagaatggaggaggctgcttcccaggtttgtgcctgagcatttcggaggatgggatgagaccagctgttatccgtccatctgaggagaaggaggggtccctgtggcctcccagacttgaaccaattaaaacaggagactaacttggaagctgactctctcgagtgttgatgccaggatattttttccttctggcttgtgcagtggcgcacagtgttttcaggtatgaggacaatgccttttaatgaatgtccagtgccattgacaaccctcctccccctcccctccaactggattatgtgtccgttgatttagaaagcatgcatgagttttcccagcctgggctggcaaccatggtttaagaactcttattttatgcactttttgggaatttccttctcactgaggtttgatattgggttagaggggagtcctgtggcccagggctcacacaagaggtcccgcttctctgtgtagtgagggcatagtgaatcaaggctcatctgctctgggccttagaaaccagaggagcagaagggttagagagatgaattctggtttcttttcccacctggctggctccttctgtgaaccttctggctgagggtgagacctacagggctgtgtgggagtagaaggagggccagggcaatgtagtcctatctcccctgccctgaaacctcgcatccaaacctcccatcactgagaggttagccaccctggggtatagttgggggagtagaagtcacttcccccataactaattttcccatttaaaaaaaatttattactttttaaacaagtaatatacctacattatattgcagaaatttagatgttacagataatactagggtctccttttatcacttctgttccccatccgaggccccctccaaaggtaatccttttaagattgagatgtattcttccagacatttttacttgtgcatctatagaaatacttatagaaatagagaggcttttggccgggcgtggtggctcatgcctgtaatcccagcactttgggaggccaaggtgggcggatcacctgaggtcaggagttcaagaccagcctgaccaacatggagaaaccccgtctctactaaaaatacaaaaaattagcccggcgtggtggtgggtccctgtagtcccagctactcaagaggctgaggcaggagaatggcgtgaacccgggaggcggagcttgcagtgagccaagatagcaccactgcactccagcctgggcaacagagcgagactccatctcaaaataaataaataaataaacaaacaaataaataaataaataaataggcttttttccacctaaaatggtattcaagcatttaattgaagtataaaacatatacagaagaatgtacaagtaattaccataagtaacagctaagaagcattttcacaaattgaatacactggtttagtcagcatccaagtcaagaatcagaaattttccagccccccatccccagcaagccctgttttgttccatttcagtctctgcccacacccactaaggttaactactattctaacttctaacagcataaaatagtttcatctgtttctgtgcttcatatgaatagaaccttacagaataaactgctttgtgtccatcttttcctcaccatgtttgtgactttaagctatgttggatgtcatggctttttaaactcggagatttgctttggcaaactttctgatacatatggatctactttgatctttttaataactacgtaatattctaaagtttaaatatagactacattttacctagtttcttactgatggactttgtgattgtatagaatgtatgcagactgtttctcaagagtagatgagaaaataacatctggatcataagcacgtatgttatcggttttaatagatactgaaaaatggttataccattttatttatttattttttgaggctacccaagtgatggcagtgagggtagaagctgggtgatatggcagttggctctctgcagtaatctgtgaacatccttcctacctccacaccccaacccctgctgaaatgctaggttacagagtttagaaatagcctggtttcatgaagggtgcgcggacatgggaagggctcacttccactggcttaatgtatgaggagacctggagataacctctcgtgcctgtgtctcctaccttgtgcctgagtctcctgggtactgtgctgatgagggaggtagcactggactagccaggatgtgctggtctgggtttgggatggaagtgcatatgtatgttcacttaccaggctctatgctgcgtgcagactctgaagagactaaggcacttgttgaaggtcgctgaagagctctgggtaacagcactactggcaagcccactgcatttgacaaaatctgagtgtgacaaattctgatttcatatgtcgtgataatgacgttgggggtattggagaaacctgtagaaaaactattttagagtctggtgagaagcttttcatgacagaaggagctctggtgagtttctgttcctggctgagtgtatgccttgttccctgtataagtctctgccacagttggcagaagacttagggaagatagtttgggatgacttgttcaccaaagctgttgcttcccagtcttgttcttcagcttgctgcctactctttactgttatgttgggattctttatgtaagtccacttgtcaggccctgctaatggatttagatgacactcaagtttgtggaactgtttctagtacaaatgatactccaatcagctttcccacattatacatatgatgtgcgctgtttgtgtcttagtctgctcaggttgccataatggaataccatagattgggtggcttaaacaactgaaatttcttttcttacaattctggggactggaagttaaagatgaaggtgctgtcaggattcgtttccagtgattcttctctcttgggttggcatatggtagccttcttgctatgtactttttgctgtgtgtatccactccaggtgtctcttcttataaagataccagtcctgttggactggaggcccacctttatcacctcatttagccttaattacctccttaaagtccttatctgtaaatatattaatggcaaaacctgcaattacttttgcaccaacccaatagtcacattggaggttagggcctcaacctatgaattttggtgggactcagttcagtctatgactgtctgaaacaataaagtttggttgaaagtgaattctgttttcctcttgagtgacattttggaatggaagttaattttttcagggctttgccctggtgtctctgttgttcttgcttaatactgcccatggacaatcttgtctacactggtgggcttaatttccgtgtatgtgtgcaggttcccttgcctttgggcatgttatgatcctgaaaatatgtctaaaagctgggtgaaaagtagatatggagatgtacttttctgataatcaggaccaaatatctttctaaaggtaactggagaaactagaaaaaataaaacttctctggttgaaggcattgtatatctaagaagatactgaagaactaccaggccagtatctgcatgagaacaaaggcctagggtgatgattttggtattttgagtctgtttttagtcataggggcaactgagaggctgcatttgatagctttgtggggctaggaagacaggaattggagttctaagcaaagggtgggcagagtcaatcacttatttgggattgagatcccaaagatatagaagttagggggaccaaaatgtagacaaaccctaaagttagattgaaatattctgggctgctgggtttggtggtgcacacctgtaatcccagctacttaggagactgaggcggggaggatcagttgagcccaggagttcaagaccagcctggacaatataggaagaccccatctccaaaacagaaaatatattctgggattaatggtacctttagacatgttaattctttctagaggatttatgtcatcctaggcctcgaattatctctataattttgcaaatacaatgactggctggtaattttaagtaaacagccagcagaaacatcacagttgaaaccaacctggatgacctccaggttggagttgccatatacatatttaaaaatagaagtgttcgggctgggcgcagtggctcatgcctgtaatcccagcactttgggaggccgaggtgggtggatcacgaggacaggagttcaagaccaacctggccaacatggtgaaaccctgtctctactaaaaatacaaaaaaattagctgggtgtggtggcaggcacctgtaatcccagctacttggggggctgaggcagggaattgcttgaatctgggaggcagaggttgcagtgagctgaaatcgcaccactgccctccagcctgggtgacagaatgagattccatctcaaaaaaaaaaaaaaaaaaaatagcagtgttcactgtggtcaaggaaatgagagtgggaatttcagcagatagctgaaaactataaaccaaaggaaaaatctcttaaagacttgttttacgtaataacagaaattaataaatcaatgaatgcttttatcaggggattaggtgaaactgtatagagcattagtgaattggatgatagatcagaagaagatataaactgaagcatggacaggcagaaagatggataataacagaataaagagaaacgcatagaggatgaaatgagaaggtctaagagtcatgaaatcacagccacagaagtaaaggagagagaatgaggcagaaaagttaatagctgagaactttctaaaattaattaaagacatcaagccacagattcaagaagtcctgtgaatcccaggtaagacaataaatttgaaaaatccacatctatttccatcacagtaaaaattccagaaaacaaagacagaatgttgaaagcagctagagaaaaaaggcattactatcaaaagagctgtagttatactgacagctaacttctcaatagaaacagtggaagccagaagataatagaatgatagctttaagtgctgaaagaaatagttgtcagcctaaaattctgtatcaagtgaagctgttgttccagaatgaaggcatcatcatgttaagtgaaataagccagacatggaaggacaaataaccacattatctcacttatatgtggaatctaaaaaggttgatctcatagaaatagagcgtagaatagtggttaccagaggctaaggaggtaggtaggaggtcagatggggagagggtggtcaaagggtacaaaattacatttaaaggaaaaaattctggtctgttgcaccgtagggtgcttgtagttagcaagaatgtatggtatatttcaaaatagccagaagagaggattttgaatgttcctaccacaaagaaatgataaatggtaatggatttgttaattaccctgatttgatcattacgcagtgtatatatgtatcaaaacgtattctaccccataaatatgtacagttattacgtgtcaatttttaaaccaaaacttcttttttttttttttttgagatggagtcttgctctatcacccaggctggagtgcagtggggccatcttggctcactgcaacctccgcctcccgggttcaagtgattgtcctgcctcagcctcctgagtagctgggactacaggcacacgccaccaagcctggctaatttttgtattttttagtagagacagagtttcaccatgttggtcaggctggtcttgaactcctgacctcgtgatccacctccctcagcctcccaaagtgctgggattataggcatgagccaccacgcccggcctacaaaacttcttaaaaaagaatgaacatgtcaaggaatgtgttcttcaggcagaaggaaaataaatccagatggaatgtcagagatgaagagaggaatgaagagcaatgaaaataataaatattcgggcatttattgtgagaatgtgttactgagtttgaaataccacaaaagaaaatgcttggcaacaatgctatctgtgagagtggagtgaaaatcaatttaaattgttctaaagattcttacaatgtccaggaagagagtggaactaccaaataatactaaattttgataaggcatgctatcatctctagggtaaccaaaggatagattataattttcaagctaaaaaagagacaaatgggctgggtgcggtggctcacgcctgtaatccaaacacttcgggaggctgaggtgggcggataacctgaggtgggttgttcaagaccagcctgaccaacatggagaaaccccatctctcctaaaaatacaaaattagccaggcatggtggcgcatgcctgtaatcccaggagggaggctgaggcaggagaatcactcgaacatgggaggcggaagtttcggtgagctgagattgccccattgcactcccgcctgggcaacaagagcgaaactctgtctcaaaaaaaaaaaaaaggcagacaaatgggttgagtgcagtggctcatgcctgtaatcccagcactttggtggttcaagtggggaggatcactggagcccagagtttgagaccatcttaggcaacgtagtgagaccccatctctacaaaaaataaaaaaaattagccgagtgtggtggcattgcacctgtaagtccgagctacttgggaggctgaagtgggaggattgtttgagctcaggagtttgaggctgcagtgagctgtgattgagtcactgtactccagcctaggtcacagagcaagaccctgtgtccaaaaaaaaaaaggagacatggaataatagagaattcttcagttgagaagaaagcaatgagagacaaggggacatagaccaaatgagataaatatagctaatatttctaataaatatatgatgttaaaattattattatttttaagacagggtcttgctctgtcacccagggtggagtgcagcggtgcaatctcagctcactgcaaccactgcccctctaggcttaagtgatcttcccacctcagcctttgaagtagctaggaccacaggtgcaaaccaccacaactggctaattttttgtatttttggaagagatggggtctcaccatgttgcccaggcttgtctcgaactcctgagttcaagcagtctgcccatgtcagcctcccaaagtgctgggattatgggcatgagccaccatgcgggcctgatgtaagaattcttaataaataagtaaggatggacctgaatacttactaaaagctctgaggccatgggtggagttggcttaatctagggtgatctgattgggctgttttgggaattagttggattcccctgagaaatatcttctgttttctctctggagggggcaggcttggatatcaacatcctggaagtcaagggggttgagaactaggggttcctgtatttggtatattgttctgtattcctcctgtttcagtgtgatacctgtgtcctcagatttgcctgctcctctttgtcgaagaggctctctgttcattttctttagaaaataaacataatctccgctgggttggagaggggcaaccatgatgagtggtggtgggatctgaggatctgactgtaccttactaaccaactcttctgtctttagactcatttttaccccattctttcaaagacatctggtgccacaaattcctgagttttgaagggttctgtgggggaagtcacattgcttttctactttatccagagccaacttaggagtctgtgtgatcagttaccatgtgtgtaagtgctttccagccttgaaatgtcatttctgtagttctctcctgttctctttgttcttacaggtttatgcattaaactactttattgcagttttagtgggactacaagagggagcaaaaaggaaatgtttgtgtataatccttggcctttacctggaagctctccttccagtgttttccaggaatgatggggcctggaaaaaggcatgtatttcagagctgtgggaggatggtgccagggccttgtttacaaagtccaagttggaagtgacttgaggtcacctggcttggttccttgtttctaggcgggacttctgaaggcagatggagctcctcctgtcaccttggaaggtgctcctgtatttacatttctggcatttgtagtgaacaaaacagtggaaaatcctcatgcaaaatacatagaaatgctggaaaaagtataataaacacccttttaaaatgcatatacattgctgcatgtataagaagtaagggaaaaacaagaaggagctggaaactagagctgtatgccttcactgactgaaactgctgattccttggggactttgcctgtctttataatttagagatgtgggtttaagtagcagtgtggacaataggagagaagatgtggaattgagactgaggcctttgcatggcttcagacttctgttgtgttataccttcagtaaaaatgtgggccagaagaaacatgtctttgttgacaaagagactaaataatgaaattgtctgagactgggtagggttggggttggggtagtttccccgagaatttataaccataggcctatgctcatgtgagcttggcatttataccatcctgttctctggtaaactaagttgagaaattaaagtggttccaaatagttaatgtcctagggagattggcagaaggcagaaatataagttacctttgaaaggttgccccttcaaacttggcctcaaagtagtccaacagaaaaggccccactgaacataagctcagtattcaaaattctaaaaccacatgaggaaacagtaccatgaataaagtcagaaataacaaatgtcagaagcagactttcaagaagttaaattacagaattctaagagagatttggaagtaggccaaagtacagaagtatcaaaattgaccaggaagtttttttttaatagaacttctagaaatgaaaaaatagaataattgaatttataaattgagtagaagaactaaacaacagattagacatagctaaagagagaattcgtgaattggaagttgatcttcaggaattacctgtaatggtgtttagacacagaattggaaattaggaaaggagggttaagagactgggcagaataagaaggtctaatatgcttataataggaatttcagaatcatagaatttggagatgcaatattcaagttgataatagccaagaatttgtcagaattgacaaaaaacacaaatcattagactaaaggcatagtgaaccccaaatagtataaatttaaatatatacttagacacataccttgtagtgaaactgccaagagagaaagcagccagaaagaaaaaaacagaatatctgcaaagttaaattaatagcagacttttcagcaacagtagtggaagctagaaaatagtggaataatattttcagagagctgaggtaaaataacaatctaaaattttatgttcatctaaattgccattcaggaagaaagacaaaacattttgagaaaagcaacaaaggctcctctgccaagagatctctactgaaatattttttttcagtaaggacagtgatctcagaaagaaaggcagagatgcagggagagatgactgtatggatgcttacaaaatatagacacaaataatgtctgatttgggagctgggtagtaagaacagtgacactaaatacggaacacaagcaatatgttaaattagatgtacattggaagagtcattagagtttaaaatatttaagttccaatgagggatggtagagatgttgatttaggcttttagtataagtgtacccattaaagtttataggcctagcttacaacggaataggaatgagatgtataactttaaaagtggctaaaataggaaattttaaaagataatccaaatagaggtaacggtagaaaagaaacaaatttaaacatacccagtaatcatatatataaacatacccagaaatcataaatgtaatgagaccgaactctaattaaaagatggtgttagattgaattagggggagggaagagagaaagattttttgtttaagttagaaaaggtaattttctctaatactaacacacgaaatgtcatatagctatgttaacatcagataaaatggactttttggcaaagagcattcattacaaatgaagagggttactatatagtaagaaaaattttattaccaagaatatataaaataatttctgtaactcaaaggaaaagtaatccagtagaaaaatgagaaaagatacaaacaaacagttctcagaaggaaatgttaataatcacaagaagatgatcagtctcacaagtaatcagggaaatgcagatccaaattgtgtaccatttcacactcaccaggtgaaccccaggtgggggctgtcatctgttgggaacttggattggcacatccactttggagaacagtttaacagtatttagtcagttgatgatctttagactctatgacctagccaagaaacgcccacacatgagtgcacacacacacgcacacacacaaatgtaaaaaagaagtcatgatggcattgctgagatcaacaaacataaataacctgagtccagtaggtgagtggatacttaaagttatgtgaggttataagcttctgaaataaatgcacttcagggctgcaggagaggcagcagtatataaagaacatgcactctagagacaggctgcctggggtttgaagcctgattttgacacttaataagtaacttgggtaggttacttaatctctttgtgcctcagtttttataaaatgaggacctgcacaggtttatcgtgaggattaaataagttactctttgcagaatgcttagaataggacctgggatgtagtgtgagctgtgtaagtgttaaattaatgcatatcaacctggatggcttacaaatatatggatgaaggacaaaaagcatatgtattagagattgtatttggttgctagaaatagtcaagagttattctcttgggtaaaagaaatgcaaagacacaatgttggaatattttgggtttttttctcccctattgtacatgccgctccacagtgtgcatacacgtgtgtgcatgtgtcagtgtctttatctgttatacactccagccttccttcctggccccatctgtctcttcaggttccctccatctctacaccccagctgcccttactctgctgctggggaggtggtggagatgctgctttgtggagctgggggctgtggaatcataacatggataagtcactgctcttggccctccttcgctcttatggagggacctgctagggctataaaggcagctgagcagactcagggctgcctttcgaggggtgctgtctgtggggagagctgcctttcctctctgggcagatgtgaaggctggacaccagagggagaacactggccctcctgagatgttcttgcttgtcttcctcttgggcatggaggcttctggcagggtgtgcctcagtgtgctggcagaagcagacctagatagatgtagtggtgagtggcactccttctcacctggtgagtggcattccttctcaccactacagtgcccacaagggtggggctgggcacctgctccctggggtaggtggctgccaaggggcctccaggagccaactgagcagtggttctgctggctgctggggtcacagttcctctaggagacactggctggactggggacacccaagtgcagagctcagggactccaggggaggtgggcatggacactccacctctgaaccatctcctcttctttctctccccattgcactttgagcccctcacagatgggaccttggtgagatttctcccttttctcctcagggcatagtgggtatgtccaaggcctactggactgagctgcttcataggagaaacgaacctcccagtatttgacctcccagtgcgtgtcttcgagcatccaaactagccggcttaggttctgctaccaggaatgttggttcagagtgcagtctgcatgtactgtgtgtgtgtatgtgcatgtactgtgtgtttgtgtgagggtcgggggtggtgtatgtgggagtggtcctgccaggagggatggtttggggagcactgggtactttctctctactggcattaggccccttggagcatagggactgccccttggggacactgccacttttatttcagcttcctttggaggccagcagttggtttggctgtgactcagggatgcagcaagccccttgtcctggtgtctgggggccatgctcacttacctcagggctatgaagcagcaggcctaagggggtaccataagcacccgcatcttgggagcatggcttctcctcctgccaggttaggcgagtgggctgggggtcaaggggagcctcctgtgcatggatgccctggcttcctgggtgtgggtgggaatctgtatctattaaaaggcagaggtggcctgtggttggagtattgccagaggctataaatagctgagtgtgtgaagaaggagagtctggggaagagagaggaatgggggaggcccctgggtctccaggtggcagcagagccctgtggtgagggaggggcatgggctctgaacataaagctcttgtaggcatggtgtgacttgatgggctgggagtcatacaggggacttgtgttatgagggattgtcataggcagtaggggatggttgtggctgtaatatagccaatgtgccaggcagtgttctaaccactcttaaagtgcattaactcaattagttcctacaactaccctagctgtgaagtattggagtaggacttgaagtctggcccgctcacggctgccatttttcgctgggttgcctgtaggaggatctggtcagatgggggtcaggtgacatctttttgaaatggagtcttgctcttgttgcccaggctggagtgcaatggcacgacctcagctcactgcaacctccgcctcctgggttcaagtgattctcctgcctcagcctcctgagtagctgggattacaggtgtccgccgccatgcctggctcatttttgtatttttagtagagaccaggtttcaccacattggccaggctggtctcgaactcctgacctcaggtgatctgcccgtctcagcctcccaaagtgctggcattacaggcgtgagccaccgtgcctggcccagctgacatcttgaacccttgggtcctctgagatttggaactcccagcctcttcacttgggtactgcccatggtagtggcaagtgggtggtccctgacttatcagtggcctggagagaggaggttactctgttggcctcccttgtttgggctcctgcctcagcacagaggcttgttgcttgtctgaatggagatggaaactctttgaggacctagggcttgggctgcaggctgaggccatccttgttgtcccctcctttcgacatgttgctctagccatgatacctatacccttctgtccttctgtctgtccacccatccatctatgatgtgtttggaatgattctgccacttaggacggcaagggtcctgcctttgtcggctttccagtcttgtggggaaggcctgacatttagaaagtagttgtcgagtacatgtgtaatgttttatttctcatacaagtgttcattgtgttatttcctcttgagattatttttggttatattattggtacactttttggatgtctgaaataatcctttaagcaacaacaggccattagtcaagggtggttaagttaggtggcaggggaagcacaagggccagtggaaatagagagtttgcctggtctcaggggagagggaagagccgaaatcagaggaaggtgggtaaccttacggccagaggtggtaacttacgacttacgctaagcctagaagccaaacacattcaagggtgtgacattatggtgtggctgcagtgaggggaggaaggtaggggagtgcccagcttccctgtctgcagtgcagcttcatggctggccccacaagtctcaggtctccacggacccccactagaactgctgccgtggatgcagtggggcccagcctggggagaggaggccctgtggcctctgggcagggtgcttcgaataacccagtaattgggtgctgctgcaggcagacagggacaatgtaggtgcaagcctcagtcctggccccggtgtgcttgttcagcctttggtctactacccccaccccaccctctcaggttctccctctaaaccttaaagccacatgcttgatgaagggcctggctggggaagccagtgtgtacccttgtaagcctctctgtggaccctgaggcccttcctttagaagaggctgagtcccagctgactgactggtcaggaggccatgcattttcctttcacaggtgtcagagcctaggccacctggtgcaggatgaccagagctgtggctgggcactgccattctgattgggtgacatttcggacccttaggtgctacctggatccttgagattcgttgcttgctcctgcccctggaagaagcatcctgtcacttcagggagttgcagaaaggggttgggtttgacaggagaatggccgctccagtggtggggggcttctttcacctgacagccagtcagtatccttctctctggggtataccctgggaaatcaagctctttcctcatgaaggccaacagtaggggtggagatgagcgtgaggatgtccttaggctacgctagtgttcagggtactttgccctcccccagggtcagggcagggttcgtgttctttcctactccagtcagcctttcaggctgatggcgaagtagggctcttggctgctggtgggctggctgtctggtgggattgactctgacccctccctccttcctgggatgggaatagtggtaggagaagaccagccaggagtggtgccaggtcactggcctatgtgggcccaaaaagtgtggataggatggctggatgcttggtgcaactatcctctcgggtgtctgtgtggggttctggcagtgaggttgtaaatgccaccacctgcctccattgtgggcggcctataatggggtgctggcagagctctcagacagaaccgaacctcctttggcatctccatactctttcctatgtcagggctatgtggttcctgcgggtagtgggagtagactggggctgggactggaggttgttttgtaggggatggtgaggaagatggatttggggaatgtttgaaatcaagtttgaaggaaagtgtttgaatgggcaggtgggggttgaagtggttgtccacctggatggcacttcctgcagcaggtggaagggggttcagaagtgatggggagtgccctggggtcatcaggagcctagccaggagaatgatctgtgattgcaggttaagccaccagctagcgctcctctgcctgaggcatgtattccccttggtgactctgggaggcttaccctgtacacgcaggcctcattccttaaggtctccagccctgccgagcaccaggtgtggttgctgggtgtagaaaggacacttacagggtcctttccattccgtatgggcagggagttgtggaggacccactggcatggtctccctggggaactgttgtgagaagggggcttgggggcagagacaggagcagcaggaagccactcccctttgtagttttcccaggtggtccttgagatctttatcacaatcacctgagacagacaggggtgattaaaagcacatattctgcccccattcccattgggatgggtctggattgggcctggaaatacgtatttgaatgaacactgctcccctttcccacacctgcaacatacagtgattccgatgtgcactggggttttaagggggcctcttcatcggtttctgctgcagcagggaagtagcccccacccccacgcaggagcctcaggtgttggtgccctttctgtgcatctggactctgtctgtctggctgtttatccatccttctgtggcattaggtttcctgcctcctcccttttgcttaggcctaggggcagctgtgatgggctgcagaatgaggtgggggctggtgccagctggcacacgtaaattaagaggtgtgggacggatgggtggcctacgtccaggggtgagtgcaggaggttggtgaccccaacccaccacccggcctccctccctcagggtggcctggcacccaggactgggagtaggggtttgggtggtggtcccaggggcatgctcagtggttctcttttctctggggcacaggctctgggcgtggggaggctgagacacgggagtgcatctactacaacgccaactgggagctggagcgcaccaaccagagcggcctggagcgctgcgaaggcgagcaggacaagcggctgcactgctacgcctcctggcgcaacagctctggcaccatcgagctcgtgaagaagggctgctggctagatgacttcaactgctacgataggtaccccaagacttgccctcctttcctcttggacccacctgcgcttatactgcccactgggccatttgggtctcaggatgtctgagtgggagataaaggaccaagaaggggctcttgagatggtagccatggccccacgcccttccacaccctatttgtcctaccttagccctgaggaggggtctcagtgtcaacccctggctgttcttccttggctttgggtctcctgtaggggaggtgagttcacaccgtccccctggtgttgcccatgaggtgctctgtctgtgaggaggggttggcagggcaggcctgggggagtcttgcatcccccaggtgaggggtatatggaaaattctgtgcctccaggcaggagtgtgtggccactgaggagaacccccaggtgtacttctgctgctgtgaaggcaacttctgcaacgagcgcttcactcatttgccagaggctgggggcccggaaggtaagggggcagtgtggaagtggggccttgagtcagccgacctgggcttctttggcttggagcgcttggctcctcagttgggtggggtgtggctacagggccctgtagtctggctctggaagtgtgagggtgggcagactgtttgacacagggctctgtgtgtcccccagtcacgtacgagccacccccgacagcccccaccctgctcacggtgctggcctactcactgctgcccatcgggggcctttccctcatcgtcctgctggccttttggatgtaccggcatcgcaagcccccctacggtcatgtggacatccatgaggtgagacagtgctggcttggggcagggcaggatagaggtggggaggacaggccagacctttttaagccttgctctcccccaggaccctgggcctccaccaccatcccctctggtgggcctgaagccactgcagctgctggagatcaaggctcgggggcgctttggctgtgtctggaaggcccagctcatgaatgactttgtagctgtcaagatcttcccactccaggtgagtgtttgaggggctccatccaggtcctctgcctccactgtagcttgaactggaggctctcctgacctggggcaatccaaaccccaaataatattgtggtatgagagaaaagtgagccttactgggcctagttactcatgttacacttggctggtctgtagatttcatgcaactatggaattttatcataggactagggtagggctttgcaaaaccttgatttgccccggttaccagggttttgtttttgacattgggttctttccagcggccctggacaccaggtctggctctgcctcatttgttgggtgatacggggtcactcacaccccatgcatggaccttagtggccccatttgtaaatcgaagtgctagccttaagtgatctcagggatcactgttggcctcatgctctggggcctagcttaatacaggtcttctcctggtccccttacaaatgctgaagctgggaggctggggggtggggattgggctgggaggcttgagggtggggaatggggaatggttgttctgctgtagggcaatgtgactgcagcagggctaagccagccacttgtccccccaacccctcgcccccggcctcaggacaagcagtcgtggcagagtgaacgggagatcttcagcacacctggcatgaagcacgagaacctgctacagttcattgctgccgagaagcgaggctccaacctcgaagtagagctgtggctcatcacggccttccatgacaaggtgagccacacccatcagaatggactctgagaggagatggaatgtccccttggtggctctccataatatgatgaccccttccctgtggaggtgtccaccatgaagtactctgccccggtagcactatccactatggggttactcctgccataggtgtggacattggttcccctatgataggaacctctcaccctgggataagtttttatgataagagtagtgactccatgattcccacccctagccctccctgcctcctggcctcatccatcttccatatcgattgtagtagccttccaggagagcagcctagccattggcccactgagacttctctgccagggctgggctgggtcctgtcctgtacccagaatctgtgctcaagttctgtgccgtcttctctcagggctccctcacggattacctcaaggggaacatcatcacatggaacgaactgtgtcatgtagcagagacgatgtcacgaggcctctcatacctgcatgaggatgtgccctggtgccgtggcgagggccacaagccgtctattgcccacaggtacctgggtcagcaggtgcctttcctgcacttgacctggagctgtgggaagggttggtgggcgagagcagtgtctggagatgtctcaacttcctaaacatacttactctgcttgctgtgtgtccgaggcagctgggcacaaaacctggccttcccactgtgtcctggggatggcatggcctcccaagctggtttttggtgccctctaatggccacatgaagtgctgactccattactttggttggagagttggctcagtagttctcaaattttctagtttaggatccctttatactcttaaaatgacttttgtgtaagtggattatgactattgatatttgctgtatttgagcacacccacacatcccattcgctgtcagagtgaggacatcacatctcatgtagcctcgggaaaactctatgctcctaagagaatgagccttataaaagcaaataaatgaaaataattttgactttatagattcccttggaacagtcttagagatcttctggggtcctcgaaccaccctttaagaaactctggatgagctcatcactgtcatgcttactaaatggcaggcagtgctctaaacacttgagaagtatcaattcatttgaccttcattaccgcccattgagacaagtactgtatttctcagctctgtcttgcagatggaggaacagtagtacagagaagttgaatgacttagccaaggtcttgtagctagttgagtctggttctgtgactgtgagggaggggaatgaacctcaaattccagcgttcaaagctgaagggtccctgatggtaataacagtaatgacatagaaggtagactgtatgaaattgccgtttttataggtcaaaaggttgaatgttgtctctgctatatggctcaacttaataggaatacctagtaagtatgccaggtgtggccctaaacatttgcacttaccactcagtcgaatcctcacaaggctgagacaggcactggggaaactgagtaccacaagtagctttgcttagttagaggtggagctgggtgcatgcaatagcacccttgctccagccggccttcatggtgagcttgagaccctaaggggtctctgcaggatcctaggaaagctaatattaaattcctattctcattcacattccaaatgctgtaaattcttctcagaaaacttgcatcccaggccagtgtgcctgtccacaacccctctgagaatatatgggctggcctttgatagtgtggggactgggacagggtctgcccagccattagggtaggtgttgctttgccaaccctgggggaagccttccatctgaagtgcactgagggattctcacacccatgtcggcgcctgcagctgcctgcttgtgctgcttcacctctgcaccccaggtagggtgggatggcctggtctggggcctgactctagggcacagactctagtatcttgggaaccaaggtgggagttggatcatgatgttaagctttatctctgcccacttgtttccacagggactttaaaagtaagaatgtattgctgaagagcgacctcacagccgtgctggctgactttggcttggctgttcgatttgagccagggaaacctccaggggacacccacggacaggtaacaggcctcacagggcaggaagagagggacagacccagggtagatactttgccctttttgtgctcagctggggaggtgcagggatgagggtgactgcatgcgttcagagctgtctgagaacttagagcaatgctcttgtttgaccagtggagaaaccaagaccaggaaggcagtgtagtttagcttccgtaggacagtcagctgggaaatgtagagattccccactggggttttgaccactagtccttgcaatcttagtctttctctcacttttttagttttaattcctaagacaaaacaaagaaatgtactaaggatccaaacaaagaacctggaaaaagtaactaaaaattaaacttaggaaatcattcctaaaacaatcactgttattattttttaagtgttctccttccctctttgtttttggtcttaatctcagtcagatacatatcatctgtagttccttgtattaatttggtaacaattccattttagattactattatctccaggatatagtatttaaaaattattatccaagtataattgatgctgtgacctcttgtaactgttgtgaatgtggtgaatcgaggtttgctatcattgataacctgtctgaattgctctgtcttgcccgccatctggtgcacagaggctgtaactcccatgtcccagctgtgtgtgtatggccagtcactgtaaatcctgccctcctctgtcctcacataggtaggcacgagacggtacatggctcctgaggtgctcgagggagccatcaacttccagagagatgccttcctgcgcattgacatgtatgccatggggttggtgctgtgggagcttgtgtctcgctgcaaggctgcagacggtaagtaggatggcagccctgggcatcctagattgagtgatagggagcagtgggaccttagagtgatcctgccaggctctctctttctcctaggacccgtggatgagtacatgctgccctttgaggaagagattggccagcacccttcgttggaggagctgcaggaggtggtggtgcacaagaagatgaggcccaccattaaagatcactggttgaaacacccggtaaggggcctggttcaggcaactttgcaggggggtggagaagggaaaacccttcatgtgtagcaggtaagctgaaatcaagggggaatgggcaaatagaaagtctgcgacgttccctggactctagggatgtgttccaggggttatggggagtgaggtaggatgatgtccttctcctgatccccactttgactgaactgctacattttgggcacttgtatggtttgggcttccaataagattttgtttgaatatcagcgcttcaaggcaagtagtcgtgtctatcctagtaggggccttggtgtctccttctccctcctgtgtatgttgaggttcaatgaacctttcctagggctgtggagtgaggccagtaagctcagaaagatgactgccatgaaggcaggcatgctgattcctgaagttttccccaggcctctgctggtggacctgctgctgtggttggggctggtgggctctgcctgatccttgggaatatcaagtttactgtcccccaaagcttttcctcactgaagggtcctaacaaaggtgtctttcctgtctgccctatgctgcttagggcctggcccagctttgtgtgaccatcgaggagtgctgggaccatgatgcagaggctcgcttgtccgcgggctgtgtggaggagcgggtgtccctgattcggaggtcggtcaatggcactacctcggactgtctcgtttccctggtgacctctgtcaccaatgtggacctgccccctaaagagtcaagcatctaagcccaggacatgagtgtctgtccagactcagtggatctgaagaaaaaaggaaaaaaagttgtgttttgttttggaaatcccataaaaccaacaaacacataaaatgcagctgctattttaccttgactttttattattattattataattattataattattattattaatattattttttggattggatcagtttttaccagcatattgctctactgtatcacaaacagcggacacgtcagcaggcgttgaggtgctgagctgtggatgcagaaccagcgccatgctgaagagcctcagccacctcctgtcctttgggattcgtttttcccgctttctctttgtttgtcgtctcagaatctgtgacacaaagaaacccatctcctgtcttaggaaacctaatgctgcaaactctacctagaggaacctttgaagactgttacataagaacataccttcctcagaagaggagtttcctctgccctctgcccttctcccctgcctccctccctcccctccttttattttgttttagtgagcttaagaaacagcagatgtgtctttcacggatctaacgggtgttgtcctgatcgagaaaaaaactgggatgagaatggtttggactggagttggaaggggaggacggtactgggggtagggtttggaacagagctacactggactcgggcacattcggagcagcatcctttagtatggaggctacttctcaggtaaccaggaatcgaggggaaggaccttgtggaggccgagcattaacagcaagagcggggtttggagaaagtctgagattgggtgcagccctgacttacctgctggccctgaccagtttcttttcactaacttggccttgggcataggatgaaacattttttctgccctaattttaaaattaggtgagggtagaatcatcacaggttaggaatacattcttcataagacacgatgctgtaaatacccttaatggacgaaaagttgaaatacttttgtttcctcttggagcagttcagggaaatgcccaccggggattgtcctgcacagatagggcaagaggatttcctgggtggagtctgccaaggcctgcctcgctggggaccccagagtcctgcacctctggttccgccccaggtggtgacattactgtccccgttctgtggctcgtggacaagactttctccagaccccttaaagtggtacatattctaaaaaactgtttttctattatgccataaccttgctctagtcagtgaatgttcctaatgctgctgtttcaacatttgaattctttttaatttatgaaacatgctaaattttttttttcaaacaacacacacatccacatatacacatgcttcgctatgtggcttccaaggtttaaattttgaaaagtaaaagaattaaaacttcacgaccacagatcacctcaaaccagaaatacctcagaattttctacttatgtaaggtttattatatattttgttagttgtgttgtcttgtagtaagtatattttaatgtaagttggcttttgtgacaaggaagtttaaaagaaatagagaaaaagaaaaaagtttgcatcttctagggagtgctaccatttttgtttgataacgcccccttgtaaataattgtcatcaactgtaggttggctgtctgggccaagtctgggcatttatcagtcttgtttgtgaaggcttttccttctggtttctttagatcattttatttaaaaacagtgcatctcttcatcgtgagggtaggcaaggcgggggccgtggggagaggttgacctgggtgagaactgaagaggccgcctcctcttgggttgtttggagcttcacatgtaattcacatgtaacatgtaacttgatcggtcagtgttcagaatgacaagtaaccccgcttaaacttggtagaaggatggcccttagacctgaatggggtgattttacttgggatttaacttcttcagcaaattaacagcaacgttggaagagatctgtggcgcctctgtgaagcacaccgtga

SEQ ID NO: 16849 - DNA, 18152 bp, Human
cttctcagtctcctaccctctattaagtgggacaggatggctagagcaggcttgagttgggtctttctcttcccccaggtaggatagggtctgatatagggcaagccttgttaagaacagaatactctgggctgggcacagtggctcatgcctgtaatcctagcactttgggcagccggggtgggtggatcacaaggtcaggacaagaccagcctggccaacatagtgaaaccccatctctactaaaaatacaaaaaattagccgggcatggtggcgggcacctgtaatcccagctactcgagaggctgaggcaggagaattgcttgaatccggtgggggcggaggttgcagtgagccgagattgtgccattgcactccagtccgggagacagtgcgagactccatctcaaaaaaaaaaaaaacagaacactctggcttatttcaaatggttacttgcctctccctgctggaagcataagagaatttttctttgatattcactgtgtgaacccagtagagctcttggaagtaaaagccacagaaatatggaggcctttctctggagttcttaactctcagagtaatctacattgagtctccagcaatttgtcagttaaagttcaggttttcttatcctggtactggttcctgcagaggtttcttgtggatttctggtccagtaaattgtaattctctctctcctttttttttctttttttttttttgagacaaagtctcggtctgttgcccaggctggagtgcagtggtgtgatcttggctcacagcaacctctgcctcccaggttcaagcaattcttgaacctcagcctcctgaatagctgggattacaggtatgtgtcaccacgcccagctaatttttgtatttttagtagaggcagggtttcaccatgttggccagcctggtctcgagctcctgacctcaagtgatcttacccactcggcctcacaaagtcctgggattacaagcatgagccactgcacctgacctaaattgtaattctctgtattcacctgtgtgtctctaacttttggggcagtcttttattaccctgtgacttcactcctctgacagatctaagaagttactcatttttcagtttgttcaacaattttacttgttaaaaaggagtagcaacttccaagctccttatgtgccagaccagaaaccagaagtcttaccacaagtttttatttaatagaatcattaaattgcaaaattgaaagagatttgagatgccatctagtccatccctgcaggggatctttgaggaatacttccctctccctccaccccacacacggacacctccctacgctccctggacatggttgccggtgatcttcctgatacttcccatatggagagtgtattcattccactaaaaattgctcggctggttagaaaactcttgttacacccctctttggtcttagttgtggccttgaatgaaggcaggtacaaagaggaagatgaagacagcttcaaagaggatacctggtcatgggccttgaagcattgcagagagcctttggcagtctttacaggatgtggtggggaggaagggaggataaagttaagaggagaaagaagtaaaccaaaacatcaggatttggggaatgtagagataatgtgagaccagtgacattcggtgcctcagttccaaggtttggggatcatagttcagctggagactgactctagggaggtctttgatcaggcctcactcttgtcaggagtctgctaatcattctgtctttctctattttagaattgtacaccaagaagtagaagaatctttagagaccatcctttacctagatggggcaattgagggccagagccaggaacagattctcagggtgaatcagtggcagagctcaagtttcctacctcctagctctagctctcttggttgcttggagccaaacaaagcaaaaattccttttctgactggaatgaggagatgatgagggcagaggacaaggcttatgtctccatctcagttcttccccataaggggaataccagactaggcagtggtgactggtagcagttgttttcttggcaattcaataaagacaatgctaagaataagaacactcaaggaagctaagtgaaggaaaaaagagctggggacagtggtgatcctggtgggagaggttggggtggggcaaagagcaaagcatgctccctgagcagcatgtcaggccttgcttctgccctccactgtctgccctgccttgacctgtactgcaggctgactgattaacaggcttccagcagctgtgccagtcaggtggccagggctgccctgcacaaccttgcttccttgcattcccttcagcaatgttcctctgctcatgccttaaaatagttcaaaattgagaacatgaaaatgctttcttatgcatacacaagcagacatgaatatgtgtatgcacctggtgtgtgtgtgggctgtggtggaggcatactttgtcttgtgttcattgtcactgacattgctcagggaggctggggtacttgcatttgttttcatctttagagtgtgttaatggtttccttcttgattaaagtagagctcaaaatgcagctctgtcattgctctgtattcttggtttgtctttgatgttgaaaagacagtgcacttgtgcttttggtggggctcctggcctgcatgctgcttcctaggattggcaggtattgcatatcaccacataccagacacccacaggagagaaaaatcatcaggatcaagaggccagattgggctgctggcaaagtttatctgcaggctaagtgcttgttgctctcctgcttatccatgctgcctagtgtgggctgtccctagaagggaattctgtgtccctctgagtgctgcaactactctcagggttttactgtagtggttttacctcgcctattggttgacccatctacctgtctcatttgagttgagtgtgaattgtttaggatattgcaattagaggtggtgcgggctggctggttgctataagccatcttaacatttggctaagctcactcctgtgtgctgggcctgacaaggtcctcttggttcctcttgtgatgactgtatcttttacacagttaataaaacatcctcagatgttataagctggagtgaactatttatttttctattttttttattttactttaagttctgggatacatgtgctgaatgtgcaggtttgttacatagatatacatgtgccatggtggtttgctgcacctatcaacccatcatctaggttttaagcctcacatgcattagatatttgtcctaatgctctccctccccttgtcccccaccccctgacaggccctggtatgtgatgttcccctccctgtgtccatgtgttctcattgttcaactcccacttatgagtgagaacatgcggtgtttggttttctgttcctgtgttagtttgctgaggatgattgtttccaacttcatccatgtggactattttttcatcatattctacccttcccaagtcacacctagggggctgaggagtgacaggtggagcagggcaaggctggattaaacattaatgcagctatcaccactgcccagaggagcaagttcccagagccaagctacagagctaccctagtgtccccaggctgaggaggtagtgactggcatacatggctcagtttgtccaggtcctggctgaaataggtgactttggtcgcttccagatacagctattgatcctgctgtgtgttctcaacttcctgtctcccttctacttttttgcccatgtcttcatggtcctagatgagccccaccactgtgcagtggcttgggtgaagaaccacactttcaacctgagtgctgctgaacagctggtactgagcgtgcccctggacactgcaggtcacccagagccctgcctcatgttccggccaccccccgccaatgccagcctgcaggacatcctcagccaccgcttcaatgagacgcagccttgtgatatgggctgggaatatcctgagaacaggctcccatccctgaagaatgaggtaggcttgtccttttgctggtctctccaccggttgtgggtctgtcaggtcttgtgcctgactcttcgccctcagtcactggctctgtatctgccccatgcccatatggtcaaccatgggcacatatgtttttcattttgtcaatctcattttcctctttgtcctctgcctattgacccatctgtctgtcatcttctctgtccagtctgtctgcccatctgtccattttttgcccatccttctgtcgtctctgtctttccttgtctctctggctatctacccagttggtgtcctctcctcttttcctatctttgtgcctttctctctacccagtgtgctcatctgtctgtccagttctctttgtctttcagtctacccctgcatgtctgcctatgttcctattttcctaaccctctaatgccatccctttccctgtccatttcactgccttcctgcttgctgggcttcaaaactttcagcttttctctctaggtctctgccagcctgcccttgggacgctggagaacatccaggactctaggacttgtcctgtggataactaagcgttcattcttgctaacttcattcttttaggagagatgcaggcagaaaagttcccatcctagccacctccgagcaagaggggccctctgaaagcatccagtcccactctgttgcttcccagatgttggggttgaggcacagaatgaggatatggcttagccagggcaatgcagtgagctgatcatggagctggggctctcatgccagatacctgctgtctagattcccacaggagtgtgaggcagcacagatagtccagaaacctgaggggcatgggtgcttgaggggatctgtataattctcatcttctttatggtggaaaatctgggattaaacattcacttcttccccaccccatggctgaaaaagtatttatttttagaggttgtcagagaccaatgtgttaaccaaagcttaactttcactttttaatgtgtgaccataaaactgctcccagaagcctggcagcctgcggatatgtcctgcctgtccttctcccaactctcccccaccccaccccaccccacaccacagggagctctagggagcctgtgcatgctcccaggctctgaggctggccagcttagccccttctgacccttactgtcctctccatcatctccccagcatcacatccatggctggtgccagccttcaccagccctaacgtgttgtgatatgcctgtatgtgttaaactctctgcccacctggccaaatatcatcattctcaaagcccagaaaaccttccagattgctcacagactactctaggccttcttcacaccccatgctggactgttcatgcaaccgtattcagccaaaggcccctgaggattaactgtgcggggaagtcagaggggaaaggtactttgttcctctagtggtcaggaaaggtctgggccccttgcagaggaataaagggctgggcgggttctaaggcccagaatttgcttcctcctggttccgggggaatgggcaggcaactttctgaaggaagtggtatgtgtgaactggggcaccaagatactagaaaaatgttgctagagaagaggggaaggcctctgcaggtggagaataagaatagcacaggaaaggcctggcagcaggaagcaggcaggatgtctggggagcagtgggtgtgcctgcaatggggtcagggtggaggggtaggggtataggaattagatggatgttttcaaggatttgggacctctgttctttggtgtttgtttgacacatctgaaaagaatgcatacacaaagaattatcatgtgagaaagcattggttaacgctaaggtaataattaggatttgtggaaggtggaaaaaattacctaaacatttttagcaattgggaactgcaaaataagccgataacatccctgttaacacttaggaagagtcttcattcatgacatctgttaaactagagagcctccattggctgttggaaggttcctcaaacacaaaacagaaacaaggggagtcccttgactggttcccatgttcttaagtgttctccccgccccttctccaacctcagctcctcgatgaagcagacctccataacttgaaagagggtgttatcattccatagacatctatcttatacagagcatcaccctcacatttcttctacatgctgggtcttcagctgcgttctaggaacaccatgtcacacactcttaagctgcacatttatgctaagcatatgagagaatgacaggaaagactttttttcagattatgaactcactccatttagtgtatttcagaaggtgcatacttctcttcatctgtcagtgaaagaagttggaaattaactttgaaaaataaatcagcaaatagcaaattttctcaaaagttacagtcacgtatatagggcaagaaatgaggaagggcaagacagactccacccacattagtgagtttcatcaaacacccaagggtggagagaaaaggcagctttcagaaaggactgtgttatgaaatgaggcaggtggggaatgtgttttctaaactagatctaggaagtggaatgtggaatcaatctgtcctcctccctttaaggactgtccactggttaataaattttttaaaagactaaaaaataaactcctcacacacaaacacccgcaaaacaaacaaacaaacaaacaaacaaaaaaaacagcattaagatgtcccatgttactctcgaggggaaccaaggagcagcttaacaattagcattagtgtactagagagtcattacaagcatgccttgcttttaagcaaacaaaaaaattttttgaagcaacagaacaaacgagtactgatcacttttctgacaataaacaatgattcaaaagtaactagtattaggatggggaagggaaccatacctatgagccttgtcttgcaagagtatatgttggtaggattaggcatttgtcattattgcagagaatgaacttcaatttttttttttttgagacagggtcttgctctgtcacccaggctggagtgcagtggcgagatctgggctcactgcaacctccacctcctgggttcaagtgattctctgacctcagcctatcaagtagctgggactacaggcatgcaccaccatgcccggctaatttttatatttttagtagagatggggtttcaccatgttggccagagtggtctcgaagtcctgacctcaggtgatccacccgcctcagcctcccaaagtgctgggattacaggtgtgagccaccgcgcctggcctaatttttaattcttagtttgacttaaaccttgcttttagtgtgatggcgacaaaagctgagctgaaagggctttggagagatgttcacagcagcacatgcctgaggctctctcttctttggctctggaggcttggttaacagcattctttttttattttattttattattattatactttaagttttagggtacatgtgcaccatgtgcaggttagttacatttgtatacatgtgccatactggtgtgctgcacccattaactcgtcatttagcattaggtatatctcctacagctatcccctcccccctccccccaccccacaacagtccccagagtgtgatgttccccttcctgtgtccatgtgttctcattgttcaattcccacctatgagtgagaatatacggtgtttggttttttgttcttgcgatagtttactgagaatgataatttccaatttcatccatgtccctacaaaggacatgaactcctcattttttatggctgcatagtattccatggtgtatatgtgccacattttcttaatccagtctatcatttttggacatttgggttggttccaagtctttgctattgtgaataatgccgcagtaaacatacttgtgcatgtgtctttatagcagcatgatttatagtcctttgggtatatacccagtaatgggatggctgggtcgaatggtgtttctagttcggttaactgcattctttaggcccttctctgtgagtgcagaatgctctgcatactcaacagccttccagtccgaggccagtctggagtgataggcttctgttttttgttcttggcaagttttacaagagtagagggatcattctctgagatgaatttgggtctcgacaagcaagaaaggaatctttggatagcggtgagttatcacaggcacccacttttctttcacatttttgaatgaggacggagataccactgaaaaactgactagaaatacatctgtttgtagatacttagcaattgcaatcttttataaccctcttgcccagaagtgtcaaaaagtccaagagcatatggctctccaccaaccataaccatgaccacatagttgttagaaatagttggtacattttcagatgtaaatttgtttgttgtgtaggatatcggtatgttttaccaatggcatcattgcttacaacagcacacttaatggtctgcattgctgaaatagttttgtatttactttaaatatttcgaacttgatgttgacctcagcttctccctggggcatggcggcactcaggacctctctcctagacagtgctggcattgcagttggaacttgggcctctcactctaccctaacatgctctcctcaccccaactcttccaaagactgtgactcccaaggaaatgaatgctttgtgccctgcaccacatgctaatcccaagctcagttccagagtgcagctggctttgtgtgatcttctatctctggttttcatctatgaggaagggttctgcccattgacccagaggaccctctctgagctgacacctaagcttctttattataaatggtgacttcatatttaaacttaaatgcaaacaatactaatttgaaaagagaaaagtatatttccatataggctgtgtgctcttgaaggtcagaatatgtttctccttttcaacctacatttcctgggcgtccacccttggtaaaagaaaaaaaatgggctgggtgcagtggctcgtgcctgtaatcccaacactttgggaggctgaggcaggaggatcacttgagcccaagagttcaagaccagcctgggcaatatagtgagacctcatctctacaaaaaaataaaataatcagccaggcatggtggcacatgcctatagtctcagctactccagaggctgaagtaggacaatcgtttgagctagtagtaagccgtattcatgccactgcactccagcctggggagacgctttctcaaaaaaaaaaaaaaaaaaaaaaaaaaatgactcccctgtctacgtggaccttggaatgggaaggtgggaagaccatcaatgaatagcaacaatcatgtgatctgtccagcgaccaaagaagtaggaataggagagaaggggaagcagaaagaacaaccatttctggggtctggaggcgtgaaaatgcctggcatatttaggaatgctgacatggcaaaagagactgggaaataggcaacagctagctcttcaagggccttagatatagtgctaaggaatttgggctttctcctagaggccaaagggagctgttgaaggttttggaataggggagggatccgggatggggtatacgccaagaaatgagggtgggattctgcagaccaccatggcaggctgcagacagaaccatccactgtgggtgttggggctggggaggatgactggcatcccaagttggagccctcttcatctctaccacctgcaacatgacaacaccatgagagctcaggcatatctcggcgcctctccaagcctcagtctctgctgctgcacaaggggaatgataagccattatggggttagaatgaggatttaatgtcatagcaggtatataaactgaagagaggtagtgaatggtggctgttgaccaggtgtgccagccttagaagactccaaggcttggtgctcatgcccacagggcacttcacccccttgtgtctgagctgtctgccaccaggtgagagctttgtgagcacagaggccagcacagcctcaccctacataacaggtgctgagagcttcgtgtgacatagccactgagctaaccatgttacaaatgttagttcctttcattatatcaggtgatactatatagcatattttattcacattttgtagtgggaaaccaagacacagacagatgggctaacaggctcaaggtcacacaaagccactcaattctgactcctgagcctgggaacagtaggcctttattattagttattttaaatgccatcttactacaaaggcaatctgtggctgctagacaaaaaccaaacaggatagaactggctggagcaacaatttcaagtcccctgtccttccctacttcattcccaggggcaatcagttcatcacttgatacatgttgaaagttcttgaaaattaacagttgtccttaagaacagaagtatgagcacaatggtaactcctggactggttaatttcttgctaaaagttatttaactgatggtgattggttaattagctagctgtaggcattagtttatgtcttcatttattcattcattcagcagacatcctcttagccttcactcagattcattccctgtctagggcaagagagatgtctcaactctaccagctgccatccagctgtaggaccaagggttagctgcttaaactttcctttctcgggaagttgataataagtgaaggattattattagaattctgtgagatcatgcatgtaaagtgtttagcaagcacccagcacagggtaagtgctcagtggttgctgctgggaagctggaggagagctcacatgacggttccccaacaaacatttgtgtgtggaactgggctgtgttcaagaggcatggcgggactccctaaggggcccacaaaccccatggggtgggggtcagtcaagtgagtcaagtgcacatacaatagacgtgtgtacagagtggtatggacccaaatatcttctcctcttggtttctcaggctgtgggattctctctataggtcttgggtggattagcattctctgtgtctctctctttctctgtcacacacctgcacattctctcattctctccctccctccctctgtgtgtgcgtgtgtacgtgtgtgtgtgttcctctctcctaatcgccttcctcagggcatgtgtgagggctccttaggattctgattgcctgtgaatggtgggtacttcagggggattttgcagccaggtagaaaaacatggagagacccaagtgtgtcccaggggtgccctggctatggagaagcggccccatttgttaagaagcagcaattaatgatttgtcacagggttccaaaatttgcatccttattgtgtcaataattttacatggcatctccaggccaaaagaaatgcctaacagctctatgtattaagtcattaagttcaaacaagtgtttatgtcctaacaacttagtagttattttttggaataaatgcataagttgacagaaaaaatattttaatgttattcttaaatacaataacttactgataagatgtatgcacttactgggcattgtacaacttctcagtccttaaacactacctccctcactttctcttccacattgattttcctgtggcatttgctttcacagcaactgccaaaagcactttcctatagatttgatgtcagatttcacatagatatgatgtcattggaaggaaagtagtgtggtctcacgttgaaagcgtgaactatcctgagctagtaatttgtgtgatatcagagagatgtcaacttgtatttccctttaaaacctgaaatgccctgccatgctcagtgagttcactatggtgccctggagtgcctcagtacacagtttgggaaccatgagctcctgccctgaagggtttgtagtgggacaggtggtgtagggcttgccctccttgcagcccctggactcacatctgcctgtgtctccctcagttcaacctggtttgtgatcggaagcacctgaaggacaccacacagtcagtgttcatggctgggctccttgttggcaccctcatgtttgggcccctctgcgaccggtaagaaccttgccctgcccactccctgcctagcaagctcgtcagctctggcacaggcccaagtcccccttatgccccttacactggcctttaggcaaggccctcttccccctaccctcaaatggggctcagacagagaccccaggacagggctgggcccccttgcggccttctcctcagatgccttccgggagggaccctccccacagacctgccctgtttcctcaggattggccgcaaggccacaatcctggcgcagctgctcctcttcaccctcatcggcctggccacagcttttgtgcccagctttgagctctacatggccctgcgctttgctgtggctactgccgtcgctggacttagcttcagcaatgtcaccctacgtgagtgtctgggccctggagccttcagccatagggtgaggcccaggggcctgggagggccacagccccaaacggcctgtggaggtcttttcaggtaccccacatctgaagtggtcgcactggtgcttcctgtgttggcactgaggcccagcccccacagggtggcatctaggagtaatggggagtgaatggcagggattagccctgtctcaacctctccattgccacagtgacagaatgggtggggccctcatggaggacgcaggccgtggtcctggcccagtgcaacttctccctcgggcagatggtgcttgcgggactcgcctacggtttccgcaactggaggctccttcagatcaccggcactgcgcctggcttactgctcttcttctacttctggtgaggaaaatacatgccaggagcaagcccccccaggttagttgtgttgtggtggggttgcagtgcagcacccatgttcataggacagtcagaggtgagtctgggagagggagcctgtcacagctgggtgtggggttcagtttgcactggaacaagctggaaagctccctaggactccaggccccaaggtcatagccgttgctgacccacagggctctgccagaatctgcacgttggctcctgacccgtgggaggatggacgaggcgatacaactgatccagaaggcggcctcggtcaataggcggaaactctccccggagctcatgaaccaggtacttccagcaggcccaggcccaggcccagaatcagacccacacggatcttcctgcctggcttctcactctgcttcttcctcccagctggtcccagagaagacaggcccctcagggaatgccctggatctgttcagacacccccagctccggaaggtgaccctgattatcttctgtgtctggtgagtgcccagaacccgaggacagaaccacagggctgcagcctccctggtgtgtgttggcagaggggtgggctggtggctgtttggctgggatggtctctccctggttgtgccagtgtcccctgctgtgactgctgaccaaggcaggctctccctctgggtggtgtctcgtcacccagcagtgacaggaacccttcattaccttgtaggtttgtggacagtctggggtactacggcctgagcctccaagtgggggacttcggcctggacgtctatctgacgcagctcatctttggagctgttgaggtgcctgcccgctgttccagcatcttcatgatgcagaggtttggccgcaagtggagccagttggggaccttggtcttgggtggcctgatgtgtatcatcatcatcttcatcccagcaggtatcagggctggctatccctcacccgcatgccccctcacccaccggctgccaggggctagaccagtggccattgttctgcttccaggagtaaaggcttcccgggggtttgggtacagaaggggtggggagttccagtggatgggaccggcgtcagggcccaggtgatggggctgtctaccctctgccagatctgcccgtggtggtcaccatgctggctgtggtggggaagatggccacagctgctgcctttaccatctcctatgtgtactctgccgagcttttccccaccatcctccggtaagagctgcagtgtgactcctgctcctctgctactgagatgctgatttggctgtccctcctcggccctcaccccattccacaaatagctgacagggctggctctggggcagcagtgctgggcagggtccaggacaactagaaatctagcccaagccctcaagttgtccccagaatggtggaggacagacaggcaagtaggccatgccctggcggtcaggacaggaatatgggacacatctaagaatgaatggccacagagaaggagcacttggggtggaagagtggtaaggatgtgcagcctctgacctgagacttgacaggcgagcaggggtgtagcaggcagggagcagggttggaggcaggagcagagagcaggaacgctggctgggctgggtgaggctggagaccctgcagacctttgaggtctggactctcccgaggaaatatactagggtgaagctgaggcccagagttgggcccaggtctacttagcttgccctggtcttcccccaggcagacaggcatggggctggtgggcatcttctcacggatcgggggcatcctcacaccacttgtgatcctgctgggagagtaccacgctgccctccccatgctcatctacggcagcctccccatcgtggccggcctgctgtgcaccctgctgccagagacgcatggccagggcctgaaagacaccctccaggacctggagctggggcctcacccacggtgagctgcttgcttgcactgaaaccacgacttgggtctcacattggccacgcactctatatgcccaggcctccacctcatcactcgtccactgttgcctagaggctaatatggggtcctccagaaccacagacatctggctggctttagttcagattccccttactttgaggagggaggtggtgaggacactgtcatgggaccaattcctgggcagccaatgacagccttctgctccctctaggtcccccaaatcagtgccctcagagaaggaaacagaggccaagggaagaacttccagcccgggagtggcctttgtgagcagcacatacttctgattgaggtctctaagagctggaccatcagcagcagggagctgcctaaacacctccttggatatggccaggacccacagggacacagggcaagaccagccttgcttatggaggcaggacaccacaatctggcccatggctgtcacctcctgccgagtccaatcccagactgggaaccaccatctgagacaggacctcccggcctccttcacctttctcatctccagagccctgcccccaatactctgtctgggttaggatcttgggtatgtcttggaattaacttgtcctctaacaatcttcatggggtatggctctcttgatctcctcaatctggagtcccctgccctcaaaacacagtgatgttcagaacagaacacaaggtaagccctttccaatttgtgggaacaggaggggagaggaaacaaatgtgaagttgtggactctacccaggcaggtggatgaaaatgctgtggataaaaggaaggttatgattccttctagcggatggaccagattcctctggctaacgtatggccccataggtcactgggtcatacagagagaagattcagttcagcctaaatcaaaacttccaccttgtgttcacttcaaagatggcccaacccccgccctacactcagctcatgcctaacctatgtgtggctcagggaccagcttggggaaggaaaggaggtttgttctgctccccgcctcaccccgcctcctcctgctcatgctcagctgcttctggaccttccagggcccatgcagggtgagggaaagggtagaggtcttttcaccgagctgctgctggttgcagttctttctggtgcacattggctaatgccagttggtgtgttttgtcaggcttctgaaagctgccttttccacgggccatcttcttgggcttctcagagatcttctcaggccttggtattgttccttagaatgagcaatatgctcccaatgcactcccagctcctcttgggacccttctccagccccacccagcattgctcctacaacctgtcctacagctggcagcccctgacccaaccaagatggccttcttggctgggcgtggtggttcatgcctgtaatcccagcactttgggaggctgaggcgggcggattacctgaggtcaggaatttgagaccagcctggctggcatggcaaaaccctgtctctactaaaaatacaaaaattagccctatatggtggtgcatgcctgtaatcccagctacttgggaggctgaggcaggagaatcgcttgaacctgggaggcggagtttgcagtgagccaagatcgcaccactgcacttcaacctgggcaacagaaagagactctatctcaaaaaaaaaaaaaaaaaaaaaagatggccttcttagatgggcgcccataaagagacctcaagccggactgccttcctcagcacctccttagcctgcaagaacaccatatatcattgtgtcaccaaatggtagatagaaaaagagcttgcctggccactgcccctgccttgccccagctaacctcccactagggagaaggtttcagtctctcttctcacaggcaccccagcttgctcaccttctcctgcatggctggttcggggttgggcgtagatgctggaccagtttcctgtaaacccagcatggaagtgttcagcacctgtcttccaaacacatggatattcctcactcacgattctcagctttgaagtgctagacaaaagctctatttagcttcctactgtgtgcccattcatggcatcctcttggggaatactagcaagtctttctgggcacaatgtgtctctcaggctgaaactgccaaggggtgcggaaaaccagatagaagtggggaaagggccatttcccagctaaaggcagtttcctcctctaagatatggacacttgctccctttaagacggaatgattgtcattcccaggaagagacctgaatggccaagactggctaatttttgtatttttggtagagatggggttttgccaagttggccaggctggtctcaaactcctgaactcgtgatccgcccacctcggcctcccaaagtattgggattacaggcatgagccaccatgcctggtccctggagactttttctttcctttttggggggattatggttggttggggagaaagatttttttttttttctgtgtgtatttaaaagtgtcctgtggtttgctctgatgaatgggtaagtgtcctttagcagtcactgatgggaggttggctgctgaggcctctgggactctgaaggagaagatatgcagcttcactggaccctggttgtgtatctccttgattttgctcctcaaaggttacggcaatggtgactatcagtcctaaacatttagtccaggtgtgtgaaagcgaaactgtgccccaaacagttaaagacaccaatgactaacagaaattcttgagtttgcaggatggtaggtaagcaaagaaacaacttgctgagatgctgaaagtccctccacttgtaagacaacaaagctggctaaaataggttggaaccaatgtggccaactagagtctgtgcagtacctgcttgctgacatcacagcctgaatttccactgcgtgtttcatactcactccccccgtacctgcccatgtgatctatgaggtgtcatgaagagaactgcgcatgctggaggactttccaggcctcctctttccttccactaatcacctgctaatctcagaatcccgacaccttttctaataaaaacactgccttagcaccagcccagggagacagattcaagctggactcctgtctccgtgtcggccggcctataattacaagctt

SEQ ID NO: 16850 - DNA, 16662 bp, Human
cctagcactttgggaggctgaggtgggcggatcatgaggtcaggagatcaagaccatcctggccaacacggtgaaaccccatctctactaaaaaaaatacaaaaaattagccgggcgtggtggcgggcacctgtagtcccacctacttgggaggctgaggcaggagaatggcgtgaacctgggaggcagagcttgcagtgagccgagatcacactactgcactccagcctggatgacagagcgagactctgtctcaaaaaaaaaaaaaaagttcaatcaaatcaggtctcttactgtgtgttctctcaatttcttgttatctctataattacctttattttaccctagttcttgacagacaattttgctgggtatacaattctatgtggtctataattttccatccacattttgaaaatattcttcgctctcctggtttccgtgttgcttaactttcatcttctttttttgagacagggtcttgctctgttacccaggctggagtgcggtggcgtgatcatggctcactgcagcctcgacctccctggctcaggtgatcctcccacctcagcctcccgagtagctgagactacaggcacatgccaccaagcctggctaaatttttttgaattttcttgtaaagacagggtttcactatgttgcctaggctggtcttgaacccctgggctcaagcgatctacctgcctgcacctgcttctaacaggagactgctgaggctcttcattagtcagtggcctgccttctctccagctgattttcaagatcttttctttgtcattggtgtcctgcagcttcattgcaatgtgtctagccatggttttcttttttatttatcgtgcctaagttacatttcctggatctaagaatttgttttaaaagttttagaaaacgtattgtttttatttcgtctccatttctccttgtgggcttccaatttgatacatgttaaatcttctatctaccaagtctctttacctctctctcacatttcagcaatttattccagttcactgattctttgtgtcaaatttgtttaactttcctcttagtgtttttatctcaacaacaacaacttgccgttcaacaagctttcatttttaaaagttcataatcttccttccaaaagtgtctgctttttcctgattgttgttttaagttcattttcgtaattacaacctttaaatccttaaaaagttcatacaatagctgttctaaattttgtatctgacagtttcaacatctgcagtctaaaagtctgtggtttctggattctgtcgacttgtagagtggcttgccttctcaagctataatctctttgcttgatgtacctccgtgagagtcttgcagaatcaacttgaagaaattttcctttagagaaggctcgcttctgcctctgctctgagccaaggggtgccccgcaccaggaactgttaccccttctgagagttttggctcaaaacagagttttaagcttagtttcccctccttgctgctgttgcaaggtaatatgctgacagtcagtactgctcaccttcctccttccccactcctgcctttccagtttggctccatgctgcactgcctcaccactgcaccagccttggtgccccatctctgtggcccaggcttccagcctcccaccttgggcccacctcctggctacagccgacgatgcagatctttgtttgtttttgaagaaaaggtccctagagacctctcctaccttttgcaagaccactggtgtctcagtgtgtgtgtaaacaaaaagcttgagttgtggggaagttgtaggagagttcctaagaacttagtccttcatgacaacagaagcacagcattttctaaaacattaaaaatctcaattacactaaaactccaggatggttgggccaggggggaataaatcatgttaactaagaaagcaagggagggaactactgagaacgtcaaggttggaatccatattgcttcaagccagaggccagttcctagtcggtggctcccatgctggtctctgatgtttaggaagtggtgtcagcagagactgagctgcaccctttctttggacagatggcaggagaggagaacttcaaggaagagctcagatcccaggatgcttccaggaacttgaaccagcatgaggtagcaggacatccacattcctggtctctggagatgctgttacgcagattgagggctgtccacaccaagcaggatgacaagtttgccaacctcctggatgcggtgggggagtttggcacattccagcagaggctagtagccctcacctttatccccagcatcatgtcggccttcttcatgtttgctgaccacttcgtgttcacagcccagaagccctattgcaataccagctggatcctggcagtgggcccccacctgtccaaagctgagcagctgaatctgaccataccccaagcacccaatggcagtttcctgacatgcttcatgtaccttcctgtgccttggaatctggattctatcatccagtttggcctcaatgacacagacacatgccaagatgggtggatctatcctgacgctaagaagcgatcgctgatcaatgaggtatgtcttgtcatgggttgtctgtaactaccctacaggctcagagttgtgcctcccaccctcactgaatgggtggggaaaccgaagctcagagatgggaagccattggcctgaggtcaacctgcagaggcagggtctgggcagaaaattagattcctgttgcccagccctggccctgcctatctatagagtacatttggggtagagatgggtgctgcatggcagggttttccatctgtccaagaaatcgctcctgtagttgtggttctgacctcagaactcacaaaaaatagggctcggggaaagaagcagctttgatcaggcatctcttacggggcttcccaacccgagctgcaatctaggccctttacaacacagaccgccctagcatgaatctgcaggttgggcctagcacctgcctttgggaaagggtctgcactgattcctgcctttgctcagctaccccctaccccacacacacatcttggcctatgcctctggtcactctctccaggcccagctctcagggtggagcaggtgccagaggggttgcagaggtaacagagcagaggcaacagctgaggcacgctgcacactgttaactgcccctaccccaggtccccttggcctataggtcccacgctgggatgaggctcagtctctggacccaaaggtgggcacccgtggccaatctctgtgtctgacccacagtttgacttggtatgtggcatggagacgaagaaggacactgcacagatcatgttcatggcagggctcccgataggctctctcatcttcaggctcataactgacaagtgagtccccgggagtttctgctggtccccgagccatcccaactcctcctcatgggcattcagggttggagtgtgtcaggctgagggaggtgagggtaggggttctccagggacccatggatggctcagggcctggcccaggtgtatccggctggggccagcccgggagatcccggcacttggtgcagcctccctttgacacctgtaggatgggccgctaccctgccatcctgctgtcactgctggggctgatcatcttcggctttgggacagccttcatgaacagctttcacctgtatttgttctttcgctttggcatctcgcagtcagtggtgggctacgccatcagcagcatttctttgggtgagactgggcctcaatggggcagggcagggtggcacaggggcatggcggcataggcgggtgacaaggggacatagtggcagggggcgtggcggcataggcagatggcaagggggcgtggtgtagctgtaagagggcatggcgggggtgtggcagcgtgggcatctgctgggatcccacaggacacagagtcaggggcctaattggacaggcagaagtggaagggatctccgttcctggctgcctggagatgtcagagaatcagtgccctgactgcccttccaccttcatcctccttcctaactccctcatacaccacaccttccaccgcatactctttgcatacccccaagccccatgggttacatttactgagcccttaagaaaggccaggcaaaaaaaaaaaaaaacaaaaaacagaagaagaaggaggaggaggaggaaagaagaagaaagaaggaggaggaggaggaggaaagaaaaagaaagaaggaggaagaggaggaggtggtggtggcagaggaggaggaggaggagaagaagaagaaggagaaggagaagaaaaagccaggcagctgctgagccctttatatgcattgtctcatttcctcctgatgcagctgtcttcagcaggcactattctattactccttcagctgaggaggactctttagcctcagagaagttaaccaacttgcacagggccacacggcaactaagtgaaaaagctgggacttcaacccaggcctatgagacactaaagcacccagtgcagccttatagctgcagctgcctagttgctcggggtttcctggcaggagaacctcttctcattgggagccttaggcctaggtggccaaagcacgaatacactcagagcaaagacaaggacaatgattccttgcctgaccatgtgtcaggccgcgtgtctggtattgcgtcttttctataagaggcacgtggtcagacaggggatgtgcagagggagcagccaggtggagcgggatggaagctgtgtatatgattaggagataagggtgtgccctggcgggaacagaggcactctaccgggctctgaggggctgtctctggacccagtgcagagacgagcagaagaagctttgcctgatctcaactgtccagagcaggtggggacacccagcaaggctggatgcaagggcagccctggggaccctgacgtaaccatggttttgtcctcttggcctctgcacagccactgagtggttagtgggtgagcaccgggcccacgccattatcctgggacactgctttttcgctgttggggccatgttgctgacagggatcgcctacggtcttccccactggcagctgctgtttctggtgggtgggatacttgtgatccccttcatctcctatatctggtgagcaagcgagtacagggcatgtacagggctgggtctgatgggctggatgtcgatgagtatggagggtccttgaagctgtgggaatgggtgggatttcccctgggagaaagtgcatgtggatgggatgagataggaaggcaccaagggcagagcctctgaacctcagcattaacctcctccccgacccagagaagaccctcaaagagatgttagagaggtggtcagaaaaccaggaggaagagtgttgaaggccaaggggttaaggccaagggaagggtcagtgttgaaggtaagaggggtgatgctgggaaagggtctgccagccttggtgaccttcttgaggtggcttcactgcagtggcagagggttgaggagtgactaggagcagaagaaattcagccaggagatgactttcttagaaagagggagaaagggatgatttatatgggcaactaagacagagtcagggaagagtatcagatgttttgagtgtaggggagtcacagacaggaacctaagagattaaagctgggagaggacaactgatggggcaaaactcggaggaataagggttgagaacaaaagtgagatgccaaaagaaagaaggttaaccttgggcaggtgggaaaagagagggacaaaacagaaggcagagagggaggtgagaagaagctgaaagaacccacgtgtgaagggttaggcagttctgcatgaagcaatgatcatatttaatcttgaaattattacatttaatcttgacccctctagaagaagtatgctactcccatgtcatgggaggtggggaggagggagaactgaggcttcagagggtggaaataacttgtctaacagcacacagctagaaagtggggcacctgggatttgaactcaggggctgtctccaaagcctctgcattttaactgtaccatatgtagtaagaatgataaaagatagggttaacagcatgggggctgggcgcagtggctcatgcctgtaatcccaacactttgggaggctggggtgggaggagcgcttgaggctaggagtttgggaccagcctgggcaacatagcaagaccctgcctctacacaaaattttaaagttagccaggcatggtggcacacacttgtagtcccagctacttgggaggctgaggtgggaggatcacttgagcccaggagatcatggctgcagtgagttatgattgtattactgcactccagcctgggcaaaagagtgagatcctgtttaaaaaaaatttcagtccagttcaattaaaaactttaatcttacatcagatccacagctttttcctggccccttgctcaggatagtggccaagggggatgaggtctgttctgacctattgttcttcctcctgtctccttgttctgattttccaggttctaggcatgggatagggacatcagataaaatagaccaaagactgacatggcaggggctattatagtctctcagggtcctctgtagggtagatattcaaataccatcactctcgggtccattcgtgggtcttctgagcattggaatttcctaatgctcccagtgctctgtttgtgacctccctcagctcctgtccctggcagttcaccccataacctctttctgtaggggtctcctcatcctagcacatggggtgcctttaagacagcagggtccacttggccaaaaaaccccactgttccccagcctccaccctgttgtggtgggctgctccaatcaacctcctgccttcattatacccagatgagagatgggcatcattctccgggtttatgtaggccctcaaactccaggtggcacatattaaccctcctataatctctctcactgtctggaataccaggacaagcccccatgtttctgaattagcaagttccagccagagtgggatggcagatgtcctttttcaaaggcagtccccgcatctatctaaggagttctcttgaactcccctttgcctagctcgagtagatgagagttgtatggggagtgaggaggagagattcaagaccctgtcacttccatgaactggattcccagcctctattggtaggctgttagcagtgagcaccaatgtactatgggtgctgaaggtccctcttttgacctagttgtgtcccctaggctttggcagtctgggcctgtgatggaaggggcagtaccaatgatctctaatgtatctttggggttattcttttagtgtcctcaaggatagtgcctggcttccgctgatttgtactggcctccttatcaaacagtagcttggccacatccttggtgttctctcccaaacacactttgttattcatggaaaatgaataaacagcatggccaacatgagcatttgacaaatctttaagttctgcttcccttttaattataaattctaatttgtttctctcttctcacattttactataagtagtcaagagaagccataccacaccctcaacactttgcttagggacttcttctgccaaatgtcctatttcatcacttacaagttccttctttcacaaacactaaggcatgaatacagttcagccaagctctttgccattttgtagcaaggattgccatttctccagtttctaatagttcctcatttgcatctgagacctcatcagaatgtctttattgtccatatttacgtcaacattctgttcatgacctcttcaatgcatttgttacatttctcccattgtgtcctccctcccattctctttgtccctgagagttggtatccttttcttatacctgttttttcagtggacatgaggccaatcccccatctttttgaagaagtctcagtttaatggctttctttaggagagttccacagccttagagtggaaaatgatgactgattgctgaaccctggtgggagagaggaggagcagggcaggtataaggaatgaagttgtctctagtgtcttgagtgtgtgtttatggcaaccagccagagtcctggtcggggagggagtgctggtataagaaatcagcaggcacagttttattaaaaagttataccaccttaggggactgaggctgtaccagtccccaagtacatagctctgcctctgtgtcctcgggcaagccttttactccttgagcctgggagtaaaatggggataatcatactaggtccaggtttggatgaggattaaacaagactatatatacaagggcaccaagcaccatttttcacacatacgtgctttttatgccaatctgtgtggattctgacagcctgagaggatgggaaaaaacagagaggagttattctgaagtcaaaggcaatagagatgtggcgggggagagatgggacagagtagagaccttcactcacccctccattcacccaggcagagtgctgggcactggggtcagacccagggtcctgccccctcacactcctcaggctgttggggagacagatagggaacaggagaaatcccaactaagggcatgggggctctacaggaggctgtgggcatggaggtcggagccctcagcatgcctgagcagataggggtggccccctagatagaaaaggagagagctctcagtgattactgagggcaattcaaggagactggagacagaggcagccggtggtcagggtgttacctagcagcagtggaggccatgtgaggcttagacaggggaagggctgaccaccagggaggagcagagggcagctcgaggtcagtggtggccttcaaggccctgacatctgaatcacctcatgctggcacaggatggccacagctgaggccacgagagggccagcagggggtctctgggcatcatagaacggtgagataagagaggggctggccacgcaggattctcccggagtccccgcggtggctgatgatgaaagggaaggtgaaggaggccaagcaggtgctgtgctacgccgcaagtgtgaacaagaagaccattccttcaaatctgctggacgaggtaaagggcttctggccaggagtggggccggagcagtgggctgtggaagggccccttccctcctcatcctttcaggtgggacattggtccagagggtgcccccagtccactgcttaaggacaatggtgacagcaaaattgaaccctgccagggaaggccagaagccagctggcactttcagggacaggcaggccttgtgggtgctgtggggctggggagcaagctggggtcttggccctgcctctgactggtcctgcttgttctgtagctgcagctgcccagaaagaaggtgactcgggcctctgtcctggacttctgtaagaataggcagctctgcaaggtgaccttggtgatgagctgtgtgtggtgagtatccagggctcgctggcagggactgcgaacaggtgcgcaggctggaaactctagggagaggatgggaatggtcaggctgcaggggaggcagcccaaggacacagatcacaggtctctgtgcttatttctctcctccgttcctaccctgacccttgctgctctgcctctgtctttattcctggctccgtgtgtgtgtgtgtgtgtgtgtgcgcgcgcgcgcgcgtgtgcacgcgcacttgcctcctggcttcatccaggtttaccgtcagttacacctattttacgttgagcctgagaatgagagagctgggcgtgagcgtccacttcagacacgtggtccccagcatcatggaggtgcctgcccggctgtgctgcatctttctcctccagcagattgggaggaagtggagcctggctgtgactctcctccaagccatcatctggtgcttgcttctccttttcctccctgaaggtacagctcatccttcccctgtggcctgcccacagccttcctgcttcccaaaacccctccccagtgccgcctgccatggccggccacctagacaccctgggaatcagccttctgcacctatagcccacccaccccacagaggccccagcacctccaatccctggagcactgctcttcctgggcggggtcccccagacagggcacccacactctctcagaggcctgaaagaggagggtgtactttccagaggacagcaggcagccttcttccaccagattccagtccaccttagaagtaggtctaatggttacatgtgaataaatgatggcaaaaatattccttcaactgctgcccaggcccacctgtcatctgtagcccctttgactgggaaatgcctgttgttccctgtagcttcaccaggaataacctgaccactgaaaaattgagtgtaatatggggctcagcactcaggaacagctcttgcatggaggcccctcctttccagaggggctcagtgccccattcctgctggcttagcactagaaaaggaaacaggaagggctggtgttatcttcagaatctcaaagagccctaaacagtggatacaccacaggtcctagagctggagcgatctgtgcagcacatgcacttagaatgactgcctgcggagccctttcacagtcgcagcaagggcaggggaggctagatccggccctgcctggaggggctccctccctttctccagggctggaattgtgtgtgtctggattaggacccttccactcccagatgctggcagtgtagattggctaacacaaaatgtggaaacaaattcattattgaatattaattgcctggtggtttttaaaaaagcaggtctacactgagtcaagcagcaatatgtaaactcagaagtgtgagagaaactaggaatggactccccggtagataaaactggatctctgatttcatcccagagacaagaaaagccaggactggaatgggagtaaggccggggcagggtcctgcagaggctgacaggcaggcaggcaggggctgaagcccccagcttcaccaggtctgaggaatgggctttccccagtttccccttcattgtgcctgtctagctggccggagaacatcctggaatgtttgggagccatcccagccattcaggccccaggaaccaaacacccccttgctctgaccaccttgcagagccccggtggtacagccctgagcaggggtcccaacccacaggacacaggcctggccctgagtggatccccagtggggtgaggaagctgcaattgggtgaggaggtggaacgaagacacagccttggaggcagagaagggggtgttgggtgtagcatgggagacagtggcctgagaggccatgggtgtcccaggggacctccccacccctgctgactaactctgcactgcaaatgtcctgccttccagcctggctgggcctctgacaacctgccactcctctgacagaatgcctgagcctgctggccagctgggcaggtggtggggaaggctgttcagatgccttctgggaggggtcaagggagggctgatgagtggaactccttcacccaccccaggggaggatggcctcagactcaagtggccacgttgtccggccacagagctgaaatccatgacgatcttggtgctcatgctcagagagttcagcctggccgccactgtcactgtgttcttcctctacaccgctgagctcctccccactgtgctcaggtatggggtctggtgggcgagggggccatggggacatgcgcagggagtgacaatgacaagattaatgcagcaactaagacaagcattcacctggtgacaagcactgtgctaaacagtttacataagtgatctcatttaaacaccaccagaaaatcccccaaatgccatcactaaccctatttcagatgcaagaccagacagataaaggcactcgattaagggcagacagagcaagcagcagagctgggatttggccccaggcagcctgactccagcccctgccttgcactcactgcctggaaagtgtttgggccacttggaggctcagatccttccctgaggttggcgatgggagcactatcttcctgcctggctggcatcactgcctgtgtcctctccccgcacatccacataatgctgcatggtttctgcctctccccctcctcatcccccttgaaggaggcccagaagaaattattgcctacttggaatcacacaatgaggatgggacagggtggagactggagagtgtgggttttcatgtagctgctggccctgcccagcctctgaacccggcagacccctcacaggagctctcacctccactttcagggcgacaggtctggggctggtgtctctggcctcggtggctggagccatcttgtccctgacaatcatcagccagaccccctccctcctgcccatctttctctgctgcgtcttagccatcgtggccttttccctctcctccctgctgccggaaacgcgagatcagcccctctccgagagcctgaaccactcctcacagataaggtaggtgtgggagcctcctgggctgtgccagcacggggcctggctctgaagccttggcacagagagcgtgcgggacattgtccatccccgcccctctgccggagagcctgtgactcgaaggctgccatgtccgcagcagtctctccgctcctctggctgctgctgtctacctgctcccacccagcctctgccagttcccatcctgctgcccctcctgacccggactgggccatgtcgtctcctttccttgcccctgcctgcctgtctggatgggtgcattgcctttgggcataccctccaggggcactcctcccagaggctccctctcctcccagggacaggggactggcttggaactgactctgagtacatctcttttcctgtctgaactcctagttcagtcctggttttcataaaaaacccagtcttgatgaaggactctggcctcttggccccagcagcccaggaccccatttgggaactgggttccacccaacacctccatgggcacttccggcctctgatctcccaggtgtcccctggagaagacttgtcatgattggcaggaccattccttctgggttttcggccaatgaacacgctctccctggacctgaggggacctgagcgccagtgaggagcagaggttgcccgaggccctagagtgtcctctgctctgtgccacagcagtcactgcctctggcctttctctgccctcctccctaccatcttccccctgccctccctccctgctctcactggaaccacacatgctaggcactgtgccagggcttgactgtcaaaggtcagaggtcagcactccccatccttgagaaaaccatagcttatgcggagacagatgatgcaaacagttcctgctagaggactctgacagtgggatatacaggatctgtaggaacctaacaagggaagaacgttaatttggggagttggagaaaatgtcacagtgacaactgagtagggctttgaaggatggatagaaacttgccccactgtagagagaggaagttcagcgccgcacgggaagagaggataatggttatgggcacaggttccatgtgccgcaacttcctagtgtgtgcacggagaagttacctcatacctctgagactcagtttcttcatttgcaaagtggaatgagaacagagtaataacaatagctaagatgaattgagcatttgttatgtgttagaccctgttctacacatgccttatctcgctctatcctcaaaacaatcaaatgcaaggtaggttctgtcactatccccattttacaggtgagaacattggggcacagagaggtaaggccatgtagcccagccatcctctcccatgggtttttttgagaggattaaacctacataaagcagctggcacagggtctggcatgtggcaagtgctcagtaaatgctagcagtgaagatggtggaccaacttcaaagacagaaaagagaagggtctcgcaagggttgggagatggagcaggcctgattctggaggctcctggcaaagctcggctggggacctgccggagtgagaaagcctcacctcttgggaacgcagggttgggcgctgctgaaggcacaagccgctgcttttctcagcttccagaaagatgtggccctggactcatcctctgatggctctttcaggaataaggtcaaggacatgaagactaaggaaacatcatctgatgatgtctgaggaagcggccaagaatgtcattctcaatgcccagatcctgagattggacccataccctgtctccaaccctgccttgaagcaattcaataaagaggaagcaaacagccaggctccctgagggccaggcccccagaccatcttgggttggaattgagtggccaagtatggggtcatggattccaggccacaaattccaggcctagttcagtctgggggcagggtcagtcctgctcccaggccagcccttgacattaaaaaaaaatgccccctccttctgcaggagctctgctgtgattcattccaataaaggtacaatgttggtcttgagatggctgggtcaaagttgcccatgtgtggagaatgcagaggccctggcctggaggaagatgggttagacagactccttagtgtctttgtctaatcgttcagggacagtgaggagctctctggatgggggcaggggagtggggagggcaatgtctatgagggccagaggtgaagtgagggcaagactgtgcctgcacaccaaccatacccactagcccatgcatccgccagcatggcgagtttccacctgaagcacaggctgaggacagatttcaaagctccattttatgcactagtcagggcagggatggaatgtaaaggaacattgagaacttctctcatttgtcccattgcatagggctttctcaccatctttctgctgatgctgcaaataaacatggtcttgggaattacccaaatcggtccacatccctggggatgctttcctgatgactccaccctagctgacctctggcctccaccactctgaggataagcccccataccccagctcacaccctaactgccctgaaggtgattctgcccttcccagctggcatgggggttctgccaggcagggcccaggactcctcaaccagactgtgaagtccttgggtcaggccttcggcactacctcctctctccctgtcttacctcctccacgcttgcctagtttattggaagatcatgggcttgcagagaatagctctggttcgactcctcatagcctctgagggaggaagacagataagcaagtcagttctcatggagccagggcagcaaggccatggatctcccaggcaggttggagtccagtgaagcagggagtggcctccagcattcccagcactctggcccagcacactgctttgcgcatgtgctcccaagctttgggacaccaagaagctggtgtccatgcctttccctttcagtgtcattttctgtgccactgttcttgactgagtttcctaggagggtctccaaagtggggtttgaagggccagaaagtgatctcacaaagtgtctgttcataggaccacaggatgctcgaaaagtctctgttgctctttctggcagaggcctgtgtgtgagctgtgatgccaacatattagccttatttaaacacctctcctcaagttactttgccaggaatcacctagtgccatagggaacaggaggaagagaggggtcaggacagaaaactgatggggcagtgtgggtgtgaaggagctggttgtacaggctgtggctgtcagcgagaccaactgcactcctacacgctttcaatttttcttaggtggccaaggcttgtcagtcagttccagataggacctacctagttgtttactgaatcaatggctaataatatttagagtttgacgttatgtattttactagactagacccatgctgtcccatacagcagccactaaccagacgtgggtatcgagggcttaaaatatgcctagtctgggaggctgaggtgggcggatcacctgaggttgggagttccagaccagcctggccaacatggtgaaaccccctctctactaaaaatacaagaatttttagtgggcatggtggtgggcgcctgtagttccagctactccggaggctgaggcagcagaattactcgaacccgggaggcagagcttgcagtgagccgagatcgcgccattgcactccagcctgggcaacagagcgaggctccgtttcaaaacaaacaacaacaacaacaacaacaaatgttgctagtctgatttgagatgtgctataactgaaaaacacactggatttcaaaggcttagtacaacataaaacaaaatatctcaatatttttaatatagatcacatgtaaaaatggcagcattttggatatattgagcagataaaacattaaaattaattgcacctattcttattaatttattttaattttacttcaagctctgggatacatgtgccgaacgtgcaggtttgttacataggtatacatgt

SEQ ID NO: 16851 - DNA, 58782 bp, Human
ctgcctatgcccatgaataagcaatgacagcttggaggctagaagcaagatggaattggttaagtcagatctctttcactgtctcagttataattttgcaatggcagtttcattaggccacgttaactaacttctctacacctcagtttctcactctgtaaaatgaagatggtaagttatacgaagttcaaagtgagtttatactggtagacatcagaatagtgattgccttgggagtttaggaagggtcatgaaggaaacttctggagtggtggaaatattctgttttgatctcagtgtttatatgggtatatacatacattttaaaaaagtcattggccaggcacggtgactcacgcctgtaatcccagcactttgggaggctgaggcaggtggatcacatgaggtcggagttcgagaccagcctgaccaacatggtgaaaccccatctctactaaaaatacaaaattagagccatacgcagtggctcacgcttgtaatcccagcactttgagaggacgaggcaggcggaacacctgaggtcgggagttcaagaccagcctaacaaacatggagaaacctcgtctctactaaaaatacaaaattagctgggcgtggtggcggatgcctgtaatctcagctactcgggaggctgaggcaggagaatcacttgaacccagaaggcagaggtttcaatgagctgagatcacgccattgcactccagcctgggcaacaagagtgaaactccgtttcaaaaaaaaaaaaaattagctgggtgcggtggtgtgcgcctgtaatcccagctacatgggaggctgaggcagaagaatcagttgaaccagggaggtggaggttgcagtgaccggagatcacgccactgcactccagcctgggtgacaggagtgaaactctgtcaaaaaaaaaaaaaagtcatcaagcagttaagattagattaaaatgcagtaatctaatcttaattagattagatacttagatacctttatttaaaattttttaaaagtggagataatagtacctacttcccagcatcattgtgacgattaaatgtgctcagcaggttgcataattgtttctgatctagctagtatccagtatttgtctattgtcacaggtggtgactgctggaggggctgagtccccaataagctgtgaatgtcttggaggacaagtatgttggccccttcttgttctagcagtgaagaggatcccatgtagactccaagcagctcaagttcagcaagggagacagaccattgcaagtgcatgaaaagggcactggtgggctgggaagttcgtaggaggagcctctcacatgctgggtttggggaggaattctggaaagcagttagtcttagggacgggaaggatgtagctggtgggacgggcgccctcagctccatgaataaaaggagtgggtctgactctggttctcattcccctttaccatgcctggcacacattagaccatcaataccaattgactccaggaaggagtgtctccccgtgggggcatcaggagccgctgagtttaaatacacaggtgggatgtgacacactgggaaccattcagatttgctggatctggatagggcttgtcaggactcagtgcttccaaccccagggcccatttccctgtggcccctgagtcaccaccatgggtggacagctgctccagtgccaagatacagccacagaggactgcaggcccagggcctccagaaggacaggcaggctccctctgaaagacaagcctgcttatagctgaaacctctggcccaggcgtcctctaagggaagccaggctgtgtcagggcacggcccatgaagacataagatgaagatggggagaaccagagggggtgcgcttcgaaggaaagcgggctgcgtgggggcaccgtcgattgcacaggacgcggtcccggctcgcgtagccccgcaggcggcgccagagcgcaagcccgcctcgtgactccggtccacagtccggccgggcggagctaggggcgggcccctgcgtctctgggcgctggagcgcggcgactatcacgccgcgtggcggacggacggactgacggacgcgcagccttacccgaaaggccatggcggagcacgcccctcgccgctgctgcctgggctgggacttcagcacgcagcaggtacagtcgcctggccgcagggccacggggccgcctcctccgcttcggtgggggtagggggcgggctgtcacccggacgcgggaaaacatgggcccggccgcgggcgcgcctacctctcgggcttcccggggcccccgcgcccctgccctgcgcgcggccgtggggcgccggtgccctcgcccggagatgccctgccaatgccacccgctcgcaagatgcggcctcgaccccgcctggacccagctaccccaggaaactgcaggcgctcctcggcaggacccccggtgcccagaggggccggaggactcggcgggttcctgcgctgttctgggcacccagtgacggggatccgaaggaagtcagctactgtaaggcaggggaacagacaggcgggtagccctgcgcacatgcacaaccagtgacctggaagcagattatagcccaaaaccttttttaaaaaattgaaatggcccaggcctggtggctcttgccggtaatcccagcactttgggaggccgaggcgagtggatcgcttgagcccaggagttcgagaccagcctgggcaatatggagaaaccccggtctctaccagaaaatacaaaaattagccgggcatggtggagcacacctgtagtcccagtttttctggaggctgaagcggatcgcttgagcccaggaggtggagattgcagtgagctaagatggcgtcaccgctctccagcctgggcgacagaacgggaccctgtctcaaaaaaaaaaaaagaaaaaagtgaaatgcatagtgtacaagtggactttaccctgtgaccgcccttcgttgacaccagcttgcctggtctgtgcacccaggactgctggccagaggagcagtgtgctgctgccaacgccccgcagacaggcaagcaaatcaaaatttgccttcaaagagggcatggggtgaccgggggcaccttttcctttaaagtacttgggaaatatacacagttgcagtcaaacccctcttctcgaatgggtcaagggaggcaggcctctggccagtccttgggggaacgtcctgtgggactctggatgactcgagttgccttgctggacctcagttttcccatctgtccaagaaaggagttatactcccaagcttggagattgcttcagtgggacattaatgtctctggaccacaatcatggcctgtgagaatagcccatggccttgcctggtctcaggcctctgcagacatggatccccagagatgcctccaaaccttgcttcccattccttcctctctggcactttctcccgcctccttgtcaggtgcacgaaccaactcatctgtgaacatcttcctctagagggtcttggctttggctatttggggaacaaagattccttgagacatgtgggtgttcctacttagcctcagtttcttcattttactaaatctttgagtgttaccccagatgagtcctctgttaccacgattacggtgaggcagccctgccttcaaggaggtctctaggttgaactgctcctagggtgtggggcctcatctggtgacgttagtaccccctggaccagtgtagaagctgaggaaaattctacacttcattttttaaaatgcctttcaggtaaaggttgttgctgttgatgcagagttgaatgtcttctatgaggaaagtgtgcattttgacagagatcttccagaatttgggtatgtacttgatgtgcatgtgtgtgtgatgggggtgttggttttggggtcctcccgcaaacttttgtattcgcagaccgcactgttgaggctttgccaaatacaggagtggtggtctcggcagacctttcaagcatctttttttcctatacctagagtgccatctcccccatttcttcctaattccattcatccattcatgaagtaagcatcagttgagacctactttgtgccaggtgctaggacctgatggcgaaacaaaaagagaaagctctcccagagcttcccactgagtagtggagactggtatcaaacaaagaatctcacaaaagagtgtttcattataaactctgagaaggcctctgaaggaaaggaactcacttctccaagtgcttattataaaggaatgtgactcagacttgggaggggaagtcccagagcgtctctagggaagtggtgcttaagctagagatcagagtgagtgaagttagccaagcgatggaagggaagttggccaggtgatggaagagcattccaggcagaaggaacaacatgtgcgagggccctgtggcaagaaagagcatggttcattccttcatgcaattgaagaaagccaatgatgctggggagcagagagaggcggaggctggtcagagctccataggccatggtatagagtttgtctttattctaaaagctatggtcagccactaagggccataaggggtaggggtatgggtgaggtatgaatgacaggttgcatttttgttttgaaaatatctctctgggggcattgggagaacagattcggagcattgctggaatggacgtggggaactattaaagaggtttttgctggtcattcaggtatgaaatgatggataggagagagctgagtagtaaaatggacaggtcctgttacaaaattgaatgtgagatgtaagggtgggatttctggctgtccttcagagtggatgttggactgtgggaaagaatgagttttggagagaaagatcatgagttcagcttgggctgccataacaaggtaccatagactgggtgggttaaagagcggaaatttatattctcacacatctggccgttaggagtctaaaatcaaagtgctgggaagattggtctcctctgggacctctctccttggcttgcaggtgaccactctcttgctgtgtcttcacatggtggtcactcggtgcaggagtgcttggtgtctgtgtcatctgtatcctaatcttcttataaggacatgagtcatactggattaaggcccattctaatgacttcattttaacttaattgcctttttaaaggccctgtctccaaataatcacaatccaaggacctcggggttaggatttcagcatatgagttttaggggcagagggggcacaattcagtccgtaacactgtggacttgctggttttgaggcaccctcgtgagggcctggtaaaagtgtccttccctgtctgttttagacacacttcctctttgaagccttcccagctgaccctttgtgcacctctcattacccatcacattgtgttgccaactctttgcccccagctaatgcggccccatggagccgaggttagaagccatcttgctttctcacattttttattattgcaggccttgcatgtttgcctttgggtagttggtatgtttcaaggaattggtcttttcaactaagccatcaaatgtgtggccatagtgttgttcataatattcctttatcctccttatgacatctgtgggaccagtaatgatgatctcttgctgttggtcatttctgatattggtaatttgtcttctctctttttttctttggttatcctggctagaggtttatcaattgtattgatcttttcaaagttcaacttttggttttgttgattttcccctgttgttttcttcaagttgtgctctaatttttattacttagtttcttctgcttgctttaggtttaaattgctcttttttccctagtttcctcaagtggaaacttagaggattgatttaagaccttcttttctaatatatgcatttaatgctataaatttctctgtaagcacaaatgctttttatgggatgccttagcagcatcccatacattttgataagttatagtttcatttttttcgttcaaaatattttttagttctcttgagacttctttgactcatgggttatttagaagaatgtttttaggctgggtacagtggctcacacctgtaatcccagcactttgggaggctgaagcaggcagaacacttaaggtctggagtttgagaccagcctggccaacatggtgaaaccctgtttctactaaaaatacaaaaaaattagctggacgtggtggcaggcatggtgacaggcaccgtgtatgctgcacgcctgtaatcctagctagctgggaggctgaggcaggagaattgcttgaactgtggagagggaggtttcggtgagccaagatcgcgccactgcactccagcctggacaacagagggagagcctgtctcaaaaaaaaaaaaaaaaaaaaaaaaaaaaggaagtctggaagtgtgttgtttaatctccagattttccagttttctgttattgatttctagtttaatttcattgtggtctgagaacataccctatatgacttctagtctttcaaaattttaaaatttcctctccctcactctctcttccatttaataagtcagtcctctccactggacatttaaaaaaaggtgtccataaccaaaatatggtattgcttttttccattatattttcaagatattttaaaccagatgcctatagatttagttcattccttccccatcacctcaattgcattgtgggttttctttttacaactttattaaggtataactgatgtacaatactgtgcatatttggagtatacagttaaaagctttaatatctgtattctttcatgaaactatcaccaaaataagacaatgagtatttccatgtcctaaaaatttcctcctgcctctttgcaagcgatgcctccttccccatacccctacccactggcaaccgctgatgtgttttctatcactagtttgtattttctagaattttgtatagatggaatcataattatgtatgcttttttaaaacctttaaaattttacatcacagttttgagattcatccatgttgctacatgtggcaatagttggttcctattattgccgagtagtatttcattgtatgatgttgtatggatggactacaattggtttcacctgatgagggatattggggttgtttctcttttctgttgttataagcaaagggctatgagagtcacatacaagtcttttcgtggacatatgatttcatttttcttggaaatgacataccaggagtacagtggctgagttatacggcaggtatatgtttaacttcttaaggaattctcttccaaagtggtgattttaagaaaaaaaattttatattgttaacaggcattacattgcacttaatatgtaactcaaatgaaaagtatacagtgaaaagtctttttttttctttttttctttctttttttgagacagagtctggctctgtcgcgcaggctggagtgcagtggcacgatctcggctcactgcaagttccgcctcccgggttgtcctccattaggaaatggtacatctacacaatggaatactacacatctataaaaaagaacacagaagtttttatgtattgacatgtaaacacagccacgttactgtgaagtgagtaaagcaaagtacagatcagtgagtatagtatgctttctcttgtatgaaaggaggaaaatcagaatattcataccttcctatatttccatgtaaaaacactggaaggagcctggcacagtggctcaagcctgtaatcctagcactttgggaggctgaagcgggtggattgcttgagtccaggagttcaagaccagcctaggcaatatggtgataccctgtctctaccacaaaagtgcaaaaattagtcatgtgtggtggcgtgcacctctagtcccagctacacaggaggctgaggtgggaggatcacttgagtccagaaggtggaggatacaatgagccaagatcataccactgtactccagtttgagggacagagccataccttgtctaaaaagtaaaaaaaaaaactagaaggatacacaacaaattaaagtcatctgtagagaagggacggagaggagagatgagctcacaggtgggattaagacttttcactgttatatggggtttcaccatgttagccaggatggtctccatctcccaacctcgtgatctgcctgcctcagcctcccaaagtgctgagattacaggcgtgagccaccacacctggccaagttgtcgctattattgccacacacagatatttatgtcattgaatttcccagtctcttttattgcttctagattttgagtcatagttcaaaaggccttcctcactccaaaattatgaaggaactcacctatgtttttatctagttcttgtaagatttcagctttcttacataaaaatatttggagtttatccaggtacgtagtatgacatttgtatccaactttaatttttcccagatgattcttcagttgttgtaacaccaaccatgtttttatttaatttattttttttatttgagacaggagctggctgtcacccaagctggagtgcagtggtgtgattcagctcactgctatctatgcctcccgggctcaagcaatcctccctccttagcctcccaagtagctggaaccacaggtgcgcccctaccatgaccagctaatttttttgtattttttttgtagagatggggtctcactctgttgcccaggctggtctcgaactcctgggctcaagcagtccacccacctctgcctcctaaagtgctgagattacaggcgtgaaccaccacacccagcctcaaccgggtttttagaagtccatctttacctttaagaggctgaggtgggcggattacctgaggtcaggagttcaagaccagcctggctaacatggtgaaaccctgtctgtactgaaaatacaaaaattagctgagcatggtggtgggtgcctgtagtctcagctacttgggaggctgaggcaggagaatcacctgaacctgggaggcagaggttgcagtgagctgagattgtgccactgcattccagcctgggtgacaaagtgagactccatataaaaaaaaaaaaaaaaaaagaagtccatctttacctccatgatttgagatgtgagccttatcatgtgctactttctgtgttcacttaggtccatttttgggcttttgtttttgttccatggtttggtagatctggtcataagccagtaacacattgtttcaattatcccagctctgtaatatgtttgtttgtttgtttatttacttttgagttggagtctcgctctgtcgcccaggctggagtgcagtggcatgatctcggctcactgcaacctctgcctcctgggttcaagtgattcttctgcctcagcctcctgagtaattgggattacaggcgcccgccactggctaatttttgtatttttagtagagatgggtttttgccatgttggccaggttggtctctaactcctgacctcaggtgatccgcctgccttggcctcctgaagtgctgggattacaggtgtgagccattgcacccggcctgtaatatgttttaatatctagaattgttggtcccctctgtttgtttttttttccagagtttccatggctattcttgttctttttcaatatgtacttcagaatcagcttttcaggttccagaaagccaaattgttaatttttttttttttttggacatggagtctagctctggagcccaggttgaagtgcagtggtgtgttctctgctcactgcaacctccacctcctgggttcaagcaattctcctgtctcagcctcccaagtagctgggactacaggcacataccactacacttggctaatttttgagtttttagtggagacagggtttcaccataattggtcaggctggtctggaactcctgacctcaggtgatccacccacctcggcctcccagggtgctgggattacaggcgtgagccaccacacccagcctgttgttaatatttttattgagatcatattatctttataaattaacttggcagaattgacaactttatgagattaagtcttcctgtctaagcacacgttatgactttccatttgttcaagtcttcttttgaatacttcacatgtgttttaatatgtttaacatacagcttttgctcactttggtagattgcacaaatgaccacaatactccacccatccctgtacccacaccctttgcaatgtgactgcaattcctcccatcaaggagtcgtttccctacctgttgatttgctttatccagtagaacaggggaagtggcattgtgccagttctaagcctaagcctcaagcagccttatgtgcttctgctgtcattcttggaactctgcctagccaccaaatgaacaagctcaggctatactgctggagagttggacatatgtggcctagttgccccaacttcttcccctaagagccagccagcccctagctactgttagctacctatgaagcagagccttctagctaccgttaactgactgcagatgtatgagtgagcccagctgagccccatccaatgatagcaagtagaattgtgagcttaatggtttttagccactaagttttgaagtggtttgtgacaatgcagaaattacccaatgtagataattatttttaagtttatttctaacttttttatccttttactactgtaagtggggaagggaggtttctagcagaaacttatcagctgtcttccaaactcatttccctttcttcctaggcactctcctgccttccttgtagttatgttcagccatgtgactgagttctagccagtggaatataagaaaatgtgatcaggcctctaaaagacctagtccatcaaaacctccttctctgacttttctcccatttttggctgatgtgggtgtccagagcaaccttggaagcacatgtggaacatgacagagccaccatcaacctggttcctgaatgactgcatggagcagaactccccactccccactcatgttcctaaccacctactgattgtgctttacatgaggagaaagaaacttcagctgtatcaagccatagaaatgtgtttttccttaactaatataattttttccctcatatcctttttttaaagaaaatactggggccaggtgtggtcgctcacgcctgtaatcccagcactttgggattacagaggcgggcacatcacgaggtcaggagatcgagaccatcctggctaatgcagtgaaaccccgtctctactaaaaatacaaaaatttagccaggcttggtgccgggcgcctgtagtcccagctgctcgggaggctgaggcaggagaatggggtgaacctgggaggcagagtttgtagtgagccgagataatgccactgcactccagcctgggtgacagagcaagactctgtctcaaaaaaaaaaaaagaaagagaaaatactgtttctattgaaatgtaattcacataccataaaattcaccttttaaaatgtacaatttgatggttttagtatattcaaagaacaatatcactatcaccactatgtaatcttagaacattttcaccacctggaaaggaaaccctgtattaattagcatccactgtatagtccccctcctgccagtagtggcaaccacaatcaactctctatctctggatttgctgattctggacatttcgtagacatgaatatatataatatgtgacagccttcttttacttagcataatgttttctttttaaaaatttttcatagctttttgcttgtttcaaataccaacttgaaccagatacctggcataatgttttcaaagttcatccatgtcatagcgtgtgtcagtacttcattcctttttgtggttcagtaatattccattgcattgatatatcagagtttgtttttccattcaacttttagacatttgagttgttctgcttttttgctattgtgagttattctgctatgaacatccacatatgttatggattgaattgtggccccccagaattcatatgttggaagcctaccctcatcatgacagtatatttggaggtgaggcctttaggtagataattaaggttaaatgaggttgtaagggtggggctctaatttgataggacctgtttccttataagaaggagagacaccagtgctatcccacttcatgcgcagatgcacagaggaaaggccttgtgagaaggcggctgtctgcaagctggaaagagagccctaaccagaaactgaatttgctggcaccttaattgtggacttctagcctccagaactgtgagaaaataaatgcctgttgtttaaaccatctagtttatggtattttgttatagcaacctgagcaaactaatacaacgtatacgtttttgtgtggacatatattttcatttctattgggtatattacctaaaagtggaattgcggggtcacatggtaactctgtgttcaacattttgaagaattgccaaactgttttccaaagtggctgtactattttccattcccaccagtggtagatggtgcctctagtttctctacatcctttttttttttttgagatggagtcttgctctgtcacccaggctggagtgcagtggcgtgatctcggctcactgcaagctccacctcctgggttcatgccattctcctgtctcagcctccctagtagctggaactacaggcacccgccaccacgcctggctaattttttgtatttttagtagagatggggtttcaccgtgttagccaggatggtctcgatctcctgaccttgtgatccgcccgcctcggcctcccaaagtgctgggattacaggcgtgagccaccgcatccttgcttaacatttattattgactgtctttttaattacagacggcagccatcctagtggatgtgaaatgcaatctcactgtgcttttgatttgcatttatctaatgataatgatgttgagtatctttgccatttgtgtatcttctttagagaaatgtctattaagatcttttgcccttttttaaaaaaaactgtgttatttctcttttattattgagttgtaaaagtttttttttaatgtatattctggaaacaagtcccttgttagatatgtgatctcaaaatttttgtcccattctgtgggttgtcttttcactttcttgatgatcctttgaagcaatgtttttagttttgataaagtctaatcttcctacttttttccttttgctatttgtgctttggtgcagtattggttaggttttggtatcaattttatatttacttcactaaaataattggaaaaattttccttcttttcaggtgctctagaacaatttaaatagtattagaaatatttgctatttaaaggtttggtcccagcactttgggaggccgaggcgggtggatcatgaggttaggagatcgagaccatcctggctaacaaggtgaaaccccgtctctactaaaaatacaaaaaattagctgggcgcggtggcgggcgcctgtagtcccagctactcgggaggctgaggcaggagaatggcgtgaacccgggaagcggagcttgcagtgagccgagattgcgccactgcagtccgcagaccgacctgggcgacagagcaagactccgtctcaaaaaaaaaaaaaaaaaaaaaaaaaggtttggtataatttttctgtcaaaccatttgggcctggtgcttttggggcatggggtggctctggtcttccttcttagctggaaatgccagttttgttttgtgtgtgtgtgtgtgtgtgtgtgtgtgtgtgtgtgtgtgtgtgtgtgtgtgtttttgagacagagccttgctctgttgcgcccaggctggagtgcagtggcaagatctcagctcattgcatcctccgcctcctgggttcaaacaattctcccaccttagtctcccaagtagctgggattacaggtgccctccaccatgcctggctaatttttgtatttttgtagagatggggtttcaccatattggccaggttggtctttaactcccgacttcaggtgatctgcctgccttggcctcccaaagcactgggattataggtatgagccaccgtgcccagctgaaatgccagttttaagttgttaaatacatggcagaatgtctggttacagtttttatctgttttgtgaaggcaacattttttggtgagcttttattgtctgtagtaaaattttgttgctctcttcctctttttccctagtagtatctttttaaaaaatccatattattgagtataatttatgtacaaaaaatgccatccattaaaaatgtataattaaaggtactttgccagatatagacctatagctgtgaaactaccaccacaatcaagatacagaatgtttatatcaccctccaaaagatcgcttttttccctgcttaccgagacaagctcggttgtggagactccaacgcaccagcactagaggaatgaagacaaagacccagaaataaagtgcagtgtgggaatcggctaaaagcctttagagctgagagccacaaacagagttttgcccacatatttattgacagtaagcctgtgataaacattgtttctaaagattatagattagctgaaagcattccttatgggaaacaaagcattcttttcaagaagcagagaaacaggctgtggctgattatctgcagcaggaacatgtccgtaaggcacagatcgcttatgccattgtttttggttttggaatgccttgagtggttttccgccctggatgggccaggtgttccttgccctcattccggtaaaccagcaacctccagtgtgagtgtcatagccatcgggaacatgtcacattgctgcagaaatcctgtttatggccagtttctttaaggcctgtttgtgacaggcttagggcctgttcccagcacccactagacttagacaaccactgatctccttttctcagtatagatgaatttgcgtcttctagtctgttcctatataagttataattgtgtacatatgaatagttcatattttttcttgctctgtagtatgatatcacaaatatacaccacgatttatctgttcacttgtttagggacactgggttgactccagttaattattacaaataagtctgctatgaatatttgtgtacaaatctttctatgggcttagactttcatttctcttggctggatacttaggaattgaatggctagatcacatggttatctaatagcatcttggtgtggattctgagactggttttctctttcctaacacatagttaaaagggttggattttatcagatcagctctttgcactagagtcttctaggggtgaggtgggtggggagagggttccagtcaaacttccaaagcctgtagtccaaggacttgttggtctgttgtgatagtagagacactcttccctccgacgcagcatctctgtgtggctgcccctcctctacctctccaaacctatggggcttgagagggattttataatccaacactgcactcccctagggtgagcctttcttatctagaaggcttctttagaagatgcttctgagaattgccacatctgggccactctgggcaatttgcctgtcttctctttccatctttgcagcccttgtgcctgttcaatcaacagttcccacttggggttggggaaggttctccttcatctggacatttccagagtcatccaccatagggtttctcctggctttgcaatggtctgcctgccctgaggctctggtctacattctctgttgttcttgcaggactcagggcggtgttcatgtgcacaaggatgggctgacggtcacttctccagtactaatgtgggtccaggtaagcgcagggattcctgttctccttctatccccaggctgtctcactggcagactcggtgatttgctaggaagtccaaaggtggcagccaatgagagcatctgttgacaccaggtcctcatgggaaagtggagttggcatgactcctgggatcaggctcagcctcagctggtgtcaacactcccaggctcagaggacttacaaaaaacttccaggtactggagctacagcagatggcaagtcctgccattaaccacctttaaaataacacagagcaaatcttttccaaacatctgcagtcaggccctgtggcctcccttgtaccatgaaatatacaaacatagactgggcatggtggctcatgcctgtaatcccagcactttgggagaccgaggcaggtggatcacctgaggtcaggagttcaagaccagcctggccaacatggtgaaaccttgtctctactaaaaatacaaaaaattagccgggcgtggtggcccatgcttgtaatcccagctactcaggaggctgaggtaggagaatcacttgaacctgggaggtggaggttgcagtgagctgagaccgcaccattgcactccagcctggataacaagagtgaaactccatctcaaaaaaaaagaaaaaaaagaaatacaaacatagcccttagggtcttagtgctcagcctctaagatcccttagctccctaatcacctagaatggcaagttatggcctggccagtcagactcatatcaatgccaagccaggcctgcctgctgaggatcaacaggaaaggagaatgcctgtagcaggatctggtgacctagggggccacaggagcagggatgtggacagcatagacaggcgtggtagctccaggggctacctcatcatatgctgcagggtccccgagtccctgaaactggaggccagctaagtgtgtgtcttccaaaagcttttttcagtcctccaatacctatctaaccaattccctatattacattctttttgttaaaaataactggtatgatttcttttttattggtgtaaccctgattcatacactggagaattggggtaaaggatggattttatccagataaactggctagaatgtacttcagagggggctgagccagaccaaggggcagagtgggagggtcgggggttagagacaatggtcagtgtcaggaggtcccagtgatgatgtcgagggcatctcataggccaaggccttcacctggggaggtgagcagtgggtgagaaccaggcttgggggccgggccaaggtgatttctgatctgatgcagcctccaggaccaaacttgatcctagctctgccagcccctgctccggctgcaccccactgcctgcccaaggtttgatggacacagatagagatggcagccacagccagggctgaaagaagccctcccagcaaaggctgggggtggtggagtcaggcaaaagtgagagagtcttctctgccctcaggaaaacacaggtcagagtgaatctctaattcctgccatgaaatcttaggagggtggtgccaagctctgctgggcaccaccatccatcccactcactgggttttgctagaaaggagggtccaaccagacagtggaggctggaataggggcctggaacaggtggccatcatctctatccactccctccagcctctggctcctggacacaggggagtctgggcctgatgctttgctctcatgggagctctctcctttgctcttcacttccctgtggcagtgaagtcagatcactaatatagagggttgaaaatgcaaataaaagaaggcaaaagttggctgccttactttgttagtttttgagacaaggtctcactgtgttgcccaggctggagtgcagtggtgtgatcatggctcactatagcctcaatctcctgggctcaggtatcctccctcctcagcctcctgagtagctgggattacaggctcatgccaccacacccagctaaatttttcattttttgtagagatgggatctcattatgttgcccacactggtcttgaactcctgagctcaagtgatcctcctgccttggcctccaaaagtgctgggattacaggtgtgaggtgatggcatgcacccgtagttccagccactcgggaggctgagatggaaggatcacttgggcctgggaggttgaggctgcagtgagctgagattgcaccactccatttcagtctgggaaccagagcgagaccctgtctcgaagaaaaaaaaatggagaagtaaaatttgaggattggtggtttatgattccatttatttaaaatatttttagcatagttgacctttttatttgattgatgcctacttgtttaattaatgtactctagtgcttacaaatcccaagtcatgagtttcttcatcatctgcccagagtactctgctgtaatggcaggcacttgcgtttcaattctgaggcttgcgtgtctgattcagtggttctgtacagtcatggtgggttctgtttttcttcttaggcactggatatcatcttggagaagatgaaggcttcgggcttcgaattctctcaagtcctagccttgtccggggcgggccaggttcgtttgcagcagactctgtctgccatgtgagggtgactgtcctgggcaatggtgtgggtgttgaagagatggcaacccttggatggggagcggctcattcttgacagccactgcacaaatttcactgtgaataaaaatccctacaactattttactttggagactgtataacttgtctcgttgcaaaaggatctgagacagttcttaggagtaagtattatataaaataggacgcttggtgagagaactgagttcctctgaaggggatggaggaagcaattgacatgaatttattatgactgcttgggggcaccacaattgcttttctatttcctgaaagtaaaagcaaagtcaaaaatgatcctaataatgatagtagtttcagtagaaggaagagtattaataatgatatcagaggacattgacttagtgcatgcgcttagtgcatgccagatacaactctgaggcctttccagatgtcatccaacttaatccttatgattctacagggtggtgctgtggagtgcttggtacacactcagggcatactgtctgggtttgatccctggctctgccatttacaggcagtgacctgggatacgtcatctggctttctggtgcccccgtattctcatctgtcatagggtcattgtgagtgtaagtacatagcacagtgcctcctattaatacgcagtaaacattattaaagcttgggcttctgttattatcgttgatatttacatgaggcacggagaggtgatgtcacttacccaagatcacacagtgctgggagtgggagtcaggacctgagtctatctcatccagtcccttggctgtgctgggatcacttttctccatgctggattactatattttcaaatcctcactaggatgtaactaatttttctgaagatgcttcttcctccatgacctaacaggaatttattgttttggttcttgttaaacacaacagagattccctgggtgatcttgtccacttctctctcccgaatcccaggcctggacacccatctccctcctagctaatccccgacccccatggctggatatcccacagatgcctcaggcttagcatgtcccagactgagttctgtctcccttcagacctcctcctttctgggttctctttctcagggaattctccccatccacccagggcacaactcaagtgtcatccctgcctcctccaccttcccaccccacatccaagggtcctcacgtcccactgatttgtctgtgactcttgactctaccatcttttctccagcgctatctgcttgtcattcttctccaggtctctaccgcagcctccttgcctccagcctaccttccccgtgactcccacaagcctttaatacattcagctctgtgcacgctgctccccctggtaatccagggttcctaccacctccaagataaaccccagcctcctgagcatggtttcaggctcagtgctcaggctgtcccctctctcttcagcccatcacccacccccgacccagcctcaggcccactgcttagaatgccactcatcccgggacttgcctggcgcccctcacctgcagattctctgcatgcaacacacactaggaccatttcctgatactcatgaccacttcctctcatctgtacccgagttggttaggtgcctctgttcccacgaccctgtcactgcagctccatagttgtacatttgtgtccttttccctgactcaactccagtagcctgaagaatagggacgaaagtatcctattcatctgtcgcaagcctggcatgatctatgtgcttaataaatgttcattgaatgaatgaatgaatgaatgaatggggtgagtgaataaataaatgaatttcaggtaatattacaagcaatgtctttaaatgcagttttacaaaaggcatcaaaatccagaccaataattagttcttggaccttttctgtaagttgtagggtagacagggcagagttcctccccattttcttgaagtggaaaccaagtcccaggagggtgatgagctctgtgactaagaagtggcaggggcaggtgtggagcccagttctttggcatgtggtctggggtctttctgtgtcttcaggaggctgtgacaccggtgtgtggtcatgtgaccatgtgcttgggtttcccaacagcaacacggaagtatatactggaaggctggagcccagcaggcactgacaagcttatcaccagacctccggctacaccagcagcttcaggtaactgtggctacgtggtgtgagtgtgagaaacttctgcagagtcccaagtcctgtgggtcctgaagcctgctcatctcagtgttgcagctgtgctcacgcgccctcaccagaagagctttcaacctcaggcttttggggagagaccccactgggccagttctaagttacagcacaaagggctggcccatgtgtctccaaccaaggtcacctgggaagaagcgtcatgactgccgtgatgggcagtgtgaccgccagccctggggcagatctccaagtcagcggatggagcttaagcctgtgcctttgccctccttcccaggactgtttctccatcagcgactgcccggtgtggatggactccagcaccacagcccagtgccgccagctggaggctgctgtgggtggtgctcaggctctcagctgcctcacggggtcccgtgcctatgaggtaggctgaggatgcggggggtgcagggggtggtctggttgcaagctccggaggcatagtgggtgacctgcctctggggggatcacatgaggtcatggaggtgttgtggagccagcaacaggcactctggcccctgggtcctgatccaggccacctgctgccctgtgtgttcccaggccaggctgggtgtgcacatggctgtgctcctgacatggaggtgctgtgcatgggggtgagggtaccccctcaatgagaaggcacctcctgtcattatttgtaacccggggattacaacaggacttacgttttgggtaggtttgaagctgaaagaagtcagtgcatgtaaggcacttagtgtagtgcctggcaatattaaaaaaaaaaaaaaaaggaaaaaaaataatagtgtctctgttccacaggttcaaccttgtccccaggggtgattgtgattaggccagcttgggttacatgacctcgctggagtagaagttttggggatagggccaactctacttgggccacctgaaataacaatatgtggatggggaaaataccccgatccctcacctggtgccttggtcagaacagtcaccgtgctgtgtgaagagcaagggttattcactcagggttgtccagtcctgatgtgggagaggccctccaggaaggcccagaagttactcacttctctatcctgtgggtgcagagccattgtttactgcctgagtatttgattactaaggacattttaaggattcaaaggccaagatcacattgttcagtagatatcaaacagatttaatgcttatttttaaaatatttaattattagaaacgaggtctcactgtgttgcccaggctggactcctgggctccagagctcctctcgcttcagcctcctgagtagctgggattacaagcgcacactactgtgcctggttggggcttacttttaaaagcttttatggtacctactcctatccagagcatgctacattaaactcactttgtggaggtaattattcattctgtgtaggatttgggttcctaagaatttatattccttttccagcgttttacagggaaccaaattgcaaaaatttaccagcagaaccccgaggcctactcacatacagaggttggttaaatgttcctgtttgattgaaagtcacagttgaattcttttcataatatgttagaatagatacatcttacgtgcagtgactgaaaacgttgataagcagacattaacaaatgatatatttgatttgcttttttctcattgtcaggacatttccaaagaggagggaaagaatggaatgtgggaaagagatgtcaggggttctcctgaccagaagggtgagggtccaggtgggagcactggggactgacgtgttcctgaggccacctgaatggaagatctgagtgtctgagcaggctgtgtctgctcactttcctatgtggttaacgcaggagggctaccaggcacatgattggcatagagtcagtattttctttggaaatgtataggactgggcatttgtgtccccagctgtggcccttcagccagagcctctgtcacaggaacccaggttcattcctggctccacagttgctgaagccagcacttgttgctgcctgagaaacagccccacgccctggctagtgattttcatcttgtgataaggaaacgatcagctcacattaaaccaaagcacctttttaatcttagaaattaacatgtggtttattatttaatgatttgaggttccagattattctgcagcattagccattaatgtaggctttgggtagaggggtgaaaaccctccctaaattctgtgtgtggaacgaagtttgcctgacagaggacaggaggtgataacattctctccacagttccaaaggcccatgattctcatgtggaagtacagacccttagggtggcattgaaaatccatcatctatttctctggctagtgctcagggtctgtggcttctgaggagccagctttcctgacgccctgagagtgtcctggttggttctgaggccacacatccacttcccttgtaaccagaaggaaatgccaaggagatagaggaaggaaatcagggcacacattccccagcatgtggattccggatggaaatgcagcttccctaagccctttctcatagggcttttggtttttgtctcttttgaacttggcagttttatggcccatcagaaactgtagagaatgaatgctctcccgaggagtctgctcatggtattccagctgctcctatctgagatgcacagtctccaccattacttgggccttttgttcaaagtttccacttccctctccaattttttttcatgctgtgtgtgtgtcagaagcattcagtagcgtagggtatgtggaagtgaggcacctctcactgtttctttcctttacagagaatttctttggtcagtagctttgctgcttccctgttccttggctcttactcccctattgactacagtgatggtgagcctcggggtatggggtgggtgcctgggcagtgtgcatgtggcatgtgggtgtgcaagcagtgggagccccacctaccccgagtgggtgccaatcttgtagccctgtcatctgttgccaggaaggaagtgtattcattatcttttaccacataacaaatgaccccaacacttagcagctgaagaccaccgtgtttattttctcacctagtgtctgagagtcaggaatgtgggggcagcttagcttggaggtactggttcgggatctcccacaaggtggcagtcaagctggcagccggggctgcagtcatctgaagggttgactggggctggaggatccatttccagcatcatgcacatgactacaggcaagaggcctcagttcctcacatgtggctgttagtgacactgcagagagggagggaggagacagaggccaagcagaagctgaggagtcttttataccctaatcttgaagtgatgtgccatcacttttgtctcatcttactggtcacacactaggtacggttgacccagtataatgttggggagaacctcacaaggggtgaacaccaggaggtggggatcagtaggggcgatcatggagcctggctcctgcaaggagctattaaagtttttgtttcacatttggtgaactcatgagatttgtgagcttctagaatcaaaaccccgaaaaaaataaattgcagttgatgccagtgaggagggaaagctgggaggaggttgctgcaggaacccttggatgagcctaagtgtgagaagagtgtggacagaacgggggtagagaatgcagggcaggagcccagagccatggatatggcttcagaatggagcctgggatgctctgagcctcgtgggagttcatgggaagttttcgagggctgttgtatgccaggctttattctggtttcaggagagagagtgactaaggagtgctgttaagcttccctcacaatctggaggaggcaacagggttccctacagctagttctgtagaactcagacaggcagaacagtcaacttggagtagcctgcatgtccacccgttctgcacacctgccacagagctgataaccgcagcagctgttccggggggcattccagaggtttatgttccttagccacagctgggccctccactctgccccccttcactcacctgagatgtcacctcctcatttcacctgggcaggtgacaccatcagcatcccagcccacctctgtctgcctccaccttggcccagtggaggaggagttctctccacccatgctctgggttccctgtcctttcccatcctcagggaagccttgggagaaggaggatgttttaggaaagagctagtaggttgatctcagtgaccagaaggaagtttagaggactctgagacctttccttgaaaagttagatgagattgagaaatccctgggggctgacctggaaacctaagggacatggagagtggttcctggtcagtgtgttgctgctagttccaggccccctgggaggtctttgagcagcagatttccaagctaactgtagtgtttgagttgatgaggaatatttggaggaggtgtggtgccgtgtgtttccaagggcccctcttatctctggttctctggttctagaacaacacaagcatatataccttccatgaagaaagagctccaggtacaagttgtggcaagagaattatctgctctgtgccagatttgtgcattttcacaaaaggtccattttcaagattgtctgttgtttgtttccttccttcctcaggttctggaatgaatttgttgcagatacaggataaagtctggtcccaggcttgccttggtgcctgtgcacctcatttagaggagaagcttagcccaccagtaccatcatgctcagttgtggtaggtctcctttctggtgatgtggctcatttaagagctggcagctaccagggaagcactgtagcgcacacacacacacacacacacacacacacacacacacactctgcacacacccttatttgttcactcacccacaggcatacacatgcagggtcttcagtttagcctaagatgtaagtcagtgtctggatcagtgccttgcacacagtaggtgctcaggtacatgccttatggtcagcgggactttggaaaattccactagaaatttattagaatagggataaaaatggcaggtgattgcatagctaaagaaaaagtgcacagagtgctgaaattctagggactactgatgaagcttgaaggaggcagccttggggaaaatagaaataccagcggggctggcacagcacaggccctggcactggacagcatgggactgaattctggttctatcagctttgtgactttgtgtctcggtttcctcatctggaacaaggggaatgatgctattcatcttacagggctgttgtgcaaattagatgagttaatacttttaaagcacttaaaaaatagtgcctggtcccacaggtaatgggaaaaacatttacccatcacagcggccccacccatttgcagtggacactggctgtgaatgccctggggtgttctacttggccagccctgttctccattgtcctgtggggacagtggagtagagagagagagaaaaagatctgggtgctgcccctggggccctttggtgggaaatgcttaccacagagccagaacaaccagaaggaactctgggtgggacagagtgctggtgtgaagaagggacaagggcaccctgaggcctggagggagtcgtgtaactgggaatcttgggccatgtggaggaggggctgctgtgaggacttcgcgttgggagtctcagccacagaagcacttttgttttcttttcagagacagagtctcaccttgtcacccaagttggagtgcagtggcatgatcatagctactgcagccaccaactcctgggctcaagtgatcctcctgcctcagcttcctgagtagctgggaccataggcttgctccaccatgcacagctaattttttttttttttgagacagagtctcgcttttgtcacccaggctggagtgcagtggcgcaatctcggctcactgcaagctccgcctcctgggttcacgccattctcctgcctcagcctcccgagtagctgggactataggtgcccgccaccacgcctggctaatttttttatatttttagtagagacggggtttcaccgtgttagccaggatggtctcgatctcctgacctcgtgatctgcccgcctcggccttccaaagtgctgggattacaggcgtgagccaccgcacccggcctaatttttttttattttggtagtgacagggtctcactatgttgcttagattgggcaattctgcctcagtctcccaaagtgctggaattacaggtgtgaaccaccgtgctcggccgtttttcttgtatgattcacactgacatgctgaaaacagcctctgccaccatgaggcagaatgtcaaagccaaaccatcagcatccaaagtatgccatgaggccagtgcatggagctgaaggaacagccatgtggccctgtggaagctgacagcacagctttctgacccgctttctgacgcaggtcagaaaggcagagaaagggcagacagaaaacagccaagccaccgggactggtaatccacacacggcttttagttggatgtgaaattcagagcaggctttgtttgccttatgcgagaacacatgcctccaagaaggagcctgtgcagacaagcagcttgaggattgggaaagaactgactctgaaaaggcattttcatttgtcacgtaggtgtcacatgtgggggaaccactcaagacccatgtttttcgtcatccctctttttgcaggtagtgctcagatagccctccctgcactctgtcttttttggattactttccttagaacattgctctctgcacgttcacgtccaattattgttaatccagtcactggggtgatagagtgagtgtgtgaggcattatctgctcccatgagtttgcttactggtgtcctgttacctttttttttttaatgctatatccagaatttggagcttataaagcaagcacaagttaggggttggtttgttctctctaccttaaatctcaagatcagcagtttttgaaatgacctcatgctcgtggtttccaaacctgcactggacttctctggcgatttgtgaacaggagggacatgcccagtttgtgacaggaagtgatgtgactccaggctctgcaaaagattccttcaggtctggtgacctggagactgtagcgttttcgtggcctgaagggtgggtggctgtgctgggcaggcgggatttacctcaacagagcacctttgctttgtccccgtccctcagggagccatttcttcctactacgtccagcgctacggatttcctccaggatgcaaagtggtggccttcactggggacaacccaggtgagtatctcggggagtttcactctccagtgagcctgactgggtccatgctggatgtttgagaattccagtccagcctcttggtgaaaccttctgtggtcattcctcaccacccccacccatgctggatgtttgagaattccagtccagcctcttggtgaagccttctgtggtcattcctcaccactcccaccctgcgatctgactccttgtacctgccccatcttagctccgactctgccctcaggagctggtcagtctgctctctctggatgaaaactgcccaatgattatggaaggcagtcgtgcccaccccatccctaacctgtcttttctgtttcaagatgaatagctcaattcctccaacccttcctctaggacatggttttaagtctctgccctgtcatctgatctgcagcaatgacttgtttctcgtccagacacctcatctccttccctagcctcttctcttcctcctcctctcctctgggtagccctgaagccactcctggaggggcccttggatctctgaaggaaggccaggtgggctacactgaataacaacctaactactacccctcaacctcacccccaccccaggaaaagtaagtctttttctaacgatccaccagattagggttacatttaacagtaactagaaaggttaattttaaccttaatcagaaagattaatttctgtcctttcagtcttctttctgtgctcataaataagcattgtttcttttaatcaacctgggcagtatctttctcattttaacagttgtctagagctcagttgtcccagcatttatttcactggtccctgatggatggagggtggtgttgcttcagtgtttgggcagtgcagacgatgttgagattcacattcggtctcgtctctttgttgttataggataagttctcaaaggtgggattcctagatccaaggcttctgacacacacactgctgattgaacctcagtggcagtgtttgagtgcacctgttcctcactcccatttcacctttattcacatgttgattcactcagcatttagtgagtgcctattatgtgccaggccttccttcagtgctggggcccttcagcaatcaaggcagataaagattgctgttgtgagccatgtgtggtagtgtgcacctgtagtcttagctacttgggaggctgaggtgggaggattgcgtgatcccggagttctaggctgccgtgagctatgatcatgccactgcactccagcctgggtgacagagtgagaccccacctatatatctcttaaaaaaaaaaaagattgctgttgtgggctttgtgtctaaggcagggcacagagagtgaacataacctcacccccttcttttccattactgcctttgtctttctttgctgtatatccttggtgtcttgtcttggcctccttgattctctgcactctcggaagtgcctgacagtggagggatgtttggaccccttcagggaagagacttcacagctcaaatcagcggccctgctaacagagacttcaccccgtgacccctatgaccttctcctcttagggcctcctgagcgctcagctcccctgctcctgcctccaccctagggtgtgggtgggggttggaggtgggggctctgcgcctgcctggagagccctgtggtttgctttgtggttcccatgtggccgccagctaaccagaagctcccctcccattctcagcgtcgctggcaggcatgagactggaggaaggtgacattgcggtaaggcgacttcccacacccataggctctttctgtttccacactcacacccacactctgataagtagcagaggtgctgctgagacccagatcccagggtcccagggtctgggtcccagcaggatctctgctacttatcagagtgtctgccggttccaaaagacagtggagggaggggatgggggcgcacatctttctcagaaagtcattgttctttgctagatgggcaggacccctgcctgcttcacagtggccagtcttagtgcatgcagtggcagagggtcagatgtggggccaaagggctgtgagcagcgcagatgaataaggaagacataacccagacattcctacttctagtgggaaagtcatatggggaaccagccatcacccaaaccattatttagatgcagttgtgggaaatcagcacagaagatccatgagatctgcatctggggagctaactcctggctcatctggtatgggagggtcagaagtggctcttagaaagtggccttgcatctgaggtctgcagcatgagtgaagtgacagggttaaggtgggtggagtacagcgcgtcgctggcagagggcagcgtgtgtgggcaaagcccaaggtgcccacctctgcctatctctcctcaggtcagcctgggcaccagtgacaccctgtttctctggctccaagagcccatgcctgccctggaaggccacatcttctgcaacccggttgactcccagcactacatggcactcctgtggtgagcttgggtgttggttggcaccattccctgggtgaggaggtgtgggcaggtctggcaccatcttgaggaccccaagtcattccactaagctctggaatgactccctccactttcccgggctctgctgggcaactgagacccccaaggactcaccagctcttgctgacagcagagctgggtggggaataacccaagaccctgtgtccttcaagcccaggttcaaattctatcctcaccagctatatcctgtgtgaccttgggcaaactctgtagtgtggcatgtctgagccacactttcctcatgagatggggagggtaagagcatttacctcacattgttactgtgacccgtctggcatgtggtggaccctcagcaaatggcgggaaggacatcctgcctcccgacggctctcatggaagggacatgctctgtgctctgaccacaggcctttggagacctgtccaaagctcctgagggaaatggtttctgagctcctaagccctaagaaccattggagaatgtggctagttaatctagccctccctgcctcattgtgcccatggtagaatgtgcagaaacccaagctccctctctctacctggggctcctctgcgtcagcctcctgtgtaaacagcccaagacaagggcgtttccggcacctcccagggacattcaggggcctgaatctgaggaagagcctccgatacctaagtttcaaagcctgctgtgcactgactaggggtcgtggtccagcctgacctgcagttcctctgcctgagtctcttcactgaaactcatgggtccagtcagcaagcaccagctccctccctcagagctatgccctcttctgcagctttaaaaatggctccctcatgagagagaagatccgcaacgagtctgtatcccgttcctggagcgatttctctaaggcactgcagtccacagagatgggcaacggtggaaacctgggtaggccagttggtggtgcccaggcctgtgaagggtcagcagctgccgactggaggggcagagcctggggccccatgagctgggggagaggagggccgtggagaagtccaggggagtcctgtctgtctgcacttatattccacacatcctacaagctggtgtggaaccctgtgttctgagcaagggtggggctgtaaggctgtccttggcttctgctctgagcagaacatcaggccatagctatgtcttctgtccccaccaagcccctggtgacagcatcagagagggcagcctctaccctggtgcatccccgttcacagcctctgccccaggcacaaggaaaagtccccagtgtctgggcaggcctgagcagggagggtctgtgcctcccttggtcaaacctgttttgatattttaggattggctgggcagctgcttcctattccaggctgccaagtgagagcaggaagagttgtctttgagaaaagctagctcagggctccctggttcccttctatcctgttggagagaaggaactgagaatattcacaggtctcatctgggggatgaaagagccaggggacccagggatatggggtcattttgtcctgttctaagtctgttaagaagctgatcttttgttttttgactaatgacggctgatctcttcctggttttatttcaggtttttattttgatgtaatggagatcacccctgaaattattggacgtcataggtttaacacagaaaaccacaaggtacatgtgctgttggtgttggagttacattggctccatttgtgagtgtaaaatttaacaattgcctatcaaattatgttacttttagggacttcattcattcactcatccattaatatcatacacacttgtggtgtgccagggtgcattctagatcctggggaatctgcaggacctaagacagacacggtcctttccctcagggaggaatgcagaaaacctgagagttctcttcctatttaacaaatgctaacactatcattgtgtatcacagaacttatttccttggcgagttttatcctatacccatcaagaacccatggatcttgagatcatgaatttcctcctggttgaaagagctgctgagcccaggaggtactaacgtttattgagcccatttggtgccaggcattgtgctcatggttttctataccttcctcatttacttttcttttttttttttttttaattttttgagatggagtctcactctgttgcccaggcttgagtgcagcgggacgatctcggctcactgcaacccccacctcgtgggttcaaacgatcctcctgcctcagcctcctgagtagctgggattatagatgcaagccaccacacctggctaatttttgtatttttagtagataggggtttctccatgttggccaggctggtctcgaactcctaacctcaagtgatacgccccctcccaaaatgctgggattacaggtttgagccaccatgcccggctatcatttacttttcaaagcaataggcactattgttcctctttctagatggagaggttgagactcagaggctcaggctaaataatctgcccagagtcacaaggtcatagatggtggagggggctcaaacccattcctctctggctctgaagctgctgttttctttctcctccacaatgtgacctttctcgggaaggatttagttggttcttgctcctcaaaattgacattgctgctggagagtcactggagagtcatcaccacattttgggttgtacctgagagatgtttctgaccccagtaaatggggggtttatgtaagacactctgtctggaaactgtaactgtcagagttggcgttggattcagtggcagatgatggcactacatgttggattatgaatggaaagctttgtataaagtaggaagttcatctcaatcttctgatggaggatcagtttggtttcttttgttagagtgagaagctatgcctgttctctttcatgcatatcaatcctagatttgtcaaggagaaagtagtgttcttcattcattcattcaaccagcagatatgtatgattggtgccaggcaccggggacacaaaggagaacaaaacattggtggcccttgctccccagagcctgctgtctaggagggagagggacagtagacgactgaatgagcacgtacatgaatgcagcaggtgctaaggctaggtggcagaagaacagagtgccgcaaaggaaagcagctggtgggcgggttggagacttaccctgggtggggtgatcaagcctgggcgtctctgagaaggtggcctttaggttgagacctgaaagtactcaggatctcaccatggaaagagtaggatagactttcaggcagagggagcagcttgggaactagaagaaggtcagtaaggttagagtgtagctgtttatgagggggatggcggcaggttctagcattggtctcaggtgccagagaagcaggagtgagcctggggttgatgcccatcagtgctagcttgaaggacatgccacaggggtgggatctcagcgtaagctcgtggctctcacttatctagtatgtactgcattttccaggctctgttgtctaatctgatcattgcaacaaccctaaaaaacaggcgccactattacctctgttttgttaagaaaaagaatgatagcaagactaatgtaacttattgaagattgcagagctgaatggtagacagaacttgaactctcagctgcctgagactaagttctgtaatgtctcttgactctcttcaaagtgacatgcatgtgaggctgtgagcttgtgtgcttgagtagtgtgtttgtgtgagtgtgtgtgacaggcaaagatagtggttaaagagcccagctatgagtttcaaatctgggctgttgtttaaaaagatcacacacagacacacacatacacacacgaatggacaatgagagttccttactctgtgcccaccttttcctggagacaggttgcagcattccctggggatgtggaggttcgagcactaattgaaggacaattcatggccaagaggattcacgcagaaggcctgggctatcgagtcagtaagtgagccactggcagcatgtgtcccggggtgggggctcagggccagctcactcgcaggggccagggctagtggggcaatatctactaaagttttcttacagggggacttgtgcaggagggaggtggagcctgacctcagggatggggtgagaaagtgtcaattggcacttgtaggcaagcatagaatagcagacaggttgttcccgcttctcagctgtgtccacaatagcctgaccttttggccaggacctgtaagacttgggaatggtctttctgaaaccctaagctccaagctgcagatgagctgtcctgagctctggactgcaaagacataggcagtgcaaggtctggggacatgaatggatcttggccttctagcctggccaggtcccattgcctgtgggacacagtctgggtctttcagcttggacagggaagagggggatgtagtaccactgtcaaaactcggaagactgatgtcttagttcattttctgttgcctataacagaatacctgttcctgggtaatttataaggaaaagaaatttatttcttacagttatggaggctgagaagtccaaggttgaggggccatatctgaagagggcctgcttgctagtagggctctctgcagagtcctgaggaggtagagggcatcacatggtgagggagctgagtgtgctggctcaggtctcccttcctcttctcagaaagccaccagtcccgttcccacgataacccgttaatccattaacctgttactttgttaacccatgaatggattaatccactcataaagccctcatgacccaatctccttaaaggtcccatctttcaatatgtcatgttggagataaagcttcaacatgagttttggaggggacacatattcaaaccatagcaactggcatggagagggcagacccagggccgggggaggcaaaaggaggagaaagggatttctgacaacttgagctgtagaataatcagcattaggatgtcagtgagttccccttacaggtggcgttggaatggtctaagggtctgtaaggaggttggactggccgcctatagagtccaggtttctaagatgtatttgtctctctgggctatagctgttgtcattagagaagatagtgaagctgctttgcttgagggccttcctatgatactctatggacaatccaagttctatgtaatatatattttatacctttgaatcaactgagtaaaaggatactataaaaatacctattagggaaacctcttagaaaacctgttagacagcatctgctaaagctgaatatacgcctacccagcaatctcatttctaagtaaaggcacaacaggaatttttgcatgtgtttactaaagatgtacaggagaacattcattgcagtactatgctgaatagccccacagtggaagtggcccagtgcccattaatagtagacagaaaaaatgcattgtggtgcatttgtacaacaggatactacacacaaatgaaaatgaaccagcctcagtgatacacaatgaaatgggtgaatctcaccaaatgtaacactgagcaaaagaggccaaacatggacatacatatggcaggggtctctgtacatcaaattcaaaagcagatggcactacaggccaggcacagtggctcacacctgtaatctccacattttgggaggccgaggcaggtggattgcttgagtccaggagttcgagaccagactgggcaacatggtgtgttgcgggaagtcagggaccccaaacggagggactggctgaagccatggcagaagaatgtggattgtgaagatttcatggacatttattagttccccaaattaatacttttataatttcttacacctgtctttactgcaatctctaaacataaattgtaaagatttcatggacacttatcacttccccaatcaatacccttgtgatttcctatgcctgtctttactttaatctcttgatcctgtcagctgaggaggatatatcgcctcaggaccctgtaataattgcattaactgcacaaattgtacagcatgtgtgtttgagcaatgtgaagtatgggcaccttgaaaaaagaacaggataacagcaattgttcagggaataagagagataaccttaaactctgactgctggtgagctgggcagaacagaaccatgtttctcttccttcaaaagcaaatgggaaaaatatcgctgaattctttttctcagcatggaacatccctgaaaaagagaatgtgcgcctgcgggtaggtctctgaactggcccccctgggcgtagcctgtctcttatggttgaggctgcagagatgaaataaactccagtctcccatagtgctcccaggcttattaggaagaggaaattcccacctaatacattttggtcagactggttgatcccaaaaccctgtctcctgataagatgttaccaatgacaatggtgcccgaaacttcattagcaattttaatttcacctcggtcctgtggtcctgtgatctcaccctgcctccacttgccttgtgatattctattatcctgttaagtacttgatgtctgtcacccacacctattcgcacactccctccccttttgaaaatccctaataaaaacttgctggtttttgtggcttgtggggcatcacggatcctaccaacgtgggatgtctcccccagacacccagctttaaaatttctctcttttgtactctgtccctttgtttctcaagccagccgatgcttaggaaaaatggaaaagaacctacgtgattatcggggcaggttccccgataatggtgaaaccccttctctacaaaaaatacgaaaattagccaggcgtggtggcacatgcctgtagtcccagctactcaggagactgaggtgggaggatcgcttaagcctaggaggttgaggctgcagtgagccatgagaccctgtctcaaaaaaaataaaaaaagcagatgaaactatttactattgttggaagtcgggataattagtagttacctttcagaaggggcctgtggggtgctgtcaatgttctgtttcatgttccatgggtgtgtttagtttttaaaaatttatgaacattataggcttatgatgtgtgcatttttcaggatgtgtgttctaggtcaatacaagattttaacatgtgtaaaatgaccaccatgagcattctgattgccctcatcccaccaccctaagtgtaaaaagacgtttcctaaaggtctgcaaagacttccaagttccctgaaaatgagactgggtgagcagggcagggttggtgctggagttggtggagtgcctggcaggggtcctccgactgtcagaagagaaccccagggaacggaacagcccagcatacagggagaagcagttagggcaaaaggcccccatgggctcaggaggagctgatgggattgtggcattattcccagcctctaaggcatttcttgtgcaaaacagcatagagttacttatcctcttagcaagcttaaatgcagaatcagacctgtcttgccgctctgctgagtgatcacttaaatagacatacttggaaccaacagaggttgcacgcacgtgaggactcattctccaggctgctgtgtggactggccagctctttcgttcttgcccagacatcatctcatttggctttaatagtgtctaagggcaataaagaggcactttgaataaaaatgattattgtgatactaacagctgccagcatttgttgggcactgagtgtgtgcccggcccagttccttagcaattaatctttattaacaacagtaccgctgaagtaggtactgatatgattcccacttcacaaccgaggaaaccaaatcttgcagtggttaaataacttggtcagggctggcagagctgggatctgaaccaagccagtctggctccagatgctggattctcaaccactggctgaacctgctttttttaaggaacaatcgccctcttgatgtttatagacaccatcagacatgatagaaaccagctgggcagggctaataagccatagttttcagtttatatttcagtgtgtttcatgttgtttaggttgattgtaaaaacagtcaaatcttgtaataacaagtttgaaaaataaagaaaatgggcctggtgctcacacctgtaatcccagcactttgggaggtggaggcgggaggatcacttgagcccaggagtttgagactggcaacagagagaccatatcttcacaaataataataattataaatatcccagtatagtggcatgtgcttgtggtcccagctactgggggtggggtggcaggggtggcaggaggccggggggatcgctggagcctgggaggtcaaggctgcaatgagctgtgattgcaccacttcactctagcctgggcgacagagcgagaccatgtctcaaaaaaataaaggaaaatgactcataatcccatcccctctctccaaccactggtatcatttagggacattttctcccagtctcctttatgagcttatttccatacagccatagttttgttcctttgtaccttatatgcaaagggtgtatacaagaaccaaagtttgtcagaagtcatctttgtggtgctgcgtatgatggccaggttacttttcctgcatttgggcactgagggtgttcttgttttttttgtttgtttgttttctttgttttgttttgttttgtttttctggagacagggtttcactcctgttgcccagactggagtgcagtggtgtgatcttggctcactacaacctccgcctcccgggttcaagtgatcctcctgcctcagtctcctaagtaactgggactacaggtgcacaccaccacgcccagctagttttgtatttttagtagagacggggtttcaccgtgttggccaagctggtctcgaacttctgacctcaaatgatccacctgcctcggcctcccaaagtgctgggattgcaagtgtgagccaccgtgcctggccattgttcttggttttccaacgtggaatcacactagagcatcttccatagcttgaattatttccccaggaggatggcagtccttctctcttcccagacactgtcttcacggccagcgatgaagatgggagaagctgagaggtgggggctgaatgtcttcttctggacagagccaaggggctggatggaaagcagcaggtcttaaaaacaactatttgttttaaaatacataacgaatggatgtctttttatcacaaaagattcatgcaaaacagaaatatggaataagaagcaaatgcccccttcatatgcctcccagactcctttccagactgtgacttccttcctgtgagtttctgtgttagattgaatcatacggaattgccaatattgaagaagttttgatttacaaaaatggcaatttcatatggttcgacctgacacgtgtgtgtgtgtatatatttaacagaaatgctattacattctatgtgttattctgagacttgctttccataacagtatgtacaggtctacctttttgttttctaatgactggcatgaggtctgataaattattttatagccctagttgaaggacattaagattatttcttgttttgttttgtttttgtttttgttcttgttttgagacagagtctcactctgtcacccaggctggagtgcagtggtacaatctcagctcactgcaaccttcgcctcccgggttcaagcgattcttgcacctcagccacctgagtagctgggattacaggtgcgcgccataccacctggctaatttttgtatttttgtagagacggggtttcgccatgttgcctaggctggtctcaaactcttgacctcacgtgatccactcatcttggcctccaaagtgctgggattgtaacctccactttcaccatctcattctatgccctatacccttgtccctagttcattcttgtttgtgtattttttttcccttgagcatgttagctaaaggttggtatattttattaagcaatgttaatattttgttttgtgctcccttttattaatttctaattttatctttttaaatgctttccttctactttatgaattttttctttttctgtatttttaagttgaaattttagctcatttattcctatcctgtattaacttctaatttatgcatttcagaatgctacatgttaactttatttacataacatatctttcatttctaaaaagatagtaattttcatctttttctgcatcagtgagtggtccttcaaactggcccctcgtccttttgacatatcttccatcattccttgagcatttccatagcttctagtataaaaaaagtttcaggctcatcttgttttttccttggatcagccttgtaatcttccatttatccaaggggccctgacttctctgagtgggagagatgtttggatgctctctctggatgctcattgctactgggatgatgctgttcccagcccctttcagtgggctgagctgggaatatgtaaggatatataacaacccctttcagtgggctgagctgggaaatattaggatatatatatacatatccaaatatatatatgtctgtatcaatacacacgttacctttctatttgtctgtctgtctacttctccatgtgttgaaaaacatgagttcaaccctatacactctacttccagtccaacaccatggggttcattctggctttcttccttcccatatttgtatcttatcctaacagtgacaaagttgattcttctgacccctccagattgctgcctccttgacatgcaagccccattttggcttctctgcttacccttacctgtgttgtctctgtgtcgtctctccagcagcctcttgaatctgccccactctggttatgtacttacatgtggcccttgagccacttctgtttgcctatttaatggctttttagagaaggaagaagaaaaaagaaaggtaggaaggtagacaggcaataaatatttttaaagggaagggtccatttacatttaatgtaattattgaaatgattggatttaattgaatctatccatttattttttatttttttaatccatccatttacaaaatggattacatatcaatttttctttttcttttcttttgttctatatgttcttttttctttcttattcttttcctgtcttatttttggattaactgagcaatgtctagtattccattttatctcctctgttggctttttaaggtatacactttttaattgatttttaaattgaaatccttaatttgaaaagtctggtttgcactaatattatacacttgaattttttacgaacatgcttgcactacaagaatgactaaaggatgtcttccgggctaaagggaaaatcataccagatggaaagtcagagcttcaggaaggaatgtagaacatctataaaaagtggattctcttaagttttactttgtctgaaaatgtatttattttacttcatattaaaataatgttttctgctgtggaattctaggttggcactttttactttcagcactctgaaaatgtcatttcattgttttcttgacttctaatgtttcagataagaaattaactgtcattcttaatgttattctcctgaatgtaatggggttttcttctctggctgatttaagatttttctattaatctttgattttcagcagtttgattatgatatacctaagtaagggttttttaattattattttgtatgtatcccctttgtgattcactgagcttcttggatctgtgggttaatgtcttccatcaattttggaaaattcttagccattatttcttcaaatatttatttttccctattccctctttcctttcctctggacttcagttacacatctgctgttgtcccataggactttgattttctattcttttttttttttctctctctccctgcttcagttggacaagttcattttttgttttgttttgttatgttttgtttttttgagacagagtcttgctctgttgcccaggctggagtgcagtggcatgatctcggctcactccaacctccacctgctgggctcaagcgcttctcctgcctcagcctcctgagttgctgggactacaggcaagcgccaccacatctggctaattttttgtgtttttagtagagatggggtttcaccatgttaggcaggctggtcttgaactcctgacctcaggtgatccgcctgcctcagcctcccaaagtgctgggattacaggcatgagtcactgtgcccggacttcagatggacaatttctatcacacctctttttattcatgtttctgctgtagacagtctgctattaagtccatctaacaaattcattttggatattatattttttctatttctagaatttccatttcattctcttatactttcttatgtctctgctgaaatttttcatattttaaccattttgtccatctcttcctctgactttatatcatctttataattattataaagctcctatctgctaattcatctcagagtctgcttttatttactattttactgccatttcctgcttcttaaaatgctatttaattttgtttgaatgctgtacgttgtgtttaaaagtacggtgttgactaaagtggctaatttttaaaccttttacttttgagataattgtagattcacatgcagttgttaaataaatagctaatgtttacctgcagaaaaggcttgcccttctatcaggaagtgcgggtgaggtggtggtttttttttgttttgttttttttttttttttttacttttatcatttaatttttatttttaaaaatgtatatagtaaaaaagctgggttgcggagatgtcggtcagtggattaaaaattttggttagggtacaggaacatattcaagagatttattgtacaacatggtgatgatagtttataacagtgtattgtattcgtcaaaattgccaagagattttaggtgttctcaccacaaaagataagtatgtgaagtaatgcataagttaattagctcaatttagtcattccacaatatatacatatttcaaaacatgttgtataggataaatatgtgcaatttttattgtcaatttaaataagtaacaaaataagtaaaaaaaagtctagaagcctatataacagcatactaacagtgtaactctggtgtaactagggttggtttttactttcttcattttgtcttttctaattttttgtatagtaacttttatcactgggcttaacaggaatctaaaaaatgtatttttagcaattgttatgttatatccacaacatgatctatatattttgtcagggaggtttattttttgactcagaactagtttgttcttgaaatatgtactttattcttttaattagggcttaaaatgttaaaatatttctaaagaggactattttgggactctacagtgtacctctttaatgagaacacccacagtttaggcctattaaggcatacttcctttattttactaaagaattaaaataataaagatttgataattttctttcttttttttttttattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcatagatcaacaggatcccaaggcagaagaatttttcttagtacagaacaaaatgaaaagtctcccatgtctacttctttctacacagacacagcaaccatccgatttctcaatcttttccccacctttcccccttttctattccacaaaaccgccatcgtcatcatggcccgttctcaatgagctgttgggtacacctcccagatggggtggtggccgggcagaggggctcctcacttcccagaaggggcggccgggcagaggcaccccccacctccctcccagacggggcggctggccgggtttttttttgtttaatcaggggttggatcagtactagttagttttagttcaccagtagttgcagtgtcttgggatcaggatcagcaggatcaggcccctccctccatcaagtctttgggacctaaccactgagattacagagctctttctctgttttccagctcttcccccacttccacatcactgcttccatagtagttcactggagacatttggtgggtagggaggactagctctatattggagactcttccagatttcagtcctccataccagcccaaatgtagttgtttttcttttctagcaaattttatctgcctgtagagtcttacttcttcatgtctcccatgctgcaggtatgaatcagcacttaagggctcatctcattctggaatttattttatttagacttcttgaatttacaattttttgatagcttcaagcaaaaatatgatgctctggttgttgttgtttattccattctgtcattgttacagcacaaatgtgttctttcttgaccatcatcatcttagctggaagtggaactatatgtcttttattagattaaggtttattattattttactatttatttttatttatttattctaaaatggagtttcacttgctctgtggcccaggctggagtgcaatggtgcattctcggctcactgcaacctctgcctcctgggtttaagcaattctcctacctcagcctcctgagtagctgggattacaggtgcccaccaccacacctggctaagttttgtatttttagtagagacggggtttcaccatattggccaggctggtctcgaactcctgacctcaggtggtcttcctgcctcggcctcccaaactgttgggattacaggtatgagccactgtgcccagcctattatatttttttggagacaaagtctggctttgtcaggcaggaatacacccaggctggagtacagtggtgtgatcacggctcattgcagccttgaattcctgggctcaagcaatcctcccacttcaacctcccgagtagctgggaccacaggcatgcatcaccgtttccagctaatttttgtattttttgtagggacagaatctttgttgtccaggttggtctcaaattcctgagctcaagcaatcctcctcctgccttggcctactgaagtgctaggattagtaggcataagccactatgctcagtcagtttattgtgaaaaatatcatgtatacagtagagtatatgtatcttacagcaagttataaaacatattaatcaaacatctgatgatcagcactcgggttaagaaatagaacatcagccaggcacagtcacttacacctgtaatcccagcactttgggaggccgatacaggcggatcgcttgaggtcaggagttcaagaccagcttggccaacatggtgaaaccccgtctctactgaaaacacaaaattagccaggcatggtggcggacgcttatagcctactcaggaggctgaggcgggagaatcacttgaacccaggaggcggaggttgcagtgagccaagatcaccccattgcactccagcctgggagacagagcgagacttcatctcaaaaacaacaacaacaacaacaacaacaaaaagaagaaatagaacactagaaccttggagtcttgctgtgctcctcttccactgtatcctcatcttcccctcatccctgcagagatcatttctatccagatttttgtattataatttccctggaattctttatggttttgccagctgtgtatgcattcctttaaatacattgtggctttttgccctttctgaacttcatgatacatggaattatactacatgcggtgtgatttgctgctttagatcaacgtcatgtttatgaattcatccatgttaatgtgcatagatagctattagctgttaattttcattgtactgtgatattccatcacatgattatacaaccatttatccatttgctatggcctgactgtgtctccccaaattcacatgttaaaaacttaatccccaatgtgacagtgttgggagatgggcctgatggaaggtgtttaggtcatgagggctcttgtgtattaatgccactataaaagtgctttcaggagtgagttcaccattttctgcttttcagccatgtgaggacatagcattctggggattctgctaaacattctacaatatacgggacgatccctcacaaaaagaattatccaacccaaaataagcagggttttattctggttggaagaggaatcaagcttttttctgtgatgagtagagctactttccatgtttgtctccatgcctgctgtgggagctcagtgtcatttcaagttcctcttcactcagtccccccatgcaccctccccagctagtagcccactttcactaatgagcacttctttactttagcttggggacaaacactgctgctgcttctgctgctgagtgtaagggagtggagggaagggtcttgagacccctgctgtcatgaagtcagttgtgtactctcagcagcagtttatgagggttcttattttcccatatccccaccaacacttaacagcaacaacctttaaatctgttgccagtctgatgggtgcaaactggtatctcagtgttagtttaatttgtgttttcttaattaacgatgattttgttttgttttgttttgagatggagtttcgctctttttgcccaggctggagtgcaatggcgcgatctcggctcactgcaacctccacctcccggttcaagtgattctcctgcctcagcctcctgaataactgggattacaggcgcacaccaccatgcccagctaattttgtatttttagtagagatgggatttcaccatgttggccaggctgatctcaaactcctgacctcaggtgatacacccgtctcggtctcccaaagtgctgggattacaggcgtgagccaccgtgcctggccaattaataatgattttgaacagctctttgtaactctggtttctttctctgaattggctatgtacattctttcccatttttctatttgatttcctatctttctcttattgatttgtaggattttattgtatactttgaatattaggtttttgacagttttttgtgttgcagatatctctcatttatctgttgcttatttatagtgtcagcaatttaacagaattttgatgaaattcatcaatttttcatcttccattttatgcttttgagatattgtttaagagatttccccccactccagtatcacagaagtactgttttatgtttctcctgttgatgttacaattttaccttccacatttaggactttgatccatctgaagtctttgcgaatgatgtaacttgggatccaatttgattttttccacatgttgatccagttttccaaacactatttactaagtggtctgttttaccccattacttgtagtgccccctttatcatttatccagtccctatatatacatgggtctttctctgtactccctttcattttttttttcctttttttggagacagggtctcactttgccgcacaggctggagtgcagcggcgcgatctcagctcactgcaacctccacctcctgggttcctcccacctcagcatcccgagtagctaggactacagacaacgtgctaccatgcctggctaatttttaaatagtttttatagaaacagggtcttgccatttttcccaggctggtctcaaagtcctgggctcaagcaatctacctgccttggcctcccaaagtgctgggattacaggcatgaaccatggcacctgacctgcactcctgtttctacttcatgggtttattggtcttgttcttggggcagaaaaactgttgtattattgtggctttgtagtatgtctgtattagttggctagggctgccataagaatgtgccacagaatgggtggcttaagcaacagaaatttattttctcacagttctggaggctaaaagtctgcgatcaaggtgtcggcagggttaatttcttcttaggcctctttccttagcttgtagatggtcaccttcttcctgtgtctccacatggtctcctcctgtgtgtccctgtgtcttcattttctcttctcataaggacatcagtcatactggattagggcccacccctaatgactttatttttaacttaattacctctttaaagaggtaatatctgtctttatcttcaaatacactcacattctgagatactggggtttaggacttccacatataaatttagggtagacacacttcagcccataataatgttttaatatgtagtatagcaattatcccctccttgcttttctttttaaaatattgtctgagctgtttataggtcttcatttttccacaaatattttataagaaattggtctagttccttaaaagagtccagctggaatttttatttaggttgaataggatgtatacattaattggaaaagattgacatatttataatgttaattcatattcattcaagaccatggaatatcttttaatttatttagatattcttttttgtactttaacaacaatttcaactttttcttaatagagacttttgaattctttgttaaggtattcccttacatgtaagtctaccttacatttctggttgctgttgtgaaagttaatttatatattttctattgtatttgatagttgattattattagaaatgccattgattattataagttgattttgtatctggcaaacttattaaactcttgttagttttattagtttgtttattctttattttttccaaatagatggactattgtctgcaaatgacagttttcttttcctttatttcaatacttatatattttagttgtttttgttatcttatggcattgactggtagatctaatactgtgttaaacagtggactggatactgtgaatctttgttttgtttgtagttgtattagttatctattgccatgtaacaaattatctcaaaatttagcagcttaaaacagtaataaatgtttattctcttatacagtttctttgggtcaagaatttggtttcagcatggttgggtgattctgattgaggatatctcctgaggttgcagtcacaatgtcatctggggctgcagtcatctgaaggcttgactgacgctggaggatctgcctccaggctggctcactcatgtggctgttggcaagaggcctcagtctcctgccatgtagacctctccctagggctgcttgagtgtcttcaggatgtggcacttagctttccccaaagtgagtgatccaagagagcatgatctgtgtcagagcgagatggaagcctcaatgtcttttatcatctagtcttggacttcatacttcatcatttacacaaggttctattgggtatacaagtcggccctattgaatgtgaggggggactacttgaaggtgtgaatatcaggagggagggattatgtggaggccattttggaatctggctgacacaccagtctgaaagaaagtgcttctaaatctctgttaagaatgacatttgttataagttgtggatatatgacttttatcatttaaggaagttcccttctcctgttttgttgagatatttaaaacaaaaaaagtattaaagacagttaaggtgggtggggcagcaaccttacaagcaaatgaatgtgacaggcctgcacacacagagccagctttggatctctcccgtagtcctgtgtgataagtgggaggcattggcccatcatgagccctctgtagctgaagaactctgcaaaaacagccctttctgccttgggagaactggcatagctattttacttttttcttttcccttgcagtgtccaagacaaagattttggccacaggaggagcatctcacaatagagaaatcttacaggtaagcgttagtagtgggccttacaccatggcctctcccatatctgttatgtctaagagccagagactggataggaaggacagcctccattcccactcctgcaggaatggggagctcttagctcacactccaggaagcagctctgttgccttacagctcacactgtgagtgggatctgtctcacatgcaggtgaattctatggctgtgtacaatccactctctgataccagcactgtcctctggagtcacatggaaagtgcctgttcttccacatggcaaaccttctcacatctagtgccagtgttcttgtcttcctcaaggcctctgccttccaatgtaaccatcgctgattctccaaccagtcctcttataacacagttgccagactgttactgtccttctggtccttcattatgccagaaacatatgaccaaaagtagaatcaacctgcagatgtctgacactcagactgtcacctgtggggctgtcagagcctgttatggagacattgtgcatttttgggtgtagcctggggctgccttaactgttagagtaactgtattagctgtttgcttgtgactacctatcttaggtaagatttttctagaaacagagcctgaaatgggaattcttctataagcagtttgttgagagagtactcccaggaagaaggaagtgagggactcagggcagtgcagaggaagaaggataagtgaggatatggtcttgtctggagtctacttcagctccatcctggtggggaggtggggctctggaacatgaattataccacagagctgattttaccttgggacaagggggccaacaggccaccctggggaggttaaatctcctgtgagcggtggcctatgctcagccaaggtcagctttcttgaggaggtagtgctgcaagccattagtagccagtactcacagcagctggggcaggatgcacaatggtccagtgagggggatctgggtcggcatcagtggcatctactacaatatctctggtcaactaagacctcccccaagttctttccatgtgaactcctcttagtacaggtcctccatttgaaatgtatgcaatttatttgtgaacctaaatgggaaacttcaccattatccccatgaaacatgctcttgttagcttgggtttgtttgggcttgttaatgttagtctaatacccagctgtctccagccctaggtcagtgccatttgctaaacatacttcctaaatcttctgccttgtctttggtgaaatggctaaaaagtacagggacagcctggggagctgtggctctccactacggacctcccccagctcatcctgactctattatcaccagggtagcatgaccaagcatactcctcttaaggcagtcgaggtggaatggaagaggtcagaagacatatgagggagagagcctggaaagtgcatcccacaatgtctgtgttccctctgaggaatggctcaccacagtagaacctctgtgtccttttcaggtgcttgcagatgtgtttgatgccccggtgtatgttatagacactgccaactcggcctgtgtgggttctgcataccgagcttttcatggtaggttgatggagggagacagctatctctggaagtggccaggacatggggtgggctgaggagggtggaaaggggagagtgaggtgtacccagtctttggggacattggagtcttggggacttcagcttcatttttctagctcccagcaggtgagaaccaacccatactctctgttcctttattctttgcttaaagtggagaaaaagaggctgggtcctaactgaatgaggtctggtcagagttaaggtcagcacagggacatgggaaaagaacacagggcatggttgagagcacgtgggcatgagtctggacagctagagggcaggagaggtggacaaagtccagagccgtcttttcagcaagaacagaagttgaaacaaaggggaaggcttcaggcccaagcagtccaggaccctggacagcaccatggagccctgttgccctgttggaggcctcgctaaaactctgggtattaagggaagctccccgatctaggcgagttctggcaggagcagcacctacctgcaagggcagtccttcaagttggatcaatttgctctgtctcctgcttgctcagggagctcctgtagcagcccaggtggttctattcttttcatattcttaacatttaacatacctatttcagcttatatttttcttttctttttttttttttttgagacggagtcttgctctgtcaccaggttggagtgcagtggtgcaatcttggttcaatgcaagctctgcctcccgggttcacaccattctcctgcctcagcctcccgagtaggtgggactacaggtgcctgccaccatgcccagctaattttttgtatttttagtagaggaggggtttcactgtgttagccaggatggtctcgatctcctgactttgtgatctgcccaccttggcctcccaaagtactgggattacaggcgtgagccaccgcacccggcctaagcttatgtttttctatcaacgttgaggaattaatcaggcaacatatccttctctcaataattaaccttggccgggtgtggtggctcatgcctgtaattccagcattttgggaggccgaggcgggtggatcacaaggtcaggagttcgagaccagcctggacaatatggtgaaaccccatctctactaaaaatacaaaaattagctgggcatagtggcacacacctgtagtcccagctactcgggaggctgaggcaggagaatcgcttgaacccgggaggcagaggttgcagtgagccgagattgcgccattgcactccagcctgggtgacaaagtgagattccatctcaaaaaacaaaaaaaaataattaacctcttactcatttattctctccccaccccatctacctcaccctgcctcatgccatatcctatatcaagatcacttgggaatttatttccagattcttatattaagtacatttaatattatattggcttttattcacacttacctatgagtctgcctgcctgcctgcctgcctgcctgcctgcctgccttccttccttccttcctctgtttgttactttgtctttttttttttttaacttcctgacatttcggtcgggtgcagtagctcacgcctgtaatcccagcactttgggaggccaaggtaggcggattatgaggtcaggagatcgagatcatcctggcctagagggtgaaaccccgtctctactaaaatacaaaaaaaaaaagaaaatagctgggcatggtggcgcgcgcctgtagtcccagctactcgggaggctgaggcaggggaatagcttgaacttgggaggcggaggttgcagtgagctgttgcagtgagccgagatcgcaccactgcactccagcctggcaacagagcaagactccatctcaaaacaaaaaacaaaaaaaaacaaacttcttcttctttctcctttatttctatgctgaggttttgttttgttttgtttaagacaaggtctctgttgtccagcctggagtgcagtggcgtagtcatggctcactgcagcctcgacctcctagactcaggtgatcttcccacccccacctcagcctcccggatagctgggactacaggcacacaccaccacacctggctaatttttgtagatatagggtttcgccatgttgcccaggctgaactcgaactcctgggctcaagtgatcccacccacttcaccctcccaaagtactaggattacaggcatgaatcctagtgctaggattaccgcacccaggctgtatggtagttttgttggaatatacaacctaaataaatattttaagagagaaattcaataggtgatggttttgaggcctgacatgtccaacaaggcctttgtttcatcctcccaaatactggctgggtaaaagactctatgttcaaaatacttttcctgagaactgtgaagatactcttccataatcttctggccttcagggttgctgatgagaagtatggggtctgcttcataattcttttgtggaagtgggaaaggagtttccctttagggacttcactgccatcctgcactgtgttttgttttattctttttccctttctgtgcttgccaaagggtacctgggccactgccctgctctgccctccaaaaccaaagcccgagccaaatcttagctcaccagtccctacccagagggatactaaccacttcatttggagatatcttctccccatctgggtctggggatgactgtcttgtgtagccagtctgcgagtatgagtggagatggaaccagagtcttttgattagtttctttgctgtccaccccaccaccattccagtccctcatccattctgctctgagctgggattttctagcatttggttaggaaaactggtcctcacatcttcagagggcccttcttcactcctggtggtggtggtgtttgtatatctgacgctactacctaccttccctagaaattgctcattgtttcttgcccaccaatggcaaccttccccctgctactcatttgcttggtgagtaattattgagtgccccctgtatgccagatggtgtgctaggcaccatggttatagtggtgacccggagagacacagtatctggcctcgtggactttacagctcagcaaaagagggatcttaaaccaataatcactgaaatatatgggcacaagttgggaaaagtgctctgaggaaaagcagatggtgctgagcgctaaggagggcctcctgagcaagtgatggtcttaggtgcatcttagctgaggagaagggaacaggcatgtgaagagtggaaagaacattccatacagtgaaaaggctctgaggcagaatgagtggagagaagaccaggctgtccagaatgtggtgaacgaggggagagaggaggggcaggcagacccttccccatcatatgtcgaggttacccgacctattccatgaaaggcacaaccacaaagagaaagacaagctgggtcctgctggagacaagcctgcacttgccatttttttgttttgttttgtaattttattgaggtacaatctatatgacataaaaatcatccattttaagtgtccaattcattgatttttcataaatgtactgaattgtgcaaccatcactataatccagttttagaacagtttgccaccccagtgagatccttcgtggtgtttttggttaacgtcttcacttgcaacatgcactaatgtgaagtgacctttcccttctaggtcttgcaggtggaacagatgtgcccttttcagaggttgtgaagttagctccaaatcccagactagctgctaccccaagcccgggagcttctcaggtgagagaccatcagaatttgtttgtagcatttgcattatgaaagcccgctagggttttttcccccaccaaaaggtcacctacattgaacgtgatgtgctcaactaaaggagaaattctgctttattgaaattatcaagaaaatggagctaaagggccatgttgtcagctgcaagtcacagatactgctgattttacagccagggtcagatggattgctgggcatatttgtattgcttcttatgcctcacggtgggcccttccatgtcactgggctataaaagctactgaaaggatccatcactgaaattcaagacatgctgggtttctagcactgaaatctcaagtctagacccaagatagctgtgcagtcacccaggccaggaaatccctgtgaaggcagacctcacttgttgcaggttgggtccctcagaaagcagagtctgagatgtcaactaagatatatgaggtttatgggagtcgggggagttgctcttggaatccacaactgcagaaaggaaagggagtagacaggattggacagagggagaaggtgagcagcaatgcaatttctggagcctaagctattcctacagaaagctccgaagctgagatgacctttagagttttacccagttggtctaaggggctgggcctttataccccatgtcaatcagtcatcacatgtgggccaccccaggatggggtgaggcagctctttatagctaaagcagtctccaaagtgggctgtcagctgagggctctctgccaacagcactcccatcagttgggagaataagttcttcattcccgaggtgaatctggatggcacaccatagcatccgccacaccactgcacctatttacagaagggtctggcagcccagcagcaggggtgggtgcatcttgtaaggaactgtgaagggtctgagatttacctgacttgcaagctaacaagtgagcctgccaccattttgtagcggcaggcagaagacacgggactcctggatcagagacaaagggctttattatgatgaaccatgatgaactcatggttcatcaggaagcatgagcttcatgcttgcctcattttcccttggcccccaaattccacagggtgatgcaaagtgggcccaggtggatactggcacataatagtctgtgatacaactaaatgatcccgagcatagaaaactcccaaccttgtaaagaaactgcgagcaaacctgtctaaactttgccaccaaaggagacattatcctttttattcttgtcagcaaacagataaacattctctccagtgtctctgccctggagagagacactatctttatgtctctatactttacaaacatccttgaaaagatggtctgaaacgaaagctgtcataagacatgtagaaacactatggagaattgtctcccagcatatcttggaagcaagagctcatgctgtctagagcagacaaaccacacacataggtgtgcccaagcatctgtaatttttctgtttgtgagaggctatttttctctcatgttcgagaggccactcgatacactggaaagattcaatgtcgagataaaggacatttaagttctgattcttattctgcttctccttcaccatgagaccttaagcagcactccttgtctccagacctctgtttgtttatctgtgaagtgggcacaccatctgtcctgcctccctttaacttgctaattgtgaggcttaaaaagaatccttgaccaaaatggctttataatctaataggaaatctgggggtagaattggttcagtagttcaacatgagaactctggtcatgttccctgcaattccttaggtcagcagtggacaatgggaacataatgtgagccacatatgtcatttaaaatattcggttgcctcattttttaaagtaaaagtaaaaataaaaataaatgattaaaattaattttaatacattttatttaatccactatatctgaaatattgtcatgtcaacgtgataaattagaagttactaatgtggggccggatgcagtggctcacacctgtaatcccagcactttgggaagccaaggtgggcagattgcttgagcccaggagttcgagaccagcctgggcagcatggcaaaaaccgtgtctctacaaaaaattaaaaaattagctgggtgggtatgtgcctgtaatcccagctactcgggaggctgaggtgggaggattacttgagcccagaaggtggaggttgcagtaagccaagatcacaccactgcactccagcctgggcgacagagaccctgt

SEQ ID NO: 16852 - DNA, 26116 bp, Human
  misc_feature (1)...(26116): n = A,T,C or G
ctccacacaagttcactcataccacacaggcttacccctagcaggaaccagcagagcacctcccagcctgtgagagccaggaggggccgatagccaggggaagagaggagaggactggagtgagggctcacccacggctctgagcagccgccgggtttctctatgagcagggcggggcccagccctcatgtctggcagaacctggttgcatgtgccagctctgagtcagcagtgcccatcctgcccaagaaccctgggctagggaggaggctgcagctcctatgtctgtgccaggggccagaggagggattctgtgaggtgggtttggagcatgcaaaggaagagcctggctgcatccccaccatggtacatagacaaagggaaaggagaggctcccaggtaatgtcctggcttggggcctggggctcagagttgggagatgatgtgaatacataggaatgatgactgagatgaagccatgtccactcctggtgtcagagtttcactgtgacgctgcctaggaagaggaggggggcttgaggaggcctgatttgctgagtacaggggcttgcaggctccaggagtatcagaggtgcaagtggtaggctccaaggcctgaggaggcctccagagggcagagaaggggacccttcttccccactcatcccctgtatggaggtccagagtgatgcctgccagtatgaatttgctcatccctcagcaaacatggtgtgtggccctgggcagaagggaaaccaaggaaggaactgacaggcctgcccagggcaggggtgttcgcactgcaggacagtattggagctgagtgccaggtaaggggtgaagccccgtctgtggagagggggcatgcagagcagggggctctccaaagcccagaagtcctgatccacttttaacccccagaaccagaagactgtccttcagctgtttcacatcccttattcaaggccacctagggcccagaagaggagggattggggtgagcccagccccctccccgcagagctggtccaactagctttgcctgactctcacattggccttatcagcccaggaggcctgggtggcttcctgggaggccctctgggggctctctgacaccaagagcccagttttcccaagggactctccaaaggggtggtgggcaacaggatctagggaccctcccagggtctgtggtgggaggggtctctgggcaacctataaagggggttttctgggtcccaagagttagggggtgggtctgcatagggaccttgcccagacagccccttgggaggccacctgaagaagggaccctggggatcctccccctcggctgcatggatcgctggggttttgggatatgagtggctcaaaagtgaaatccgtgcacctgcttgcttccccctcccacacccccaacactccaccaaaggcactcttggggttagaaacctcccagcgagaggaaaggggacctcctcccgacaaggtccaggtattgctctctgaagaccttctaatcgtgtccgtgcacccatttcgcagaagggaatgcgaacgctgggagctgcggctggaagcctggaacgccgcgtctccctagcgcagcagcccggctgggcgtcggaccttacacgatcccttccccgggatgacgccggattctttccagcatcaccccgaccccagcgaggcgcccacaacagggcgtggggcccggccgcccgcggtaatgacagggcccgcggcccgtgggtggcggcggcggaggaagctggaggaatctggctatttctggtcggggcgcgcccgctggcccgggccagggttggccagtcctccgggcccccagctctgccctccctctcgcgtccccagaagggggcggggagagacgagggttggcgggctcagggggcgggggcgcagggcagcgggggcggggcggtgtcccgggaccacccccggcctcctcccaccgcggtccattcaggtccctgcaccgcactccgctcggaccccaggccgccggtgctgtcgctactcaagtgagtcccgcggtgcccctcccgccgcgccgcccgtcgggcatggactcgggccgggacttcctgaccctgcacggtgagtgcctggcccgcgcgagcgggagaccctgcaggggtggacccctggaaagctgttccgggccctggacagggagcccccagctccttcggccgcctccacaccaccccgggcccgcctctctgccccttctccggactgggaaaatctcagcccgcggctccctgggtgggactgccgggcacgaccctgggcgtttccaggcttgtccgagatctagcccggggggtgggtgggcgggcggtacgggtctaaagacttccctccgcctcgcggacccccttgtcctggtcatgaaagtctgggctccacgatcccgctcgcacggaggggcggcgaaggaaggaaacagcatccaagaacgaccaaaattctccttgccccatccgggccgccccagaggctccccaaagcctgggcgtgcctggaccgcgtcaggccgcgcgggtgtggcggagcaggggctaagcgggtggggagaggaggtgtgcaaggttaaccgtggtcgggccgtgcagccttaactgcccagcgcagaatagtcagcgatgctcaggctgaaagaagcagcacgatcccctcatctgcgaccctcctcgggggacagggccaggtctcagccggagctgcctgctccatcctttgtccagcggagctttgtttcctccaatatgagccagctctttgccctttcgctgtccctccagcagcgaggggagcctgggctcccgaaggcagatctggaggccttctgggaggcgggaggttggggagggtaactttgggcgcctctttgctccaggacaggcactcactcactcttggtgggggcttgccctcctgccctcccaggtcacttgccatctcagcaaaccctgctcctttcataccaatcactgctttactgtatatccctctcttttttagtacccttggggttggaggctttagtggccaccacccatccatctaaactgttcatggacataatagatgggaaagagaagggcagagtcctctagccttccactagagtccccctggaatttagagggacttagagatgttcccatcagccagcctccagtctatctcgtgttctgcagttggcacagacctggtcctcctggcccagagagaccttgctctgtgcccagagctgttgcttttacaccaatagcctaggctccttaaagccaccttgtctagatgagtcatggagtccctgccccttccagtgctccctcttctttcttcaggccagaggtgtctttcgtgcgcctgccagactagcaagaagggaggctgggcagctgagaggacacagtggacatctctgctttctctctgacacagcgtcattccttggctcctgttggaacaggcttcatcctcagtgtctgtgcctttgtccagtttctctcctgaggcagccttgatatcttttccatggaggaagacacatggaggctcagtcaggacctcccagtcctgtggcataggcttggctgccctggcccaccccatttgagaccagcctcccaaatgcctaactcagtccagcctttcctgaagggttgacatgaacactgtgaccccaagctgttttccctgaaggccctgccacttctagctcatcacccaaaattacctcaactgccttctgtccacactgcaaaccagatggggaaataagaacctgtcaaggagaattgttggtgggagggggtgatcactgtgccctgtgctgttccaggttgtctacacttgcattggagagtctgcatccgtttcacagtgtgggtgccccagcactggatgtgctgcaggaccacactctctggcctagggctccacactctctggaaggagcccagagggactccttctattggcctggggagctatgcggctcacctagatgtgacatgtcccttctgtcctcaccccagatgcatgcagaagtaatgtagtttactggcatagattctgaaagcaaagtacctgagttcaagtcttggctttctcatctcagatgaatcccttgacttccctgtgtgtcagtttcctcatctgtaaaatgggggataataccatctacctcatagggttgctacgaagattgaatgagataatatctacacagcagttagaacagtgcctggtacccagtgagtactatgttcctgcaggaggccccctccccaaatttctatgccctatgagttgccatctgtagttctttgggagatgatgggggcatcataaggtagttcctagtcatggaaaatagggccagaactagattcaagagcgagccagccagctctttctagtgcctctgaagccctcagactgatgcgacagcatccatcctccttccttcaccttacttcttccactctttattctggctatgcctggactggcttctctagcaggtcccccgatgtgccccaaaggacattacctcccagggccctcccctcactgaacaccccccacatacacactaacttttcctacacccaatcccttttgcccccacccctgcaagaggtgccgtttgtaaaaacagaaaatagaggggcctcatcttggccccagtagacctgggctccagtcctagctttggttctacttactgtgggtctgagaatcatccatgggatagcagtacatatttcacagtgggtgttgtgaacataaacgccaatgggcatagaaattctaggttgccccaaaaaccagtcctccaagagatgatgattccagagctcttagcaagttggggtggccagctcctcactcacctgtgttccaaagcagtctgcccctgggcttccaggcccatgctacacaggcacacactgatccacaccaatcttaactttttgtgccacagaccactttggcagtcaggtgaagcctgtagaccccttctcaggattatgtttttatttatttatttgtttatttatttatgagacagaatctcactgtcacccaggctggagtgcagtttgcgccatctcggcttaccgaaacctccacctcccgggttcaagggattgtcttgcctcagcctcccaagtagctgggattacaggtgccggccgccacgcccggctaatttttgtatttttagcagagacggggtttctccatgttggccaggctggtctcgaactcctgaccttaagtgatcctcctaccttggcctcccaaagtgctgggattacaggtgtgagccactgcgcccggccaggatcatgtttttaaatacagaaaataaaatacataagaattcaaaggaagccaattattttgagatgttattctatctacaggttcttgaggggtctttggtctggttaagaacccctgcgcagtttctccataacacaggctccctttgcactctgcttcccctctccaaagaatagcttttccgtgttcatatttcagctcatctaccttgtccatctactcaccttgctcatgatttattctctctgatatgaccttaggcaagttactctgcgcttcagtttcttgttattactgctgtgcttgtctgtgccaataactggctttgccagtgactcactgtcaatgctggtgactggagctgcagtgaagcgaactgggggaactattcagaggctgagagtaagagtcaggcctctgggtggtgtcctgacattggcacacagtaggggctcaataaataattactgggtgaatgaaagggaagttgtgatgtacatgaaaggacccactgttcccgagcatattggcagcaaagttttgtgcaaagttacagtcgttctcatgtatttatgaaagccaccctgggttaatgggcttattttaagatcagaattttttcaagaatttcgtttgcatccgtcaccttggggattatcactttggtggtcaaaccgagagaagcaaacaggcccacctgaggttcacaaatgaggcaacagcaagctgagtcgcaatgaattagttgagcaattgaagtaaaatacttggggggggctcggtgtctggcccaggctccatccccggtcccgcctgacctcgccccactcaggtccccgctagactgccatccacctcccactgggactcccctcagcttttctccccagactcagcccttcggttctgcgccagcctcaaaggtggcgttagaattcgccgctccggctccttggtcagaccccgcccacactgcctcccggaccctggctccgcccccgcaccgcctccaaagccgagggaccgcccctccctgcctggacaccgcccttccagtgcgggatcctcccaggctcgcctcctgggccctggccccgcccccgggctgcttcctgggtatggctctgcctccacgtcgcctctggagcagaggctcccggcctgagctccgcctctgagcctggcccctccttcgccccgctgccttggctctggccccgcccccaggcttcgacacagatttgcttcctgggttatggatttgtcccactccgcctccgcggggcccggcacctcctcggccccgcctcctgggttctggatccacccccatccccacccacgcctcgacaccactctcgccccatctccaggggtcgttagtcccacccctcttggatggcccagccttttggggtctgactctgccctccttagcccagattttcttctcgtcccgcctcctgtattctgactccccccactcatttactttgcctcggtttcgctctcgcctcaccttcagggggcataggtcccgccgctcgtggactagctccgcctcctagcgtctgactaccccctcagcccagatttccctctcgtcccgcccctccgaagtgcgcccctcctctcgaactctagctcctccctcccattcctggactccgcccctgctcccctccaagggcgacagttccgccccccggaccagagcagagggtgttgtgagcataaaacactggaggcggcactgccccggacccggctccgcgcaggcaggggcactgtggagggccatgcagtgcctggggatccggagccggagccgctccagggagctctacctgcaggagcggagccttaaggtggcggcgctcaatggacggaggctgggtaaggggcgcagagcactccgagatctgcgggggaatgggaaggcagctggagcaggacgccgaccacttgtcccttaacgcggggccatttgccttggagcctttaattggacatgtttagtacttctgtgagtgtgtggcccactgtggggcagtgtttgcagtggtagcacgtcggggtgagtactagggtgattagttaccccttctcattatttaactcagcccttccaacgctccccatcccttgtcacccgacgccttcctgtttacaaatttctgaggcaccgtgtatgtggcctggtctgtgtaaccaatgaggtgatctgcaagagtttgtgcttcaatatgatcctgtgcaaaagtgtgcctgtatgtgatgggtgtgacagtggtgatctagtatgggacccagtgccgactgagtagttctgtcatgcctggggtctgtggtggggccactgtacagtgtgtaatgatggtgatggtgtgtaatgttgtgaaacaaagtgtgtgacattgtggcactgaggtggctgcttgtaacccagtgtgacagcgtgtgatctgttgtgatactgttcaactgagtgtgactgtataaccaatgtgacagtgggtgacctagggtgactgagtggttctgtcattccattatggtgtgtgtgttatatggattttctgatgttcttactctgtggcagtatgtcccttcacagtggctgcgtaaagtttcataccgctgaccctgtgggtaagctacctgcttctgagtcctgactccaccatgcaacttccttgagcctcagtttcctcttgtgtaaaacaggaataatgacagtgccttcctcagagggttattgagagaattaagtgcatgtgctaagaacagtatcttatttaaatattaactattattatgggagcctctatcatcatcatcatgatgctctggcactatatgttgtgtggctatgcatgactaagtgtgacactgtgcaactccctgtgacagtgtgtaattttggggggcagtgtgtcattgtgtgtggctcattgtctctttgaggttgtgtgagtggtggtctagtgtgtgactgtgtatttgtgtggccatatctgtgtagctgtgtatcgctgtgggtcccaggcccagtgtgtctttattatgcatcacccttggtataggaacaggactcctggcacctccctcagcttcccactggcacctgcaacaccctgtatgccccaccacatggccacctcactgtgcacagctagcctgggcaggctgcaaggtcaacccagggtcagctcaaagtctcctcgccacgaccctcccacaggaggagaagctcttagattgatgcaaaagtaatcacagnnnnnnnnnnnnnnnnnnnnctttcaatagcaaaaaccgtgattacttttgcaccaaactaatattatgactgggttgagtagggctgggtgaggggtgccacagactttctgggtgctaagggagcaagggtggtggggcaggaagtccagaagctttgggaacagaagggccccaaatgaggctaagagatgagggcacctgcccaggtttcctaatggtccagagggctgtggctatcacctttctggaattatcaccctggaactgatgtccaccttttagaaaccattgttggcagctgggggtttatctctgcctgactgtagatagggccacagcctggctccaggacaggatgagcatgtcatctcttcatggtgttttccagaacaggagggtggtgctcaacttctacttcctggctcccagctccattcccatacatgctgttggcagtggcttgccctgatgtatgcccagcttgtggggtggggtgctggcagagggtaaggagatgtccctctcagctttagagggacatcagccttagaagggatagtggaattccccgccggaggccggaggtggccctgtcctctggcagcctgggaactcccttctgcctcctcttgtctcaggctcctcagacacagccagtagttgggaatattctatcagagcccccttcttttccactgggactccccttgggctaagagggagctgctcacgctaaggcacaacagctcatcaagtgggtggacagacctgggagaaaggtggaggaaggtcacatcagactgtcacccctgaggaggcccagggatgcctcccctacactgttcttagcccagtgctgatgggggaacaaaagcagagagagggaagggagttgcctaaagctatagggggtggatgttagcactgacctctatcctgattggaagcaggagactggggaaggataaagagtgtgtgagcaactgaagcctggggaagtggtccagagggttctgtgagccctgaagatatgtgggacaggctggctgggggagggggtatggataaaatgggagaggccatctgttgttggggatctgggctcagaaaagaaaaggcctgtggcttcatgagggcttccccacataggcttaggctcaagaccctcagactagacccttgaagtccctgaggctgccactgtgctggagcagcaggacagagattgctgatgggccacatagttctagggagagaagtgaagtggccgattggctctcaatagagctggctgctggactatgtacgtggctagggtgatacacgcacacatacgcccttatagatgtttctgtattacaccagtgggttactaagggttggggtcacttttatcaactttatcagttggtacagaacctgctgggtggtgaaggctctggcgtccttttggtgcctcctgtctgggcctggtaggactgagggcatcgcatctttgggagcccacacctctgagagcagcaaaagagtggggcaggactggggcaagcagccaggttcctctctctgggctctgggacaggacctgctcagcttcggaaagggatgcactgtgccttaaagctgctgtatcctgaggggtcccagaccctgggcactctgagatggggctggggcagcgaaggacagggccatcccagcagaccaaacacaggctacagtgcactcatctgtctcttcttggggcaaagatcagagatcactcatgtgggctcaagtcagaggtgggggggacagcaagggtaagggtggcagagatgggcataggggtcccacagcaaccacaatgttgacaccaagaaccccaactgccattatcttggggcctgcacagattcaggcatcatctcattgaacctagaacttccctttgaggtggttgctgttattatctccatttcatagacaggaaagcagaggcccagcagcatgaagtcccttgcccaggtcacacagcttgttgggaagggcacctgaacctaggcacaaatgattctggagctattggagttgggacgttgttggctccatgacgctctggggtccatctgtgtctgtcccccttttatctccctgctttgcctaaccttttgatcccagcttccttcagttcactctgactcctaagtgtgaccaggaggggctcacctaatctttcaaaaccatctttcagaacatttcttagggggctggtcctctaggaaccaggggttcttgaattagctgcctttcttttgttcattcagctgtgggtggcacgtcacagtgtgtaagtatggtcttgggtgggcaggtgtcccgtttgcatggtcaccttagctggcaatcagggatgacttcctggaggagggcaggctctgggagcaggttggagcatgggtggaggagggaggagtaaacagagctgaggatgaggctggtgaaaagtgggctctgagagggtcgaggtgggcatggccagtgtgaggcctagggcatcagggaaactagtggagaaggtggcatcttactggctttgatccccaggcctacaggatgatgaggatctacaggcgctgctgaagggcagccagctcctgaaggtgaagtccagctcatggaggagagagcgcttctacaagttgcaggaggactgcaagaccatctggcaggagtcccgcaaggtcatgcggaccccggagtcccagctgtgtgagtgccctggggtcacaggggaggggatagagtgtggaatctgctcagggctgggtaaatacaaaggtcagtcatggatcaaaaccacagatggggaaactgaggcctggcctggtggggcataggtcatttatacaacctgggctggcagtggggaaactgaggctggctggggttggggagcagggccagttaaattgccatcgggaaattgaagcctagtctggactggagagggcagtcatggaacgaggaccgcagatggagatggcaaagcttttgagggatggggatacttaaccatgaccacagatggggacagccaggctcagaagcagggagggagttggacggtggcccaaggtccaggcagataaggtacttccggggttgagtggccaggtgggagctagggctgcaggaggcagctcctccctgggactggagccacaggaggggtgttagggcagagcaggactgggacacacagacagaggccactgctggggagcccttgtgggtctgagggcattctggaagcttctaaaaagaccaaggaacccaagtctcaggccacaaatggagagagcctcctgcaaggcctcagggagaagaaagctctgctcacttcactcagttctctccctttaagggagagaattccctaaagatcctgtaaagtgagatgtctccctctatgcctttacttggtggggaaattttagaccgatgctgtacagttgaacaatgatggaaatgttctatatctgcactgtccagcatgggagccactagccacttgtggctattgattgagaccttgaaatgtggctagtgtgactgccgaactgaattctcaatcttatttaattttaactaatttatatttaaatagccccaggtggctagtggctgctgaattggacagtgcatatagatcattgcagcctgggtttcacatagccaggcccctggagatccctcgcccattctcctgccattggctgaggtgtgggtggggagatgggggcaggtctatggggagtgagactggacatgggtgataagcgcaggtaggaggagagcataaggaaggggaggatcaccccaccgagggtgcctttcacccaggaagggtctgccttgcctcaggacactggacaggaccctgagaaggtatggcctgccaacctgtggccagtggaggggctgaaggtaaggcaggacaggagcagggccagttgcagagagccggctgggtccttggggctgtgagccatggaagatttctgggcagggcagggtctgaggggtaggggctccagaacattctgaggaaaccacacggagccccagctcagcctgctgccacactgtacaggagtgaccgcctgaccttttctctgtggcgccagacaggctccttcatggggctcttgccctgatatgggatttcctgttagatgctggtgggtgggagcacagtgagaatggggatcttatactctgagccctggggattccctggagcccacctacctaccgatacgtatggatgactcccagtgtgtgcctagctcttgggaagcatgagaggggagatagaggagtggaagacccaggcctttccccgcaggaaccacatttgagctggcgagaggaggaccttgtattgggacagctgtgagcagatgggcaggaaggacattgcaggcaggaggcccagtgtgagccaaggtgcagggtgaggaggaggaacaggcatgagtgggaggctgaggggctgcgtcctgccaggaggaggggctgcagggagccaggtccagggtcagggagccaggtgtgcgcaggtatggagcaaggcctgagggggctttctgctggtcagacgcctgagacgggtctcgtgctgagcctgctttgttggctgcctcccttctctgggtgagtggtgagactgttgtcttcaattgctctttaacctggaaaacagaggccaggtgagggaggcctggaatagcctccccttctgcccagttttctttagctctgcttcctgctttttaagtctccccaatcctgccactactacccacccccatgactctggttcccagaggccaaaggtgttatcagcagtgaaggcatctggactttctctctgtgtgggtgagggcgctggccttgggtgggggtcccatggctcaggcttcctgttttcattcctgacccaggcagctgcagctgcaccctgtgtgcggccgtgtgggtcaccaggggctgcaggcagagggattaagccgtgctatcctctgtcccccacatggccctgggctcatgtgtcccactcctcaaagcctgcagcccaggctggcacatgttacatctgtgggccctgcaggtggctaggaggcccctgggcactcagagtgggtgggcacagggagggacaggtggacttcagctagaaccgtctaggagccaggacagatggatgaggatggctcaggatggaggtatggcaggggcagagcctggatcctgctgctgggaggcacagcatgagcctgactggaagaactggctcctggccaggccatggagggcacattggaagcgggggtagacagggcctggcatctccctgaagcttggaaggctgggtgtgaggggagggccctccccttggctcccctaagggcagaatgatgtaatctctcagaaccctgcaggagaccctccagtttgcctcttgggactggggaaggcagagtcttcctgtaccccctgccaaggggctccctgaagtcaggacacacacagctgcacacagggcacgaccctgtctcctctcccatgcagggcttctccctctgtcttcggccctctgcccatagaccccagggctggggctaactgagggtggttccagtctcttgaatgttcaggagaggggcctggtggctcttgtggctttatcgggtcaggacagacccaaagtccaatacagtcagaagggtgcatggcccttctctgtcatgggccccacactccagagtggtctgtccgcatctctaagagccttgccctgctccagtcctctccctggggccctgcaccccccatcaccgagagagcaggcctggggtcccaggtgccttttccgccctaaagtctgtctttctctcactctctgtctctccctgtgtgtctccactgtgcctgcaatgactgtgtctcatgctctgtctccccctcagtttctgtcttcctttctcctttttgtcccccacttgtccaacctcctgcccctctcctttccttctggactcaaggcctgagctccggccctggctctgtgtctccaagccatgcccctctctactgtggccttggccatgtcagggtcagggactgacctcacagcattctctccctctctcctccaccatccccctctcgcagtctccatcgaggacattcaggaggtgcgaatggggcaccgcacggagggtctggagaagttcgcccgtgatgtgcccgaggaccgctgcttctccattgtcttcaaggaccagcgcaatacactagacctcatcgccccatcgccagctgatgcccagcactgggtgctggggctgcacaagatcatccaccactcaggctccatggaccagcgtcagaagctacagcagtatccttttggtggcagtgggtccaggcctggcttgtggacactggctgtggttatccccagggcaacttgggtatggaagctggtttaggtactttgggctgccataacaaaatatcataggtggcttaaacagcataatttattttctcacagtgtggaggctggaagtccaaggtcagggagccagtatggtcagagcctggtgagggctctctcctttgctggcagatgactgtcttcttgctgtgtcctcacatggtggggagagagagactaggttctctgccatctcttcttgtaagggcactaatcccagcgcgggtgccccaccctcatgacctcatctcaaccaagttatcttccaaaggccttatctccaaatatcatcacgttgggcattagggcttcaacatataaattttggtgagttggggggtgggggtatacaattcagaagggaaggagggaagatacatgaagccctctttggtctagtctgaccagagcccaaatagctctgctgctccctgatactccctgtgtccccgtctgtcaccagcatggagttgggggtctggggagcctgaggggagcagcctgctgcaatgggagaccagtcttggatgttttaatcatgttttctagagttaccacacgatttccctctgggagttgggaggccatggtaccctcctgtgccattctttggggagtgatcaagttcccctgggcctggtgtgtaggccagcctgtgagctcaaaacaaattaacttcaacatttagttacacaatgacacactggtttatgattcgaagtggtcgggcttctggcatgtatggattagggtggagccagctctctccattttttatggcagctttattgaggtgtaattcacataccatataattaacccttttaaagtgttgaacctgattcagtgctttttagtatattcacagaattgtgcagccatcatcacaatcaattttagcacatttccatcaccccagaaagaaacactgtaccccttagcagtcagtccccatttcacctcaacccccagccctagacagccactaatctactttctgcctctatacactttcctgttctgggcatgttacagaaacggaatcatggagtcttttgtgactggcttctttcatttagcgtgatgtttgcaatgttcatccatgttgtagcctgtgtcagtacttcattccttccaattgtctagtaatatgctactgtatggatagaccacatgtatctcttcaccagatgatggacatttagattgtttccactttggggcttttatgaagaatgctgatattaacattcgtgtataagttttggtgtgtatatatgttttcatttctcttggagtagaatcgctgggtcatatggtaactatgtttaaccttttgagaaactgccaaactgttttccaaacaggctgcatcaatttacattcccaccagcagtatacgagggtttcagttttccatgtccttgacactacatttgtcttgattatagacaccctgtgggtatgaagtggtatctcattgtgattttgatttgcatttccctaatgattagtgatattgagcatttttccatgtacgtttatatatcttctttggagaaatatctattcaggtcctttgcccattttttggatcatttgtctttattattgagttgtaagagctctttatatattatagatacaagtcttttatgagatttatgcttgcaaataatttctccattctgtgggttgtcttttctctttcttgatgggtttttttaggctagaaaagtgaaacagtgagagtggagaaggaacaaagaaatctggaactgcttgtgatcaattagttgtaaacacccctgcactcagatcagcctcttgatattctttgaagcacaaaagtttttggttttgatgaagtgtaattcatatactttatttcttttgttgtttattttttttggcatcatattcacgaaagctttgcctaatccaaaattctgggattacagcagtgagccactgcgctgggcctgagttctcaattttattctgtttgtctatatgtctgtccttgcaccactaccacaatattttgctttctgtaactttgtagtaagttttgaaataaggaaatgtgagttctctaaatttgtttctgttttttttttcaatattgctttagctattctgggtcccttgaatttctatacgaattttaggattagcctgtcaatttctgcaaagaagccagcaagattttgatagggattatattgaatgtatagatcaatttggagcatattcccagtataataatgtcaagtcttctgatccatgaacatgtaattctttccatttatttatgtcttctttcattttttttcaacagtgccttatggttttccaggttttgcacttaaacaatttctttaaaagcattttattcactttgctgctactgtaaatggaaatgttttcttaatttcactttcaaatttttcattgctggtgtatgtccactccttaggggacacattttgagccctgttaatttccttttctgtgtgcttttgagcatttgaaagacttttaagtgttatttctcaatggcacatctgcctgattgtgagctttttaaaaagcccaattctatggcatttttgtcataatcccacctttggcagagccttgaccttggacagtctcatgccctctgcagagtcctgctgcctagaccttaagatcataaagccattctaatttatagtgcatacactcagtggaacattatacagtcattaaagctgtttatggagactacactaacacagggaaataattatgatataatgttacacagaaaatggactacaaatgtatgatttccattatttttggcagatgcatcattaggaaaattaaaatccgggcggggcgcagtggctcacgcctgtaatcccagcactttgggaggccgaggcaggtggatcaccaggtcaggagatcgagaccatcctggctaacacggtgaaaccccgtctctactaaaaaatacaaaaaattagccgggcgtggtggtgggcgcctgtagtcccagctacttgggaggttgaggcaggagaatggcgtgatcccgggaggcggagcttgcagtgagccaagattgcgccactgcactccagcctgggtgacagagctagactccgtctcaggaaaaaaaaaaaaaaaaaaagaaaattaaaatccagaaaggctgggctcggcggctcacacctctagtcctagcactttgggaggctgaggcaggtggatcgcttgagcttaggagttcgagactagtctgggcaacgtggcaaaaccccatctctccaaaaaatacaaaaattagccaggcatagtgacatgcacctgtagttccagctacttagcagactgaggtgggaagattgtttgaggctgcagtgggccataatcatgccactgcactcaagcctgggcaacagagcgagaccctgtctcaaaaaaccaaataaataaataaattgcagaaaaaaatattaggaggaaaatgcaaatatcagaagcttctggaggaggtaggtagatctttaaaacttcattataggccgggtgccgtggctcacacgtgtaatccccgcactttgggaggccaaggcgggtggatcacttgaggtgaggagttcaagaccagcatagccaacatgctgaaaccccgtctcaactaaaaatacaaaaattagctgggcatggtagcatacgcctgtaatcccagctcctcaggaggctagggcaggagaattgcttgaatccagagggcagaggttgcagtgagccgagatcgcgccagtgtactctagcctgggcaacagagcaagactccgtctccaaaaaaaaaaaaaaaaacttcattctaacatatatatgttttccaaattgtatatatatgggtatagatgtggaaaagaataattatgacagaaagccaggtgaaaaaagtcaagtttagaatggtccagccaagcacgagattcgtgtgctgaaggctattcagcaggtggaatatccatttctttagtgttggatatttattattatatattatatgttgaaaaccagtccagatggctcatatctgtaatcccagcactttgggaggtcaaagcaggaggattgcttgggcctaggagtttgagactagcctgggcaacatagggagaccctgtctctacccaaaaaaaaaaaaaaaagccaggcgtggtggtgcggtgcacacctgtagtgggaggatcacttgagcctgagaggtctaggctgcaatgagctgtgattgtgccactgcactctaatctgggcgacagagtgagatcttgtcaaaaaaaaaaaaaaaagaaaaggaaaaccagaaggatatactttggaatgttgatagtatttatccctaggtgatagactacgggagatttgtttgattgtttacttttctgcattttctaaattgtctacagtgggcccttttgtagtaagaaaagaaatgttttaaaaattttgaaaggtttgaaaaccagcaaatagaaaaagaccccttaacattttcctctgaagaggccactgaaacatggatgtgtagtaagtcaggcctgcagggagctgtggctataggtggcttcagctggagccatccatggctctggctgggaccttggtaggttccagggttcctgggttctttccttacttcttgcccagctggattcactcctgcttgcgaaaagctgacaaaaacaaggacaacaagatgagcttcaaggagctgcagaacttcctgaaggagctcaacatccaggtggacgacagctatgcccggaagatcttcagggtgaggcaggaagtgggggctggggctgcctgtccatggggcccttgaccccggcccaaggcctgctctgagcccactcggctgtcctggctctgcaggagtgtgaccactcccagacagactccctggaggacgaggagattgaggccttctacaagatgctgacccagcgggtggagatcgaccgcaccttcgccgaggccgcgggctcaggggagactctgtcggtggatcagttagtgacgttcctgcagcaccagcagcgggaggagggcggcagggcctgcgctggccctctccctcattgagcgctacgagcccagcgagactggtgagagcctgaccagggcctgctacctgcagtcgcagggccgcactgggctgggagacccctggggagactgcagccagaaagaagggaaccggagggaaggggctgcctcagccagccccggggccctgctccacactttctggtcctatgaaagccggcagatgagagacagggctctggcatccctacccttctctggtcctgtttccctcttggcacctccttcagggggctttgaggaccccttcttcaagaaacaagagagatggctgaaaagcagatgctactcctgcttcttttttttttactcattcttggcccagctttgagatgtgatagagcagagaagatgggtccctgccctggagggggctccagtctggaggtacagagaacggggagatgacaccctgtcctcaggggtcttagagtgtgcagacaggggaggaggaggagacagggccccactctggagtagccacagtctggtcgagagcctcagacttatcctaattccaagagctctggaagactggctcaggacaggcaggcaagcgggttcagagggctcctctgtccagatgggtgggcagccaggagcgcctgctggaggctggctctgacgggcagtggcctcctccctcccagccaaggcgcagcggcagatgaccaaggacggcttcctcatgtacttactgtcggctgacggcagcgccttcagcctggcacaccgccgtgtctaccaggacatgggccagccacttagccactacctggtgtcctcttcacacaacacctacctgctggaggaccagctagccgggcccagcagcactgaagcctacatccggtgctgctcagggagccttgggtcgggagtctgggtgggacccgggacaggacctggagggtcctagccaccaccctccccgcagggcactgtgcaaaggctgccgatgcctggagcttgactgctgggacgggcccaaccaggaaccaatcatctaccacggctatactttcacttccaagatcctcttctgcgatgtgctcagggccatccgggactatgccttcaaggtgggagtgcccctggcaggtgaggagtgggatgctaggggtggcccaccactcctaatgtgcccttgggcctccaggcgtccccctaccctgtcatcctatccctggagaaccactgcacactggagcagcagcgcgtgatggcgcggcacctgcatgccatcctgggccccatgctgttgaaccgaccactggatggggtcaccaacagcctgccctcccctgaggtgtgtggtggggatgggggatccctgggggagggtggggagcctagccggggcgctaggtgtgtcttgaccagttgcccctccccacctagcaactgaaggggaagatcctgctgaaggggaagaagctcggggggctcctgccccctggaggggagggtggccctgaggccactgtggtgtcagacgaagacgaggctgctgagatggaggatgaggcagtgaggagccgtgtgcagcacaagcccaaggtttgagggggagctgtggggtggggcagcccgggccttccccatcccctcacccgtgggaggtctgccttgtctcagttctctgtggctgccactcagaccctctgccccgctctctctgtctgtctccctctgtctctctgcgcctgggtttctggctttctcagtgcctaccctaccccaaccactgaatctaacccgggcctccccgtgttccccaggaggacaagctcaggctagcacaggagctctctgacatggtcatttactgcaagagtgtccactttgggggcttctccagtcctggcacccctggacaggccttctacgagatggcgtccttctctgagaaccgtgcccttcgactgctccaagaatcaggtgaggcctggctccccaccactcccctgctctgttacagagagaattggcagggcagggcttgggcctcaccaggaggcctccactgctgaccgaaccacacctcccctcaggaaacggctttgtccgccacaacgtggggcacctgagcagaatctacccggctggatggagaacagactcctccaactacagccccgtggagatgtggaatgggggctgccagatcggtatgggctggctggggctggaggaggcctggaggagggtttcagtcccaaggccgggggcctggagcctcgaaggccatgcagtggagctctgaggacccaagcagggtcaaatgcaggggcttgtggagctggtaatatcagtctggaaatatctgcccaccagcatgtcacagtgtctgaaacctcattagcacactagtcctttgaattctcacaccaggaatggaaggtgtggttagcatggtgggtcactgagggtggcaggagggcagcaggcattggagtgatgctgggccctgctaactcaccatgtgaccctaggccttagtgtaccctgagcaggctgtgctctagggccccagggccagcccacagcctgtgactgctctgtcctgcctgtagtggccctgaatttccagacacctgggccagagatggacgtgtaccagggccgcttccaggacaacggggcctgtgggtacgtgctgaagcccgccttcctgcgagaccccaacggcacctttaacccccgcgccctggctcaggggccctggtgggcacggaagcggctcaacatcagggtacgctggacctaggagggacaggtgcccacggacctcccttccccgctaccactcctgaactgtccattgtcctctgcctttcctcaggtcatttcggggcagcagctgccaaaagtcaacaagaataagaattcaattgtggaccccaaagtgacagtggagatccatggcgtgagccgggacgtggccagccgccagactgctgtcatcaccaacaatggtaggtgctgggcctgggctgggctactagggctggtgtccatgctgctgatatggtgcctgtccccctaggtttcaacccatggtgggacacggagtttgcgtttgaggtagttgtgcctgaccttgccctcatccgcttcttggtggaagattatgatgcctcctccaagaatgacttcattggccagagtaccatccccttgaacagcctcaagcaaggtgagtgtcaagagaaggggatggccaaggtggtgggaagcagggcctggcgtctcttgggctggggctggctgtcccttgacgcatccaccccccctccgccgccgaatgaccagaactctctctgtgttccctcctgcctgtccacccaccaggataccgccatgtccacctcatgtctaagaacggggaccagcatccatcagccaccctctttgtgaagatctccctccaggactaggctggaggaagccagtggggtcccccctgagtgggctgggccctctgtccacatgtggggacagggctggtgtggctgctcccagcctcttgctcagagctaggcccccaaattgccttcagccctaacatagtgtctgctgctgcctccctggggaccaggagctagcccagtccctggagctgtccttcattccgttaggaataacactgcagccctctccaccctccggccagcgagtggtcaaggatttttataaaaatcacgataagattaagccttgtggtctctttacctggatgccagaaaaatcccctgtgaagcgtgtgtgtgtgtgtgtgtgtgtgtgtgtgtgtgtgtgtgtgtgtgtgtgtgtgtgtgtgtccccatgtcctagagtgctggagccctagcacctcactctccaccttccttgcacatagttgagtagggcaggggtatctggagagaccaacgagaaataaacccctctgtggggtggcactgagagctcacacccgccagccctggaggccccttcccctgagaggtggacctgctgagtggcccgggcttgaaagcacgcataccacagctcgtatgggctgcctgcttttactgacacgcagaggatgaccaaaagcctctgaggggagtggaagcagggcctccccagcattgtaggtatgttggggtccaggggataggggcagtcgagagggcttgggttcagaagaagcccagctgctttttctcctgccgctgcctccacgtggccatgctgtagaattcctccttggatttcccaaagatatcttggaagtcagagtctgagagatagaactgggcaggggagagagggggaggtacagggtagggtgtcatctgagcccagaatcctgccccactcagtagtgtcagtcatccagggcttgggactcccgcatctgtttgcccaccaccccagctagaagacacatctcccggggcagttgcccactgcccgccaccagtggatcctgccttgggctcctccagctcagtgtcagatgcactagtgctggggcagtgagggggtgcccacctccctgcgggcagggtccacgccctctggcaggtcctcaacagcctggtgcatcagttgttcccggcgcaggcccccgttgatcgtggcgctggtgctgctgacggagctgctggttctgctgccagccgacttggggcttcgcaccagatcattctctgagctgtcctgggagcccttgagggcctgcagggccacggcacctgccctgccattgcccggccatctggatagccgcaagttgttgacttcctgtccagagaggagcctcaggctggggaagatggggaatcagtagcccacagggaggctgcactgaacccacaggcctcttacctccaactgcagcccctcccacttacaagggcctggcacttcccctgcccatcaggaccatgctgtcggagcccaggccactgtggggaaggctaggggccccaggactcactgctgttatctcagagatggttgatgctgctgccgggctgccatccaccacttccttgtgggacgggtggctctggagcaagaatcggggcaagtatcagggccagggcaggagaagggggcaccaatgggacacatgaggggcctgaggacaagaccaggtctctcgcacacactggcaatccccagccagggcagtgcctcctcattccattggcccaggtcaggttcctctccccacaaattagggtagggctgggggtttcaggcctcactcacagtccacttgtaggggtcccaagtgaagaaccatccaatgaaggtgggaggctcatggccctgcttgaccagcacgatgggtgtggccgggctcctccctgctgggtgagtcttcaggtactcctggccccaggccaccgcctccttccactcacttgcagcttccccaagccacaggaagatctgagccacagaggggacctggccttgggcaggtggaggggctgcccagagctgaccccttcctgtccactccctgtccagttgtcccagacagaaccccacatacacatccctggccaagcagacacacccagcaagcggctgtacccacacacccgtgaacacacgagaaggtcacaggaatgcatgcatacatgcacacacacgttcaatccacacattttttttttcttgcatgatttacctggagatcaatccacaaatacttat

SEQ ID NO: 16853 - DNA, 93920 bp, Human; identical to SEQ ID NO: 12461

SEQ ID NO: 16854 - DNA, 40964 bp, Human
ggaagttacagtgagctatgattattccactgtactccagcctggatgacagagcgagatcctgcctcagaaacaaaaaccaaaaaacaaacaacaacaaaaacaacaacaacgaaaatctcagaaaactacaggccttattatcaagaaaatgacaggccttattattgagaaaactacttacatttttaaaagctgattttcaaaaaccagattgtgaattaagtgatgctgaataggggaaaaaaagactgataaaccagtgtatctctgaataacccactagatcagtgcttgtcaaactttaatgtgttttcaaatcaccctgatgttttgttaaaatgtaagtcatgtctcagtaggtctagaggagggcatttctgcatttctaacaagctccccggtgatgcctagaccattggtcctcacactttgagtagcaagtgattgggctatactctttattctaaattctaaatgtattctatcttctaatgcctatcagccctcttgctggtctggctaattatcaaacttgagcatttaaaactgggggttttcagagattaattgaagtgttaaagacatggaaatataggtcacatatggcttttcatctcttccggaaatatcctatatatccttacttcttttctacctacctaacctatgtgcctaccccttcacttatgttcaaggttctattatacttcaaaaggactctatgcaatcaaagtgatgtccaagacaaatatacagaaatagtatgaggctctaacactttacatctaatggagtggtttgcatcattaattgaggcttactctgtgccaggcactttacctgccttcttcatttaataggataggagcaggaactcttagaggttcatttcttgttcaaggatatacatctcatctctggcttatatcacagtggactcttttattcactatcctaatcattataattttgtttggtgacaacaattctaaatgcagaaaagttaaggctctttattctgtgactaaaggctttgtattttctaaagatttgtggagctttgctgccattatttcaataattttataaagatcctaggtggtaaataggcctggctttttttctttttgaaatcttctccgtcttcttcttcattagcagtgcaacttcttgtggcatatggtacccaagatcttgggaaaaggattgatcaagtaaagggaaacgatagagagagtgtgctctacaactgagatcatgctccttgtgaaagacagggtagggaaatttcttattgctccctggttcttaagaaatgagagctaacaatgacatccagttttaaaagaaataaaatctgaattgtacttttaaattttataagccagagttaaaccaatagattgtaactcctgctaatttgatagtagctccagataatgaggaagtgacagggaatgctaatttcatttggtaagagataaaactgaaattattaatgtctccacggaaatgctaaatgcctccttacaagtagggtccggctaattgtctgtcttccaacaagccagatttgttggtgtttttccagacaatgttgtgtagttttcggtttggttcgatcccctttcttgtgatcaaagaaagtgattcaaatgtttaatgagtcttgatttggattggagacttgcagaacggctagcctcacagccccaaggctggctttccctaaggtaggtttcctatgcaccgatactggcaaggcgctttggctggaaactctggaaggaagccaaaggaaagtgaagttcctggcgctagcgcgtgtcctgctcagagagcccggcgctagctcattcttcgtgcagttattggctgggactctgtgtgccgctgtcggccaatgaagacgctggagatcgggcccctgcccgtcccctttctgcgccccgggatgaggcagagactgaacagccggcgagcaaatcaacggcatccagaaagccatgtcggactcggcgcccagcgcccaagcgctaacccgctgaaagtttctcagcgaaatctcagggacgatctggaccccgctgagaggaactgcttttgagtgagatggtcccagaggcctggaggagcggactggtaagcaccgggagggtagtgggagttttgcttctgcttggtgccttgaacaaggcttccacggtcattcactatgagatcccggaggaaagagagaagggtttcgctgtgggcaacgtggtcgcgaaccttggtttggatctcggtagcctctcagcccgcaggttccgggtggtgtctggagctagccgaagattctttgaggtgaaccgggagaccggagagatgtttgtgaacgaccgtctggatcgagaggagctgtgtgggacactgccctcttgcactgtaactctggagttggtagtggagaacccgctggagctgttcagcgtggaagtggtgatccaggacatcaacgacaacaatcctgctttccctacccaggaaatgaaattggagattagcgaggccgtggctccggggacgcgctttccgctcgagagcgcgcacgatcccgatgtgggaagcaactctttacaaacctatgagctgagccgaaatgaatactttgcgcttcgcgtgcagacgcgggaggacagcaccaagtacgcggagctggtgttggagcgcgccctggaccgagaacgggagcctagtctccagttagtgctgacggcgttggacggagggaccccagctctctccgccagcctgcctattcacatcaaggtgctggacgcgaatgacaatgcgcctgtcttcaaccagtccttgtaccgggcgcgcgtcctggaggatgcaccctccggcacgcgcgtggtacaagtccttgcaacggatctggatgaaggccccaacggtgaaattatttactccttcggcagccacaaccgcgccggcgtgcggcaactattcgccttagaccttgtaaccgggatgctgacaatcaagggtcggctggacttcgaggacaccaaactccatgagatttacatccaggccaaagacaagggcgccaatcccgaaggagcacattgcaaagtgttggtggaggttgtggatgtgaatgacaacgccccggagatcacagtcacctccgtgtacagcccagtacccgaggatgcccctctggggactgtcatcgctttgctcagtgtgactgacctggatgctggcgagaacgggctggtgacctgcgaagttccaccgggtctccctttcagccttacttcttccctcaagaattacttcactttgaaaaccagtgcagacctggatcgggagactgtgccagaatacaacctcagcatcaccgcccgagacgccggaaccccttccctctcagcccttacaatagtgcgtgttcaagtgtccgacatcaatgacaaccctccacaatcttctcaatcttcctacgacgtttacattgaagaaaacaacctccccggggctccaatactaaacctaagtgtctgggaccccgacgccccgcagaatgctcggctttctttctttctcttggagcaaggagctgaaaccgggctagtgggtcgctatttcacaataaatcgtgacaatggcatagtgtcatccttagtgcccctagactatgaggatcggcgggaatttgaattaacagctcatatcagcgatgggggcaccccggtcctagccaccaacatcagcgtgaacatatttgtcactgatcgcaatgacaatgccccccaggtcctatatcctcggccaggtgggagctcggtggagatgctgcctcgaggtacctcagctggccacctagtgtcacgggtggtaggctgggacgcggatgcagggcacaatgcctggctctcctacagtctcttgggatcccctaaccagagcctttttgccatagggctgcacactggtcaaatcagtactgcccgtccagtccaagacacagattcacccaggcagactctcacggtcttgatcaaagacaatggggagccttcgctctccaccactgctaccctcactgtgtcagtaaccgaggactctcctgaagcccgagccgagttcccctctggctctgccccccgggagcagaaaaaaaatctcaccttttatctacttctttctctaatcctggtttctgtggggtttgtggtcacagtgttcggagtaatcatattcaaagtttacaagtggaagcagtctagagacctataccgagccccggtgagctcactgtaccgaacaccagggccctccttgcacgcggacgccgtgcggggaggcctgatgtcgccgcacctttaccatcaggtgtatctcaccacggactcccgccgcagcgacccgctgctgaagaaacctggtgcagccagtccactggccagccgccagaacacgctgcggagctgtgatccggtgttctataggcaggtgttgggtgcagagagcgcccctcccggacaggtaaggtttagcaagtcatgcttgaccctgttagtgcttttttattcctacatcatattgaggaaggaatggagctgtttttttagtgatgaagatgttttcctggtgatgcattcacactttcaactggcccttcctagatcaaagttagtgcctttgtgagatggtggcctgccagagtgtggtttgtggtcccatttcagggggaagatacttgactcatctgtggacctaattcacatcctcagcactcttttgctatcacaactaaccaatcttgctaagggatggttaagctaaaacacaagatctcagcgatcagagtttagcttggtatcatttacattaggaataagctgctggatacctctaaccagtggcagcttctaggaatacaaaaactacctcattcctccacctttcaagtgattgtgacatttgtattaaaactaatagctttttgataattttcctttgtttatacagatcgtgtacctcattctcagataattttttatgaatgaaatgaaattccaggcatcctttaaattttatttcaagcattctactggaaatgatgtgcaccctgcttacaaaatatttttaccttataacagtaatgcatgtttgctagaaaattcagaaaatacagaaaagtatttaaaaaattaaaactataatctccaaacccaaagataaccatttttaattataaaagtaataatttatttcaaaaataaatctaggcaacccaagaaaacataaagtagccagactcagtggtgtgcacctgtagttcttgctgctcagtgcctgaggtgggaggattgcttgagcccaggagttctgggctgtggtgcactatgctgatcaattgatcaatccactgtctgcactaagttcagcatgaatacagtgacctcttgggagggcaggaccatcaggttgcctaaagaggggtgaactggcccaggttggaagtggagaaggtcaaaactgctgtgctatccagtagtgggatgacatctgtgaatagccactgcactccagcctaggcaatatagggaaaccatgtctctttaacaataacaacaacaacaacaacaatcccagaaactacaaaaggagagtctttttggtgcctccagtgttagtccctgtccttccagccttatttttcttaagtatatgcacaatgtgaaaggtagataaattcatatccttagacaggtaaagcattcattaattcagggtggtatgcaaggatactatccaaggcatggtatccatgcaaggtgactgcaaggcctttgccctggagagaaccctatacatactctcaactgtaggagaaacactgttattttgttactcagtgcatcattgctatcaactcttggatttggcagttagtcaaatgaggttctaccatttaccaactaggagtctgtggccaagttactcaatctcctttctaagcctcttcctcatatgcaaaaagggaataataagtgttttataagattcatgcatgatataatgtatgcaaagtgtttagcatggtgcctggcatatcataactgttaaacaattattagccagctcctagcattttgggaggctgaggcaggcggattgcttgaggccagcagttcaagaccagcctgagcgacatagtgagatcctgtctctacaaaaaaaaaaaaaaatgtgttttcattagctgggtgtgttggcatgcacctgtggtaccagctacttgggaggctgaagtgggagaattgcttgagcctgggaggttgaagctacagtcagctgtgattgcaccactacacttcaaccatggcaatagagtgagaccctgtctcaaaaaaaaaaattatcagctattactataattatttttattagttcctcactcacctaaaatctcaaacacaccttagaaatacacatatgagaacaaccaaaaatgacaaagtagaagcacatatgaaaaggctaagaaagcatgaaagccagcaagaaataactgccgctcttctggtcagcctggaaagcaactggcattttccctagaacaatgttttcaaacttggttgcacattaaaatcacctagagaccttttaaaaattctgaaacccaggccacaccccgacaaatgaaagcacagtctctgggggtgggacataggcatcattttttgaaggtccccacttgatcctaatgtgcagacaaatttgaaaaccacagctttgggaggctgaggtgggtggatcataagatcaggagtttgagaccagcctggccaatatggtgaaaccccgtctctactaaaaatgcaaacattagctgggcatggtggcgcatacctgtagtcccagctactctagaggctgaggcggaagcatcagtgagggagaatcagtgaacccaggatgtggaagtttcagtgagcccagatcacaccactgcactccagcctgggcgacagagcgagactccacctcaaaaacaaaaagaaagaaagaaaaaagaaaagcagtactctggaacctaccaatccatcatttagcatatttgtgaagtaaagtgttattctggtatttgcagaaccagaatccagctttattgggccaggcccaatttttttaaaaaacatggtaaggtctcccagccttaaagtattacatagcatagctctaaaagatcactgtaggaagacataaaatggtatttcagtcatctaagggaaaaaccttcctaaagcactagcccctggacaactattatttaaacatctacagctgttcaatagatattgggttctttttggagggatgtgacaaaattcttgtataattagattgtgatgatgattgtatcagtttagtacatgtaaatacactgaaaaccattggattatacactttaaatatgtgatttgcatggtatgtgaattatgtctcagtaaaaatctagagatggggctgggctcagtggctcacgcctgtaatcccagtacttagggaggctgaggccagcggatcacctgaggccaggagttcaagaccggcctggccaacatggtgaaacttcatctctactaataatacaaaaatcaggccgggcctggtggctcacgcctgtaatcccagcactttgggaggcggaggcgggcggatcacgaggtcaggagtccaagaccagcctggccaacatggtgaaaccccgtctctactaaaaatacaaaaattcaccaggcgtggtggctgaggcaggagaatcgcttgatggtggaggttgcagtgagccgagatcgcgccactgcactccagcctgggtgaaagagcgaaactccatctcaaaaaaaaaaaaaaaaaaaaaatcagccagatgtggtggcaggtgcctgtagtcacagctacttgggaggttgaagcaggagaatcgctttatctcaggaagcagaggttgcagtgagccaagatcatgctgttgcattccagcctgggcaacaagaacaaaactcactccatctcaaaaaaaaaaaaaaaatatctagagatgggagaatcatatggctggcataaaaaggtcaagtcaaagatatgtaagattaaggctttacgatgctccagttctagtaaaacagaccaggtacttgttttggtgtgaaattgccaatataagtatagtactgtacatattagttgtttagcttaggtaagtcttttaatctctttaaactccagtttcctcatctataaaataaagagaatatctactttgcaaacttgttgtgagagtgaaaagtaatgcatataaagtccctgtatggagcaagtactcaataactatttgttgaactaaaaatgataatactgatattcaccatttattagcatccctatgtgccagacactgtaaacaattaaaagttatcattctggtacccagagtacagtatgagacagacatgcaaaaaaaaaaaaaaaaaaagataatggagatctgcatagcataagatgcagtgggaccaaacgggaaaaaacacctaaatgagcctggagaaaggaagaaatgatagaggtggtgatgcttgagctatgatctaaaggttgagtagtagcttgtcagacagtaaaggggaaaggacagggcagggaggggccattgcaagaaattccatgcagagggattatggtatttcattatcactgaaccttaaactgtgtgtgtggccgggtacggtggctcatgcctgtaatcctagcactttgggaggccaaggtgggcagatcacttgaggtcaggagtttgaaaccagcctggccaacatggtgaaacctcatctctattaaaaatacaaaaaattagccaggtgtggttgtgggtgcctgtaattccagctacttgagcagctacttgagaggtcgaggcaggagaattgcttgaacccgggaggcagaggttgcaatgagctggtgtcaggccactgcactccagcatgggcaacagagagagactccatctcaaaaaaaaagtgtgcgtgtaaaacagacagtctttgtaggagatgaggtgaagcaagtaggcaggagttagatcctgagttacctttgggccaagccaaggagtttttattttattccatatagatgacagtcactgcagaaatttgaactgatatgcatatatcatgaggtttttttgttttagaaatattattctgtcagtcataagtgaagggactggggacattgggactggaggcaaagagatcttatctctttgcaatagtttgaaagctattgcaatatttgaagagaagattgataaatgcttgaaccagcacagtggcagtacagatggagggagctgactacaataaaatcatcaggacttgttgattgacatgatataggaagtgagggacagggatgagtcaaggctgatccccctagatcctgactaaggaagctgggtggttgacagtgccattcacagagacagtgaattctggcataaacacctaataggtcaggctggtttacacctccatcattcccatgggagaaggtatagaggggtgtgtgtttgtgtgtgtgtgtgtgtgtgtaaaagaacacagaaagccagattcctctttttgacaccagaatattggttcccaccatagtcaaaaggatattcctgaggatcgaggcttggaaaaatattggggaaggataagaactccagttgttgctgctttttttggcagccagtgtaacctaggtaaggacttggttgaattaagaaatttcatgtccagatcaggatggatttttctatttctctgagctctggtgtgtttcccactcagattgcaggtcgtaggtacctacggtgtgaattgtgttgtgtttctgtgcttgtgcaagggagtagctaggttgctgggaggtctggatgagggtgggggtggggtgagatcaagtctccagctccaagaggtcccctggggctaagtgaaaagcttgctcttttgaaatggtcttcgttggtaattaacaaaagatcaagaataccttggtgtcagataaagggaatttgtaggcacaatgctgttggtagctgatctcaatcattcaaggaagctattaaatctatgaacattagcattctgccaggtaaagagatctggtccttagcacctcccagacacactgattctttactgttttgaaacatctccctctcctggcttcctccaccccgcttccatactgtccttgaaatcaatgaatggtaatttagtgtatctagtgtatcactagcaaatgtctgaataagaaaggtttggtttccgctgtgtctcctgttacaatgagaacatgtactgcataaatttaattggctacgttaatgtgtaagccttttctgcaaagagatggatccgtttctgaatattctgcagaagggcagagttttgagtatatggcagtggttctaattagcagttgctccaatacaatcagactgagacggaagctactcatttagaatactggttgatgacaacactggcttgaacaaagtgaccactctccaatggctactctccctctcagtgggccgcaggttgctagggctcaggctgtggctgttttccccgccgaaaaggggcggggtcagtcggtgtgttaggaaaaaaaatgtatatatatatatatgttgtctgcctccccacagagataacaacccgtggaaaaacatgccgttgagcgggaggaaggcgaaaagataggctgggttttttggggggtgggggagcgtggaggatagggtgggctttttcccctccaatgctgcgacgcattaaccctgctgctgttgggacgttctctgctcagcctattggctgagcccgggagccgctgtctgccaatcgggtggtgaaaggcagacaaatctaccccgccaccagcaaaaacggcgcgtaacccttgcggcgccggccgaaccgcgccagagctggcgcggggaaagggagataggtgtctccagctgctgtggctgtttggggcgggtcggcttcatccgcgtctcaggagcaagtagagaattagcgggcggcagcaatgctccgcaaggtgagaagctggacagaaatctggcggtgggctacccttttgttcctcttttaccacctgggttacgtttgtgggcagatccgctacccggtcccagaggagtcacaggaagggacttttgtagggaatgtcgctcaagatttcctgctggatacggacagtctgtcagctcgcaggctgcaggtcgctggagaggtgaaccaaagacacttccgtgtggatttggacagcggagccctgctcatcaagaacccaatcgaccgagaggcactgtgtgggctcagtgccagctgcatcgtgcccctggagtttgtcaccgaaggtcctttggaaatgtaccgagcagaggtagagatcgtagatgtgaatgatcacgccccccgttttccgcggcagcagctggacttggaaattggggaggcagctcctccaggacagcgtttcccgttggaaaaggctcaggatgcagatgtggggagcaattcgattagcagctataggctgagctccaatgaacactttgcactggatgtgaagaagcgcagcgacggcagcctggtcccagagctgctcctggagaagcctttggatcgagagaagcaatcggactaccgcctggtgctgactgctgtcgatggagggaacccgccgagatctggcaccgcagagctccgggtatccgtgctggacgtaaacgacaacgccccagccttccagcaatccagctacaggattagtgtgttggagagcgcaccagcgggcatggtgctcatccagctcaatgcctcagacccggacctgggtcccagtggtaacgtcaccttttatttcagtggtcatacccctgatcgtgtaagaaacctctttagcctgcaccccactactggaaagcttactcttttggggcccctagactttgagagtgagaattactatgaatttgatgtgcgggctcgcgatgggggttctccagccatggagcaacattgcagccttcgagtggatctgctggacgtaaatgacaatgccccttacatcacagtgacctcagagcttggaaccctccccgagagtgcagaacctggcactgtggtggcacttatcagtgtgcaggatccagactcagggtcaaacggagatgtgagcctccgcattcctgaccacttgccatttgccctcaagtctgccttcaggaaccagttctccctggtgactgctggacccttggatcgagaggccaaatctagctatgacatcatggtcactgcttctgatgctgggaaccctcctctcagtacccacagaactattttcctcaatatttcagatgtgaatgataatccaccctctttctttcagaggtcacatgaggtgtttgttcctgagaacaatcgcccaggggacctgctttgctcccttgcagcctctgacccagactctggcttgaatgcgcttatctcctactcactcctggagcccaggaatcgagatgtatcagcttcctctttcatctctctgaacccccagacaggagctgttcatgctactcgatcctttgactatgagcaaacccagacactgcagtttgaggtgcaggcccgggatcggggcaacccaccccttagcagcactgtaacagttcgtctatttgtgctggacctcaatgacaatgctccagctgtgctccgtcctcgggcccggcctggttccttatgtccccaagcactgcctccatcagttggtgctggccacctaatcacaaaggtgactgctgtggacttggattcaggttacaatgcttgggtttcctatcagctcctggaggccccagatcccagcctgtttgcagtctctcgatatgctggggaggtgcggacggctgttcctatcccagctgacctcccaccacagaagctggtcattgtggtaaaggatagtggtagtccaccactctctacctctgttactctcttagtgtccttagaggaagacactcatccagttgtcccagatcttcgagaatcttcagctccaagggaaggagaatctcgtctaaccctctacttggctgtgtccctagtggcaatttgctttgtctcctttggctcattcgtggcactactctctaagtgtcttcgtggggcagcctgtggagtcacatgctttcctgctggcacctgtgcctgtctcaccagatctcgaaggagggaggggcttcccccttccaatgggatcctccgaatccagctagggtcagatgaccctatcaagtttgttgatgtgggaggccactctcatggctgtacacccttggcttctgcacccactcggagtgatagcttcatgatggtgaagtcacccagtgcacctatggcaggggagcctgttcgcccaagctgcccaccctctgatcttctctatgggctagaggtgagacctttgcaggctcaacaaatgcttgagggttattctgatccaggcatatggctaggccatgtcctagagagtactggcctctcagtaagtgcccatagtgatgtcaccatttttgtaagaggtaactatgtggtagacgctgtgctttgtaactgtttcgtgaattaaccagagttgtcacagtttagcattgggggcgggtcatgcctatatctgagtaagaaatgaaagtaattggtgatcaagagccaggctgttgtggaagcatgatgatggaatgtgggagcacaggaggctacagtgcacagggtacagtgcaccaggcagtcacttggacaaaggtggctgttttctctactcttcctgaaagaggggatcagattctgaagtaccttaactctaggttaccatttcccaagggattgaggggaaataaaatctttgtctcccagtatctagtacactgtgaagggacctctctatttgaaacatagagacagcagaaagaggagagaactaaaggaatagagaggcacgcatcagagtggtggcatagatcttttggtctgggtcttaggactcatatcaagtccctactggggatttgaactagatgcggtaaattggaaggttggggcgggttggtcatcacctttggaaaaaacagtaagtgaaatcacttatgtcagaaaactggtttacagttggctgattcatagaaacagccaccctgtgcatctttaagttgagttctcctgaatttggtgaaaccatgaaacctagaagccaagccatccatgcttggcctctgaccaccctcctgggtgacctgattcagccccagaaatgttcccctacccaaaaactgtaacactcattccacatttggggtctggggtgtcagaaaagctaagtcccatgtcagctgacattgagatttccgcaaagcattgctggagagtcagggcaagactttacaaggttcttactaatcttttctctcaccttagcagcattcagcaggatgggggagggtgggggaatacatgggctttgcctctcccagaaggacaagattttgctggttcaagcaaagtggtggaagcttctgaagtcatgcaggaagttgctgggacagaacgctgaggagttttgtatcactttgtcttccctgttgagtaccatctgagctgtcaaactttgctgccaagggggctgaatcaacctgcagcacgaagtgagtggggaggtaggaagcttctgtgacacagatttgcagcctgtgttcccaaggtttccaggattgaggaaactccataattggttgagagcacacagactttttggccaatcagactcagagctgaggtgggagatctgctcttccagcccgcctctcctcctccagctccccagctccactcaaattcagctcccctcccccctgcccacccccgccactcggtgactaagaactgctgcaagcaggcaaacctccgagcagtttttaagaggctggaaggagacataagagacttcagctgctgcattccaagccctgggtctaccttggagacaggacagcacagacttactctccacaaagggacttctgggtcatggggcccaagacactcccacagctcgctgggaaatggcaagtgctgtgcatgttgtccttgtgctgctggggctgggtgtctgggcagcttcgttactcagtggtggaggagtctgagccggggacgctggtggggaatgttgctcaggatctgggcttaaagatgacagatctgttgagccggcggctgcaattgggctctgaggagaatgggcgctatttttccctgagcttgatgagtggtgccctggcagtgaatcaaaagattgaccgagaaagcctatgtggagccagcaccagctgcctgctgccagtgcaggtggtgactgaacaccccctggagctaatccgtgtagaggtagagatcctggatctcaatgacaactctcctagctttgccacccctgagcgagagatgcgcatctcagaatcagcagcatctggggcacgattcccactggacagtgcccaggatccggatgtgggcaccaatactgtgagcttttacactctaagccccaacagccacttctctctgaatgtgaagaccctaaaagatgggaagccattcccagagctggtgctagagcagcagctggatcgtgaagcccaggcaagacatcagctggtgcttactgctgtggatggggggaccccagcccgctcagggaccacccttatctctgtcatcgtgctggacatcaatgataatgctccaaccttccaatcctcagttctacgtgtgggaatcccagagaatgcacccattggtactctgctgctccgcctcaatgccactgatccagacgagggcaccaacggccaactagactattcttttggagaccacacatctgaggcagtgcggaacctctttggcctagaccctagcagtggggcaatccatgtgttgggtcccatagactttgaggagtcacgtttctatgaaattcatgcaagagcccgtgaccagggacagcctgccatggagggccactgtgtgattcaagtggatgtgggggatgtcaatgacaatgccccagaggtgctattggcctctttggccaaccctgtcctagagagcacaccagtgggcacagtagtggggttgtttaatgtgcgagaccgggactcaggtagaaatggtgaagtgagccttgatatctctccggacctgccatttcagattaagccttctgagaaccactactcgctgctaaccagccagcctttggaccgggaggccacatcccactatatcatcgagctgctggccagcgatgctggttcaccttccctacacaaacatctcaccatcaggctcaacatttcagatgtcaatgacaatgcaccccgcttcaaccagcagctttacactgcttacatcctagaaaaccggcctccgggctcccttctttgcactgtggctgcctcagatccagacactggggataatgcccgcctcacctactccattgtaggaaatcaggttcagggagccccagcctcctcctttgtgtatgtcaacccagaggatggacggatctttgcccagcgtacctttgactatgaattgctgcagatgctgcagattgtggtgggggttcgagactccggctctcccccattgcatgccaacacatctctgcatgtgtttgtcctagacgagaatgataatgccccagctgtgctgcacccacggccagactgggaacactcagccccccagcgtctccctcgctctgctcctcctggctccttggtcaccaaggtgacagccgtggatgctgatgcaggccacaatgcgtggctctcctactcactgttgccacagtccacagccccaggactgttcctcgtgtctacacacactggtgaggtgcgcacagcccgggccttactggaggatgactctgacacccagcaggtggtggtcctggtgagggacaatggtgacccttcactctcctccacagccacagtgctgctggttctggaggatgaggaccctgaggaaatgcccaaatccagtgacttcctcatacaccctcctgagcgttcagaccttaccctttacctcattgtggctctagcgaccgtcagtctcttatccctagtcaccttcacctttctgtcagctaagtgccttcagggaaacgcagacggggacgggggtggagggcagtgctgcaggcgccaggactcaccctccccggacttctataagcagtccagccccaacctgcaggtgagctcggacggcacgctcaagtacatggaggtgacgctgcggcccacagactcgcagagccactgctacaggacgtgcttttcaccggcctcggacggcagtgacttcacttttctaagacccctcagcgttcagcagcccacagctctggcgctggagcctgacgccatccggtcccgctctaatacgctgcgggagcggagccaggtgaggggctcggcgccgccccgggcgacccctgggggcggcactggagaagccgcccgtcctcataagggattgaacttgcatccactcctctccggccggcttggtcgctggctgcgctccacccgattctcgggatcattggaccgtttgcgcgaaaccagagtggccgattaagggatggggctccgagcaccgggggtggtggcgactgtgggcgaggggaggtgggaccgacccccacccctacactcaaaaaaggccggggcctccttcgagcttccggtgaatttcgggcgatttccgcgggtgtcgggggtcccgggaggaggcagtcacagatccacccctgcagccagcctcctaggcgccggctccggcacgcttcgccggtctgtagatttcctcttcgatttctccccagctcccagcatctgtgacttcactgttaccctccctatccccgcatcacccaaccgcacctgtctgcgggacttaggtgtgcgcgcggggctcatgcgtgtcctccctgctggccacccccacggcccacacaagttgcacgggctcgccacgccccgccaacacgtgcgcggacgcacgcacgcactcctcgcacgtgggcttacgcgaataccagctttcactgccactcgctcgcggccagattcacaggcctgttccggtccactcgcagctcccctctgccgctccctccgccgggctcaggagtactcgtagctgattgtgcgcgcctgagggtcccagatcgcggccgcccaggaccaggcgaggactccggagcctcctctcacctctcccacctgcgccccgggctgggccgggtcgcctggggggcggcctgagcgaggcgcggggccaggagcgctggagcgactgccgctctaagtgccgggcgggcaggactctacgatccttgggccagaggtccggatggtcccgggactccgtctcaagggtcggcgacccctcaacccagaagcctcgagcaggcggacaggcagagctgcccagtggccgaggcgcggcagggctccgcgttgggcgagtgagtgagcctctataggacagcaggactgggactccagtggcaccagcggccccttcctcccgcaggaagtgaaagcctcgagcgccctggctctcaacccccagagatacaggcttttggcgccgtcgtgatcacaatgtgcccagcgatctagggtcagagatttggaggtgaccaaactatctgacactctaacaagtcctgtctcctctggcagatggaaagctataggctctgccagatgccagggtgcccttatgtgtgaggaaactacaatagtaaaaaacacaagtttctccaactccaggagcttttattcaaaatatatcaatgcctaactctgctcctaggactgtattttgaaacacccccaggtgattttgatagctgattgagagaaacttactatataactcctttgagaacctcatctcatttgctcttcccaccattgctgttggctaggtactaacatgcctctcttataacagcttcacagaggtcaagtgacttgctcaagttcacagagcaagtaagagagattctaacccctgtctaactccagaatgtgtgcttttaatttcttggcacttggaactttaaaagcttgaggacaggagaggggagttgcctctgctgggattttgcttctgctgggatggggcaagggtggggttccttcccttttaggaccttacatgtggggaaagtcttctgtggctcctcatttctgagcagtccccgcagcgcaaacttggccagttatccttttggagattgagttcccccagctccgtttcctcctatcacaatcactgcatttccatgtagattctgctgtgtctaagaatacagtggctgagggctggccatccctgtgcccttctccatggcagccccagaatggtgctggtgactcccgatacacctggaatgctaggtttctgggttctgctcatatcactgccacctgtgagccttgagtgagccactggcagttccggagcttccttctccctggagtaatctgagatactcacactctctgcttctgggagcaagtatgagtattaattaccagcccaccccagaaccagtgaggaggtggctctaggagtgctccatgagagtgtgtgatgggataacacaccccctggaaagaccagaagggactcaggaatgaagtggctggccagagccccacaccttcagctaggtgggagatggctacacatcagccccttgggagccctggagacttagttggccctgcttggaggctgtgggagctggatccctccccgctgcatcccttccatttttctccgtctcagacagagcagccttgttctcttctccttagtcacagaccattgtctggcacggagttctaggggtgagaagtgtcccgggacttggatgccccgcaaaggcccaatctggcatgactcctaaattaataatgtatttagctgtgggaagagattcttgcaagccaagggcccagagaagatgtccctgtgaatgtgtcactgcacaacctggcaccaaaagggttaccaagaacagcagccatcttgctgcagaggatgctttgttcccagctgaggagttgaataaattcattctagggctggtagaattctcattgaaaagcctcctttgccactttagggggctttgtctgcacctcttcccccagttccacagaagatgccttcagtccttgaattttggctcaggagttctgactctgggggcagggaggaaggggccatttctttaggaaaggagtctcagcttgctcactgtggtcagatgaaatgtgatttatctcttggtttctggtacctcagacctctgagacctgaggtgtattttgtctttggagatgagtccacccctgccccctcttagtccgttttcttctctgtgcccactcccctccttctctcccggcccatccctaggggctcgggtgacattctaacttctcacgggtactcagcccctttccctctgttttctccacagcaagccccgcccaacacggactggcgtttctctcaggcccagagacccggcaccagcgggtaggtgactgattctccagcccaccctcttctctgcggcattttctcagggatgacgtgggaggagatgggggagggcccagcatttgctacagatggcttctccctcagtttgagatcccagggaggtcttggtgtgcggggggctggcacacagaccccggaaggaagaggcgactgccctgactgttcaggaagctcaattcacatgcttgccccttccctcctcgccacgaccggcaccttttcctatcccctgagggcactgtggaaccaaaggatggtcttaagctggtctctgggtgaaagcgaggctttctatgcccatgtactgcctaaccccctcccctgagttgagctgggctccattatgacctggggctcaggcagaaaagcatttgaccggaggaggcggtccgcactcagcgcctcctccagagcctccagagccgaggctgactgcagcctggggagagtggaggcagcacagctggaggtggaactgaggaaggactgggcggggcatggagcaggcccccttctccggcccctcctcccactgtcctctgcccctacttgtcctgctctctgtctgtggggtctccgtgtctctgcccctttttcttgagtttccgtctttgccactttctcttacctctcagtccttccctcagtctctatctcgctttgcaatctctgcctctccctctcttctccatctctgtcttagcttccgtcttgattgctgcacctcagcctcagtccctttcatttgtctacttgcattgatctgtgccgcccactgtgcctgccatggcataagtgctcaataaatgtggagtgagtaactacacgggacccttagtctctttctccttctctatctctgcctccctgtccttgtcctggacctcttttctgtttctcctttcaccgtttcctagcgccttgtgttcttctatccccagcctctatgtttctctgtctctcactatttctgctttcctctctgttctttgtctctctttgtctctgtctctgtatatctttctttgtctctgtctctggtctctgtgcctgttgtctttttctgcctctttctctgttactctttctttatctctctttttcttttatcttgtcttttttctctgagcctctgtctctgtctctcatttttttgtgcttgtgggcaagccagcacacacaaccccccacccaccacccaccaacaccccgctctcttccttccctgcccctcacacactgagcctttgatcgcagctctccaccagacaccctcccatccaagcagccccagctgctcatttcaatctggtatgaattcctgctgagacaggaaccccctgcgggctgaaggggagggaaacttcagcagaaagaccttcagttggtctgagcagagtgggataggctctgcgccaggcctcccagttagaagtcaggagcctggaggagtctcagagcccagggagagaagcaggagcttgggccaccttaccctacctcctcaatggttgagtacttgctgtccacatttgccaagttgctacagatgctgagcttccaagagttatctttcccccatcctgcaaccaaccaaacccttgttgccacaaggacccaggagcccttggtgtatggcagagattccagcttctgggcatgcacagtcctgtcacccattttaggaacgcaaagcgcttcttagaaggcccctaaaaagcagcagatcaaaaggcttgggctgcccttgcccttcctttgaccccagctgttgtccttctccctgctggccttgccaaccttctcataagttatccattaagtcattaatgtattcattcgttcatttattcaacaaatatttatcgagcatctactatgagcagggccctgtgctaaacattgggctataggagtgaacaagtagatgtgatcccagaactcataggcttccagaccagcagaggagactgaaaatttgcaacaagtaacacttaaaaaaaaaaaaaaaggctgggcactgtggttcacgcctgtaatcccagcactttgggaggccaaggtgggtagatcacttgaggtcaggggtttgagaccagcctggcagccaacatggtgaaaccccatctcgattaaaaatacaaaaattagccaggcgtggtggcaggcacctgtaatcccagcgacttaggaggctgaggcagaactgcttgaacccggaaggcagaggttgcagtgagctgagatcacgaaaaaaaaataatctagccacaaatcacagtaagttctgagaggcagagaacaatgtgagtgtaatgggggggggaagatcagagaaggcttctaggaggaggtgacattgagaagttctaggccatttatgttccctctacctaccaccaccccaggccatacactggctttgaagcagaattcaccattgaacctggaagccccaccaactgcctctcatgtgtcctctggggtgagcaccttacccctgcctcaactcccattccatcaaatgagaggcttagtggcctggaatacatgtgggagctcttggagatatggaggagaaggtgcggaacctctctctctctcctctctctgcttccttagttaacttgtggaggatgcaacaaaccttttttttttttttttttagacagagtcttgctctgttgcccaagctggagtgcagtggtgcgatcttggctcactgcaacctctgcctgccaggttcaagcgattctcctgcctcagcctcccgagtagctgggacagcaggtgtgcaccaccacacccagctcatttttgtatttttagtagagatgggtttcgccacgttggccaggctggtttcaaactccccgacctcaactgatccacctgcttcagcttcccaaagtgctagaattacaggtgtgatcgcccccggccacaacaaacatttttgattcagcggctccaaagtgaaataagcgttaggatctagtccagtaacttcaacttctctccttcattcattcaacaaatggtcagtgagcactttctgttggccaggcagtgttctcgatgtgggaggcccctgccctcaaggagtttacagtgcactgaaggagacaaatattgaccaaataattacaaaaataaatgtgagactgaaactgtcataagtgctaggtagaattgtatctggtggtgtgggcgtataatagggatttgatttagggagcaggaggacatcctggaaatgaagttgtgctgagatctgaaagacaaatacaaattaaccagctaaagaaaagaaggaagagcattccagatggtcaggcataccagcttcaaagcagggctggtgttgagttcttcagtaaacttggttcaagatcaagccagctctgggtcacactgcctacacagaaggaagagcattccaaatgggaaaagcctatgcaaaagccttgtggtgaggcctcctgggatcaagggaatggcagggagttttctctttgctggcactggagtgaggggatgaagaggagaggttccttttatccagtctaaccctggttccagccttctgttgatgccctgcctcactccctccccaccatcttgcccactgccctccagcctggtctggtcagacacaccagcttcaaagcagggctagtattgagttcttcagtaaacttggttcaagttcaagtcagcactgggtcacactgcctagacagaaggaagaagacctggccaggtgtggtggctcacgcctgtaatcccagcactttgggaggctgaggtgggtggatcacctgaggtcaggagtttgagaccagcctggccaacatgatgaaaccccatctctagtaaaaatacaaaatattagccaggtgtggtggtgcacacctgtagtcccagctactcaggaggctgaggcaggggaatcgcttgaacccaggaggcggaggttgcagtgagctgagatcacaccactgcactccagtctgggtgacagagcgagactccatcaggaaagaaagaaagaaaaagagagagagggagggagggagggaaggaaggaaggaaggaaggaaggaaggaaggaaggaaggaaggaaggaagaaaagaaagaaaaagggagaaaaaatgaagaagacttacattctgaagttcctgcttggcacatgcttctcctccccaccactatcccttctcaggtcatcctttgggtgtctgatcccaatagctgttgtctcaagctctgagcccagcaaaccatttcccccttcttaggctgtaacccaggccctgccctgcagctgtccccagcctctgcacaaagagtctccatttggtccctagactgttctctgatggctccacactaccatccctcctctgagagacagtatccctgctctctctcagtttgggcagtcattcaacaaacaaatagcaacttaatttttttccacttataaaatagtacatgctcattatagaaacatgaaaaatagaaaaaaaattaaaaggaaaaccacccatcattttacaatctagggagaaccaccaccaactacagtttaatatgaaacatttcaaatatgtacaaaagtagagagaatggtgtcatgaacctgtatgataccactatccagcttcaactaatgccttatcttgtttcacctatatccctacccttatcctgtccttggattcttttgaagcaaatctcagacatcatataatttcatcttggtctccaccatctttaacagatgacttttttttttttttttttttttggagacagagtctcactctcttgcccaggctgtggcacaatctcagctcactgcagccttcgcctcccgggttcaagcaattctcatgcttcagcctcctaagtagctaggattacaggtgtgcaccaccacacacagctaatattttgtattttcagtacaaacagggtttcgccatgttggccaggctggtcttgaactcctggcctcaagtgatccaccctcctcggcctcccaaaatgttgggattacaggtgtgagccaccttgcccggccagatgattctttcataaggtccacattttatatttgagtgagtgtctcttaagtatcttaatgctcttttaatgtaaaagacttcccctccatcttccatttttgcaatttatttgttgaatccctgccttttcatatatatctttctaaacttttctttgtgtaatcaaagaacatgcatgagcttcatttttatttttatttatttatttatttatttatttatttatttatttattgatacgtagccttgctctgtcacccaggctggactgcagtggcgcaatctcggctcactgcaagctccgcctcccaggttcacgccatgctcctgcctcagcctccagaatagctgggactacaggcgcccactaccacgcccggctaattattttgtatttttagtagagacggggtttcaccgtgttagccaggatggtctcgatctcctgacctcgtgatccgcccgcctcggcctcccaaagtgctgggattacaggcgtgagccaccgcgcctggccgagcttcattttaaaaaaatctcattcacctaaataagttgttcacaaacttgtcacactttcatgtgacactttattcacatattaagaactgttattcccagtcatacggtacatttcctactagttttttaaaaatagcaactgaggccatactgtccaacagaattatagcttttttcttctttgcagtgtatcatgagaatttccccatgtctttcaaaattcttcccaagtcatttgcagagtaactcctcttatgaatatacatattattttacagaataagtcctcatatgaatatacatattatttttctaatgctaatgggcttttgctacattagaaaacatacacattcatttacaattttttttttttgagacagtctcgctctgtctccaggctggggtgcagtggcgccatctcggctcactgcaagctccacctcctgggttcaagcaattctcctgcctcagcctcctgagtagctgggactacaggcacgcgccaccacgcccagctaatttttgtatttttagtagagacggggtttcaccatgttgaccaggatggtctcaatctcttgacctcgtgatccgcctgcctcagcctccctaagtgctgggattacaggtgggagccaccatccccagcctcatttacattttaacacaattaaattcagggtgttgtcagggtgacttcctagatttctcagttttttgagcatgatgtagggagtattttattatagtccagtctatgggatattcccttatacacacacacacacacacacacacacacacacacacacacaccccaaactcaatagggcaagaaccatattcatcatctcttaaatcctaggtcctgtcacaggccactgcttggaaaatagttgactaaatgtagtccatttcttccatttttacttttcactattccccaaatcctggaagagtccctcatatctgctgctggggctccaaggcctccaagctgaagcccagtacgttgttgtgcataagatcataggccctggaatcatattaggctggctttcaggttgcaactctaccagttccagctgtgtgactctggtatagtctctcaacctctctgagccctgttttcatctgttggaaaatatagataatcacaacacttatctgcagggtgattccgaggataaaaaagacaaatatattacccagtcagcttagaataggaagctctcagtaaatggttaaaaaagaggtctctctccctctgctcatctcttacccagcttcacataattggcagcccacccacctgtttggccctcaaccttcaaccatttcccaggacgcctccttacactcctgatcatcatggttccaaccccactgttccactcagctttgttccctcaacaccactgctccctgtgacaggtcatcctcctaacctctggcatctggtcccgttgtctccctgacaacccgcatgctctcctccctgcaacccccgccgcttgcctgctctccctactttattcccattagcccccttcacctggggctgagaacacctggccttgaccctgcaccctcagccaggcccacagagctcagtcgggccggaagtaaggaccccagatattcagttgaggaatttaacattaatacaataatatagaatccaccagcagattttcataaatgttctgtgtgttcttttatccttttttttaatccaggattttatcaaggagcatagattgcatttggttgtcacgtctttcctctcctttaatctggagccagctcccagtctttttatttttttaatgacatggatatttttaaagagtccaggccagttgtactttaaaatgtccccgaacctggatttgctggctattctctgatggttagattcagattacacaccttggtaggaatacttcccgcagcatcacactgggactcatctaacgtcggcctgtcccactatcagtgatgccgagtttgttcgtgtggtaaaaacagtgtcccagatctctccattataaaaatatatttttataaagatattttaaaatatttgtgaaaatataagtaatctgtggatgatactttgagataggcagcaacccttcatgcaattttagtattccctgatgatccttgcctgtatctgtttttacatcagtgattacaaagcggtgatgttctgtcattccttctacatgtatttgctggtattcttctgaaaattacctggatgatttcttcagatttaaattcactgtcttttccttggggaagcctggactggctgagctgcctaaccctgactctctgtcttttttttttttttgacagggagtctagctctgttgccaggctggagtgcagtggcaaccttcacctcctgggttcaagcgattctcctgcctcagcctcccaagtagctgggattacaggcgtgtgccaccatgcccggttaattttttttttttaatatctattttagttgagacagggtttcaccatgttggtcagaatggtctcgatctcctgacctcgtggtctgcccgcccctgcctctcttcataccctctggtagcccctgacacagcccatggcaagtatcacaattgcaattactctattgtgtaattatttaaaatcagcctctcagtgcccaccatgagcaccgtaaagatggacagtttctatcatactcacagccacaaccccagcacctggctctgtgtctggtacatagaaattgctcaagaaagaattgttggaggggcgcggtggctcacgcctgtaattccagcactttgggaagcggaggcaggtggatcatgaggtcaggagttcgaaaccaacctggccaatatggtgaaaccccatctctactaaaaatacaaaaattcgctgggcatggtggcatgtgtgcacttgtcgtcccagctgctcaagaggctgaggcaggagaatcacttgaacctgggaggcagaggttgcagtgagccgagatcgcgccactgtactccagcctgggtgacagagcgagactccagctcaaaaaaaaaaaaaaaagaaaaaagaaaagaaataattattgaatcaatggaaacagaattacaactcttcccacttttgggaaggagaattgagattcctgctttccccttcaaccctagctttatgtttgttgtgatggtatagaggtcacacatggcagccttgtgtctgttcttaggctgagttcatctacttagggacggggaatcccagattgggcaaaaccaaaagcagggacagaccttggaaaaattgtaaagcagttcttggttgtgctcacccaccatgacaaaatatgcacacacacaacgcaacacacacacagacattttcatgccttcaaggcctaccctacagcctttcccatggtgccaaacccttcttcttaccttacagtcacttaactgtctctgctggtctcttcccactcatttaggcaacaaatatttattgaaaaacttctctgagccagatggtgccaaacagttacctaaagggcagactgtgtgtgtgccagggctgtttcccgccaacactcccctgcaaattgaaataatttcatccttggaaattcaaaaaaatcatgaaaattgtcactgtgggaaaattccaagtagagctgaaccttctaagaagcagagagttcttcttatggtttagtatttttttaaattatgaatcatttcatgttttttcaacactcggagtttctaaaagtctcacttaggtccaagtgctaggctttgtgctaggtgcttcagtaggaagcaggtggagtcgctgcctcacagaagccagtgtggtggaggaacagacaggcactacaacagctgcagtgtgactagtgccatgtggggcagccgctgggatgggagtacagtggaggcacctgcccagtctgagtggatctcctctgatatattttattcgtgtcatcatggcaaatgttgggggactggcattctagggaacaccatctgcccaggattcacagcaagagggaacttgagggataggaaagtgcaccttggaaaaggtttgatgatagagtgtttgagggcggggggtgggggttcttgtaaaataggaggggcaggttcttctatggccgtggattttactctgagggcttaggaagccattgaattttagaaatttcttctccctgctccagggtctcttggggcctcctacatctccccctaggtacctcctaggtccccactttttctctagctctggaacattctcttccatttcccaccttcacagtcctctggagaaggtctgatctccctcactatgacaggaagccaggctctctcatggtgggtgggggaatgcactatgttcaatgcattggaccagcctggccaacatggtgaaaccccgtctgtactaaaaatacaaaaattagcctggcacagtggcaggtgcctgtcatcccagctacttgggagactgaggcaggagaatcgcttgaacccaggaggtggatgttgcaatgagccaagatcgcgccactgcactccagcctggatgacagagtaagaccctgtctaaaacaaaaagaaaaaagcatcggaggcagcaaagagctggtttgagggactgacttgtgggattctggcttctgaaggattgtagaagtgcctcctaccttgctgagagaaacaggtcttgggcatggggtagggttagggtactaggtttgggagccctgggagaggacaggaggggcatgagctgtgccggcctgggagtctgtgctcaccatcctactctctccccagctcccaaaatggcgatgacaccggcacctggcccaacaaccagtttgacacagagatgctgcaagccatgatcttggcgtccgccagtggtaagtggtgtcagtgtgtgtatggaagagtgggagacctggggttctggggtgcatctcacagccaccatgcccacggactggatgtcaaacctgtgtagtttctccagatctttcggcaggtctgaaaggacccacaattccaaacataaagcctggaattgtggctaaggaacagcagaggggttgggggtcctgggatgcctggaggagagcgaacaaggaaaagactcatggagggaatagtggttacaagtctagctctggaatgggacagtgtagctcaggtcctagctctgctactatccttgggacttggatcgacttgctcaatctctctaaacctcagtttcctcagcctagaaagtggggacagggaccccaaagggttgttgtagagattaaatgagatgataccacaaagcatagagttctgggcctggcgcttggaagccctcaagcaatgaaagtgggtgtagaaatccccagccgagagaacacctcctctttatgcgaggctcctcttttgctgcccctaactccagagtaggattctggttttcccataaggttgactaagggcttcctttgtaatagagattcggctagtggtggttgtccctgaagagtcactagggcccagagcaggagaagaagaatatcatttgtccttaagagcacagcctaagctgggcgtggtggctcacgcctgtaatcccagcactttgggaagctgaggcaggaggatcatgaggtcaggagttcgaaaccggcctggccaacatagtgaaaccctgtctctactaaaaatacaaaaattagctgggcatggtggtgcgtgcctgtagtcccagctacttgggaggctgaggcaggagaatcgcttgaacctgggaggtggctgtggtgagcagaaaatcgcaccactgcactccagcctgggcaacagtctcgctctgtctcaaaaaaaaaaaaaaaaaaaaagagcacaggctttagaggcaggccaatctggattcaaatcctggcacctggcaccaccacttagcaatgagtccttaggtaagttattaaaccccctcggtttcacttactattaatgggcacagtattaacggatctcattgtggtgttaccagggccaaatgcaagtccctcagcacaggattggcagagagtaagggcacaatatattattatctttgctgacccaaacccgttttttactgggtagaaagcagaattagaataatgcctattaataaagactagcttctggagcagcaaatcctgggcttataaggaggctggcagaggatcaaggcattgccctatatcatgaactgatagccctgccctccagcatgtctggaggactggtgggtagagaaccaggtgaaatcacaagaagcactgtcatcacacctgggcacatactaaacaaactttaggggcctcctgtcaatgaatcctctcaatagctctgcaaggcaggtctgatttctcacactcgacagatgagagaaccgagaaggcacttgccccagggtcctcagttttgagctgccaagctgaggttctaacctggctcaactcctaagtttatgctctttctactatagggaccatggctgcctttggatccagcctcggcttctctattacctgagcaggatgagaggctgtcctcttcctcgagctctgctttattcttccagatcagggttgccagataaaatacaggatgcccagttacagttgaatgtcagataaacagcaagtactatttcagcataagtcagtctcaaatgttgcatgagacataatgtactaaaaaaaaaaatgctcattgtttacctgaaattcaaatttaactgggagccctgtacttttatttactaaatctggcaactctaccccagatgtctgtgaggttaagtggggccaggcctacagctgacggaaggacagagagagaggtggcagggactgctggcctcctgaggcagagctgtcccaggtctggtggggctatgattccagagaggccagagactgagtatgaaagtggcaggcggctgggtctgaggagatgccaagttggcctcttgagggaaataaacaggtatatttagctgttgtggccttgcgccctgaggccaggaagcagctttttagcctaaatccagatgttaaaaacagaaatgaaatcagtatttatggccccaaaccctccaagcaagtcatgcagctcgttcccctgtcaaggcctcccacctttggcccacacagggcctgaccctcgtctaagcctgcgccctggggaacggaccctgggggtggaggtggtgggtcaggccctgctctcactttcacacccgcttcctagccctgaaaccagagaggttcctgaagtccagcccagccaggcctgtggggctgctgagaggggttaagtaagagggagagtaaaaaccgacacttgggaggaggcttttaaaataaacatctgcggggagggatgctctcaaggaggctgcggtttgcagctcagccagctgtgttccagctaatcagcctccttgggctactctggagttgctgccttggccctgggatggggtaggttaagaggacagagggaggtcagggagctgggggctgagtttccctgagtagaggctggcacaggagagaaggcatcacccccacctcgtccaggccagaagatgtccagcttcttgaggctctcctaagtctgcctctcctgggaccaagagaaaatcccggtccttgaccaaggtgggccttggggggagtggggtgtagagggaggggcactggagaactgactctacagaaagtcaaagctggcaatccaacttcttcccctcagatttatagatgggaaaacaggcttgagccacgcagagacttgaccaagctcacacagttccttagtggcagagcagagcaaatattctctttcttttacattctggatttccatatcttctctccctcctggtccagcccaacctcagggcaccccccacgaggtgggcgggggatggctttgtcacttgcacccactcggggtgctactcagagatcttgggtgcacataggacgtgggtgggccgagcttctagctactccgtcaggcccttcctgtcattctgtctctgcctcccttctccctgcttctccgtgttcctcctcattcttttctgtgtgcagggagactacaccccccaccccgctctttctctggcgcctctgaggtcccccctctagcccctaaatcactctggaatcctggctctttgaagccagatctgggcccccctcccctaccccttccattcccaggctgggaaaggctgaagaggctgacggctggaggggagggggcggggcggtggcggatctggcttccttttggagttaattagggaaaacagagaaatgtcagcggaatgaaagggctgggggtgggggccagctggggtaggagaggaggaagtgggcagctgctccctcccactcaacccctctcccccgcccccagaaagctctcagctccggggatttgcgacatgaaatgggggctgtagaaacctgagcgctggtgcgtgaagagaaaaaccgaggcgcatcccggctctcccctcccgtgtgccctcctcctcttatgccggcttgaaaatatttcctgtctctctatttctcaatccctggttgatgtcccaggattactcagcctctccggctttagtcactctcgctacccgctcccagggtccagggtggaggcagagggaggctgggagagaagctctactgccagctgggcctgggctggcctgggcatccctgaggttttaactgtctcctaaccacagaggatctcagggcctccagcagcgagccccaatgagtcaaactcttgtttcctcctctcccacccccgacccagtcagggcaggtgaggggtagaggtgatggcatgctggatgtgacggtgttgatgatgtattgcacaggatgaagcaccatctcatttagtcctcacagcagccttcacagtgcgtacaaatcagctggcaattccgagaggctgcattctaaacaagttcctgggtgatgctgagccagggccagagtgtggacttctctgggccccagtttcttcttctgtacagtgggacgttggactggaggtgctgtctgatgtcacctagctgtggcactctgagcctgtgcctaaagtgtccctgagatgtctagtccccgagatcatcatctcctcagcttcatagagccgagctcttctccatcttctctctacctcccattcactcagaacagggataaggtccaagctgctggtggtgatggtgactgactgtcccttccagcatgcgcttaggtacacttgggcctgaatgcccctctaacaaatgctaccgggtatggccttggtccttctaacacttggttccctcatctgtaaaatgagggtcataccacatagctggctgggctgttatgtagaggttaaaagtgattgtgcatgtgaagcatccagcagagtgcctggcacacagtaggtgctcaaatgctgttttgaaatacaaaaattagctgggctagtggtgtgcacctgtaatctcagctactcaggaggttgaggcaggagaatcacttgagcccaggaggcagaggttgcagtgagccgggatcgcgccactgcactccaggctgggcgacagagcaggactccatcttaaaaaaaaaaaaaaaaaaatgctgttttgaaatggaggcttggaagagcactcttcacccccaccccacacacttactaacggaactaccgaatctctactcgtgccaggccttgcttggcaaaggctaggggcatgtaaagccatggtttcatggctgctgccctccaggagcccatggtctagtgtgggagtcagaggctcccttgagaaagccagggcaaggaactgagagcccgtgtcacagccctgagagaaataccagcgaatgtgttttgagcacttacatctaccaggcactattttacgtacctgacatacattttcttatttagcattcactaaaaccagaagaggtggttaccattatcatccccattttgcagatgagaaaactgaagtggcataaggaggttaggtagacttgcccaggatcacagtgagtaaggaaaggagctaggaatcaaacctagactttctcactccagagcctcttaacctctaccctcaactcttgtgaagagagactaccttggtgacccctatattcccagtgctcagcgtggtcaaggcccagggtgctgtataggcattcattaactgctggggatataagacagtgactgttgaggaccctaagtttagctcccacctgatcttcctctgtctctgcagaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctgaacgtttctgtataagcgatggaagctcctggcatgtgtgcatgaagtgatgagctgaggtgggtgctggaagaagggcggaatcgggaggccactctgtgtcattgcgcgtctagatgtttccgaattgcgtgtgtgtgtgtgactgtgcaatatggttgtgtatgcttgcaatgccgttgtgcctatgagacagtgtgcgattgtgtgcctatggatctgtgtaccgtgtgccattgtgtgatcggtccgctgtgggggtggggatctgagtgcggcgtgtcagtgtgcagtggagtgtgcagtctaagcttgcggctgtctccaggcagaagaggagaccccggcgcgggcgggggcgggttggcgccgggcaaacgccttgggtagaggggagaggacgtttcgttagttcccgccccttcctgactaaaattgcctacccgaagcgccccggagggcttcacgggaggagggtagactctcctttgcccccgcacccccacccccgctgcctaggggttttgggaaagccgcgggagtgggagggaatgcgggaggtgattcttccaaagccaagtctgcagctcgagcctcagtttccccatctggaattcgccttcccgctgacatctccgtagcgaagcctaagaaattggagggctcatcctcttcttgcgggggtcaaggggactgaaaggacgtgcaggaaatgagatccatcgcagactcagctcccctccctccttcctgtcggtgcttttccactcactcgcctgctctcccatctccccgccccctccgcctgcctcctcgaagcactgtgggattccgaggttgctgcagccagagaagctgcagaagaacacggagctgggggtgaagggggacttaaaaggggaactacccggaaggacccaagaacacaaagacagagccactggggttatctggctggtcagcaagggtatgcggcttcctccgcgctgcggaggctcccagagccaggtcacccattctgccagctcaagtctgttgtcatgggaaccaaaccttccaacttaagaatctgggggcgactttctagcgtgggaggaagggtggtgtgcacggttgctgagatggaagcagggttttgttactcagagccaggctgcggaggggcggggtgccgggcgcctgggttctattccaggcacagcagcagactggcagagcgcgtgagcagctgtggtttgtcccctaattggtatgtgtgcctataaagctctgaaccagaaaggcgtggcctccggggggacgggagggaggcggcaggcaacccatccccacacctcaggccatactgaggaggcagctgcccaggctccagggctatttaaaaggcttttatttccagttccagagcccgcccgaatgggtttgtggtcctctccaggcctctccctgtctatcctgggcctgctcattgctggtctggcttttttgtgcaggtcataacgtgctcagacaagtatggctccaagtggcaagtcatctggagcatgacctcaggctcccaacctctgctgggcaggctcaggtttccaccccagggtaaacccctctactctggaatgtggtctgtggccaccaacagagcagaggggatgagaaaatgggagccagatgcttccctcagcaagagacacaggtactgccaggaaaccttgcgtgacatctgggaacatgaaaggttccaagtgagttccaaaaaagggctccaaaccaagtagcagcaatgtggaagagtcagggagctgaaccaggcgcccactcctttactgtggccaaacggccctgaggtgagctctggtggggcagcagccaccatgtattaatcatctctagccctgtgcccaagtaaagtgtctggcacctttagctttttcacagtgatttgtcaggtcaaccagggatttgaggcaggaaagactagaggagcctggacta

SEQ ID NO: 16855 - DNA, 40964 bp, Human; identical to SEQ ID NO: 16854

SEQ ID NO: 16856 - DNA, 40964 bp, Human; identical to SEQ ID NO: 16854

SEQ ID NO: 16857 - DNA, 16102 bp, Human
tatatcgtgaatgaatgaccatctagggaaccctgttcaagatgacatttctagttcaagtacaatttgtagctatttttgatttccaagaagaggtgaggcccattccccaactacccccacccacgtactgaagtccaaggccacttaaaaaccttggggagaagaaggagagcaagtctcacccatgccctcggatgctgaggttaaagcagcccaatcgatcacagcccagagagtcagctccacactgcaaaaagcaaaaccccaggaaagtgcagtgatcagaactgatcagaacatcacagataccccttccaccaccaacctaaagaacctcctcttcccttgctctctttccccaagcccaggcagaacactcctgaggaggaactgacagtattacctggagcacaatgcacgtgggttggtagaagtccactacctggttgataaccggctggaaaaggtgcttgtaacctgggagagggccaaagatgggcacctggcaccccaaggggatggggagacagggaacaaaaggaaaaagggggttgagcgagcatgtagcccaggaaaggggccacccaaaagaatcaaatcactggtctgaaacttctggaagggatcccagactgctatgagtgactgatgaaagccaatgacttttcccagaaaaatgcacatacacatgatatgttgcatacaatttccagagattcatggtccctctgaaggccattcatccttaaggacaactggcccaacagcagacaataccaggcagaagaggttatttcaaggagaaaaagaaggggcctagggaacagagggaagacttcggtacttactctggtcatcaatgccatcccgcaggggcacgttcagacagtagtagcggccactctctgccccgacttcatacatgtcacctgtagggaagtgggtggtggtagccacacatgggaagcacccacaacccagctgtttcagccccaatctgcactctgggagcctctcattccatctatgtagcttcaccataaactccctagagccactaaatctcttgcagcttgcattcattgggcaaatagttttgggggatccactctgagccaactgtgtactaggcagtagggatgcagcaacgaatggaactaatgaaatttacgatatcccaccacgcttatattcttagggaatagccatgaggaggagggaggcagtaaacaaaacaaaacaaaaaaccacaataaacacaaatagcagtgagtgttctgagggaaacaatgaggctgatgtaacagaggaatggggaaggaggtgattatgataactggagtggtaaggaaaggcttctctgaggaggggacacctgagatgagactagaaggctgagaaggaggcactcatagtaaagagctgaagggtgcaaaggggaaagtaatccctattcccatacctgtgccagggaagaagtaatttccgtatttgtggaaggacaccgtcatgacccggtcagtgaggtagaaagcttcttgaaccccgtcaccatggtggatgtcaatgtcaatgtagagcacccgagggtggtacctagagggaagccaaagccagggtctgagctagaagtgaaccccccaacccactcctctcaaacaccgggtctcgaattgtgaagagtctgcttctgccctggtcacctgaaacttaatgtcaccagttccctaaaggcaactgggggctccagcctagaggctagaggcagggacaggagagggatatgcagagaaggctgaaatgtgagcaggcagtagggaatctgcagcagtggaagaggcagcctgaataaagcatcaagaacttgggagaagctaatcagggaggagggaggtcaaggtcagggttgagactgagagacctcctcagccaagaatcccgtaactgcccccatctcctcctgggctacttacttgagcagctccaggatgccaatcacaatgtcgttgacatagcagaagccagaggcctatggcaagacagtggtctcataaagagaagagcaattcccctcccagctgccccccaccatcatcctaaacacctaccctaggatggccactgtctttcccatcacctcctcactcacctcaaacttcttggcatggtgcagaccaccagcccagttaatggcaatatcacagatctgaaagacaaacacctaagtcacagtccttcctgcccacccctcaagctgggagcccaggatcagggttaaatcccgagtccagggatccagaggaaaggaagaacaggactcgggactatgtcaccttgttgttcagctgggttgctccttgcagagatgcgcctgtgtaacgcgagcagaactcaaagagcccgggaaacactgggctgcagggaagaggaacaagttggaaccctcctgcctctgtctgggcccttcccatatctccctccccatcctagattcctccaatctccatttttcaagaaccttctctccctctcctacacacgtgggctatctgcaaatttattcaacaaatattttggaccaaaccatgtaccaagccctgtgcaaggcactggatgggaagtaaagaagcacttaactgtcagggagtttgtatcctagctgcggaaagaagcaagcagcttccaggtactcaagtacaatgtaaaaaggaaatcagttgaaagaaaacatgagctctgtttttcttagtcttctcagtgtaacaaattttagcataatgttcaataatatttttcagtcacatattttaaagaaagaactgtatacctacatatgtgaaacagtgatgagataacccacgaaaagcctgtagcacagtatacagtatccgctcagcctttaataaatgtcagctataattattaccattgttattctttataaaaagtaaaggcttgaagccagacacaaaagcctacttactgtatgactccatttatgtaacattctggaaaaggtaaaatacaaggacagacatcttatcagtagttggctggatctaggttgcagagaagttattaactacaaaagggtgagtgacctttgttgggtagtggaaatttcctgtaccttgataccttttttttttttttttttgtagagacagggtctcactatgttgcccaagctggtctcaaactcctgggcctaagtgatcctcccgccttggcctcccaaattgttgggactacaggtgtgagccatcggcgctggccctataccttgatatattctatcaaacctctcagaactcttacacctaaaaaaggttaattttactgtatgcaagttatacctatataaacctgactttttaaaaaggaaaggcttaggcaatccctagttttaggtctcaaaaaaaaaaaatagtgcagctgatacatttgaccatgtgaaaaacagaactgtaggggttttttgtttgtttgttttttgagatggggtcttgctctgtcgcccaggctggggtgcaatggtgcgatctcggctcactgcagcctccgcctcccgggttcaagcaagaattgtagggttttatagtttctcaaaaggcttggaaagaattagtgattaataccagaaaactaagcaaatgaaaaaataatgcaattgtcagctccaggaaaaacaaaaagctttagaagaaaatagattaaatcacactacactatttggcttgatagtaaatgaatctttcagagttataataatgtaaacacagaatactgatttatttttaaattactatgaagctgaaaggggaaaggaagccaatgtgatggtgtaagaagactaaatgctcatatcccatactaaaagcttaacagataatgcctaaaattgacagacgaagaaatagcaatgagagacaatacaggaggggagtatgattacaagcaccgattctggagctagactacctaggttctttaacacctactaatgatagtgaggttgtacaaactgtttaacctttctgtgcttaagtgtcctcatcggtaaaaggaaacaataatagaccctgcttcataggggttgttgagattaaataagctaatggctgtaaagcacttagaacagtacctagtatataacaggtattacctaaggattacagattagtaataacagtcaattaatattattatttagaaatccaaaggtaaataccagaagacataggggaaaggagctgaaagtggctgtcactgggcagagggatttatgggtgaaaaggagaggtctggaatttttttttttttttttttttaagacagagtctcactctgttgcccaggctggagtgcagtggtgcaatctcaggtcactgcaacctccaactcccgggttcaagcaattctcctgcctcagcctcctggagtagctgggactacaggcacgtgccaccacacatgactaatttttgtatttttagtagagatggggtttcaccatgttggccaggctggtcttgaactcctgaccttaggtggtccacccgcctcggcctccgaaagtgctgggattacaggcgtgagccactgcgcccggcttgggactacttttttatttttttcatttaaaggcctatagtacaatttggctacttatgttagaatactttgaaaccaatcagaaattcattaaacagaagaaaaattcctgattctcatcggaaatacagataagcacaactgtaacttgtttgacaggaagactgatgcagcataaatagcccagagatagtattctaattagcattccctaatcgcacaaagagcatctacgggaccccagtgtggcgtaagggctgaccctgtattcacagagctagaaagtgagctcagaaataacagcaggaatactaacaaaaaaacaagaaacctccccaaacagcatgtgactgaacaccaaatgagcagtgcagtgtgtgcaagacagagctctatgggctggtgtggtcaagaaaggtttcatggagatggtgtgaaggctgagaaggccttgaagaggttgaatagagaactaagggcattccaggaaggcatcctgtgcagctgaggtgtagggataaagttggaaaggtgccaatgccagcctaatgagttggcctctatcctacagccctggctgcttctgtcattaagatctttcaggaaaacagattagtggtttaaaaacccgggatctggatcatgccccctccaatgaccagttatgtgactacggctaagttacctagatattcccaaacctcaatttacttatatataacatcagaaaaaggtctattataatacatctaaggattggtatgagaattaagtggatttaccagcaacccttggcataatacctagcagagtaagcactcagtaaatggtagctatcataagaaattctacaggatcaacaacctggtttcttcaagaaataaattcaagggggtgacagaaaagctacaaattaaaagtcttaagagacatatcaaccaaatgcactgtatagaccttgtttagatctggatttaaattagctacaaaataattatgagacaactgcagaaatttgaatattgatcccatatttgatgacattaaggaatcactgttaactttttaggtttgataatgatactatgtttttttaaaagagtatcatttagagatacataataaaatatttatggataaaaggatataacatctaggatctgctttaaaacaatctaacatgagggagtatagatgaagtaagagtggccacttgctcagctgggtgcgatggctcacgtctgtaatcccagcacttttggaggctgaggctggtggatcacctgaggtcaggagttcaaaaccagcctgaccaacatagtgaaaccccatctctactaaacatacaaaaattagccaggcatggtggcaggcgcctgtaatcccagctactcgggagtctgaggcatgagaatcgcttgaacccaggaggcagaggttgcagtgagccaagactgcaccactgcactccagcctgggctacagagtgagactctgtctcaaaaaaaaaaaaaaaaaaaaaaagagtggccatttgctcataagcgttgaagctaggtgatggacgtatgggaggtcactgcactacttcactttcagaaatttttgaaattttccctaataaaaagtttaaaaacaaaagtaagtagaattgagcaactggtagctgtgatggttactattttttcatggatatagagtagagtgtggcttatctttgttgtccactctcttccccagagggtctaaccctgactcttctatggatgatacaagctcaatgtaaacctaatgatatcaaaccactccttcgttgttttttttgtttttttaactgcccatagccctcttaagatcccttgctttttaaaacactttgatagcttccctctactctacgggtaaaaaccccaattcataatagagctgtttgcttttaaaaggtcctatttctttagcctcaattcagttcacctcctcttcatactctgcacttggccttttttctgttcctcaaatgagtcatactcagtcctaccacagacccttagcacttgtccctactgcctgctatacttctcccctcaccctccaaccatctttcatctgattacttctactcttttttcagatctcagctcaatctttacttcctctaggaaggccccaccgaccagccactccaccaagctaaacaatcctccacgtatacactctcataatctgtcatacacctcctctttataagacttagcaaaaatacgatattaaaattttgtttttgttcatcactgcattcccagcacttagcacagggcctgcctagaacaagtgaccaataaatatttattgaataaacaaataaaatgaattatgatgcattgacaagtaggccccccttgagatcttcccactgctgccaaaagacctcactgaagggcttggcattaaactgttagacatcaaaactcccagtcctccctcaccagtcatcgcctacgttgaaggcattaagactcttggtgaagccttgcatattggtggggctgactctctgcaggaagtcaatgtagtcctcggagtggaagcggcacatgtcatgttgggaggcctggtatggcttgaagacctcgggatggagacacaagatgaacccaggcagggtcagccccactccacaggctcagaccacccatactgaacccagtcctggagactatatgaagccaaacatagcattcccctcatcccacaatccttaagtcagtagagagactccgattaaccaggtaagttattacaaatgagccccctgaagaccacttcttttcctttccacctccagctcagcctatcgtaccttctcaactttgagccctgatccacctgccctgttccttggaatctcctattcccagttctctccatgctcatctcctcccccaagctctgattctgtcctctttcctctggattcttctttctggagtcaaatatatgggatatatgtcaactttctaattaaaatcaaagatttattatctttggaaggtcagggggatgtgtcacacctctttgaaaactgcacaagaaagagcttttcttctcccagaaaatgcacacaggtacatacaggcaaacaatctcaagggatatagattcctgcactaacatcacctcagtcttttctatgaccagtccatttgtctgtgccttggcacaagcaatgaacattcattcatattgttcactagtttccctagcaacacataaagcctgggtttagctgttttgtcttattttttcttttgagacaaggtcctccctgtcaactcaggctgctgatcatagatcactgtaactttaaactcctgggcccaagccatcctctcgcctcggcctcccaagtagttgggactacaggcacacccaccgcacatggctactttttttatttttattttttgtagatgtgggtcccactgtggcccaagctggtctccaactcctggcctcaagcgatcccccccatttcaacctcccaaagtgctgggattacaggcatgggccaccacgcctggcgtggcttaactgttactatcccatatcacagccataaattccaagctgggaagacagcatgtgtatgtctggtagatgaaaaactggatagcgattaagcagaaccatgtagaggtattccaggctgaaaaaggaatatctaaaatatcgcctctgttccacacgcacatacacatttacaaagacggcagcatcgttccaccctggagccctagctccttggaggtaaagaaaggtggtaaaagaggagtgggaactgagggtaaacctcacaccctgatacagtgatatccgctcccctaaccctaattcctgaggccaaggccctatccacactctaaaatgcagaggaggaacacaccttctgtcttcaaaccagccccacatcacgctaaccctaggccaagggctagtgtgcctacagtcagagggtggccgacctgaggtgagaaagtactttccattaagcagaggacgccacccccaacaccctgcactttcaaggtactcctggtgacttctatccagctccccgatactctaggggcgggtcgcacttcatgcactcagtccagcccacctatccctacggccacagctcgccccaccccccaacccccggccgaggcggcggaactcacgatcatcttcttatagagaccgtaatgcaggaccaggctatgggtcaatgccaggcgatggggcttcatagggtgtccagctcctgggggtggggagaagagagttcgtcagctctcacccctggagttgcaaccccgcctcaaaacctccgtgtcccaacccctcatgcatatccctgtttcctcaccgtagtggaagttgcccacgtcggggtcgtagaaataggccacggtcttggccatggtgccggcgggagcaggccccgcacctccgccgcccgccgcccgcggccgccgccagcccctccccggccgtgcgtgctgcgcaagcacgtagccggcctctgcggaactgggcgttgcggccccgcctccatccacacccaggccacgcccccaggggagctccgcccctcgcccggctcagctctcccggtatctggggctttgagcgtcccgggttgggcagggaactggcagcatagctcctaggatgcgagggccatttgtctccggccgggggtcagatcctcgggaagccgagccatcccatccagccgcttgccccaaaccgggcgcaggccgtggtcacttctctaggaagctccgaagatcccgccactccgtccctcaaaggtgcggaaagccggcttcccccagccctcggagaagattcctgactctccgctcggtcggggcatctgagggcaggagctgcgccaggcgtaccggatagaccagtggacaacacccacgccggaccgcctgtcccctacccggacccagactcggcgccgcacattgccccgggggggcccggcgcagtcacgcgcgcgcagagctcacgctctccgccccgcacacctgcgctccgccccctggtcctgggcccgcgacgggtgaaggcatttgggaagccagggcggctgcggaggcgatctccctgacccagggccggagttgcccggagcctgccaccgctctcagccagcccgcatccttctctgttcttccctccccccgcctgccacggcgcgggtatccgcagccacagcccggggccggtgaggcggcgaagggggaggggaggaatcaagggatgagcgccggaagggcgtcgggggccctgagccgcactaggacgcccctggagccggaaccccagcagaagccggaaccagaaccaaatcaccggtaccgggtcggccaggtggtcagggtgggagaaaccaaaaagggagaggggtgcgggagtactgagaggaaggggctgcagaggcctggctcaggccggcgtggaggaggtgcgggcgctgactcaggcaggatttctgctcccgccgcctaagaatgccgtcccatctcgtgctgcagtgtccttgggagggacagaagcgcgaacaagctggaaaggggaacgctcggggcgtcggggaagcgggaccagggtcgtggtagagagcttgcgttgccgctgacctcttgccgaaaggcgaaacagcactcctggcccggacagctccctggttgggtagggggtggggccggacctcagccggacgtcttagacgtgcttgtttcagatcctgaggacggcattcctacccctcccccattcccagctgcagccccctaaacccaggaggcgccctggcccgcgctcgccccccagggcctcatgtcggaaccacagcctgacctggaaccgccccaacatgggctatatatgctcttcctgcttgtgctggtcttcttcctcatgggcctggtaggcttcatgatctgccacgtgctcaagaagaagggctaccgctgccgcacgtcgaggggctctgagcctgacgatgcccagcttcagccccgtgagtgaggagcctggaaccctggctcagtcacctttcacccttctccccacacctctgcctccctgaccaacagacccaggccaaatcctgatcaaacctgctcaggaagcctagtgatgcactcttgagttagcaagtggggtgacaccactctgaaagcaaaactagagaaagcagcatgggcaggaacggtcctctggatggtagtcttgggcttgcattggtgtccccatcttttctggtccctgaaatgctgaggtccagcatgatagcaagtaggtaaaagggtatgtcctaagcaataaatgatgggagccaccaggtaatattcccccaaagctgactcattcctgcttccttgccaatctctttcatccttcagctgaggacgatgacatgaatgaggacacagtagagaggattgttcgctgcatcatccagaatgaaggtgggtctagcatagccccttgctccctcttctccaaccttctcttgccctgacctccacctccactgactccctcttttccttcttccctcagccaatgctgaggccttgaaggagatgctgggggacagtgaaggagaagggacagtgcagctgtccaggtgagctggaaacaagggccagcatgacttagcttgccttggagagtatcctctcctccagcacaatcctctcccagcctccttgcatgtatggggttgggggaagggcaaagctggctaacttataggaagaaagttgttttgtagaaatcgcgattccttcaaaccatctctctcatctagatatcatcaagcctaacattcacctctagtgccactcctttgggttaagcagtgttctttttagcaaacagccctgggaggaagaacatatggtcactaacatcttaatattgagtttattagataaagacaagaaaaaatggggcttggggaaattggggcttctggggttttaaggagcatgctgaaagaacgtaagaaacaaaacatgaagggaaatggaaatgttaccctcactcccctcctccctgctgtccagtgtggatgccacctccagcctgcaggacggagccccctcccatcatcacacagtgcacctgggctctgcagccccttgcctccattgcagccgcagcaagaggcctccacttgtccgtcagggacgctccaaggaaggaaaaagccgcccccggacaggggagaccactgtgttctctgtgggcaggtggggcaggtgctccagggaaaggggggctgaggtagggggcccagtgatcaggcacctgatcccaaaagtgggccttggctctttcctcctggactgggagctccggcagaagtcaggctacacaatgtgccccacaatctgagaaggcctcccctaccttaggccagagggaagtagccaccaaactcaggatgtccctggtcagaggggagggccaagcagcctctgagttgtggtcctaaaccccagtgttccctcccctcccaggttccgggtgacacacattgagaagcgctatggactgcacgaacaccgtgatggctcccccacagacaggagctggggctctggtgggggacaggacccagggggtggtcaggggtctgggggagggcagcccaaggcagggatgcctgccatggagaggctgccccctgagaggccacagccccaggtcctagccagccccccagtacagaatggaggactcagggacagcagcctaacccctcgtgcacttgaagggaaccccagagcttctgcagagccaacactgagggccggagggaggggcccaagcccagggctgcccactcaagaggcaaatgggcagccaagcaaaccagacacttctgatcaccaggtaggaaaacacagccgggactgcactgggctgggctcttattgctctctactctggggggcactgataggacctactcctggtctctcattgttgacccctcccctttctctcaggtgtctctaccacagggagcagggagtatgtgaggtgagtctgcctgagccctaaatgaggtaatctcatcttcccatcacctacttaaactatttaagcctttcggctccctgaaccccccgagtaaactgcaggcttagcctttgctataaatcccttggtttggtggtggaggtagggaaggtcctggagccccaggggaaaagctggacacagcttgaacaggaagcaacagtgttattcttcctcttctccaagtctccttcattgtgctgatggactaccagctggcagggccagggggtgggtgggcgtgaaagccctcccctccactggacagcactgccccccagctgagggaccagctctacttccacctggagttgcacagtctcaggctgggggcctcaggagaggtcacagcccctcagtctcttctccttcccctgcctgcaacaggctgcctgccccgccttccccaacacctcgctccatatgatagagcgtggcagctgggagcaggcccctgcccgtggtgggcccctaaagcaatagcaccgtaggccccctgccctcttagcacaagaggcccaggccctggcctggccttcgtgccctttattcattgtcaataaatccgctcagaccattacagctgcttcgcatcctggctccagctcctgattcccaaggcctgttcctctccccagcccaaccccagtgaccctggcatccagagtggggtgggtcatggagccagggtggggaaagaggtgggccagaactactagagaccttgatggatggtttccagccccagagatttcaggcatttcaccaccctagatagggtcatgacagaagagaaggtagttccggtcctagagatgatagaacaatgggaaaaaaaggagtgggttccagctctagaaatgggaaggggcaagtttccacccttggaggtgagggtggaaataagggcgattccagcttttggctgtgttgctctggatcattgatggtgtggtctgacagcttgaagatagggacagcagcatcactgggggtcaaggcttccctggccttcaggtgaggggatctgggtggccaggatccggggctttagccggcgggggaggtggtggacgcatctgtagggaacacacagttagtgctccagagttctcccttaagggtatccctgtctattccctcagccctgcagacaaaacaggactggttggaataacccctctacatacaatctcctccaaggcaagggcccttaccggcctgagtcgaggtgccatcatgtccaggaacccagggaagtccagggctttgtctggaaataagaaccacaagtcagtcttcagactttgttttgttcaatgctgtatctccagcacttaggacagtggcattctataaatatttgttaaattaatggtcaccatcctagaccataaaatccatcactctatccactgtcctcaacatttattgggcaactgctgtataatcagctctgctcaaggtacaaaactaagggagataggatgcatagtgctcccacccccaatggctgtcaagaaaccaataatgaaacctcaacaaacacaataaatgactaagtgctaagtcatgcaaagtgaacttggggtggtggagatggtggtaactccagggagggagactccttgtggacaaggtggaagtaccagaaagttttagaaaaggcaggcattccacagccataaaaaagaatgaaatcatgtcctctgcagcaacatgaatggagttggatgccattatcctaagtgaactaactcagaaacagaaaaccaaatattgcatgttctcacttataagtgggagctaaacaacgggtacacatggacatagagatggaaataacagactcccaggactccaaagggggcaaaggtaggagtagaggcaggggcgagggttgaaaaattacctatcaggtacaatgttcactatttgagttacaggtacactagaagcccaatctccaccagtatgcaatatatccatatgacaaacaagcacatgtacctcctgaatctaaaataaataataaaataaaactgctatagacatttaaaaaagaaaaaaagtgggcatcagaaaaaataatgatacaaagctaggtatctggacactaggagcaaaaggtgcatattgggaggacaccgtgagagaagttagctaatttttaaaataataacagtgactgcatacttactgtgtgccaggcacaatgctgtgtagtccacaggcatcttttttaactctcataagaattcaataagctagtaccttttccttacctcataaagaacataaactgaggccaagacaggttcagaatcccaccacacacttggagatgacagagcgggacctgaaccagtcagcctggctccagagcccaggcaagtgctctccaccaagcaagatgcctgaaggcacggagaggaccagagcgtgacctgggagtccaagcttcctccttcttcctgtctgttagcctcccaaggctcccagttccttccactcacccccaggcaggacaggtgcagggggcccatccaacacagaggtaggtgcaggtggggagaagctgggaggagaaggggacggcagcatctggaggtggggtgggcacagagttattcctggcatgtggggaggttttaccagcttttcctctcatcccatctccagttccttcctcatcacttctcaatacaggaagtggccaaatgcttgcattcggtgggggggtgtagctgacaaatatttcaacagccaatatgtattgaacgcttatgtttactatgtctcaagtgttctgctagcacttcacgtgtaccaattcattcaatcctcaccactaccccatgaggtaggcatttttaataatatgactcctatgttagaagtgagacccaggttaagccagctgtccaaaatcacgaagccagttattggcagagtgctggctagaacccagttctcctgatgcccactcctattctctttctgctgtatgtatatacattataacaacagatatcttatattgaaacaccttctgcattccactgcactaaaggctttgcctcggcggggcgcagtggctcatgcctataatcccagcacattgggaggccaaggcaggtggatcacctgaggtcaggagtttgagaccagcctgaccaaatggagaaaccctgtatctactaaaaatagaaaattagccgggcgtggcagcacgtgcctgtaatcccagctactcgaggggctgatacaggagaatcgtttgaacccgggaggcagaggttgcggtgagctgagatcgcaccat

SEQ ID NO: 16858 - DNA, 106256 bp, Human
attgcctctgacttcctcctcccctgggttctgacttcttcctccccttgcttccagggaagatgaagagagagagatttggaaggggctctggctccctaacacctgaatcccagatgatgggaagtatgttttcaagtgtggggaggatatgaaaatgttctgttctcacttttggctttatgtccattttaccactgtttttatccaataaactaagtcggtattttttgtacctttcgcctttctaggaatgttaattcttgctagtttcctatttatgaaaggagagggaaatgggcatgatgatgcatgtaataaaagcatagttaacattcattcagcacttatcctacgttaggccctgtgtatgtattctacatttattattgtaaatataagaagttaatagaggattttggttaagagttagacaaacctgggcagatttgagaggagtagaagatgacttcaggtttttgaatctgggtgtttagagtagtgatgctagttggtgaagatacactgagataaaacatgttaagtgcttagcacagtgcctgacagaagaagttgcccattatctgtctatgtgaagaacaatgctaaatactgtagtagccacaaacatgaacctttctctagaagagtttacattccagtcagtagtatgataaatattgtagcagatacagactgatacaagaaagaggactgatagatgggtcacttcctcccctccattctctgattctgtctgttctcaacactagcttagaaagtagcttttggactttttagacaaaatgtctggaaagctcagcactaagtcaagtttgaagtatgggatggacagctctatgtaacattctatccgatcaccatcagaaggtctggaccacaagagagatgaatgccaaatttaggagccagccagcttggcagagtccctggtatatctcaggcccttgactaggtactggggctctagagtaagtaagtcactgactctgcccttcaggaacttatgcttgaaatcttgctagctgtggtcaagaatattcagtccatattgtgaaggccgactggtagccacgtaactgtcacacaagggacagatgtagctgggagaatggatgaaattgcttagggagaaagtcatgctagaagagcaaagaatatactcttggagaatactcattcttttcactcatgtttggtttatgtcagtggggaatcctggttaaacatagggtttggcagcaaatcagactaagctgggtttaaattttatatcaattatgcgttcttgggcaagtcacttcaactctcaaaagtccaaatttactatttataaaatggtgaggctagcagaatctatcacatgggactgtggggacttagaaaaatacatgtagagtgtttgcctagtgcctagcagagagcaaagggcatggttaagtggtaactgttattgctgtttaggcacatgttggcaataattagtttgtcctgattagaaacaattagatggtacctaacctggaattcgaactaggaaattaaactccagagcgagtctggtttagtctagtgcttgccctggaccgagctctgttcttgctaccttgctttcaaaacatggtggctatcactataatttttttcatgtgttccatgggtattgcacacattgaaaactgcattctcttggaaaacctgtcactaattttctgccaggataatggtctcacgcgatttttggtctgggatgtgagagggtccaggctgtcaggctgtacagccacgtgggcgctgcgtgggagccagaggcctgcgctgctccaaccgccagggggcggtgctctccgccgcggccgcggagagctgcaccgcccactcaccacccccccccacgtgggtccgaatggttaggtccgctgggcaggtagcgcgcttccgcggcttccctccgcccctctcccttcccccattggtaggggctgcgggtccgggcggaagtggggcaggcgggcgggagcgaggcgtcgtcgttgtatattcatgaggcgcgcgcagcccggcatgctaatgaggcggggcgcggcggctggctaaagagcgactgggcggcggcgggcgcggagctgccaggcgggagcggcgtaggcgcggggtcgccggccagcgtgaaccgggacatggagccgcccggcgggagcctggggcccggccgcgggacccgggacaagaagaagggccggagcccagatgagctgccctcggcgggcggcgacggcggcaaatctaagaaatttgtgagtgtccctcccatcccgctcctgcctggccccgtaaccgccctctggacccctgcagccggcccctggggcgcctgcccggctttggggagccgcccccgcgccttccttcctcgtttcgctcggtccgcagctctgcagcccgacatcctctcccttcgggacctcgggaagccccggaatcccacccggctcttgccccggccacctcggggcttccctcgttccccagcccttacattctgccctcccgcccgcatatccccggccggctctcagccccgtctctcccctctcagcctcacttcctttcttcttcctccagtacccgaacacgcctcctcttttttggtcccctcttctgggtccattttctcttcttaaccttacaccttttttggtattctcgtatttccttctcctaaaggtcacttccttctccatgattcatcctttttacctgctaactttcctcccgcccagtcccccgtgggccctccgcccggtgtcacttgataatccttcccctgaggaatgttacctgacttgagccctacccccaactccttctttggacgtttgtccttgcgattacaggaatgggctcctgcccaggtcctatggtcactggggcatgacgtttatttgtttaccagtattcctctctccagagaacctctctctttgccctgttgcttatcacttttcagaggattagaactctcatgattgtgcccttcttgacctaggatggtgataaacctctcctgtgggaagaaagttggactgcgagttcaagaagtttgtaattgaattgttttttatacatttcccatgataaccgtctcctctactccttttctactgcctcttgtgccccaaggcgactatcggcttccctttgcgtgcctgtagaagagtaagctttcctcaagtgccagttactttcaatccgagtgaaggaatagtgatatacatgtaaccctatcatatttcattaccttttgcccacaccaacgcctctctccagggagccgtttggttgcttttttgctataaaagctttgtaagatacggggcactgtccaggagaggaaaagtcttggatattgatgatcattataatagctagttataactgtagctcttttgtcttctcttccaggtatttatgcccttacactagtgtatctttctactaaacaaatggcttgtaactcttagtcccacctcccaacattttgacccagctccacaaatttgggaagaaaactgataaagcgatggaaacaggaagaaaatgttgttttatgacctagagggttgagatgttaaccctggagggttagatgtttaattctaaatagaattaaaatagtgactcatctcttcctatttctagcaagaccaagtgctcctggactgccctttccagtgatatctgagatgtcagtaaccatctgtttttatctggtgaacatctttttttccccccctagaaatataaggttaagggtattgacaccccctccttctttggtgactaaagcagcatttttgtatgtttctttaggataagaattgacccctcccccccgttagctttccttccaaaacttaagttctagggctcatattccttctatttctgtatctttttgttttgattttatttccatgagtactgtttgaccttcctcacccaaattccagctattgctgctgacttgtggtgacctcagtgacttgttttcatgtcttgagtagaattttatatgtactctattttatctaacaattatttcacgaacttgtgaagtctactatgtgtgtggtactgtaaggtgagaaacctgaggaagctcaaccccttttcacctgtcttttggaatgtccatgaagtcttctatatgtttaatggatttggctcagggttgtaggtatttgctttagagaggatggagctgaaccaagttctcttttctttctgcggtgttagtcttaacccttaatctgctgaatttttaaaactaaatagctcaggtaatgaggaaaattgcattagtagctacggaattggaaggtttctaggaaagtagtgctgcttaacccttttattgccaaatgtaacctatctcaaggcatcagaatattctttcttcctcttgctccttttatgagaactctgtggaaatgagagatgaggaggagcattgcaatccacttctctttgtgtctgtgtatgtatacgtgggtgggtggagtgggcgagattgctggtgtgcttttgatacccgtggcttagttttcttgaactataggctaaaactgaactcaaaggtctttcgccgcctccaccttttctagagtatgtgtcctctggaactccattaagaatgtactgtataaaactgcactggtttggactaagtgtgcccgaaggttgtttgcatttgagggtttataattcctttagctgctacatacctttcctggcttatgcaggttctaaatacggattaactggtgagaacacagagctcacaaattgtctgagatctgctcttaccctctgaggcatcttgtgtggaaaggagatggaccctcagtttaaaagtggttgggcatcatcttttaaaaacacatgattgttagacgtgctgacagtgagtggctgaagccaggctgcctggtattaccccttggttcttcatgagtctgtcttctcctgggccatgagcataccccttctccggcattattccatttcctttcacaagtccttaagatgaaggaaaataaaaattttaggtgaacagagggttttctgacttttcagcagtgatcaatgtgggtgtcaaatagactgatttccaaaatatacgtaaggggaataagtagaaccgggatgttaggaggctgcagagtattcttacatttaatagactttgtatgcactctcatataatcgagaaagtgatgcattgtaagagagaatattgcttcctgatttaactaggagcattagcgagaattttttttttctttttttgagatggagtctcgctctgttgcccaggctggagtgcagtggtgcaatctcagctcactgcaagctccgcctcccgggttcatgccattcttctgcctcagcctccccagtagctgggactacaggcacctgccaccacgcctggctaattttttttgtatttttagtagagacggggtttcaccgtgttagccaggatgttgtcgatctcctgacctcgtgatctgcccacctcggcctcccaaagtgctgggattacaggcgtgagccaccgcgtgcggccctttttttttttttttttttttctttttctgagacgagtcttgctgtgtccaaggctgcagtgcagtggcgcgatctcggctcactgcaacctccacctcccgggttcaagcgattctcctgcctcagccttccaagcagctgggattacaggtgtacgccgccacacccagctaatttttgtatttttagtagagactggtttcaccatgttggccaggctggtcttaaattcctgacctcgtgatccgccagcctcagcctcccgaagtgctgggattacaggcgtgagccacctcgtccggccaagagaatgatttttactattattaaaattattaaaattagtttaattttggattcctatattgagttatgatcatgttgcagttacacggtcttctaaatgcaaagtaatagagtataaatgtttagtagtagactcctgtccaaaaggagacaaattaaaggatgccaggcagaaagaagtggagttgttcgtgcagatttctgcttatatcctcttaaaacattaactttaatccaaaagtttgcagaaaactgaaaaatatacagagagctttgcaaaagtttgcagaaaactgaaaaatatacagagcgctttgtacacctttttttttttttaacagatgatgaacgcaaggattatatagtttggaaagagggaggggagcctacaggaacgttagtgagatgtttgagatgacagaatggtagcttaaagatttccgccattcttcctgccttgtcttaaggacagatcatgagtctacttggtatggttacctgtactttttcaaagaaaattctccctcacaggaggtgaaagtgagggaatgccttagaattaaaatctctgccttgggagagttggtaaatttttttaaaaagctgaaaattttatgacccgtaaattatgtttattatgaaagctaagaaaatagtgagacatgatttaattttgttgatgggtgcacgggtcagaataattttatttcctgtgtcttagaatcaccttttgttattccccaaggcccttggtattttataaatgtattgccaggctattctcagggagtgttatatatcttccatgaaatgtaatagagatttaaaagataagttgtatgtcacatatgatttagaagaacaggttaaaataatttttattgataaatactagatgttatagagaagcaaagagtttgtatatgcaggtttatatatccctttttatgtcccagtagctgaaattatttatggctacaaaaatcatccccattttgaaacaaactttgtattacttaagtggttttcttttttcattgagcctccttttctcaattacctttgtttgaaagcagtaggcaaaaaattcattttatgctaccagcaaagcattggatgtttgcccctccttggggttaggtgagacaaagccacactctccccttgcctggctgcctgtcacctcctccctgtgtttttattcctttcctacttacgtgggggctgatttgagcgctatgaatagccaggcctttggggaattaggggcagtcagaagctgttgataataaaatttcttaaaacttttaagctaaaattgaaaagtaaagaataattactatgaacatattttactgtatttctccttttttttaacacgtttcttaggatcaagaaaccctttttaaggaagtaaaagaattactgaaggaaaagagaaatagactaatattttaatgaattttaccactgattacaagataactctcattgttctttcaactttgaaattcttacttccatccattattaaatcttactgtgaatggtacccttaaaacttcagagttggaagggactttaaatgtcatcaagtccaaacacccactcagtgcaacagtcacttctgcagttgtaggttggaaacatcagggggctaagaggtggaaattggatgaacaagtggaggaagaggagcagaaattttggattctacattttctttactaaattttaggatcttgggaatggctggagtagtagaaagagattatataaaaggaacagatatactagaagctgtgagattgaaaggaaaaagattgaagaaattggctctctattgcttggctctgtaacagttagggagagtcagtttgccctttaaatatttgtttaaatttctttcctccaaggcgggggatagaacagataaggggatgcaaatgagagttagcataatggaattgaattaaaggaaacattctcttatggaggatgggaaaattccatccttggtggtggatatgactggtccttagtagctatctgggaattttgttagggtggcaaatataggtagaatttatggtgtcctgtataattttctggatttctgattttgtgacttatttcctgtcttgtgagtagtgtcatctgaaggctttggatttgtaatttcttttaagatttaaaatactgtaaggacccaagacaggatgatttataaaccatttttgatactgaaggtcacagaaaaccaaagagcatacgttggtagttggccttacatctcagatctgtctgtgttttattttcagtgtcagaactttaagatcaagtagaaaagatacccttcatctctatttttacagcattattgatatataattaaaatacaataaactgcatatttattcatgaaaccatttctatagtcaagataatgaatatagcagtcaccttcaagtttcctccttctctctttgttatccctccctctcacccatcctcgtcctcccatctccagattaccactaattttctttctgtaactatagattagtttgtgttttctagaattttatataaatggaatcatacagtatgaacccttttgctggggcttcttttattgtgatgtgtggtctttcatatatcaatagcttaatcctttatattgctgagtactattacattgtatggatttacacaatttgtttattcatttaccctattgatggacatttggggtgttcccagttttgggagtgcagtttttgtctgtgaacattctcatacaactttttgggctggacatatgtcttcatttctcttgggtaagtacccatgagtggaatgactgggtcatttggtagatctatgcttaattgagaaattgccaaactgttttcaaactgttttccaaactgttttcattttacattcttaccagcaatgtgtaaaagttccaatttcctgtcaactgttagtatgatcagtcttaaattttagccattctagtgggtatgtgatgatatctcagtatgctttatttatttatttatttatttattattttttgagacagagtttcactctcgtcgctcaggctggagtacagtggcataatctcggcttaccggagcctctgcctcccaggttcaagggattctcctgcctcagccacctgagtagctgggattacaggaggctgccaccacacccagctaatttttgtatttttagtagagatggggtttcatcatgttggccaagctggtcttgaactcctaacttcaggtgatccacctgcctgggcctcccaaagtgctgggattacaggcgtgagccactgtgcccagctgcagtatgctttaatttgtcattccctaatgatgttgaacatcttttcttgtccttacttgctgtttatatatctttcttaagaatctgttcaagattttgcccatttgctatctatgtatcgtccgtgaagaatctgctcatgatttttccttccttccttcctttctgtcttttgtctttcttttgtctgtctgactttcttttgtctgtctttcattctgtctttgaaatggtagtctcactctgttgcctaagttggaatgcagtagtgcagtcatggctcactgcagccttaatctcctgggcttcaggaatcctgcctcagcctcacaagtagctgggactacaggcgtgtgtcaccacttctggctgtcttttcattttcctaacagtgtattttgaagaaccaaaaaacttaattttgatggagtccaattttttttcatttttgttttgtgtgttacatttcaaaaatctttgctaaaattatggtcgctaaggttttctcctctgttttgttttttgttgttgttaaaagagaatggatctcactttgttgcctggtctggagtgcagtggcacaatcataggtcactgcagccttgaaactcctgggctcagcctccccagtacctgggaccaccatgcctggctaatttttcttttcttttcttttctttttttctttttttgaggcagagtctcactctgtcacccaatctggagtgcagtggtgcaatgacaactcagttgcagcatcgacctcctgggctcaagcaatccagctgcctcggtctcctggagtatctgggactaccggcatgcaccacaatgcctggctgatttttttctttttcttttttttttttttatagtggtggggtttcactatgttgcccaggctggtcttgaactcttgggctcaagtgatcctcctaccttggcttcccaaagtgctggcattaaggcatgagtcactgcacctggcctaattttttttatgttttatttttgtagaaatgacgtctcgctaggcggggtacggtggctcatgtctgtaatcccagcactctcggaggctgaggtgggcagatcacgaggtcaggagtttgagaccagcctggccaagagaccagcctgtccaatgtggtgaaaccccatttctactaaaaatacaaaaattgggctgggcacagtggctcacacctgtaatcccagcactttgggaggtcagggtgggcggatcacgagatgaagagatcgagaccatcctggccaacatggtgaaaccccgtctctactaaaaatacaaaacttagctgggcgtggtggtgcgtgcctgtaatcccagctactcgggaggctgaggcaggagaattgcttgaacctgggaggtggaggttgcagtgagccgaggttgtgccactgcactccagcctggcgacagagtgagactgtctcaaaaacaaaacaaaacaaaaaaattagccgggtgtggtggtgggtgcctgtaatcctagctacttgggaggctgaggcaggagaattgcttgaacccaggagacggaggttgcagtgagccatacatcatgtcacccttgggcgacagagcgagactccaactcagaaaaaaaagaaagaaagaaagaaagaaatggggtctcactatgttgcccaggctggtctcgaactcctagcgtcaagtgatcctcctgccttggcctcccaaagccctgtgattacaagtgtgagccactgtgctcggcttctctcttttcttctagaacttgtatagatttagcttttaaatttccctcttttctatcatgcatatgtgagttccacatgttcactttgggatataaattgtcacctgtggtcaacagagaacatttctgatactctgaggatttcgggactttcattccatttatcgtggaagcatttttttcttgttaggtggtggtgttagcaaccttttgttttcctgtattcagtatactacagattgtgtaatgccagtcttcctgtttctaaatattaatgaatgtttagcatctttatagataaggaaaattaattcattccagactaggatagggaataacaacagtagcagtaataaaagcagttgtttgttgcatacttaactgtatccctagtgcagtgctaaagagccttagatttattatctcattaatctctacattgaccttataaaataggtactgttattattcccattttataggtaatgaaactggaactcagatcaagcagcctgcttgaagacatagaactagttagtgacagagctaggattcaaacctaggcctagctgattcaaaactcatggacttactcactacattgtactgacagtttatgtgtgtccagtttttgtgcctgcagtgtaaaactggactgcagtgtaactattcactgctaggaatttcttagaaaattttggtggtattcccttagagttctttggtcatctacagtctattaaaatgaactggattctcctagagttcagttggcaggaaaaaagtactaggcttagatgtaaaaagcgtagtggctaaatgcctgtttttttttttttttttttgcatttagtaatttagactttgaagccattggaagaatcttaattaaaccttttttaggcatgaaaaaatagctattacagtgcttgcaaaacctatctttcgcttggctcatgcgttattaggatgatgcttaaattattattttttaatgtaactgtgtctcctttgtaagtagaacagctctaacatcatcacctgtcaggagttttagttgtttaaattgctgagagccacaagtagtggtaacaatgttacaggaagggggaagctgttactagactgtctctatagttatcctttttatattttaaatttgacgtttggtattcttaaagacctctgtttgtgctcctgaaatttgactgttgtaatgattgcaaatggctaataaccaggatctcttctgagtctgggaactgctgaagtttgttctttagacctggcagttatttgccagtggttaataattaagacattgccacagaggtccaagtacctggaactgggatttgtttctggtgactagtggtgaggagtagggaagagtttctgttgatttcctgagtctacatgtatctactctagatccaaagactgaccaagaagtcatgagactgtcctatcaggttcagttcttgctctttaagaaattgtaatttcaaccacgtctataaaagagggatagaaaaagctctaaggctgtgatcttagactttaaatgctgtagaaattcatagaagtgagggaattaagtggaaaggctattggactgacagaaggcctaagtttcaaaatcttagaatgctggagtcaaaaggatgctaagaattatctaattcaacccctttattttttattttttaagagtcagagtcttactctgttgcccaggctggagcgcagtggtgcagtcatggcccactgcagcctggaactcctgggctcaagcagtcctcccacctcagcctccagagtagctgggatacaggcacaggccaccgggcccagctatcaacccctttactttatagattaagaaatgttgactagacaagtgatctgtccaaatttaaaactagaaatagaacctttatctcccaccctgtctgaattattctttccatatgtagctgcttagttgtgtctttaccactaattaaccatgtgaactctaagcaagttattttacttttcttcatctttttatcttttgtaaaattagggggttattatgaatcatttctaacatctctgctaatgccccagatactgtaaatgacccagaatgtaattgcgggcagtgttaacttagcttcctagaagatgggggatatgactgggccttgaataaaatccaagatttggcagagtagagagggaaagaattcatgagatggggagcagtagaacaaaggcttaggtgtgaatatgtggctgtagtaaagagaaatggcctgattatagcaattatatgaggtttagtagaaccatttaagaaaggtaaagccacttcatagaaattattttatccctggtaagggctttaaggttccctttctataaaaacctgcagaaagcaggattgaaatttaacattttgtaacaggttgtaatacatgttgatgtccgtttttggccatgtgataagtggtggtgacagtaagtacattggaatatccaagaaggaatagtgttaaggtcagttttcagcaagttatttccgctacgtagatggagtttaaaaagttaagtttatttgattttcagtccttaccaattttaatacatcgatctttttagactttcagaaattagattttaaaaggcgtgactcttcagctggatctcaaggatgtataagaaaattatgggctcagataggtaatgccattgttgaaacaatctgagtctatctttgggccctgttgtttcttctaaatgttctttaatacagtacgatttagcttttgattgcatacttatttgaagtattcttctgtctttcttgaatgcaaaaatatatgtttatatcttattttggggtcttatctcccatctagattgtaaggtttctaagagtagtggtagtatttagctcatgttagttaatatcctttatgtattttatattttagttttaatgttaaccttgggaatctttttcttttttctcatcttaaggtttgcttcctttttttttttttttaatagccttgggaatcttgattattttcaaggctctctgtttctgtgatctaatataggagactgacagttttgaaaacattaattctctctcaccaaagtaactatggggcagagagaatcactaatgtaactatatgtgaccagaagaactctgttgagaagagattattattcatctctggagagatagttttgacttgtgtttaatgaaagaacatgtctgtaggattaaaaaaaactcttatgttattttacatagtgtaaggctatcaacttttattattaaaaatgaaagcaggcactttgggaggccgaggtgggcagatcacctgaggccaggagttcaagaccagcctggccaacatggtgaaaccccgtctctactaaaaatacaaaaattatccaggcgtggtggtgcccagttgtagtcccagctacccgggaggccgaggcaggagaattgcttgaacccaggaggtggaggttgctgtgagtcgagattgtgccattgcactccagcctgggcgacagagcgagactctgtctcaaaataaataaataaataaaaatgaaagcaggatttgactcagtgcccttagggattgttacatacatttaaagtgaataattgctaagttcccatattatttgaatctattaatatgatctttaatggctacagaaaggtttacattgagtattaaatgaagagaacaaggaagagttttcaagtcctcagggtatgtctggatatccacaaaaagtactagtggcagtaggagtgcaccatttttttcataagcacatatactcccacccagagctataagaattccttcagttccttcatttggcaatagaagcaaaatagttttggactattctaaaattatttcattttgcatggggcctagagggatatttttagttttcttagtttttgtgaaagatgtgtgtcaggcttagaggtctctagtgatttctttcttgattcttgtatttttaaaagatgggagttggtcttagttggcagctctttgcatccgccagggctgttcgttacttacttctaggtctgtgggtgacgtctgtttcctgtgattgaaaccgcaagaagaagtggtgagaagccactgtaggatatgtattatcaggcaagcagcaggcattgggctgccctcaaaaagagcagtagtacctaagtatagtctttaaggagtcggaagagaccctagaaatgatctgacccagcctcttaaaattaggaggacactgaggcctagtggtattaagttgctcaaagtcgtgtaattagatgacctaggttttagactccactaatattcttctcagtattctttctcacattgcattgtcatacctaaactttgtaactgtgccttgtcaggagtgtttccttaagcaaaataccactggagaagagtaaatactgataggcattttgcctatggtaattggatgatgatgttttgcttttagatgatgtgctaatgattttttgtgtgtgctttttttttgaaaacacatatatatttttgaaacaatacgtaagaaccctaaatttctatttttcatttttattttacagtctttgtatattttagtcattatctctatgcacaaatatttttacaacattgcctttatagtttacagatgttttttgcttttaaaatagtgtcataaaaattttccagctttctaatctttgaaaattgccaccttaatttgaaatggaaatgtatgtgtattctaaaagtgatagtttttttctaagaaaatacaaatgtatataaaaagagtaaaacagtcccatactttgtttttcagaaattaattttttttaatggttagaaccaaagagaacagtacatgatatatggaagtttctttagatcctaagtactttggcatgaaattctgtgtgtgtttgtgttagaacatagttcaacacaagtacaattgctagaagtatcagaacaaccttattttaacacttatatttctggtggtagagaaataataagatttcatcttcatgctcatctcccctcctccctaagattttttcaaaatcttattctgaatgtgtaccgggccaaaaaatattttctgtggtttcgtaggatcaagtctggcttattgagtagtagtataatttttggattagttaagcggttgtcagtaggggtaggattatttctgggtattcaggagtggtgtgaggatacaaaaaagagattatttagaaatgaaaggactttaggaatgggatttaaaacaaggtgtcctcatacttggtgcctgtatgtagaagcggtagcagttgcagaaacttcctgctgtctgctaggctttgggtgtgtcacacacatgcccacccttgaggaagagtagatgtcctgctactcacatcataacatgggaggagaagacagttgctacggcgattgggaaacagcattcctgagtcactgactatttctaaatgaatggacaacacccctttttttaaaggagtgatcatagtcttctctaagcttaggcagcagagggagaggcctagtaagaaaggaagagcaagtatcaatatttgaagcttgagaaatatgttgaaattttggaaaaattggttaacattatgttttgtttcctgtatatgtattcaaaagttgtattggaaccttagaatgtttgaaaggaaggaagctttgcttactgttctgtcaccaaatgacagactatgcatgctggctttcaccttctgaacagcagaagataccggtgtgcctgctacaccttgtgatacttgataggaaagtaggacttccagactctgagcactttctctgttggcagcttgtttgcccaaaccatgtgtgctttatagtgcaaggactggcagtttgtatggatggacttggaggaatgcagcatcctcagcccggtttctacctgttctgctgtgctggaatagtgataccagcgtggcctttcctccttccctctgggctatcaactacctaggatgccggctgccagttgcagggctttaggatgagctgagctgtaggcaaaaagttactttttccctttccccaaggtacttgccttcttgaactattagagaagtgatactttggacctgttagaggatccaattctaatattaagatagttttcccctcattttaattataattgggaaataaggtttattggaaagcagactcaccaacagttttagacagttgtgcaggacattaagttagttgctttacatttataagtaaattatttcaaatttataagcaaattattgaaatacagaatggactacagttactactgttctttatacggcatttctaacttgtgcttgacactggccactgcctagaatctttcattgttcccgggtggggttaggaaaaagatgctgattttggaaggcaggggtagattgatagaactcttttaattaggaataaaagatattggactgtcttttactatgtttcctttgttggctgttgtatgaattctaacaagtttattatttatttatgttttctcagctttattgaggtataattgacatacaaattgtttatggtatacaacatgatgttttgatatatgtatacattgtggaactaatgagtttaactctccagtgcttagtttagctgtggggctgctgaggcactctgaaccaaatggaggagctgctacagtcttacctaatccttcagcactttttcctcagtggtcatggagaacatgagcctatcatttccatttctggggactgctaggtaatcttcagccttctttcccttaaacacatttagcttttctaggtttatagtttatatttttaaattcctggtcattttgtgcccctcttctagacttcctttcctctgaggtaccctttttctttcctttattttctttttgaagtgggtactccaactctacacaacgcctgtgtaggctgcaggcaccaataagtggtgatgtcagaatctagtttgtttctctgtaaatgctagatgaaatgttgattcaattgctgttgtctttgggccattccttgaaaatggaagggaaagttcttctgtgcatttaaagttgtccattatttcattttctttagttctgactgacttctgtttaaggagtgggaattgaagaagggaaactagccagtttcagtggttccatcatatattatttaacttttacaaagtactttgcaaaacaaagtgctttatatctgttttattatttattcttcatactagtcctctgagacaacagaaccctagagataggaagactgaaactgtggtcgatttttaaaagcttaccctgactttacattcctttagtggaaatgtgataaattttgtggcaaaggccaggcgtggtggctcacgcttgtaatcccagcactttgggaggccaaggcaggtggatcacgaggtcaggagttcaagaccatcctggctaatacggtgaaaccccgtctctactaaatatacaaaaaattagccgagtgaggtgatgggcgcctgtagttccagctactcgggaggctgagacaggagaatggtctgaacgcaggggcgtagcttgcagtgagccaagattgcgccactgcactccagcataggcaacagagtgagacttcgtctcaaaaaaaaaaatttttttttgtggcaaagctagatcaggcctcaatggtaactgaattcaagatcctattatgaccctctgttgcctcagtaccctaaggaactgtgtcaatcctgaataaagaaattaatcagagctggacccttatctctctgttctgcatgattctaagtgacatatgccttaccttacctgttctttctgggtaggtagattaggatatgaaaggaaattatttttggctgtagtgatacttatttcccattttacccataggtagactttgtcattattgagggcttattgtcctgtgggctccagtcaaggttccttggtctcattcataaggaaagacattactcttgaaggtttgatttactgagctattcgtaacaatcatagtgtactgtcatataccttgaattgaaacttttccttacttttctcaatttgaatagagtaatgaaagaataaatatactgtttcggatgatgctcctaaacctgtagtgatgctaattttaaaatttatttattaaaatgtgggccacatcagttgaataagacatgattttgccctcatgcaatttagtctggttcacagaaaaagttacaacaaatgatctgttaagaaggttctaatatagtcccggtgcggtggctcacgcctgtcatcccagcactttgggaggctgaggcagatggatcgcttgaggtcaggaattcaaaatcagcctgaccaatatggcgaaaccctttctctactaaaaaaatagaaaagttagccagatatagtggtgtgcaactgtaatcccagctactcgggaggctgaggcaggagatcacttgaacctagaaggcggaggttgcagtgagccaagatcacaccgcacgttagcctgggtgacagagtgatacttcatctcaaaaaagagggagtagttcttttttttttttttctgtgtctaagattttatttttattttatttttattttttatttttatttattatactttaagttctagggtgtatgtgtacaacgtgcaggtttgttacatatgtatacatgtgccatgttggtgtgctgcacccgttaacttgtaatttacattaggtgtatctcctaatgctatccctcccctctccccccatcccacaacaggccccggtgtgtgatgttgcccaccttgtgtccaggtgttctcattgttcagttcccacctatgagtgagaacatgcggtgtttggttttctgtccttgcaatagtttgctcagaatgatggtttccagcttcatccatgttcctacaaaggacaagaaaaaaaaggcagttctagtataaaatatttagaacctggcttgagtgagtcctttagttatttttgtgtaagaattgtggctaagtatatgatttatagacaaggaatagattttttccttatgccatactgttggcataaagcatccactagtctatcttcaggtgtgtattttacaagaagtcttgtagcacatttgcctttacagaatgatctctcaccactccattttgtttatgacctcagtggtcgtaagaggtatatgtggggggttaataaatgggggaactgaagcatgaagaattaagcatgtttgctcaaaatcatacttgtagttttctaggaagccagaaataaaaatcaggactcatgagccttttcctttagcgaagttctagataaattccagagttcagcagtttgcttaatgtattggtttcctattgcttataacatcaccccaaacttactagcttaaaacaaacacacttattagctcatagttctgttggtcagaagtttggcatggattgtgtatctgggatctcagaatatcacaaggctgaaatcaaaatgtcaggctgggctaagttctcacctggaggctctgggggaaaatctgcctccaggttcattcaaattgtttgccaaattcagttccttgcagttatagggctgaggttcctatttctttgctgtctgtcaccggggaactgttctcagtacccagaggctgcctataatctgccttttggccccctccaccttcatgccagaaatggcatcctgaatccttgtgtctctgacctctagatttaaagggttcatgggattgggtcaggcccacttggatgattcccctttcttaaaagtcagttgtgcctgagccaggcatggtgctatatgcctgtaggccccactacttgggaggctgaggcaggaggattgctggagctcaggagttcaaggccagcctggcaacatagtgagaccttgtctcaaaaacaaacaaacaaacaaaaaaacatagaccaaaaaaaaagtcaattttgcctaaaatgtaatctaatcacaggaatgatatcctatcatattcacagtcctgatgattatacagggtgtgtacatcaggctagcaatcttgggggacatcttagacttccacctatcacattaaacatgttcctcacactaaattagcccatgagcaagggtggatgtcagaaaagagagaagtaggagtgtataccgagggagttagtgaattgtgttgtgattatacatataagaaaacctggctgggcatgatggcaggtgccttgtaatcccagctactcaggaggctgaggcaggagaatcacttgaacccaggaggtggaggttgcagtgagccaagaacacaaaaacctttgtagttcccagggatcctgggcctcctagaatcgtcagagtgtaaggaccaagtggcattcagctgtgctgttctggtggtagtccatttagccaagaactcaaatataattgtagttgtctattacaacttagccttaacaaaatctttagaaagtaatgaaatacaggcttacagtgtgggtttatatttcccgtgtgctggccacatggttcttgcaattaccgtccatgattaactgtccatgtgaagcacagaagtaggaattagaaacactttttgctatgtagaatgtactctgtgttcagagtaatgtttagtcatactctctttttagatccctgctaacctctctgctgctaagaactacccaattaccttttgcttggctacatgagcatcctgtgccaagagaccatgcttagttgtctgagtattctctgggccctttttctgattaaagtgaaaagttaaagattcagagaatcaagtagaggtgaatcagtctcttggatgagttttcttgtgtcctgaatttacaatagattgaattctgttactaagcaaacagagggagcctctgtgcagaagactgccattggaccgtttttaaaaagctgaagtattaatacacacaaccaccaccactgcaagaacaaatccagatatgcaaaataagttttaaacttcatttatgttttctgataataattaatcagggtgtttcaaactcattaagttattaattagcttgaccttacagggaataaataccttggggtcttttgacttttttgttgttgttgttgttataaactataaagtatctaggaagtttctaatttcctgtagatggtaaccaaaagatttatcttaccacatattacattaggatgtggtaactgaatcagaacttgaattactctctggaaggggagtaaagggacagcttttaatttttatgttgatggatggtcttagtgcagagaagaacccagccaaatatatttatatttgatgctgttatttttgatgtactgtacctttgagcaatttgtattgatttaagtaagatttgatagcactgagaatcttttggagaagagaagctcattttaatacatgcaattctattaaattattttcctgtaccagctaatgacctttagacatttatctagtcatctaattctattgcataaaaactcctatagaataaatgtttttctgcccctttaaaaatattttgttttcattaataattatttgcatataaatgaaatagataaaacttaagaaacaaaaatctaacatgtgtataaaagttggcattgccactgttagatggagtcttccaggcagagaaaaactgaataccatctcagagtcatagcccagcttcagattctgtgagtgtttacgagtgcacctagattttaaggacatcacttggccaggacataagtaaggcctgggaaacagggttcaccacagttgagcatctggcaggcctgcagtgagggccaagtactagacattcaacaggaataaggttgagggagtacactgctctgtattttctgcttctgagcttaccatatgcaacctctgggtctcctgaataagtcaaagcgggaaagttctgtggtgtgggaatgagtatccttgacagtccaggtagtagagcagagaaggaaagaaaaaaactgttaacatatggtccagacaggccaaccatctgggtcagattcacccaggtgttgtgaattttaaaagccagaacaaaagcagatgatggtgatgacaggcttcaagggtctggctcaagtctcattgctcccttttagctggtggttctctgtacctggcacatacagtcatcctggaacctttatccccgggatttccttcaatttcctcatgtgttaggtttcatttcctgtatttcaagtcttgcacttttttggtttgcatcctcattttggtggagcatgtcctacagtagcttcctgcggtatatgggaacagattttttaaagcttaaatgtctgaaaatgtctattctaagctgacatttgattgatagtttttgttgggtatagatttgtagtttggaaattatttttcttcagatttttaaaggccttgttccattgccacccagctgttgatattattgttaagaaacccagaactgctctgattcctttgtatatgacctgttttcatcctttctgtggaattttgtaggattttctttgtattccggtgttttgaaatttcaccattatatgcctttgaataatctatttttgtcctttgtgctagagacttatccttcaatactgggaaattttctttatttccttgataacttgctctctattttatgttttctcctattatttggatattggtcctcccaaactggtcttctaattttcttatctttttgctgtactttttggggaatttccttaattcttccagtccttttattgagttttcatttctgttcttgtattttaaacttctaatgacctctttttcctctgaatgtttgttgtggatattaatgatttttagaacatctttcttcttgttgcatactgtttatttggcaagttgcttcccccagccccgctttctctcatgttaggatctttcctcagatgtctgataatcctgggttgtctactcatgtttaagaatgagggattacaaagcagattggaaactctaggtgcgtgggtaggatttgaaagctggttgctttgctgtaggacagcaccatccaatagaaatctaatgtgaatcacattgtaagtttagattttctagttttagaaacgtgaaattaatatatctaaaatattacttcaatatgaatgaaatataaaaattattaatgaaatattttacttttttatattgttatgaattgcagtgtttattttacatttacagacatctcaactgagacgctaaatttttatttatttatttatttatttattttgagattgtcttgctctgttgtcagcaatgtgatctcagcttgctgcaacctctgggggctcagctgatcctcccacctcagcctcctgagtaggtgggactacaggcaagcgctacaatgcctggctaattattattactttttttttttgagacagagtcttgctctgtcacccaggctggagtgcagtggtgcgatctcggctcactgcaacctctgcctcccgggttcaagtgattctcctgcctcagcctcccgagtagctggcactacagacgcgtgccaccacgcccggctaattttttgtatttattttttagtagagacgagtttcactgtgttagccaggatggtctcgatctcctgacctcgcaatccacctgcctcagcctcccaaagtgctgggattacaggcgtgagccaccgcggctggcccatgcctggctgatttttaaatatttttgtagaggcaggttttgccatgttgcccaggctggtctccaactcctgggcccaagccatctacctgcctcagcctcccaaagtgccgggattacagatgtgagccaccacagccagtccctaaaaatttttttaagccttttttttgaagagcagttttagggtcacagcaaaattgagatgaaggtatagagatttccaatatatcgctgcccacacacgtgcatggtgtatcaatccgttctcacactgctatgaagaaatacctgagactgggtaatttataaaggaaagaggtttaattgactcacagttctgcattgctgggaaggcctcaggaaacttacaatcatgatggaaggcaaaggagaagcaggcaccttctgctttgccttctaagggtggcaggacagagtgagtgcaagcgggggaaatgccagatgcttacaaaaccataagatttcatgagactcacttgatatcatgagaacagcataggggagactgtccccatgatcctattacctccacctggtcccgcccttgacatatggggattatggggattacatttcaaggtgagatttgggtggggacacagagccaaaccatatcgcatggcctcccccattgtcaacatcccccactagcgtggtacatttgttgcaattggtgagcctgcattaacacatcagcatcacccagtccatagtttacattagggttcactcttagtgttgtacaatccatgaatgacatatatccatcactatagtatcatacagagtatttttcactgccctaaaaaccctctgtgctctatttattcataacctgcctaccctacctgcctcccccaacccttggcaaccacagttctctttactttttccatagttttgccttttctagaatgtcatatagttgggtacatataatatgtagccttttccttttttctttctttttttttttttttgagatggagtttcgctcttgtcgcccaggctggagtgcaatggcgtgatctcggctcacagcaacctctgcttcccggtttcaagtgattctcctgcctcagcctcccaagtagctgggattacaggcatccgccaccatgcccagctaatttttgtattgttattagagaagagatttcacaacgttggccaggctggtctcaaactcctgacctcagggaatccacctgcctcagcctcccaaagtgctgggattacaggcatgagccaccgcacctggccgccttttcctttttttgagactgggtcttgctccgtcacccaggctggagtgcagtggctcgatcttggctcactgcaacctctgcctcccaggttcaagcgattctcatacctcagcctcccaagtagctgggattacaggcacccaccaccatgctgagctaatttttgtatttttagtagaggcggtgttttcaccatgttggccagtctggcctcaacctcctggtctcaagtaacccacccgtctcagcctcccagagtgccatgtttacaggtgtgagctaccgcgcccggccatatgtagccttttcagttcagcttctttcttttagcagtatgcccttaagattagcactaagacaacagataatgttctgttgtctgaatgtgccatggtttagttacctgttcacctactaaaggatgtctttgttgctttcaagttttggcaattatgaataaagctgctgtaaacatttctctgcaggtttttggtgtggacatacgttttcacttcctttggataaataaataccaaggagcatgattgctggatcttatgttagtgtatgtttagttttataagaaactgtgaaactcttcgaaagtggttgtaccattttacattcccaccagccatgaattgaaagttcttgctcggctgggtgcggtggctcacgcctataaatcccagcactttgggaggccgaggtgggcagatcgcttgaggtcaggagttccagaccagcctggccaacatggtgaaaccccatactaaaaatacaaaaattagccacgtgtggtggcatgcgcctgtaatcccagctactcgggaggcttgaacctggaagaaggttgcagtgagctgagatcatgccactgcactccagccttggtgacagagcaagactccatctcaaaaagaaaaaaagaaaagaaagttcttgctccacatctttgcaagcatttggcatcatccgtgttgtggattttggctattctagtaggtatgtagtggtatcttattttaatttacacttacctgatgacatatgatgttgagcttctttcgtaagtttatttgccatttaaattttgttaaataaaatgtaataaattcctcctcacttacactagccaccttagtagtgctgtacaattatatgtgcctagtggtacatgttggacaatggagctctgaagtgatctacttggactatgtcacaagctttaagttgattccccagagaagacacttccaaccttctgtctcaaggggaaaggccaggctgctggggctctaagagactagagggggaaaagtgctgagtgtctcagtatatactatgcctaggtttacttttctttttagtatagggaccctggcatcctccaatccagagaccctccgttttaccctcttctgagaacaaacttccagacctctgctggaagaagggagggtagtttcccaatggcatggttgaggggtggggtatgatctagggatctaactgcttcttaaacagcttccaaccagtcttatttttagcctccccctcctttaactcccatttccataggtatctggtgccaattattcctaagccttttgaggatccttaaagtgtaatgggttggttattgctctttccggtttaggactcagctttctgtaatgtgttggatttaatacctctagttcttctagtcccagtcttcaaaatttgcagttgctcttttgttcttcccaaccttgtaggctctttccttgcatcacttcttactttctaaaaaacaccttttctgtaggtttagtgaggtttcaagaaggagagaaattagatgttttggttcagtctgacatcttttacctgaaagttcctattaatctggattcctaagccagatttggatattttaaaaaaattcattctgtatttatgcttccttcagtatctatatttgtagttaaaggtataagtgctaatgtttagtggaggactcaatagaagggccaggaagtgagatatttaccacagccagcctaggacagtaagggtttggtttgggaccagaagagaattgacagcaaacaaggagaatgatgaaagtggatgcatttagatgtaggtaggatgattagagacttaattttaagaatcttggatatctgagacctaatacataaataaagctccagtagcatttatctccctggactcctgtgtttttgttgttgttgttgttgttgttgttgttgttgttaacttgtcatgatctaggaacttattctatatttcagagaatacacacaactaatgatacaattaaaaaatgactactgaacaaagctgtttgccaacatagaatctgtaagaacacacatagtattaactaagtaaacaatacactctgaatatactgtagcagcaggtttctattttaataattgagcttgctgtttgagtgttgtattggattctaaaaccgttttgcttgtactgactgggctgtgattcactttgctggttgttgctgccctctgttggactagctcaggaaatgcagctttttttccctcgtggatcatgtttgctgtccttccccaaattgaacactaaaacatgggtaattttttttaaattttctttctttctttttttttttttttgatacagagtctcgctctgtcacccagactggagtgcagtggtgcgatctcggctcactgcaacctccgcctcccgggttcaagtgattctcctgcctcggcctcctgagtagctaggattacaggcaggcgccaccacacccgtctaatttttgtatttttagtagtgatggggtttcaccatgttggtcaggctggtctcaaactcctgatctcgtgatccacccgactcggcctcccaaagtgctgggattacaggcgtgaggcactgtgcctggcagataatttttttttaagataaaatctgtttctgatgatgccctaggaaagcaagggaaactggcatcttccttcatatatatatatatatccccatctcccttccttccttttccatctaaaggcgagagttagtggatattgaataggaaaaaggcacaagaatttggggaatgcaaagatttggcagctttggagtctggatgcctgagttctgtatccaactcatcccctaatcatatgacctcagtaatttacttcacctggctgggcttcagtctcttcattgatataatgaagaggtgtaatagacttggagagtttctccagggattgatattttagggaagcaagcctagattatagtatttgttcataggagatataatgacttaagttacaggctctgccatcaagtaacttagtctggaaatgggtagaggaaacagacaatcagaagacaattgtaatccatttttagtgctgtgagacaggcaagtgccttttactatggaaacacaaggaaaggtacatatccatttagaggagggatcattctgtagggcctgttggagttgtgaaagcacaatctaggctgaggaggcagcagcctagggcaagtctggggcattgaggcagcgtcatctgtttggagacgaagatggagtctgaggtggagagtttgctgagaagatgagactggggggaaaagccaggagagtcatatgccatgcacaggaattttgattttaacatagggcagcggagagttattgaaggcttttcaatggagaaataacatggacagcttggcattttagaaagatttcctcttggatatagtatggagaatggatgtggtatggggcagatgggactgaaggcagggagatcagttaggaggctgttggagtaaatcaaacaggagacaataatggtgtgaacttaggtagtgctagtagacatggatggaagagagacgaatcaagagtctgtaggcagaaagaacaggttgctggttaccccccaccctttttttttttttaaacttaagcttcagctgtgaacaattcagctgccattaattctttagacgcaggttctgttatctacattacatctatcttagagttgtttgcttgttgcttggttctgagggaactctttgagtttgggggacaagattttggaagcaatgactctgggagcaaataagtttaaccttggctacggtaacccaaattgtatgcactcatcccttttgtgcttgtttcaccttctatatgccaagggacttagggtggtgacaaaaggaactatgttgttggttgtcttgggtggtgctttctgcttcatcatccttctgctttgcttctattacataatcagaacacatgaagtaactaaattccgtggaccctttctcatggcaagattctcatggtttgggtgagtgattagccctcagccagtggactcttgacctattctggacaatggaggtcaaagtttgtttgcttgtttgttttattttatttcaaaagcaccaggttggtgaaaaatggacaaagtatacattcacagtttacactggattgaactgaattgtgttatatggggaacgtgaacataataatgtagatttttcttgtccatgaaagaggaaaaatagctttgtggcagaaatggaaccagtttttcattagttggggaaggttattcaagaagcatttaccaactgggtacggtggtatgcacctgcaatcccagctactcaggaggcggaggcgggcagatcacttgagcccaggggttcgagaccagcctgggcaacacagggagaccccgtctctttaaaaaaaaaaaaagatttactatactcgtctaaggacattaatgaaaaagaaatattgtttaaaattaggcaggatgaagaaaaattcacactttcccagacttgctcattcagacttttttgggggggcaggaggggtaaagtataacatgtatacagaagagaatgtaaaacatacagaataattataaactggacagtcatatgatccatgtcaagatacagaatatcataaacaccccagaagctgctttgtccccttccccaatcacgaccccaccccacccaccccaagtaaccactgttttgacatttatggtgattatttcctttatataataattttacataccaaataatacagtgttacatgtttttgaactgaatgtaaatgaaataataattcaatattatatttatgaatagctgtaagttcattcactttctttgtgaaattgctttccttgtaccaatataccagtttatttgtccacgctactcttttagttcacatctttcattaactcatacacaattatttgtcttctggtttgttgaagcaataaatcagacaacttttgtcacaataatatctgtcagagtggccagccggccataaacactgtaacactacatccatctgaagggcactcccaacgaaggtggctacttttgccattctcattggccttatgggatttcaggacagccagcttcaccttctttctcatgcttattcttcttgggagtagtgtaaaacttctttttcttagccccaccacaaagtctcaagatgaagagtggactccttttgaatgctgtagtcagacaaagcacatctaccttctagttgcttgccagcaaagatcagtctttattggtcaggaggaattcctttcttatcctggatgttggcctttatattttctgttttatccaaggattcaacctcaagagtgatggcctcccccataaggatttttatgaaaatttgtgttttggtggtggttccaatatatccagatggcggatcagaaaacccgttctactcttgatggccatttgcattgttttctgttttacatgtcatagtgttactatgaacactcttggtatacacattccactacgtatatgcaaaattcagcagggtagataacatagaaattgatgtgttgcgttgtagtacatgtgcatattttaactttactggacaatgccttactgttttccaaagtggctatagcattctatagtaccaccaagagttcctgttggtctgtgactagacggacatgaaagttttttccagtcttgggagtgtgaattgatatctcactgtggttttaatttgcattgcctcatttactatgaagttgagcatatcttataagtgtatcggtcatcagattcggattctgttcagttctgcatcatcttctttttttttttttttttcctttttaagagtcatatgttagtgaccttcaaactcttcctgccccttacttgagggaatgtgctaaggaatactttgacagaaatcattagcttgcagaaagtagcttggatcctttcaacttctctccctcttttccccaacccgtctggtgtttgggaggtttccttgtacttcactgatttctcttctttcttctccctcctttttcctgtttcctagactctgaagcggctcatggcagatgaggtaaggacattttgtttagcatgtgcatgttctagctcattgcctacactatcatatttaccagttttcataactttgactttctgtaacttatagtggtgatatggcttctactcagtatctcaaggcttttttcctaactctttgctgtgtttggcccattgcatgcatttccgtggaccttcattatcttccgaagttaggcatgctctttaaactcaaagctgacttgcagtctgaatgccactcatatcacttgaagccctataatacttacagataattactgttattttcaaacaaggagagctgataagctgttgcttattggtgactcttgttgatttgagcatcagtatttgagatttgaggaatggcttgttagcatttgtttggcagagagatggcatatatacccctgaggtacattgtattctttgctgacgagatgtcatgcaaaggggattttgaagaatatatattgaacttttgctgcctacattacacaagtgctttggagtgtacaaattaaagagaaaggaatgaatcctgactttaaggacaaatttatcctatttggcttgtatctattaaaatctgtagtaatacctcttgaagggagacatcctctggggtcctagcaacatttattgttgggtagctagaaggaaacaaagggcattttattgatagaactctgtcatgagaggctttcagttccgtactactacaaggcttagaaatggcaggggagatcaagaacaatgtttcttctagtttaaagaggtttgaaatcttaatactttggtcctcttatctttgaacatagatgagagtacagagtcagtatggtaagttagataggaggaagactgatttcttcttttcatgtcagaagagtcttgaactgcttgtgaaccagaggaaccatgcctgtgtaagaggttaaaggggtaaagaatttgatgtgtggcttgttatgtaagtgaaaatggatcactgctaatgcttttttctgtttctcagctggagagatttaccagcatgagaattaagaaggagaaggaaaagcccaattctgctcatagaaattcttctgcatcatatggggatgatcccacagcacagtcattgcaagatgtttcagatgaacaagtgctggttctctttgaacagatgctggtaagtttcccattcccaaaatgttgcttcttcctgtgcatttatggacatggtgggctctttttggtgcataattcccaactagccctttattacaaagaattccaggcttaacatggaactttttaatattaaccctttaatcccataattagggactaaatatacaaataccagttcataaaattggaatctgtgcttggaaacatccgatcactgtcttgttcatggtcttctgcccagcaacactttagccacaaagacgtagtggaccatctaaccctgtgtaccagagttggtaatatggagaccacctttgggttaagccagagcagataaagtgtggaggtattcacaacaaactctgtataaaggagaaactgaggatggaatatcatttgctcaaggtcctgtatagtggtgaatctggaaagaaaatacatagaattgctagaagacctttaaagattgtgtctgaagtcagctaagtaacaaagtatatgtgcatgtgacttactttgttgtcctcagtgaggaacaccgaataaggaggatattcagtgagtgtccattagtggtaagtcttggaaagttttgatgagtacaagatttcctaagacctgtatattgcatagatatgtgatctcagattcaaatagagactagtggcaggcctagcttaattaaaagcttaggtttaaaatccttagcacagggcctggtacatagtaagcactcaactggtactactgttgttatttttcactgaatctttcagtttgtctcttaatattccaagtgcattaagagtcttaagagtatggtctgtcaagataatctcttggccttggattgcaagtttaaatgtctcttgggccaggcaggtagtataaataaggtaagcaggctagatagaagatggcaaaagaagtggggaatgtggcaaattgaagagaggcttttggcatttttgttagaaaagccagccacaactcagttctagtaggtggttgcattccagttgggaatacttgcctagtagtgccagatatttctatttttcaaaagaagtcagcaatccgtaattttaaaaaaataataaatcttgaataacataaaatatcctagtcactatttgaatttccccaattaggtcatttttttaaaaaccagtttgttcaaatcacaattccaaatatagtccactgtactggtattctcaattttcatttaaactataggtttcccttcctcttttttttgagatggagtattgctctgtcgcaagcagagcaagacttgcaacctccgtcttctgggttcgagcagttctcctgcctcagcctcctgagtagctgggattacaggtggacaccaccatgcccggctaatttttgtagcttgagtagagatagggtttcatcatgttggccaggctagtctcgaacccctgaccttgtgatccacccacctcagcctcccaaagtgctgggattacgggcatgagccactgcacctctttttcttttatccttactattgatactaaaaaaaaattgttgaaaaaaccgtttgtttgacctgtagagtttcccacaacatgaaattcgatggatgaatcctttggtgctgttttactagagatctgtatctttatgtaaggtcccccagatttaaaatgttgagctagccaagtgaaacattttatctttgggtttgacttagcttgagggccaccattttgtaacttctgtgttcagtttatctgcaagaggaaaaatgcatctggctggcagtggtggctcacacctgtaatcccagcactttgggaggccgaggtgggtggatcacgaggtcagcagttcaagaccagcctggccaagatggtgaaaccccgtctctactaaaaatacaaaaattagctgagtgtggtggcgggcgcctgtaatcccagctactgccaggaggctgaggcaggagaatcacttgaatctgggaggtggaggttgcagtgagccaagattgtgccattgcactccagcctgggtgacagagtgagactccgtctcaaaaaaaaaaaacccaccaggaattaagtcacagaaacttcagattaattttgctgcttgcagaagaaacagaatacatccccccatccatatttttctcaattcaaataacattctggaattattagggctaaatttgtgcacaccaaggtactaggcttggacacatggttgttatatatgtagaaagatcaagcagagcctttccccaaacatacatcagattatgtctgtcagggggcctctgctttatcatagagtttccagttctttcttcgtgggaaaggagtttgtacagggactgagttaaccaggggtaatgggtttgtaggccctagagttggtgcagagtttgttgctgttgattttgcttgtgtttagattatgccattcatccagtgcttcagtctgaagagatttttaaggtccatccttgatgcagaaagcattgtgtgtggttttctttcaataatacaaaataaatctttcatttatattgagtccatttttcttagagaaaaaaagtgtgtatatgtctatagagatttatactaaaatgttaactatacttatctttgaggaattttcatcagctgtaatagcttaaatttctagggatcaaaaagatttatttacttaagcattttacatgctcaactcttcactaagcatactaatattaaacactaaaaatttgtaaagaatttgaggcaattttgttttttctcttttttctccctctcctagctggatatgaacctgaatgaggagaaacagcaacctttgagggagaaggacatcatcatcaagagggagatggtgtcccaatacttgtacacctccaaggctgtgagtcctgggacaggtacccatgacatgggagactgtgcccttgtcttggacctgttttttttttgccaattttatgtaacattttatgtctgcatcaattctgtttcattccattatataagcctgttcactttttactgtcttatttagttaccgttcttacatacattttgcctggttaaattttcatgaagtatgtaaatatagggaatgggataggcagttctaagtctcatttatgttggtggtatgtgagatgggtatctgccctgataaacgtggcctgacatggtggcttactcctgtaatctgagcactttgggaggctgaggcagaaggatcacttgagcccaggagtttgaaatcagcctgggcaacgtagtaagaccttgtctctgctaaaaataaaaaataaaaataaagtataaactctattgactaatactagtccttaatttatgactgggtccaccattactaatctctgtctatgccttctgtctagggcatgagccagaaggagagctctaagtctgccatgatgtatattcaggagttgaggtcaggcttgcgggatatgcctctgctcagctgcctggagtcccttcgtgtgtctctcaacaacaaccctgtcaggtgaggattctgaggaggtaacaggagtaggagccaaatgttggacttcactggtggtgattgaagatcaaaggagccagggaagcatgagaatagtctgaattgggagtagtaagttgtcaggataaactttgtttggcaaataagtatttattggtttgatattgcattgcctctctctgttccttacagttgggtgcaaacatttggtgctgaaggcttggcctccttattggacattcttaaacgacttcatgatgagaaagaagagactgctgggtgaggacttccaagtctttgcaacttcaagttggagagtcacaggggacttggctatttgctctgaaggagaaagtagcagttaaatgtaaagttgtgggctaggggaatgtactgttagccaagaaggggtttatcatagtggtggctagaggatgaatgatgattatagatacaggaaagggaggaggaacttaaatttcatgttggataagttcaatacataccacagaatattagtctcccagcactggttctttttcaatctggaaataaaatctgatttagtgctgctgtgtaatctggtctgggtaatatccatttggaagtcttataatatacttgggactagtattgtgacagtcttcaaggttggaataattttaggtataccttggactctcttaggctaccttgaagccaacctgaagcagagtacttcctggaatctttctgaaacaaaataataacatggccaagacctacatatatcttctcagacttgaaacctctagtagcaaggcaagcagcaatagatgggatgttatcctgatagaatttagcatttaggagcctagggagagttaaaaagaagattttaatataatactaaattcttggattacaagaggatcagccagatttgttgatggtgaagatccctcttcagttatctattttcttcagtggttctgggcaaggtgctatttcctaaaatttactcatctgctagatggggctgttgttcctaagaaccttgtttgcaagattaaaaatgggaaaggggtagagaataaagggacctcactgattatgtcttctatatacaggagttacgatagccggaacaagcatgagatcattcgctgcttgaaagcttttatgaacaacaaggtgagatttttcccattctcattccaaaccccatctggacgcctgttctttctcttctattggcaaaccaaaagaggaactaggaatatgaggttcaggacttctagctttctcttttagtatcataactgtttttcattgccacatatacatgcttctgtggatatttttttctcagttctaacttctgtttcagaggacaggctcaattttgtttctctctcttttttttttttttttttttttttttttgagatggagtctcgctctgttgcccaggctggagtgctgtggctcgatctcggctcactgcaagctccacatcctggattcatgccattctcctgcctcagcctcccgagtagctgggactacaggcacccgccaccacgcccgggtattttttttaatttttatttttagtagagacggggttttaccatgttagccaggacggtctcgatctcctgaccttgtgatccacccgccttggcctcccaaagtgctgggattacaggcatgagccacagcgcccggcctgtttctttactttcttttgctaattcttgaatttcctgacctgtagttattgtctctgcaatatttgctttatttcctgtttcttttttcttctagactgttgctccatttttatcttctttttgtctgtttagtaattcaacctagtgagcccacagtcctgtgcctctgaggacaaatctctcttcctcattgtttaattttgttataattaacttattccattggattgcggggagagaattaacaagaaacatataaatcaaagacttttattcttggaagacatctaattctgttgtgcctcctagaaaattattttggtatgttcatctctaattatattgggaaaagtattctacccctgtattaatttgctagtgtaccacaaaattagatatcttaacagaaatttattatctcacaattctagaggctagaatttcaaaatccaaggtaccagcacggttggttctttctgaagctgtatatggtaatatgttccatatccctcctagtttctggtagcttgttggcaatccttggcactccttatcttgtagatgcatcatcctgatctctgcctatgtgatcacatggtgttctccctctgtatgtatccatatccaaatttcctctttttataaggacactggtcatattggattaaggaccctttctaccccagcaggacttcattgtagcttgactaattatatttgcaatgagtatatttccagatgaggttacattttgaggtactgggggttgggacttcaacactggaatttaagaggacaccattcaacccataacaacccgtaaacttgtcccccagttagatgctttcgtctttcagcctcctttctttgttcttggtcctaccagtttggaatcaagaccatgttggagacagaagaaggaatcctactgctggtcagagccatggatcctgctgttcccaacatgatgattgatgcagctaagctgctttctgctctttgtattctaccgcagccagaggacatgtatgtgactggaataatttttcttctccattttcaattttatcattttctcttagttcagaggacaattgagttggttgggtgtcctctcggtcataaatactaggtaagattgtgtttcttcccagaagtgaacactaagcatcttaaaatttaagaacaattcctaagtgatgggtgctatcctgaatgttccactggtcatcagaggtatagcaaaatgtctcctatatctccattaatatctgtattgtctaggatgagggtttctttttactattctttttttttttaattcagaagtggcacaatgttatttttaaaactcaaacgatatagaagtatataaagtaaaatttaactgcctcatccctttgccaaatcctattctgcaaagagaatgactgttaatggcatggtatagtctcatagaacgtttcctaagcatagacaaacatattgcgttcccttgattctagacatctgccaccgcaaaagatagtatcttaagagctgaggaatgacacttatgcctataaaactaactgcatatataggatagatttttattattgaagagggatttggtttaaccaaagctaaatcattcttttcaacctgtttctttttaatagtagatcttggacatttcttctatgtcggtacttacagatctaccttattatctttagtagctatttagtattccatatacatgtatgtatggcctataatttatttaacaattcccctgttgctggacttacagattttttttttttccttttttttttttgagacggaggctcgctctgttccccaggctggagtgcagtggcgcgatctcggcccactgcaaactcctcctcccaggttcaagcgattctccttcctcagcctcccgagtagctgggactacaggagtccgccaccacgcctggctaatttttgtatttttagtagagatggggtttctccctattggccaggctggtctcgaactcctgaccttgtgatccgcccgcctcggcctcccaaagtgctaggattacaagcgtgagccactgcgcccagccaacttacagatattttttaaagcagatttcactatctgttctaggtgatcatttttacaaatgatactgcagtgaacatccttgtgcatatcttctttcacatttatgcccatatgttggatacatttctagaagtagactatatgttacatgcatgagaaattgattagtactgttaaatgcccctccaaaagttgtatcaatttatacttcattgaataggggacttgatttggtatttatggacaggagcctagggatggattgtagggaatgcatttccctgaagagatggtccttagctttcagcagtttctggaaactgagtggtgagaataataatgtgagaaatccggaacactgataatgtcctgtttcctaatcggtctgtgcccctgtgtaatttactcattatacgtgtccgtgtcacagtacctggaaagttctctccgtttcctttctcttgggcaggaatgaaagggttttggaggcaatgacagaaagagctgagatggatgaagtggaacgtttccagccgctgctggatggattaaaaagtggaaccactattgcactgaaggcatgtatatcccctgaaactgggcccaagaatagaattcaagatggacagacttaaattcatttgaccttttaataaaatacatggagtgcctcccaactatatattttacatttcagaatctgttatgaagggaaaatgattaaccttctttctaagaaggtaaagaatgaactgttttcctcattatgagatggaaaaaggcatgatatctatttacaatctaggaaaaccaagacctacaataacatatactctcaaatccttgaaaccatttagagtttaggctctccggatctgtactcaaaccaggtctcattgctatagtagaaaagtcatctttagagtttttgtattgtatctttcaggttgtattggggacctaagaatgcatgtaaagaaaatggattcttgatctccaggagttagcattgacatagctgctgaattttcttattttaggttggatgcctacagctgatcaatgctctcatcacaccagcggaggaacttgacttccgagttcacatcagaagtgaactgatgcgtttggggctacatcaggtgttgcaggtaagatattacacttcattagaaaggctagactggttccttcttgctctacagccccaataatcccggggataattctggttttcaattaaaaaccaggttgaaaagcttaggtttctaaccacagaggatacttttgggttccctgacttctacttttgttgttgacaggaccttcgagagattgaaaatgaagatatgagagtgcaactaaatgtgtttgatgaacaaggggaagaggattcctatgacctgaagggacggctggatgacattcgcatggagatggaatatccttttgctgactaggttcaaggcagatgagacattcattgtatttagttccctgatccctgtgtggaatggtttgggagatgatgactcagaacagagcatcaggcttatgtgtcttctcattaaataaggcaggtgtatttttattgcgctggctttacttagcttatcatagatcagggaagtcagtaaaggtgatctgagggttgttgagcatggaagccatcaaaatcagtgtaaacttcctagaatgtgatagcttagcttactaagatgtagaactggcttttagagatgtttggactgacagagggagtaatttagttacctgttaatattttcagtaagtgactttgaggcagttacctcttattttctgtctactgcctgatcttcaagccaagtacttactaggaatcctctgtgtgtatagtaccacccaattcactggtcccttaaaggacgttttagaaagcttaaagtttctggtgatgtttacaggaagaacagccagtagaatggaagtggtgtcttgctacttttccctagctttttcaagagttaaataagccacctgtcaaacataatttctgcatatttgctttccttagcctatttcccttttccactgactttaatgaagtctttcagattctcttaaacacagtgaaggattcaaaggcagagccacacttcctttccatcctgcagcacttactcttggtccgaaatgactatgaggccaggtaagatgctgtgcttatgagaagttttgaatttgagcctaagtggagagagtgaattccttaaattcaaagattgttctgtaaaaggaaaatgtaaagacaaagacccaagattagggttcattagtcaccgatataaaggaagttgtcttatttctttaatccaactcaaaggcatccctatggcagaggtcagagtgtataaggtgaaatgccgttctgtttttggaggggagtaggtaaataggatgaagatgttagcaaacagaagtggcaatttaaaattctttctagtttcctggaagtatagatttagcaatagcactatccatcacaggaaggatcaaacgcaaatttttagatgggaaagtattggcactaggagcggatggcaagaagttttgattatttgaagtagatagggtagggtagctgatgtggaaaaaggagttttcttagcatggcagcaatacttgtgttaactttacaaaagtttttccaggtctctcagttgtcagagcaattacgttttcttggtcctgaatacttctgaaaattatattttgattttcctttgatgaccctgtttttattctcttgtagacctcagtactataagttgattgaagaatgtatttcccagatagttctgcacaagaacggggctgatcctgacttcaagtgccggcacctccagattgagattgagggattaattggtaagcatactcttctatctggctcctccaagtattgcttcttcctttcattttgcatcttgtttcagtgaaaatgtcagagaagatacctttccagtccccagatagttctatttttgtcctttcttaggtcataaccagcatctttgctaggaatctataggtctttagtttatttttagataaaacacacaccagcaccttttgcaggaactcctggtggtctcagagagtcaaaaatatcactcataggcattcttcttgccacccagcatggtggccttaccgcacactcagattacatgttgaacttaactgaaagttccatttctttgtctagtgcagaacattaagaaagataataaaaatgatcaaaaagactgttctttggaagggtgtagtgtgaaagaaatagaacaagagaattaggagctttacttactgactcttcttcttttcagatcaaatgattgataagacaaaggtggagaaatctgaagccaaagctgcagagctggaaaagaaggtgcatatgagagaccaaagacatgtgtttgagtatatctttctttgagaattattattttcctgatctatgagacagttttcctctgtggtattttggaagcgtttagcacccaatagtgtagttcccaggggaaacctttccagtatagggtagtcattggagaaagtgatatggatgtcttcatagggagctctagtggtggactttcagttcttgggctactgggcaggaaaagaaagacagatgatactcatgtaatagtaatggcactctcaggtttgcttggcattttaggcctcttacccctagaacaataggaactggggtccttagagcaatagaactagaggatgtctgagttctctttttctcttcagtttttaagaacgtttattgtggttaataggtttttgatcctagagaatattgggattgtactaccatggtcgtcctcgttaaatacctttaaaatcttattttttttaactataaaaatagggaatctgtggaaatgaactgattcccctctcctttaaccttgttttattttcatttttatttttatttgttttttttttgagacggagtctcactctgtcatccaggctggagtgcagtggcgcgatctcggctcactgcaacctctgtctcctgggttcaagcagttctcctgcctcagcctcccaagtagctgggattacaggtgcccaccaccatgcccggctaatttttgtatttttggtagaggctaggtttcaccatgttggacaggttggtctcgaacttctgacctcaggtgatccacctgcctcggcctcccgaagtgctgggattacaggtgtgagccactccgcccagccaaaccttgattttaaggtcagaatcatggtgcttttttcccccgagcatggcctggatttatgagctctgtaaatcaagtactggcccagaacaggaggcagtggggggattccagcacccccaggcaaaagaggaggtagggagaattatgggtaataatacttgtgcttcttactgagatggagagcttgctgggagcctgattcgttttttctctagttggactcagagttaacagcccgacatgagctacaggtggaaatgaaaaagatggaaagtgactttgagcagaagcttcaagatcttcagggagaaaaagatgcactgcattctgaaaagcagcaaattgccacagagaaacaggacctggaagcagaggtgtcccagctcacaggagaggtaatgcctgagcagggaaggcagaatgacctgtaacctcaggatgcacatggcttggaacaggagtcagtcatctcgctcctagggagggttcagctactaataggtaatctagttacatggtgcatattttaaaaataatatactggtttttggtttgtgttgggggtaagtaatacataagacagaaaatctggaaaatacagaaaaacattaagaataaagtaagtttcattaccacccagaaataaaagtaataagtctcctaataaattaggaataaaaactaaactgttaaaaattgactaatttcctgttattttagtcacctctgcacagatttatccttacacactctctctgcagtagtaaatacttaaatgatctttgatgtctgataacttgattacttatgtggttatataatcatctgtgtagcacatatattagttatataactagaacatttaatttacttgacctttacattttctaatcaagggagggtttaacataaaggttgaaattgtcttcttaatacaaagcatgctgaactaagaacatgaaaacctgaattctagttttggctctgctgccaagccgtgtgactttaggtgatcatgtcatctctctgactcctctcagttcctccatttgtaacatgagaagtttggattaagtagtttattaggttccttccagtcccagtagtccctgaagtggggtgagaagtactcacattgatgttatttctgtaggttgccaagctgacaaaggaactggaagatgccaagaaagaaatggcttccctctctgcggcagctattactgtacctccttctgttcctagtcgtgctcctgttccccctgcccctcctttacctggtgactctggcactattattccaccaccacctgctcctggggatagtaccactcctcctcctcctcctcctcctcctcctcctccacctcctttgcctgggggtgtttgcatctcctcacccccttctttacctggaggtactgctatctctccaccccctcctttgtctggggatgctaccatccctccaccccctcctttgcctgagggtgttggcatcccttcaccctcttctttgcctggaggtactgccatccccccacctcctcctttgcctgggagtgctagaatccccccaccaccacctcctttgcctgggagtgctggaattccccccccacctcctcccttgcctggagaagcaggaatgccacctcctcctccccctcttcctggtggtcctggaatccctccacctcctccatttcccggaggccctggcattcctccacctccacccggaatgggtatgcctccacctcccccatttggatttggagttcctgcagccccagttctgccatttggattaacccccaaaaagctttataagccagaggtgcagctccggaggccaaactggtccaaggtaagagtttctgtctatttcttcaccagtcaatcttttttttttttttttttttttgagacggagtttcgctctgtcgcccaggctggagtgcagtggtgcgatctcggctcactgcaagctccgcctcccgggttcacgccattctcctgcctcagcctcccgtgtagctgggactataggcgcgcgccaccacgcccggctaatttttgtatttttagtagagacgggatttcaccgtgttagccaggatggtctcgatctcctgacctcgtgatccgcccgtctcggcctcccaaagtgctgggattacaggcgtgagccaccgcgcccggcccaccagtcaatcttaagaaacagtttcagttttctactttgtattttgtgcatggatgggctacgccttaaggctttcatctttctatctttaagcttcactcatgcttatgtttattcaggagatattaggcatcttctttattccatacatcaccacggagagttctgtgaaccctgtattctgaatttaatcttaacttaatgttttttgccttttctctgaggctgtgaataccatggtaacacacagtttgataatagtcattcaccagtctgcaaactactgataattgtgctgatcccaaagtcatggatttatgaatccactctcctatcccaattccgcaggatgtgagttacacaggccatttttttttttttttttgagttggagtcttgctctgttgcccaggctggagtgcagtggcataatctctgctcactgcaacctcagcctcctgagtagctaggattacaggcgtgtgccaccatgcctggctaatttttgtatttttagtagagatggggtttcaccatgttggtctggctgctctcgaactcctgaccttgtgatccgcccaccttggcctcccagagtgctgggattacagacgtgagccaccacacctggcctacataggccatatttgcatgcacagtattgttcccatgatgtgtttgagatgcctgtgattctgagtgagttagcctttttcttctagaaaccaagttaatataaaggaccttagggatttgctcataaaatgagcaaatttggcacagttagccaaactggtgggagaaatttaatgatgagcaagacttctctgaaataaagccttaatggttatgaagctagaggatttggagttaggaggaggatacgtagtatatatatgaatctagttcttgaataatcaccaattaacagatgaactggaagtattctctcctaatcccactgcagctattctgtgcctcaagttagtcttattctagtaagacattgctgataatcagccagccacctattttacagcctcatccgttttctaggacggaaagtacagggctcagtttactaattcttaacaccctgcctttatccacagcttgtggctgaggacctctcccaggactgcttctggacaaaggtgaaggaggaccgctttgagaacaatgaacttttcgccaaacttacccttaccttctctgcccagaccaagagtgagtaccttcctctttgatgcaaaggtccagtgtagggcttagaatattttttcattaggtttcctattcccttcccttccctgggtgaagatagaaagggtatgttggatggaagactgatggattttcccattcaaaagaaagaaaagatgtttttgtattaaatattatggagttacttggtttgggaaagagaactgttgtatgtaggtattttgtatcagtataacttgttagggatatgagattaaagtgacagagcttgatttgggcccattttgatacttttgaacagattctggcactgccttaaggtgcagtttccagttctaagtacataattaataagggttggaaagagtctttaacagtttgggtgactgagtgactgtctacagtaacaagaaccatatgtgattccttttcttccttccatttctttccaatattggatgccttctccctcctggcactttgctcctgaagcttccaaaggtaagaatacaaaagagccttttagtttggtctcttgaatattagagaaaaagatgaaatagatataaaggaatttctcattagaaaactgagaccagagattgagggttgacttgtctttgctaggtgttttttgtttttgtttcctcccctggagttcaaaatgaccaatagctttggcattaactaatagggaggaaagtttgcttcccgttaaactaccacatacttaatctctttagaaggtgagggacaacgtaagcaataatactattaccttacatttgtgctgttttacaattttcatagtgccttaacatatatgaccctatttgatatgcagagaagccttatgagacaggcaggatgtgtatcatctccattctgtagcatatatagactctgaacagttaggtagctttcccaaggttatgtgatcagaaccaggagtcttgacttctggtccattttttctatataaattcttgattttcttttttagccttcatatggttccttttattttacaagagctgatctactttgccctcttctttcttgacttcctaattcttgtggttttgtgctaccttgtgatagggtacttatagttacttcccctgagatagtatttgaaagattgtgtcatgtataatgacaattatagcccaataatttcatatttttatcttcttccagcatttttgtttgtttagaggcttactatgaccctagtgatgaaaattaagtgcaactttggagcatttattttccccacctccccctagtcaattagtatttttaaaggcaattcctttttttttccttaagtgatctgatggaaacaggctgcactttgttctaataaggagtctaacagattgtgaggtgccttggtggcccctagttacatatgtgtgtgtgtgtatctaggagtataagaccataatgctcagatctgtcttgttgccctgtcattcaggtcaaaatggccttttcctctaagaaaattgtcaccttccatgccaaagtccagcctaagggattaattccactctcttaattaaaatactgggatggtaaccacatatactgtattagtctatcaataaagactagttgacaaagtcaaaattaaatgattttctaatttgtaagttcacagaatccctatgttggcctctggcataagtttctttcttgagtctgggctctgcacttttagtgccattgcaaatgaatactgactgggccccttttctccccccacccccatccccatctttttatttggtgcatttgtattcctattaattctagttgggttttatacagtttagtggtcttccttggcattatattctcattatgaattgggatatggtagtattttttaaaataccaaagtggcccccttagtcacaaaaggccaataaaaagaaaactttagtaaaagatctttgtgcttcttatttagagtttaggtttttgtcagataaggaatttcaagctctcaaaaattgcaagcactcagaagacccagatctcctcagtatgacagcaagtatactttacttcagtgctttaaacatctctagtatttatatttcagaaaaagatcttcatccttaactacttttattttttttatttttatttttatttttgagacagagtgttgctctgtcgcccaggctggagtgcactggcgcgatcgtgctcactgcagccttcgcctcccgggttcaagggattctcctgcctcagcctcctgagtagctgggattacaggcacccaccatcatgtccagctaatttttgtatttttgtagagatggagttttaccatgttgggcaggctggtcttgaactcctgacctcaggtgatctgcccaccttggcctcccaaagtgctgggattacaggcatgagccactgtgcccggccatccttactactttttaaaagtaattcttgaatactgaattgaatattgaaccagttcagtttgaatgctgaagccagtgtcagttaccaagtctctcattcatagtcttgatattgatgatataattaaatgatagataactactcattatcaaccttgtaaatatttcatcttccagatgaagtagtgacatagattagataactttttccaaactgtataaaaagtgtcagaattcagactccaaacagtgactccaaagtccttgctctagccttctacttcttaggaagtgtgtatgtacttgccctaagagcctctgaaagcttagatccagacaaaagctgcaagaaaggggatatgccgccttcaggaaccacttcattcattcagacgcaaatgtccttgaattggcagtgactgagtagaaaaaagggaacaataatagattaaaaaaagtaagtgagatactagatatttagggttataaaagagaaggcatattctgactgtattcaactctagcaaaactaatccagttgaagaaataagacatgtttatctagtagaagcactgcttaggtgatttcagtccaggtggttgccagtattgatgaagaagttatttggacactgggttttcatcatattgcattatttcctctcttgcttgctaaacacaactctgctatttgttaagcatgcctgtatcccccttatgttttattgatacctaaaaccttcggtatacctactggcccctccaagaatgggcattgaagaaagcacctgcctcactctgcacatttgcctcctgtagtgaaaagtctcctgttacacatattctgaagcagaatatgtgtgcctttttacaagagaagagctgagagacaggaactggtcctagaatattatactccagattcttttacacattatttctcttttaaggattagtgtcttgtttctgaaggctttgtttcccataaatgaggtatttacttactcagttaacttattccctgccagagaatattttgaatttacttttgataggcagtgccataaaacttctggtcctttttcacattctcactttccttatagtgatcagcaaggagtctttgttgactctttttgaatttcttggaaataggtccaatagttaaatttctttttttttttttttgtttcattttctccaagggagcattttcattgctgtagtagccttaggcagctcattatttgtatgtacaagataaactagtttttcattttccatttcttctcttcgctgtcttttgttgattatgtgatcattacactaccacctcttgaaccatagcatggtgagtgataactcatgtcttaaataaatagtacagtgacttttatttttaggtttattccttccttccagaaacaatatggaacattagacttgttaaagtaagaggtgtgttatgtgaactgtgagcatcagaacagttctccaaatatttaatggcagtaatttagaaaaaactctggctaaaaagaccttcactaagaattgagaattttattaaaaaataacagtattctagttagcatttgactgtgtgggtccagtactgttgttccagaagtcagaactgttagccgtaacagataggtttacctgtctgctgccctgacataattttcttgcttcaggcttcagcaggagcccctttcccaaaaagaatctgagggtctttttctttttccctgtgatatctcttctgtccactaggtggcactcacccagttgcatctttattagtgaatttttgtagcttctgcagctttaacctttagcagcaaggttttgtgagagctcagcctgctctaccttgttcagtgagtctcttagcagaaagatgtctgttccatcagtttcttattccactcaaatcggtaagattaggactagaggtactagtcaagtgaacacttgttgggagtcttaccttttaattacttagcttctcttgggttttgagtagggtcagactactagcacaaagaaattgggaagttctataatatcaagataatagtcccttgtgatttaaaaatataaatctatccctattatctggggtttccagaacttcttcacatggaaaaagtaccatacctcctccaggttgtcatctcactgtcactagtgatataaaaaaggaacctaaactgccccctcatatacccctctacaccccaacctttccatcaccattttcttttaatccactggatctaatattatgccatttatcttggtttatgtcacttaccacaggcagccccagactcctgggtcatccttcatctcccatagtttaattgcgataaggttctgtgtggttcctattctgtctcctcccatcccacctaagctcctgaaactggtccactgtaccctctggaattcatggtccattactggcaaaacctttttcactttgctctactggaaacctggttttctctcaataccactttcccttttgcttgcttatgtggttttgttttgttttgttttgttttgttttgttttgttttgtttttgagatggagtcttgctctgttgcccagactggagtgcagtggcaagctctcagttcactgtagcctctgcctcctggtcacaagcaattctcctgcctcagcctcccgagtagctgggattacaggtgtgcaccaccacacctggctaatttttgtatttttagtagagacagggtttcaccatgttggccaggctgctctcgaactcctcacctcaggtgatccacccatcttggcctcccaaagtgctgggattacaggcatgagccactaggcccagcccatgtgattgtttttctttgttctcatagacctcaccccagtgggcttggagatggggtagatgtaatctttgttattcattgccactctcagatcattttgcctctttactaaaaggaaacaattcctaaaaaccaacaatttcaaatcttatgacatcgttatgtcacccattttctcttcatgttgtcatctactgacacccgtgttactcctcatttctcaaacaatttagctcttgactcatatccactcttctatactccaatactacctctgacttaattcttaggaatttttatacgaaaaggtcatgatcctaccaatattctggcctttcagttccttgaattcttctactgattttgtcctctatcctacctcaaccattcccccgttctaggatctcatgtcataccacccaggttctatctttttaccttactccctttgctatcctgaccccaacaggcctccagccccgctaatccatttgtcctaccagcatttcactgtccttcactttctgatgacttcactctttccctgagctaaaatttcttggttaatcattataatcattcgcttgggttttgttcttccattatctctctcatttcatactcgattggcaaaaccacaatcccggttaattccttttctgtctttgtcctgctcctgtagctgtgcaactgaacatggctggagaataccacaaaactgggccctcctttgacagactttcttctcttagctttcaggacaggaaacacttacttttcctgctaactcactggctgatctttctcccaactctcctctgcttaatttgtgaagttgcttggcccttgatactgccaggcactcatatttgaagcattacaaattcattgaatttcctgctctcctaaaggttatttcacacctttttttcctcctcaacagcccaaacctccctcatcctcattctcagttggggatgttttctttctacttcactgacaaaattgaagcaatcagaaaaaggaacttctaaagacttccatcattacttttacctagcagaattctgtcttcctctgttaccatggtcctgtctaaagccagttcctggactaatttgttatcatcattttaacaaatatgtagaatacactggaaatacagggtaaaaaggtgtcctcccccagagtgactgtggttaaatcatactttttatatacatatgttattctaataaaggaatgggaaaatccttttcttctttagttcaagtgagaaaggtaaatttttgaataaaactttactggaaaaggggcaagggaattaaaaataaaattacagaaacatgaaggtatacacacttcttttttaatataattggtgtgatcttatacagtatatactgttttgtattttgcttaacgtgttttagcatctcgatgtccttacatatagatttgtgtcattatttctgatagttgtattctgtcatataatacaaataagttttccatttttttattacaagcaatgctgaaggaaacatccatttttaattgtctttgcaaacttgtatttctgcacagtaaattcttaaaaataaaatctgtgggcccaagttgctaggtataagattgtagcaatttatacttccacgaaaaataaaaaaatatttatggtaatgtctagtaggggaaaagtgatatgttgttttagtctgaccactaataagattgcaccaggggttatctttcttaccttgactctatctgtaaagtgagatacatgaacctaaaaggtatctttcagttttaaacttctggttctgttactttttttccttgcaataagctgtctttggtgttatctgtcatgtcaaactcttcttttgtttctgacagccttccaggtccttttgttattttgtttgttttggtctgagtttcattctcttactctatgcaccaaaggtcaggcatcaggagctgctgcttgcttacagccagtgtttaggagtatagagctaaactggggcaaaactttaaaactattgcgcgaaggctgctgatgtagtttccacagaagacttactattggagatttaagggactgcatcatcaggtaaaggaattaagttttaattttcttctcaaccgtgggaatttgatattttatttctagcagtgtgctttactgctttcagccaccagatggcacatggatcccttttattttagatgtgtcattgttgcgtttggtagtgatgtcatcacgttagagagaggcaacctctgtcctttccaaatacaagctgattagtatactgccctctacctgtcaggaaatttatttggaggactgatcagcagttaaattatgcagaaagctacagcttgcccttttacaaaaggatcttgtcctgttgcagctagtattttcaatagtagcaatattcgtgttctttttggggtccagaggctggaaaggtttttgttctttagtctgataccttcatgaaagcatagccttcctttgagagggctcaaagagaggtttgtattttatcagcttggtagctcattgtagcctcattatatacacactcataatcccatctctgtctcagtttctgctgaaaaactactttaagcgcataatagaacctacccacattatatatggataactagcttgagataacatactgaatccatttcttcagggaattcccctggtctaacttggatagaatatgctggtgcagaaagattttcacggtcaaagtcaaccctttgtgtcatatgttaactcctaattatccccagctagtctcatttttagagcctctttctagccatcccagctttagtgtgtgcctgtattactcttttctagaaacatatagactgaaatggtatcttttaagtccaaggtaccatctgccattatctgtggattccagattttatttctaaccaaatgtccttttaaatgtcattgtctgagacttagaccatctagttggggggtcagtattacttaaacttctaacatcttggtacagtcagttcctagccttaaatgtctgttgataccagtaaatctcaaactttagtataaggattacatgaggagcatgtttgtaacatgtaacatgtttacatgttaatggtgtgaattaagccactcttcacctgttctcttaataatattttggtatctgtatctgaataggtattatataagtattatccctgttcttatggaggtcatatgagattgattaggaaacaattcaacattttctgttgacttggcagtcaattttggagtcactgtttcagaggcacttttcttgccatcttccaaacttctcagtagccatcttagaaggacattttgaagaagtcctctgtggtcagtgaactagctcggaaccacttagagattgactctgctggagaggatggatggagggcagagtgattagggcagagtattgtgctggactggggcttgtacaacacggaaggagttgtgagaaactggaggagatagaaatcaagatgaagaatgttacagttatacagacataacttttgttcaagcttggttattctcttgctatggagacctggagttggtagacatcagagatgtgtttaggcaaagaaatgggatatctagcaagtgtcaaagcagaactaaggattggggtgaacaaaagagtgatccagtgctctcttactacatactagaacccaaaactgttgccttaaggaaaaggcactgttttgaggatcccttgaccttacactatttgggaattgttggacctgaaatgactttgctgctgatgctgaacaagtctccctccaaacataaggttgtagacaggctagtttgcaaggagtgctaaggatgtctccacagaatgtttcctctggggcttttctttcagcttctctgttatctgtttttttttgtttgtttttttttttttgcataggtaagtggttcagaagtcaaaacagtataaaaaagtctcattcccaccctagtattcatccatgccatccttctccctcccctaccttctagaggtaaccatttttattagtttgattatcctttagactttcttaaaaagtgcagttataaacaaatactgatacagattcttgtccttcctcttaccaaaacaaggaacatactatctgtactgtttctataccttgcttctatatcctggagagtcttcgtatcagtatgcagagactttcctcattaaaaaaattataagtttttaataagcaggcattacttttataatgaacacaaggataaaacaaaagtagagtaatgaaataattgttcttttttttttttgaaacagtagctacagtaacccatttgatctgactgcatcttagcatgtatacatgtccttttgatcttcctaaaaaaaactcatacataacaatgaattgaagagttagttacccacatcagctctgtaaatgtatggcaacttatgctagagcttacagccattatgatatggggaagagagacttgcaaagttcagccaggggaccttccagacttcactcgagtgtgatacttgaacaggaggagatctttgtactgctagcaaagggatgctactctataaaaggtctttaaaggaaaggagtggcctaccttatttttttcttgcttccatttcagtttttgttctggagatgaattgctctagaacttagtgtcctgtaactgttccatgtattagaactctcgcccattgcctttggagcagtgtggaagaatgcttgtgattcagtgtttggtgggaaaagcaggaaacaaattatgtacaccttattacaattgtttcatattaaaaacaaatgcattagtgaaagattagaagggaatataccagactactgtaacagagattttgttagggtactacatactttctcttttaatttttctataatgtggttatattgtttttataatgaaaaagacacagggttaaaaaggaaatttcagtgtctgacatgcttggagaagattctagagcacttctagatttctagaagtacttggacctgagatttcgtctgccaagccaagtactagcattcagttctataaagcaagtaacagtatcctttacttcactcttaacagtttctttttgaaaaaacagactccaatgtaaaaaaaaaaaaaacaaaactcttttcacttctaagtaccattggacaagggaccccagtgatataacagaagggcattggtaaccccatttctgcaagatgggatggaaccattctttcctcctgatcctacaataaccccaactcttcttagagccagtgatttcttcttttagatctattagatgggaagatacggcactctcctgtgtgtgtgtttgcatttcttttagcaagaaaaactgcaaaaatccttcccaagaatttcccgtttttcctattctgcttgcatttttcttttcggccacggggtgcgcgcagttgagctattttggctcaggttccagattgtgaggtcagagactagggattggaggagaagatcaggtgactttcagtaacagagatggcggtcctcccatctccaccccttccccccctcatctttccccaccctttcctggcttccacctcaggaacaaagaagggaaaaaaacagcagtatgacgaaaaccagcagctgtctctgcaggctcaggctgggggctgggagtttattccatctgttctctttgttctgctcttaccctgttacttcccttcccaaccctgaataaaacagaatatttctagaatcctttgttatggagaatggtttagaattctgcagtttactcagtatttatttaggttagcgtgggtgagatacagcagagattaaaactgatctggagcacctaaaaaaaagatgaaggtactttgccttctcattcagtcttaaattatgaatacctatttaatgtcagatttgtgacaggggattatcaactattatttccaattatcaaaacattatttccataatgcctaattggtattatctttgttttataattgagagatataaaagagaattaatatgtcctttgcttgttaagattttatagcaagtaaacaccaagccagaatttgagcctagatatattgggctcaaatccagcacttagtgaaagggagtggcaagaatgcaggcatgttgagagaaacctcaggtgcttgcttccagtgactgacagtgtaaagtaactgtgctagtgcttcttgatttttaccagtgattagtgtcctgatttcttcaacaaataaatttcaggggaaaaaatgagatggagaggaacatatagattaagagggaattttaaattttatcaaccagtacagtatatggaacttatttagatcttgatccaaatgaactatacaaaacacttgacagttgagacagctggaaattagtgtgataatggtttcatggcattttttaaaaagtcatcatcttttagagatgtgtacagaaataattgcggatcattatgggatttagaagtggggtgtagatgaaacagaattggtcacgagtggataactgttgaaactgagtgatgtatgcatggggattaataattgtgtttttgaatgtttaatttttcccataataaaacattttttaatccaggaaaagagttttatttctagtaccttattttaatgccttttcttctgccctctagcctattgtttccttgcataaacctgtcctctttgctgacatacctgagtccttgtttgggatagtgcctgtccttccagtccttccccacccacatcctagaagcagacctctttttagcactccctaattgagtcaccatcctgggtgtgctgggaaagtatctgtgggaaactcaatgactatattatctgaaagaccaaatgcttggtgaagtgcccagatttttaatactgcttttctgctacccttccagacttatatctgtccccttctttataactctcagcatctggttcttcctttgggattctgtgtggctttgttcttgtcctttaggtttgttcattaatgccagtttgccctgtccctccttacagcttgcacatctgtaatggtctagttctgtgggattttgcagatagttgtatattttggccaaggtatcagtgatacggttacctttgggcagggataactgctattcggttggcatgatattttttccttctataatgtataccttagtgattgttttaaagtgctgaatttatcccttatgtatattacaaccatgaagaatataaatcagaagtcctccatttgggcagcttcttatattaacacttatattaacattaagaccctcttactgtctcctcttcccagaattagagagttgatgtagtgcttaatagacatggcttattgtatgctaggtgaacttggcaattccatagctatgttaccctcacagaaagttatttcctggagagattattaagtgttctgatctttcatatatgcctgagagatctaagattcttccacaaagaccctatttcttcagagaaaactatagtgatgccagagtcttttttttttttttttaacaacttgtgatttttgtgcacctgtgttgtatgtgttgccattatctcactttagggacgttggataaactggcgtatttgtgcagcctcatttaagtagtggcaaccattaatgacttgtacccacaagtttttccagataatttctgttttttccacctttcttacatgttcttttttagtcataggtacttggcttactcaagggaggtgtagcgtaagataaagataatggagggtgttccctgtagaataggtacaaatgctgcaggctttatcttgggcagagcaagtagggttttggtcctgagtaagtgagtgaggttaggtggagctgcctgtcttccagccgtgcggatacaactgactcagtccgtgttctcaacagtttttgaaaagcccatttttctatcccacttactcccacctgcagttctttaagaacgtagtttccaggatgtcaggcaactccccactcctccatttcctgtttgtggtcttcattgagagacgccttaaacaggaattcctggggaagtgcaggctatagcggtgggattccgggggtcattagtccattattgaagctggggaatcatgtactataaaaggacctcccttccgttctgttgtctcctagaaactattactgatcataaccaagcagtaactgcaactcagggctgttgacttgtgccctttgtctttagagactgaaaattattttcccttcttgtgcctcagtttctattagttgaattttagagctcaacatcaagatttgtgacaaaattaacttggactctgtaggactgattcgtttgaaatgcaaaagtagtgaagaacataaaacagactccctatcttggccgccagggggtgccctttcccttcgctttactgtctggcactccccaccgcattcagccattttagacagattgtttttgctcccagctaactccattttgtatttgtgacgcaggaataaaaaaaggagttaggcaaaggaggagtctggtttgcagagggagggagactggctgaggcgcagctacgtactcttttactcagcagttgctcatcagggacacaccttgctgcaggctgcctgcatcctgagcaatcgatgccgcaagtccttgccagcggagcacagagcaaaatggtttggctgccggacacctactaacagtgacagagtgctagcttttgaggcagcaggccagggcatcccctctgcctcatctagactctaatcctgggtttaggtgtttttgctacagagatgtttagggcagttttcttaattataggatcagataagaaaagatacccccaaaaaaagaagaaaaaaaggaacccctttcacttagctgtctgggaagaatcaaatgccccaaggactctagggaaatggtcctgaatttttttaaaaaatgttatttttgaaaccgtgaaaaaaatgcacgcacacatacacacatatatgtaaagagactagtatgaacacccctatgtccatcacccatttaaaaaacttaatcaacagctagtcttgtttcatatacctgtatcaactttgtctttgccacccattatttttacatgtatccttgttcatattatttaatccttaagcagttcagaatgtgtgtcaaaaaaattaggacttttaaaagaagataattactaccattatcacatttaaaaaattctttatcatcagatagccagttagtattaaatttcccaaattatcttatgatagttgttttttttaatagttcatttgaatcagagccaaataaagtctacacattgcagttggttgatgtctctataggttctctcttatgctcttttttattttttattttgcaatttatttatagacttaatttcttttaaaaagatctctgccaggcgcggtgactcacgcctgtaatcccagcactttgggaggccgaggcgggcggatcacgtgaggttgggagtttgagaccagcctggccaatatggcgaaacctcgtctctactaaaaatacaaaaattagccgggccgcctggtggcgcatgcctgtaattccagctactcgggaggctgaggcaggagaattgcttgaacccgggaggcggaggttgtggtgagccaagattgcaccactgcactcaagcctgggtgacagagtgagactccatttcaaaaaataaataaataaataaataaaaagaagatctctcaggttgggactgagaagatacaaagccagacttcccttcttgccagagcagagcctcttctttaggatttcccacagaggctattggtgaccaagtgaaggagcaatgccctgccaccttcagagggagaaagggctggactcttacttttctcctgacgtgataatctgttacccaaagtcttgagaaaagtttgcacactgccgtcaacggagaacatggtcatagaagtgggcctcacccgttctaagaattaaaggagagcttttaagctttgggacaactgtgtttggccactgtgtaatagctgcatccctatggtgattctagagtatcagctttttttttcccgaatactttttttacttaagtagcagctttctccctggtaagactcaatgaattaacagcacttcatggacttttacagaaagaaaaaatataatactgtgttggggccgggggggatgtggtgaaaagtcctttatggcttcaggattataatatcgctagtccttcccttgacctttttggagatactccctgagactgacttagatgcaaatgatcagatgaaagttcttgcttaatattcttctcccacttctgaaatgggtcagtgactctgactttcagcagccacagcaagcagtctattcccttgcccaagggaagggcacaggtgatagaagggaattagcagggtctggcttcttggcaaggctggcaggacactcgtagagtctggtctgtggagactagattggccccatgtctagtttggaaactatagttcccactagcaaaaggtttagaatctgctgaataggtcaggattgcagcagctagaaatacggatcctggcacggccactttttaaccacatagctaggtgtaagggtctctcttttctactattgtttgttgagagtcacagcctttgcagaaaaaattttcctcttttcctttgtgctaaggtgctatctatacccacctattttggtcccttatttcacacaattctgtaaactgaaattactcagcccttgatgttgtttttagggtgagggacagcatgaggcctttgttctggacttctcatctttgctcttatgaaaatgggggctggaacccaagcattgataaggttgtatattaggtgctttagtatctggatgattaattagtgcaccattcctgtaagaaggctgggaaggcagcaaatgggagcattctatgggttctacatttgactgcctgtctttactgctggttgtcagtgggagttcttcctaacccaccgtcaaagttgaaccaggcctacctgtctaaggatatgaaaataaaataggtggtgcccagagccatatctgtcttacctttctcacagtttcctgtttggtgacagtttttaaaatttacacatagttacattatcacactatgttaacaaatcaaactgttttaatttgttcatattcacttgtagtctttgcctgtgctgtatatatagcatttacatggttgtaatcagagggggacgtgtgtgtgtatcttagttcttctttatttcaggtcgaagtgtacaactcattatgcagcattaaatttcaaaaaatttaaaaggaaatttacattcatgtaatcagggtctgagaccaagatgccctttgttatgtaccccccttccagttacaactgaacctccacccccaactcagagtacccaccatcctgaagggttttgcctgtagcttttggtatatatacacattgtcaaagaagtttcttcgatttctaatatgctaagactatttattctgaatggatattaaatttggtcaggtttttttttgtattgttgagatgatcatataattttctactttaatctgtaattgtgggaagcatattaactgatttctgttacaccgattttgcattcctaaaacaaatctaacttgaatgtgatctgttattatttttattttataccccttaattcactttgctattaggaattttgtgcctgtgtttatgagtgaaagtacctatgatttttttgatactgttctttcacattttgatagtgaagttatgctagcctcacaacatgagttgagaaaatatacttctattctgtggaaaaattttttgcgtaaaattggtggaattatttattccttgagtgtttgaaataatagctggtaaagtcatctgggtctctgaagaaatttttgatcaccgatttagttcttttatggttataggactggttttttcttattggataagttttgatgtgttatgtttttctagaaatttatcaattttatctaaatttgcagacatattttgtatgatattattcctttttttggggggagcgggtggggatggagttttgctcttgttgcccaggctggagtgcggtggcacaatctcggctcactgcaacctctgcctctcaggttcaagcgattctcctgcctcagcctcccgagtagctgggattacaagcatgcactaccatgcctggctaattttgtattttggtagagatggggtttcaccatgttggtgaggctgatctcaaactcttggcttcaggtgatctgcccgcctcagcctcccaaagtactgggattacaggcatgagccaccgcgccctgcctgatattattcctcttaatgcttgagcctgagccatatttagttcagtcctgtattttgttcctgatgttagttacttatgcctgatttctctgtttttctttcttgttttaaaatactgaatttaactggtcttaaaaaaaatgttttaagccaaaactgttggcttcgtgaatcccctctgctacagatttcactaatttctgttcttgtctctatctttaaatttttcttttggtttattttattattcttattctaatttttttaaataggtacttacctctttagtttttagtcttttttccctgtcatatatgcatttgagacgatgttttcttggggggtttttttgagatagagttttgctcttgttgcccaggctggagtgcagtggtgtgatcttggctcaccgcaacctctgcctcctgggtacaagcgattctcctgcctcagcctcctgagtagctggaattacataggcgcccaccaccacgcctggctaattttttgtatttttagtagagttggggtttcgccatgttgggcaggccggtctcgaactcctgacctcaggtgatccacctgccttgacctcccaaagtgctgggattacaggcgtgagccaccatgcccggccgagactgtttttgtttaaattattgtttgggacacatctcttaagttgtttttttgagacagggtcaaaaaaaaaagacagcctgtcacccaggctggagtgcagtggtgcgatcttggctcactgcaacctccacctcctgggttcaagcaattcttctgcctcagcttcccaggtagctggggttacaggcgtgtgccatgacacccagctaatttttgtatctttagtagagacagggttttttcaccgtgttggctaggctggtcttgaactcctaaccttaagtgataggcccgcgtcagcctcccaaagtgctgggattacaggtgtgagccaccatgcctggctcacatcccttaagtcttgataggaagtgtattcgtttgctagggctgccgtaagagagtgccacagactgagtagcttaaacaacagaaatttatttctcacagttctggaggcttgaagtccaagatcaaggtgttagcaagtttcatttcttctgaggcctctcgccttctcttgcagatggttgccttcttgctgtgtcctcgtgtggtcttttcttctgtgtgcgcattccttgtgtctctttgtgtgtccagatttcctctcctttataaggacacatcagatttgaagtacttaatttccatatatattgagtgtattagtttcctattgttcctataacaaattaccacaaatttagtgacttaaaacaatgcaaacgtattatcttacagttctggaggccagaatttctaaaatcgaaatgttggcagggctgtattccttctggaggctctaaagaagaatctatttcctttccttttccaatgtctaatgcctgcccagattccttggcttatggtcccttcctcaatctttaaagccagcagcatagcatcttcaaatctctttctctgacctctgcttctgtcatcacatgtcctctctgactctggtcctcgtatctccttcttataagaatccttgtagctaagtgtggtggcatgtgcctgtagtcctgacagctcaggaggctgaggcgggaggattgcttgagcccaggaatttaaggctacagtgagctctgattgcaccactgttctccagcctgggtgaccgagtaggactgcaactctaaaaaaaaaaaaacaacaaaaacaacttgtgattatactgagcctacccagataatccagattaatcctgtcatctcaagatccttaattaaatcatgcctgcaaagtctcttctgctgcataagcttgttcaatattcccagattgtgggaattagaatgtggacatctttggaggaccattattctgtctaccacatggaattttcaggattttttgtatttcttgttaatttccggctaattgcattctggtaggtgctcttgtgatttcagtctttagaaatttgtagagttttgctttagggctcagaatattgccaaatattataaatgttctgtgtgcactgaaagaacacgtatatggtcttcagttacgtgaagtgttctgtatgtctccatttgttcttgtctgttaattgtgttgtttgaattttctgtattctatttgttttatcaattactgagaaaagtagtcaaaatatctcactttatggagtaggcattgtactatttggttttattttatattttttcttttgatttttttatattgacataattttagacatacagaaaagctgctagaatagtacaaaaaatttcctgcatttgcttgaccacattccaaatcaactgttaatattttacctttgtcttacccttttctctctctgtgtgtgttatttatgtatgtgtatgtgagtatagtattttttattgaactatttgagggtaagttagacacgatgcctttttttttaagagacagggtcttgctctgttgcccaggctggagtgtggtgacactgtaaccttgaactccctggcacaagcaatcctttcacctcagccttctgagtaactgggactacaggcgtgtgccaccgcacctggctaattttttgatttgtatttttggtagagatgtggtctcactatgttgcccaggctcttcttgaactcttgggctccagtgatccttcctccttggccttccaaagtgctgggattataggcataagccactgagcccggcccagtgtgttttctaataacaggtccataaatgcggtacagttgtcaaagttagaaaattaacataagtgcaatactgttatttaatctaccgactttcttcagattttaccaattgtcacaataatgtcctttatagaaaaaagtcctggatcatgtactgcattcatttgtcttttatctttagtctcatttaattgggaacagttcctgttatggtcacctgcaagggcattatagacccccacttaaaatttggtttggatgttaagactattcgtgttacatgcataacaagagggtatgaaaaggtttattaacataattgaggtccaggagagcagggcaatcctctcaagcaggtttgaaatgactgtagagaacaaggaaaggatagctgggcatggtggtgtgcacctgtattcccagctactcaggaggctgaggtggaaggattgcttgagcctgggaggtggaggtgagctgagattgtgccactgcactccagcctgggcaatagagtgaggctctgtcttgaaaaaaaaagaaaagaaagaacagggaaaggagattcgtttgggcttttattgtggttaggggcttgggctggggtgagagttcttacacaagagcggactttacctagtttggatttcttgctgattcccaaggaaggaacatctagactttcatatcagcttgcctggataagggacttaggagaaagaaaaagaggtaaggtttacatctggcttatgtacagatataggacatgagagaaagaggaagaggtgagctgtcagcagttaaacatcaaaaaatgaagtcagactctttgttatagttcctcagtttttattttttgtgaccttaacgtgtccatcagtttggatttgtctcgtgtcctcattattagattcaggttatacatttttggtgctttatttatcttaagataatgttattaggtacatacaaatttaaaaatcctgcattttcctgatgaactaaacttttttttttaatcagtatagaaagtccctctttatcttttatactgctttttgttaccttaaagactattttcgtctgatgtgaatgcaacttggacaactttcttctagttagaatttgcctggtatagctgtactttttcttcctttctgtatccttgctctagatgtttctcataaacagcatatccttggactcttgttttttaatccacttgacaccattggtctcaaccaatacagagtgtgtagtctgtttacatttaatgtaattactgaaatattgaggtttaaatctaccgtcttattttgtgctttttatgagttccatttgttgcatgtgatgtgttgatttcattccattcaaaatatttttttctattttgtgatttcttacctgactccagagttatttatatatttgcttaatatccaaataattgggtattttttggttatctttttactgatagcttagtactttgaattatttctatcctttgaaatttgttgaggcttgcttttacccatatatggtaaattttggcaaatatgctgtatacatatgaaaaaagatatgttagtattattgggtacattgttctaacatgtcagttaactttgttagatatggtcagattttctacgtcctttccaagtttttatctgcttgttttattagtattgtgtgacgggtgttaattcttccactgtggttatggatttgtctttttcagcctttagttcactcaatttttaactttatatattttaaaactaaattattggatatttttagatttagaattattatattttcctcaaggattgaccctttattatgaaatgtatgtatcatgccagttattagagatgatatctctatctgatactagtatagctacaccagttttctcttgattattgttcttttgattagtacatcttcttccactattttactctcaatatatctgtgtctttatttaaggtgtgtcccttataagcagcacatatttagtatgttttgtaactccagtctgacagttttagtcttttcatatatttaatccatttgagttgatatataccctatttctatttgttttctgtttgattttcatgatttatgttcttttttctgtttttgccctcttacggattaatttagaactgtattatttcacatttcccctgtcgttatatacctttttactatcctcctagtgagtatcttaaaaattacaatatacatacttgacttatgatagtctaatacaaattataattttactaccctctagataatgctagaactttacaacatttctttttttatttttcttttttgaggcagggtctcactttgtcacccaggctggagtacagtggcatgattgtggctcactgcagcctcagcctcctcgggcttaggtgattctcccacctgagcctcccaagtaactgggactacaggcacacatcaccatgcttgctaatttttgtactttttgtagagacagggtctcaaccttattgcccttattgcccaggctggaacattttagctctgttatgtaccttccttttgagttactggtgtcatgcagtttgattctgtaggtgctttaaaccccacaaatatttttactgttactttgtaataccagtagtcacttagaaacacctttctagtgtttttgcttcctgtctacatttttgtatttccttcggataattttttctttcttctgcctgaataaatactccctttactatattagttcaggtctgctgctaatgaattgtgtttttttgtggatatatctttatttcatccatattttggaagatgttttttcttttttttttttttaaagaattccactgtcagtcttattgtttttcatttgaagataatatgttccaccccctgctattttgaggtttttttttttgaaacaagatcttgctctgtcgcccaggctggagtggagtggcgcaatcatagctcatggtagccttgagctcccaggcttaagtgagcctcctacctcagcttcctgagaagctaggactacaagcgtgcaccaccgcatccagctaattttttagttgttttgtaaagatggagtctcactgtgttgcctgggttggtctcaaactcctgggctcaaggaatccacgcacattagcctctcaaagtggattacaggtgtgaatcatctggatcaccacacccagcaaggattttttttttaactctgatttttagcagttttactatgatgatatgccacggtgtggttttctttgtatttatacttgagtttctctgagctgcttgattctgtatgttgaaggctttcatcacttctgaaaaatacacaactattttctcttcaaatcttgctcctgtccaatttttcttctctttctgggcctccagttatacatatgttggaccattggccttttcaatgtgtctcacttgtccattacattctttttcattcttaccatttttaacctctgtgcttttagtttggatctttgttactgtcttccagttcacccatttctactatgtctactgttaaacccatctgttgagcttttaatttcaattatattaatattttttagttgtagaatattcatagatttttattttttatttttatttatttatttttgaggcggagtctctgtcgcccaggctggagtgcagtgccgcgatcttggctcactgcaagctccgtctcctgggttcacaccattctcctgcctcagcctcccgagtagctgggactacaggcacctgccaccgtgcctggccaattttttgtattttaagtagagatggggtttcaccgtgttaaccaggatggtcttgatctcctgacctcatgatccgcccgccttggcctcccaaagtgcgggattaccgcgcctggctgaatgttcatagattttttaaaagtaaattctacttctctgatgaacttctccgtcttcatttatttttattttttcctctatattccagaacatgttaaccagagtgattttaaagtcctttttgggaaactgtaatgtctgagttgtatgtgaatctgttcctattggtttgttccttgaactttgggcaaatgatcctcccttttgacattactagtaattttgattaaatgcccaggcattgcatataacaatggtggaaactccagatgatgttacttttctctgaaaagagaagtcacactttcctctctagacagataatagtagaggctgattgtgttaatccagtcaggaattgagctgtgccaagacgtggttgtggttttggaaaagcttgatctacctctttcaccctgttcctagagtgtagtctttctaaggctttcagctgtgagcctgttttattcaactttaaggatatagccttttgtgctcccagcttaaggaggagagtctctttttttttttttcttttttttttcagagtctcattctgtcgcccaggctggagtgcagtggcacgatctcagctcacagcaacttccacctctcgggttcaatcaattctcctgcttcagcctctcaagtagctgggattacaggcacctgccatcatgcccgactcatttttgtatttttagtagagacggggtttcaccacgttgggcaggctggtcttgaactcctgacctcgtgatccacctgcctcggcctcctaaagtgctgtgattacaggtgtgagccaccacgcctggctggtctcatattttgtttgtttgtttgttttttgagacggagttttggctcacttcagcctctgcctcctgagttcaagcagttatcctgcctcagcctcccgagtagctgggattacaggcatgcgccaccatgcctggctaatttttgtagttttagtagagacagggtttcgccatgttggccaggctgcgctcaaactcctgacctcaggtgatctgcccacctcagcctcccaaagtgctgggatacaggcatgagccactgtgcccggccccagagtctcatatgttttactttataccatcttgattttttgttattcttagggaagttttcatttattcaagattatatttctgttttttatagttagatttttaatgtatctagaatttagttttgtgaatatcataaaattaggatcttactatattcctttaaaatggaaagccagtcgtcccaacactattggttagaccaggagtcagcaaactacggccaacatgttttgttaataaggttttattggaacacagccattctattgtcattgtcaatgactattttcatattatgccggcagagttgagtagttgcaacagaaactattaatatatggtccacaaagcctaaaatatatgtctgtttatggaatttcttttatttctttatttgcttaatgtgttcttctctcatcatctcacactgttttttgttgttgctttttttctgagacagggtctcattctgttgcccaggctgagtacagtggcataatcacagctcacagcagcctcagccttctgggctcaggggatcctcctacctcagcttcctaagcagctgggactataagcatgtgccaccatgcctgactaactttttatttcttgtagagacagactgtgtcgcctaggctggtctcgagctcctggactcaagcagtcctaccacttgtccttccaaagtgctgggattacaggcatgagccactgtgtccagctgttctcacactattatagttattttagctttatcctactgtattggccttgaagatacaatttgtttagtcaggtttgctgagatataatttatatatagtaaaattcaccctttttatgtgtacagtattatatggctgacaaatgtatacggccatataatcacagtcactccaaaaagttccttcatgttcatttgtcagtcctcctccttattgccaaaccctggcataccactgatctattttctgacagttgtgtctttttcagactgtcatataagtagaatcatacactaagtagccttttcagtctggattctttgattttagcataatgtccattatgtccattcactggctgatggacatctgggttgtatccagtttttggcaattatgaataaagctgatagaaacgtttgcatacaggattttgtctagacaaatatattttcattttggagggataaacacctagggatgagattgttgggtcatatggtatggtaaatgtatgtttaactgtataagaaactgccaaactgttttccaaagtggctgtaccatttttcatttccactagcaatgtatgagagttgcaaatgctttgcatcctcaccaacacttaagtctcataagttttgtttggttttgtttttagtgattttaaaaggttagactttgtagttttaattcctaatgagtttaattcctagtacatagttttcatgacttactgatgatattgagcagctttctctgtgcttaatttgccatctgtatatcttctttggtaaagtgactttccaaatctgtccattttttaaaattgggttgttttcttatgatctagtcataactttttaatctgtgttgggtatactagttctttatcggataagtgttttgcagatattttctcccaatcttgtcttctcatttcttaataatggcttcaaaagaacagaagtttttaattttgatgaagtctgcttcatcaatttttctttttatgttttgtattcttttctttctttatttttatttttatttttttgagatggagtctcactcttgtcgcccaggctggagtgcagtggtgccatctcagctcactgcaagctccacttcccagtttcacaccattctcctgcctcagcctcccgagtagctgggactacaggtgcccgccaccacgcccggctaattttttgtatttttactagagacagggtttcaccgtgttagccaggatggtctcgatctcctgaccttgtgatctgtctgcctcagcctcccaaagtgctgggattacaggcgtgagccaccgcgcccggccgatttatacttttttttgtgtcttacctgagaaattattaccacctcaaagctgtgaagattttcccctgttctcttctagatgtttggtagttttaggttttccatttagttctatggtccgttgtatagatgcatgcttgtctatatgcatgtatacatttatctattgattgtattgacatataattcacatatgataaaattcatctttaaagtatacaatcccattttttgtgtgtgtacagatgctccttgacttacaatagaattatgtcctgaaagccattgtgagtcgaaaatattgttaagttggaatgcatttaataacacctaacttaccaaacatctttcttagcctagcctaccttaaacatgctcgggacacttatattagcttacaattggacaaaataatgtaacgcaaagccagttttataatgttgataatgaattttgaatcaaaatttgaagtacaatttctactgaatgcatatggcttttgcaccatcataagctaaaaaaaattgttaggttgaattatcttaagtcagggatagtctgtattcagaaagttgtccagccattaccactatctaattccacagcattcttatcacgcttacaagaaaccctgaatccactagcagccacttcctacttcccattccacccaacttggcatctgctaatttacttactatcatatggatttgcctgtcatggacatgttgtgtcaatataattaataaagtatgtgccctttgtgtctggcttctttcactaatcatgatgcttgcaaggttcgtgttgcagcatgtattagcacttcattcctttttatgacaccacattttgttttttccattcatcagttgatggacattaggattgtttccactttttggctattataaataatgctactatgaacattttctttttttttttttgtaactaaactgagatgaagtaccaacagcatgaccttttacccttaaattcttcagcatgcatcttctaaatacaagttctataatcacagtgtaattatcacatttagaaaatttatcattgataggatactgttatctaatatacaatccatattcaagtttcaccaattgaattagtttttaaacatgtaagacaataaacaattttattgagatgaaattcacacaacataaaattaaccattttagagcaagcaatttagtggcatttggtatactcataatgtacaaccatcatatctatccagttccaaaacattttcatcactcccaaaagaaatcctttacactttaagcagttgctcctcattcctccatccctttagctcctaacaatcaccagtctatgtgtgtctctatagatttacctcttctgaatatttcatataagtgaaataatatatgtgacttttgtgtctggcttctttcactttagcatgatgtttttgagaattctccacattgtatcatgttatcagtagctcattactttttatggcagaataatattccattgcatatgccacagtttgtttatgcattaattgacagacagacaatttcttttttttttttttcccaagacagagtcccactctgttgcccagtccagagtgtagtggcacgatcttggctcactgcaacctctgcctcctgggttcaagtgattctcttgcctcagcctcccgagtagctgggattacaggcatgcgccaccatgcccagctaattttttgtatttttagtagaaatggcatttcaccatgttggccaggctggtctcgaactcctgatctcatgatccgcctgccaaggcctcccaaactgctgggattacaggcatgagccactgcgcctggtggacagttagactatttctacgttttgtctattttgaatagagctgctatgaatgtgcatgtacttgtatccatttgagtagctgtttttggttttgggggatatatgccttaggagtggatttgctaggtcacatggtgattccgtttaataggatgaaaggatatgttgaatctgtagatcgatttggggaaaatatacatctttcaatgttgaattttatgttctatgaacatcatgtatctttccatttatataggtctttgatttctctcatcagtgttttgtggtttttagcatacagttgggtcacgtaacttttgttcacataactgaaatgtaactgaagtgtttctttctcttttctatttatttatttgcttttgtcttatggtactttatttctctttctagttgttcatttctttttctttctttcttctttttctttcttttttttttttttttgagacagaatcttgctctgttgcccaggctggagtgcagtggcacaatcttggctcactagaacctccgcctcccgggttcaagcgattcttatgcctcagcctcccgagtacctgggattacaggcacacaccaccaccagctaatttttgtgtttttagtagagacaggctttcaccatgttggccaggctgatctcgaactcctgacttcaagtgatcaacctgccttggcctcccaaagtgctgggattacaggcatgagccactgtgcacagcccttaagtatatataaagaaatataatttagagagtagtgagagcaaacatctttaccttgttcctggtttctagagtctcagaattcaatctttcacaattaagcataaagttatttgtaaatttttcgtaaatgttctttatcaggttgaggaagttgccattaattccaagtttacctagagttttaaatcatgaataggattttaaattttgtcaaatgctgatatgattttttaaacatctctgaaatcatgatgtttctcacagtggatgtcatagtttcattggcaggactctttcatttttaatggtgcataaaatagtgtgtattttataattgctgccatcatatatttgatgaaatagcccaagctggagtgcagtggcatgatctcagctcattgcaacttccccctcccgggctcaagcgattctcatgcctcagcctccagagtagctgggaccataggcgagtgccaccacaccaggctaattttttgtattttagtagagatggggtttcaccttgttgcccagggtggtctcgaactcctgagctcaggtgatctgcccacctcagcctcccaaagtgctgggattataggcgtgagccaccacacagggcctgaaatggcgtcttttgataggtgatagtgctgtgacatgtctgtttaaaaattttcctgagaccaggtgcagtggctcatgcctgtaatcgcagcactttgggaggccaaggtgagtggatcccctgaggtcaggagttcgagaccagcctggccaacatggcgaaaccccatcactactaaaaatacaaaacttaggctgggtgtggtggctcacgcctgtaatcccagcactttgggaggctgaggcaggtggatcacgaggtcaggagttcgagaccagcctggccagtatgatggaaccccgtctctactaaaactataaaaattagctgggcgtgtggcaggcgcctgtagtcccagctacttgggaggctcagacagaagaatcgcttgaacccgggaggcgtaggttgcagtgagccgagattgtgccacttcattctagcctgggcgatatagcgagactccgtctaaaaaaaaaaaaaattagccaggcatggtgtcatgtgcctgtaatcccagctactcgagaaggaggctgagacaggaggattgcttgaacccaggaggcggaggttgcagtgggctgagatcatgtcactgcgctctagcctgggtgacagagcaagactccgtctcaaaaaaaagaaaaaaaacaaccttatgccttatgagatatacagaaagcactggttagagggtaatttagacctgtaaatgcccatagtaaggaagaagaatgatctcaaatcaataacctaaccttcaaccttaagacactagaaagagaagagcaaactaaatctaaagcaagcagaaggaaagaaataatagaaattagggaggaaattaacaaaatagagaatagaaaaaaaaaatagagacaatcagtgaaaccaaaagcttattatttaaaaagataacaaaattcataaaactttagccagattgaccaagaaaaagagagacttgaatcagaatgaaagagtagacattactaccaaacttccagaaataaaataaagaggattacaaagaataccgtgaacaactgttcaccaacaaattagataacccagatgaaatggcaagttcccagaaatatacaaactaccaaaactgacgcaagaaaaaataaacaatctgaatagatctgtaacatgtgaggagattgaatcattagtcaaaaactacccaaaaaaggctgggggcacggtggctcacgcctgtaatcccagcactttgggaggccgaggtgggcggatcacaaggtcaggagatcaagaccatcctggccaacatggtgaaaccctgtctctactaaaaataccaaaaaaaaaaaacaaaaaaaaaaacaaaactacccaaaaagaaaaggcccagatatcttcactgctgaattccacccaacatttaatgaagaattaatacaattaacactaattctttgcaaactcttccaagaaatagaatatttgacaactcttttttttttttgacacatggtcttgctctgttgcccaggctggagtgcactggggcaatctccactcactgcaacctccgcctcctgggtttaagtgattctcatgcctcagcctcccaaatagctaggattacaggtgtgcgccaccatgcctagataattttttaatatttttagtagagacagggtttcaccatgttggtcaagctggtctcgaattcctggcctcaagtgatctgcctgcctcagcctccttaagtgctgggattacaggcgtgagccaccacgcctggctcacatctcattttatgaggctagtattaccctgatggcaaaatcagacaatgacatcataagaaaaaactatagagcaatattttttatgaatttggtagcaaaaatctttaatgaaaaactattgactgggtgtggtggctcatgtctataatcccagcactttgggaagctgaggttggtggattgcttgagcccagcccagcctgggcaaagtggcgaaactgtgtctctacaagaaatataaatgttagccaggtgggctgggcacggtggctcacgcctgttatcccagcactttgggaggctgaggcaggtggatcacctgaagtcaggagttcgagaccagcctggccaacatggtgaaaccccgtctctactaaaaatacaaaaattagccaggcatggtggtgggttcccgtaatcccagttactcgggacgctgaggcaggagaatcacctgaacccaggaggcggaggttgcatggtggtgggtacctataatcccagttacttgggatgctgaggcaggagaatggtgtgaacctgggaggcggagtttgcagtgagccgagattgtgccactgcactccagcctgggagacagagcgagactccgtctcaaaaaacaaaaagccgagcgaagtggctcacgcctgtaatcccagctctttgggaggccgaggcgggcagatcacgaggtcaggagattgataccatcctggctaacacagtgaaaccctgtctctactaaaaatacaaaaaattagccaagtgtggtggtgggtgcctgtaatcccagctactcaggaggctgaggcaggagaatggcgtgaacccaggaggcggagcttgcagtgagccaagattgcgccactgcactccagcctgggtgacagagcgagactctgtctcaaaaaaaaaaaaacaaaaaaacagccaggcatggtggctcatgcctgtagtctcagctacctgggaagctgagatgggagaattgcttgagctcaggaggttgaggatgcagtgaaccatgattgagccactgcactccagcctgggtgaccaaatgagaccctgtctcaagaaaacccctcaaaaacaaagattctattttgatttatttgcagtgtttgagtgtattgctttatatagttttcttagatgttgttgtaggtattacaatatacgtatataacctatcccagtctaatacataacctatcccagtgttttaccaggttgagtgaagtgtagcaacttttttttccatttaagtctctttgccctcctcactttttaaatataactgtcttaagtatttcctctacatgaagctactccattttggtggaactggaagtgcatatgcttgtcttttatctgtcaaccttactgaatgattaattcttgtagttcttccttgggttgtcttgaattgctatatatagtcatatcttccacaaaaatgacattttcatcccttttttttttttttttttttttttttgagacggagttttgctctttttgcccaggctgcagtgcaatggcgcgatctcagctcaccacaacctctgcctcccaggttcaagcgattttcctgcctcagcctccctagtagctgggattacaggcatgtgccaccacacccggctaattttgtatttttagtagagacagggtttcttcatgttggtcaggctggtctcgaactcccgacttcaggtgatccgcccgcctcagcctcccaaagtgctgggattacaagcatgagccaccgcgtctggccaattttcattttttatatgattttcgttttttggagactagggactctctctgtcatccaggctggagtgcagtggcacagtcatggctcactgcagcctcaacctcctgggctccagtgatcctcctacttcagcctcctaagtagctgggactacaggcatgtgccaccatgcccagctaaatttttttttaaatggagacagggtctcactatgttgcccaagcttgtctcaaacacctggactcaagtgaccctcccacctaggcctcctaaagtgcttggattataggcatgagccaccatgccaggcctatttttttatgtgatctgtctttacctacttctctcacttcatctcctgctcttcccttcattgcatctacttttagccttagtgacgtttttgctcctccttcaacaacacatccaacatgctctatctcaggcctttgcatttgttattgcctctgcctggaatgcttttgcccctttcccctggatgtttatgtggcttgctccctcactttctaagaggtctttactcagatgtcacttacagtgagatcttccctgaccatccctctaaaattgtaaactgcccccgtcatcaaatcccccatccttttccctgtttttcttttcacagcagctatgataatatagtatactattttatctattaaatggtctagtttatttatttttgttaggacgtaagttccatgaaggcaagaatctttctctattttgttcacttcttttatttccattgcccagaatggagcctggcacatataggtactcaataaatatttattgagataattaatctttgtgtatttagtatttttcttcctcaaactgggactactgagctccaaaacagtgaatttttttgagacaggttcttactgtgtcatccaggctggagtgcagtggcaccatcacagctcactgcagcctcaatctcctgggctcaggtgattttcccacgtcaacctcctgagtagcagggactacaggtgcgcgccaccatgcccggctaatttttgaactttttttatagagacagggttttgccatgttggtcaggttggtctcaaactcctgagctcaagtgatctgcccacctcagccttccaaagtgctgggattacaggtgtgagccactgtgcccagccaagagtgaatgtgttttatagttctttgtaccttttgtatgtaacttttttgttttaattcttgtttatttgtaccaggtaatacttttcatgtggtttaaaattcaaatggtataaaaaggttgtgttcaaaagtattcctcccactgtcgtgttcaaacaccccattcctctgctcagaggcagctagctttgtcagcttctcgactctcctttcggggatattcccatatgactttctgaaaatttgataccaagttacactatagtacaaagtattttacaattatatctgtccagaatagttacttggttttttcctatgtattgctcaaccctccttggatagccagcatcaaccattttttagagaatgttactatcatgagagccattaagggagtgatacaatgaaatactgttttgcccatgcccttgaagttcaaaatctaggtgggatgagaaatatccacacttattaaataacagaggctttaaaaagatcaagataatacgtatgcaatgtcacaaaacattgaataattaattgttggatgagatatagataacaaataccatgaaaataagtttatcaaagcagagagtgagtatcatttatcagggaacgtttcatgagaagggaagaatatgatggctttggatagtctgaaaagaatgcagaaggcagaagtatattttacctcaatcataggcagttgagaaaacaaaatttttttagagaaagtcatgttcaagatggagcttaaggtagggcaacagtggctcatgcctgtactcctagcagtttgggaggctgaggcaggcagattgcttgatcccaggagtttgaggccagcctgggcaatatggtgaaacctcatctccacaaaaaataaaaaaattagccgggcgtggtggcctgcacctgtagtcccagctccttgggaccctgaagtgggagaattatctgagcccaagaggtcaaggctgcaagtgagccatgattgcgccactgcagtccaacctgggtgacacagtgagatgctgtctcaaaaaacaaacaaaaaagatggagcttgaaagataagttggatttttaaataggcacaaaaggaaggataacatggtggaaggggactgctgaactactactaaccaactgttcttgtgaatcaagttttaatggaacacaaccatgcccattcatttatgtattgtctgtgcctgctttcatgctacagtggcagagttgaataattgagaccatatggcctgcaaagcctaaaatagttactatctggtcctttacaggcagcttgctgatccctgcaagtagataggatgtaggtaggaaagcattactgataaatattgaagaaatgaaaatgagatatttattagagttgggggaggttcagtaataaaagggtggttggttgaagaggaggttagttttgaaggaatacaatagaccattataatagagaggaagtgaggggccatttcacgctggacagtagttgcttggtaaagcacagaggtggcttacttttaatcatgcttttctaatcttttccctgctagccaagaaggatcaagaaggtggagaagaaaagaaatctgtgcaaaagaaaaaagtaaaagagttaaaggtgttggattcaaagacagcccagaatctctgtgagtatctcttggtcccaactattcaaaatgtgaaggaattcttttaagaatttttaattctcttgaatctatggtcccttgatatggaactttaattgttcaattcctgctatataccaaccattgcacagtgaattttcagtatcatgtttaatttcttcaatagcactgcaagatttttaagtatccagttttatgtcaaggaaacaagctaagacttttaggaatttgcttagacataaagctagtaagaaggaggtctgggatttgagccttttttttttttttttttttttttgagacacagtctcaccactctgttgcccatgctggggtgtaataatgcgatcacagctcactgccacctcagcttcctgggctcagttgattcttccaccccagcctcccaagtagctgagactacaggtgtgcaccaccatgctcagctaattttttgtagagatggggttttgccatgttgctcaggctggtctcaaactcctgggctcaggtgatctgcccagctgtgtctctgactttcttatttaaaagttcttactatgtccattgcgttcacagaaagtctaccacagatggtctagccactggacatttccttgctcccacttttgcttttttattaaataaatagagaaggggtctcgctatgttgcccaggctggtcttaagctcctggcctcaagtgatctgcccacctcagcctcacaatatgttgggattacagatgtaagctaccatgcccagctttcactttctgataagtaaaggtactagcttggcttcaattaaatttaaaattactttgtgatttaaaataactaaggtaaattttgtacttctcagagtaggatcagtaactccagagaagggttctgttctgaagtttccacgtatactcgtaactctttggtagcaaaatttcaaatgagaaattcctctgcaaagttgatataggtagtacttatttgatgatcaggacaaatgttaaatttttgttctttttaattactcatctacctacttcataccaagaaatatagacttaaatatttatttgacaaatatttcagggtctgctatgttataggctctattaggcatgtgttccagagatgaaagggtattttccgtaaaacccactcatagtcttgtgatgcagttattgtccctgtttatccaaatgagaaaaccaaagtttaaatgatgcgaagtgcccagatcacacagccaataagtacacatacccataagtaaagtcagtgatacaatgagaccagtaaactgtcacattattcttgattatataatcttaaattattgtcaataactattactacatagtgtctgtggtgaagtcttatggagattaaagtattgtgagtcagttcctcttcccaagagtatctctaggaacataagacatgagtaattggtttaaaaaatgatacaagaaagacaatggtgtagtacattatgatttctagtgttatgatattgatatggaaaacagaatttaagaaaagaaaattgagagtagtataggataggatggtctggaagatggaatttagtgattaaatgtctctcatgtgctaatgatacaaagctgaataagacaatagtccctgtctgcatgagccacgtatttggtaaagacagaaaggcagatgataacagtgcagattaataaatgctatgatggaggtatgctagaatgtttatgagagtactaggaagggagggatctaaatcaagtgggggcagtgttggaggggcaaatcccagaagatattctaaaggaggtactacttaaactgagttgaaagaccaattaaggaattaaggaggctgggcatggtggcacattcctgtaatcccagcaggaagctgaggtgggaagattgcttgagaccaagagttcaagaccagcctgggaaacaaagcaagacccctgtctctacaaaacataaaatactagctgagcacagtggcgtgtgccagtagtcaactactcaggaggctaaggcagaaggatcacttgagcccaggaatttgaggttgcagtgagctgtgattgcaccactgcactgcagcctgggcaacagagtaagacccgtctcaaaaaaaaaaaccaaaaaattaagtgaaggcgggaaggttggcttgtttcaggagagggatcagcatgtatgagagcatgagataacattgtgcagttcaggaactgcaagtagttgagtacaactgagtaaagtttaaatcaggaaaatgagtgagattatcctgtgtaatttttaggaaggctgctttggcagtgattttgaggctggattgctttttatcctgtgtaatttttaggaaggctgctttggcagtgattttgaggctggattgctaaggtaaggggagactataggcagagatgagttatgtcattgttttaaactaggtgagatgtgatcagggcctgaaactaaggtgatgagaataagagagggagaggatattaagatggtagaattaggctaggtgcagtggctcatggctgtaatcccagcactttgggaggctgaggcaggtggatcactggaggtcaggagttcgagacgagcctggtcaacatggcaaaatgctgtctctactaaaaatagaaaaattagctgggcatggtggagcacgcctataatcccagctactcatggggctgaggcaggagaatcgcttgaacccgggaagcggaggttgcagtgagccaacaccatgccgttgcacaccagcctgggtgacagagtgagactcatctcaagcaataaataaattaaaataaaaaactagccagatgtggtgccgcatgcctatagtcccagccacttgggagactgaggtgggtggaggattgcttgaggctgggaggtccaggctgccatgagctatgactgcactgctgcactctagcttgggcaacagagtgagatgctgtctcaaaaaaaaaaaagagagagagagagagaaggtaaaattaatggaatttagtgattgacttgggataaaggagaaggtgctttgaggtttaggtcactctgcggaaagtggtaccatttactgaaataggaaaattcagcaggaacagattgtcttttcggggaggtggatgtgagaggtagcaggttggtgtcttacttaaagtatattctctaagtggctgccatcttttcattggctttgtggttatggaataaatcagagtcgtggaagtgagagagaataggctagtttagattgctataaagtgaaagaaagagaaactggtaatttagagaggaacattgagtaagatttaaaaaacttgattatgtatatatgatgaagggaaaggtctgtggggctgcctcttctgttgacacatgaggaaaggatgagtacatgggagtatatatacttagacgtaaatatatgaacacatgcctcctataagcttacgaaaatgttggtatagttttcttctaggcgattccaaaaggcttatctgagtcttttctagtctggctctaaccaagagccctagtgctttatttttaagtaggataagagaaagctgagcaagtaatttgaccagtggctttgatttttctcagtgaagaggagcagggtcttcctggaacaaatggggaagtggtggggcagtggggaaagtgggaatatgttggaggacctgccaagaagggtgggagaaagtggaattgggacacacaaagagaattgctaacagcgcggaggccccagttatcattggtgctactgcaaattcatagactccagtccgcatcagcctaggtgtcagagtagagaaatgaaatggctagactgaccagggacccagaaggagaaggaagcaaaagaaaggtaatagtaggagtaataatactaatgggagtcatagtagagagcaaatgaactgatggtttagaggctcctaatgaaataggaaaggcagagtggaactgatatatcagtgaaaacagaatggtcaggagactggaaagagaggtcctgataaggctgaagagtcaagtgagagattagaaagggagagttgaaaaaacaggatgtatttgttagggaataggatatggtggtttaaggtcaaggcagctttgaggatcacgtcctgagagtggggaactaaagtagagtggggtgaaagtctttgacgtatatatacttttttgagacgggtctcgctctgttgctcaggctggagtgcagtggtgcggtcacagctcactgcaaccttgacctcctgggctcaggtgatcctcccacctcagcctgccgagcagctgggactacaggtgcacaccaccacgcctggctagtttttgtattttttgtggagatgaggtttccccatgttgcctaggctggtctcaaactctggggctcaagcgatccgcccaccttggcctcccgaagtgctgggattacaggcatgagccactgtgcctggcctaaaagagccctgttaggaagattatccagcataggtttgcaggatgggttggaagcgggaacagaccgagaagaacatgtcttaatatctcattttctggcagcaatctttttgggttccttccgcatgccctatcaagagattaagaatgtcatcctggaggtgaatgaggctgttctgactgagtctatgatccaggtaaggagtaaggtggttctgctggagcaggctcttctgtgtcgctgggcactggcctcatctctgtgtagatgaagaggatcctcctccagcattgctgacttatgaatgctggctttgagaaactgccttttctctggtggtcagattacttctggtatattttgcaaaagtacccccatctcagtagctgcctctcttctcccaccatatgtttctttctgtatggtccttgagcagagtgtgggactgacaacagagtaaaagttgtttaggcttgagttgttagcgaattcccctccagctgagatgtctcttctgtctttcagaacctcattaagcaaatgccagagccagagcagttaaaaatgctttctgaactgaaggatgaatatgatgacctggctgagtcagagcagtttggcgtggtggtgagtgaggcctgtggcagtaagcggttttccacctcctgtattcccctcccctctagagagcagcctgggcatatgctccttgccgcttgtctgtttttgaacctgtcttaatctctctcttctccctgctctggagctgtgatcctcccataggaggctcaagcgtgtatctttttctgacttccccctcttttgactgtaatggaactgcttgtgttctttactagatgggcactgtgccccgactgcggcctcgcctcaatgccattctcttcaagctacaattcagcgagcaagtggagaatatcaagccagagattgtgtctgtcactgctgcatgtgaggagttacgtaagagtgagagcttttccaatctcctagagattaccttgcttgttggaaattacatgaatgctggctccagaaatgctggtgcttttggcttcaatatcagcttcctctgtaaggtgagccaaagaggtagggcaggacaacacaaggaaggctgtagcctctatgagttcagtgttggcaggaggccatcttggacatgtcaggatttaacagtttctcctctttctctaagcttcgagacaccaagtccacagatcagaagatgacgttgttacacttcttggctgagttgtgtgagaatgactatcccgatgtcctcaagtttccagacgagcttgcccatgtggagaaagccagccgaggtggggcagtttggaatgaagctagagcccaaaagtctctgcatggggagggaaataagacacagtctagatgtgagagcattttcagttcagactatttcaagtggaaatgagataggatttaggcatggtgcctaagtcacaagggcagagcgtatggctgaggagagatctttatgtgtagaaataggaagcactctttctcttcctaaggaaacaccaaacaccaaaaaacagctagaaaggcaggtgtttttagtctaggttaatagttcttttcattaagaaaacatagactacattaacaaaaattaggcctcactgtcctggaactagacaaagaaaaagcagcattcactggaaattggaacagatttctgcccccgcctctatatttctatgtatatctccttcctcccaaaccctgttctctaaaataaatgagaccaagatctcaggggatttcatagattcatgttaaattaaatgaagtctctcttctgttcctagtactgcataccttgtgaaggctggaggttcaatgatcaaataatttatagtttcactggaaagatgaaaacttaagtatgtgacacaactaaagtacataaggaactaaaattattaagtaccagaatgtgtgtatagactgaagctatgctctgaaaggtgaaactaaggggtgttgaggctgggattattagtaagctcttgctgtctgtttttatggtttttttttttttttttttttttagtttctgctgaaaacttgcaaaagaacctagatcagatgaagaaacaaatttctgatgtggaacgtgatgttcagaatttcccagctgccacagatgaaaaagacaagtttgttgaaaaaatgaccatatcctctcttgaaaggagggagttgttccctaggaagggaaagaaaacttcctgtagtgggggaaaaacaggatagatagggcagtatgcaatttttttctcttaaaaaactctttttctttaaatacatagttttttgggtttgttagtattttgagacaggctctctctgtgtcacccaggctggagtgcagtggtgccatcacgcctcactgcagccttgacctcttggactcaaacgatccttaccccctcagcctccttggtagctgggactacaggcatgtgccaccaggccctgctaaactttttgtaacctttttttctttagagatggggtctcactttgttgcccaggctgcatagttcctgagagcattccattgttgtggagtagaagcacaccatgcagatcaaccataaaagtcccaccaactcccctgcctgtaccccgtctccactacacacgctcacacatgcttccctctctttcccctccccagaggtaaccactgccactggactttattctgatttgcacctcatacatttattttaaacaaaaactgcattgtattgtgttttgcacatatgtcttggccatgtttccataatagtatttatagaaaacctccttttaggtcaagagatggagaccatcctggtcagcatggtgaaaccccatctctactaaaaatacaaaaaaatcagctgggcgtgatggtgcgcgcctgtagttccagctacttgggaggctgaggcaggagaattgcttgaacccaggaggtggaggttgcaatgagccaagatcgcgccactgcactcctgcccggcgatagaacaaaaccctgtctcaaacaaacaaacacaaacaaacaaacaaacaacagtttaaactgccaccttctttttttataggtgtaccatagttcatggtttactattcccctatttaggggtacctacatggctttggtttttgctgttataaacagtgctgtattgaacatccctttgcatgccagtactcatctttgagtaattccttgggctagagaagtgggtctgcttcttggtcttggtcttggtcctttactccttggctgcacagctttgtgaaggatgcacaggaacagtataacaagctgcggatgatgcattctaacatggagaccctctataaggagctgggcgagtacttcctctttgaccccaagaagttgtctgttgaagaatttttcatggatcttcacaattttcggaatatgtttttggtgagcaagggatacttgctgactgaatcttttgtgggcatttctcactttcccctgggttcctgttggctggtagtaggtatacaatgcccatgtgttccttcctcctcttccctgccccagcaagcagtcaaggagaaccagaagcggcgggagacagaagaaaagatgaggcgagcaaaactagccaaggagaaggcagagaaggagcggctagagaagcagcagaagagagagcaactcatagacatgaatgcaggtgaggagtgaagacgggttgatgggctgagataggaatgttgggaagacttctctgcctagagtctagaggcagagtctcatgtctgagctcacctcctggcaaatgatttttggcagtcttcactccgagatcctgatgccggactttaaccccaattctgatacatgcgcattccaacttgccctggttaaactattaccttttctctcctttgctcgctcttgcattctctctcattcccctgtgattgtggtattgctgtgatatatactgttttccttctgtccatccaaaggttcctctggcctgttctcattccctccactaaatctttcgggtttttttctgtaaaatattttcctgacgctcctcccatcttttaattgtggcgtgtcttccctttctgcttatttcacaaagtactatgtccctagtaccttagcacagttgtatgcacaattagattttaaatggattgaacttttggagcgggtggggagccggtcaccctcttctttcttcagcagaatctctgtttcactaccagaagcatgtctttgttgaaacatatggtttcaattactggccctctgtttcctgtctctgcttctttcttgctgcagattccctaccccttcgcccccactgctctctctgtgggcagcggaaatacagcatacactgctcacacagcactgagcccatgccaccctcctctaaacctgaggggccacaaaccttctgcaaatgaagaggtgttcacagagctgctgagtttgttaggaatcagtattttacagagcacaggcacaagggctgctctgatacctcttgctaccagggactttttatacttttctgtaaagcaatttccttgcccttagttgtaagccacaacttcgtaatgctattaaagcccacaccaagtatccttcaccttcccctgggactccagggtttgtccccaggtactggctaggatgcagtgggggaaggtggagtcccgctgacatgtgggatgagggctgcacacggtcaacaggtggcgtaatggaccttgcccagtttccagtacccgggtcaagcaaatgagggtggaatgtaggtcagctgcactggtgatgctcagccagcaggtggcgctgggagcagtgagccccagccttggatctggcagcctatggactttttgggatttcacagtttcagatttcactatcctaagctgttgtcatggaaaccgagccaggctagaacaaggattctacattaactctttgtattccagccaggctgctcctcttagatgcagaggacttagacatcaggaagacttagccactggaggcagtacttcaggaaagtgcactctttgatcagtggtctttcctcggccctgctctgaaacctaaccaggcaaaacactttaggataaaagggagtgatatagttgcttagtaatttcacaatcgtagtctctacttatcctggtcttggagttgggcagttgtataattttgttgctagtcctgattggggtggggaggatggcattgcgggaaaatatcccaaggtctgcattggataataggcaatgagatcttttgttttaaccattttttagcagatacaagtaaacatgagcgtgtgagacttaaggctgagctctctttgcctcttcttagctgccagctgctgtgggagaggggaaatcaagcaatagccattcattttgtgtggggcttgatatttgccatgctgctctggctgaagagttcacatctccatcttgttctttataacagagggcgatgagacaggtgtgatggacagtcttctagaagccctgcagtcaggggcagcattccgacggaagagagggccccgtcaaggtaagtaagcacatggagctcatcctgggtgtcgaagggggtgagggctctctactcctgccagtctgcggctaaagagcaaataatgatgctctaagcatctttttagtccctgcatccagaacggattatctagtcctcttcttcccatgttacagagtagcgacttagaaaactggggtttaagggactggcaataaatcagttacattggattatgccgcatttctccccactcttgaagcagatatttggaacaaaggaactgagctgcaggacccagggatttgagttggcatttgtgtgtatgaacaaaagttgatctaaatacaaaatgtatattagatatagattgaaattcaaagaaaaaataagtcagagtccttactctggacttcacaagcagaagacatacgtagagagaactaataatagaaagtataaaattttgtagacaggtttaggcatcattattcccagatagaaaaatatagaggagcatctcagttgaaggattatgccgtgtctgaaaactaccttttccttgagtgcagttagcctctattgcccttgccttccccatcactgccctgcaatctcctttcatgtcctttggaagatctaagtggattacattgagctagagattctaaaaagaattatggagctaggacaagtgatccaggcattagtatgggaaaagattaatgaataagttccctttcagggaagcttacagtggccaagagactaattcaaaggaaggtataggcaagtctgcccctcatgtggagttgacctgcactatcgtgtctagtgaaggtcttttgaggctaggagtggtggcttctttactaatttgaagagtgggaattacaaaaaaaggcatcattagaggtttctacttcagagggacttaaatctatgttccctgtttcctggctgttgcattgtgtaggcccatttgatagttatactttgagattattgtaaacagaaggagttaacacagcttgctttggccagtgcttagctattaatacagtggtatctgtagggcctgtagtacctgccacagcctggaaagggggaccttagagcatgctagcctatgtaaactcagtattctggcccaacaacagccatcactgtgagtttcatctgtaatggctggctgcccatttctacctatactctgaataaccagagtgatactcccttctgagggttctcttgtatgacttcagaatgttccccaaactgaaagctcccgagtcaaagttcttacccattttctggcattctctgagtacaggctttctaaagcgtggggagaagtggatatgaagagctgagtactctctgggctcgagcatttagtcttatagataggtgtttgcaaggagagtacagctagaggtactattactcctgtattttgtctttataggttcttacaacattatttcctactgaccacacaaggtgatgtggccttaacattaagcatttctagccttacaaaaatacattgcatcttattgttttttttttttttttttttgaccccgtcggctaagtgcctgcatcagaattttggtggggaattcccttttaagcctcttcctgtggaactatactagaatcccagatgcttcctgtccacaggtagccagacatcagtggcttccctctgctggggaagccccattcttcacttctttccaagtagaaaatcagaactcacaggtggaggaaggaggaattttgttggaaactaaccttccagcagaggacctgaattagtcaaagtactctctcccatgcaagagggaataggaggagacttatactaggagatactaaattggaaagtaggtgaaatgacaattacatatattttaagtggctctagcctataagcttatctttctaggctctgggtccactaaatacacttgaatatatctgggagaatctcaagggagacatttgtagttattctggtaactctttagaccctggtgcattcacatcatgtaaagtgatgtgatgcggtctcacattaaacaggaggatagccatcagagtagattacaaagaacacagggctaggtagggatcaaaagacctaaagtcacatctagttctgatgctgtctgtgttatcctaagcaagtcacttaatgtttctgggactcagttcctcaggtataaaatgagagttggactagaatgaatggtctgcagggtcccttccagctctaatattttttttgtgcagtgacaacaggattaagaggagagagaggctggacttagatggccccattctcaaaatacaaaggctccactggctataggtttctctatgcagctactgaatttggctgttccaccccttgcctggctgtctctgactattcctcttggctgattgctttgagctaaaaaaacagaggcactgtggaacatatctgcctcatagccctccttttttccagagaggcagctgtccctattcaaagacactagctttttccctagaatttaaaggaatgttaaattcttccggtctctggagacctgggggagtgaccagtatacaaagactcattgaggagttggaagaggagagttactatcaggcttggttcattaaaagcaacatgtaaactcctgtgatccgcagggtgtgggagaacaatggttggagtgtcaaggggaagaatccatgtgattgtattacagctgctatttcaggcccatgattgagtcagcttgtggttttaatgactcaactttatctccatgtctgaattgtggcctcttgtatacaagtcatttgctcactgggataaaagccaagggaagaaagaaattcaactcttcctttccttccctctaccatttcccagcttccctataagctccatccatctaacagaaccatagagttggaaagactctaaagacttccagtgattagtatctaaccttctcatagggaaagggattaaaaccagataaggtgactaacacggtgaaactctgtctctaccaaaaatacaaaaaattagccgggcgtggtggcaggcacctgtagtcccagctactcaggaggctgaggcaggagaatggcatgaacccaggaggcggagcttgcagtgagccgagattgcgccactgcacttcagcctgggtgacagaatgagactccatctcaaaaaaataaaaataaaaaacagataaagtcttgcccaggtctacatggctaatgacagagcactgtagcccacttttgtgactccaagtccaggcctgtttcccctcagcctgcgtgattgaacaggagacagcagtgaacccacagtatgggccggaaatattctttcataccttccagcaaggagagtcggacataatgacattgcttcaggaaggtgctctcatgaccacctgtgttagtctattttgtattattataaagaaatactggagactgggtaatttataaagaaaaggggtttatttggctgacagttctgcagactgtagagaaagcatggcgccagcatctgctgttgaggcctcaggaagcttccaatcaaggggggagaaggtgtatcacaaggcggaagtgggagctagagagatgccaggctcttttaaacaaccagtgcttgtatgagctcattactgtggggagggcaccaagccactcataagggatccaccccatgacccaagtgcctcccactaggccccacctccaacattgtagtccacatttcagcatgaggtttggaggggtcatacatccaaaccatatcacctcctatctagagaaggttgctaagaatatttcctgtaccactgcttattctcccccctacttttgtaaataggacaagaaacataattaggagagtttgagacaagaatgagttatttagtgtgatgatgattgccccatctgtcctagtttcctcttccctaaggaagcttaatgtattaacaagagcacttcctctttagtaatagttcctagcctacgttttataaaggtcttttttcaaatcactaacctttttaaaacttgcgttatatggttgattttgctggtgtttttatcctagcccacccctaacttctaggaatctgtcctcagagagcattcaccagtatctcaacattgttcccttttcccacacagcctgtgggactgttctcttgtagtcaaaatatttatctggttctatggctacttttcaatagtctaataacaagtgagtaagttgggggaagcatggggaggtcagtttttcttgactgttcaacctgctgagcataatggtgagtgagtggaaagctgggagacctgttccaacaagagctttctcatcccctgaccttaggccaaatcacaccctccctggtgtataggctttcaaggcttaaaagggaaattttgatcttctccctacctactctctgctcctggttcttatgaagtttgtaatacatcagaagcttcttgagtccagaaaagtctagaaacaccacttggttaggtacaactggtatcttcttattttggaggaagaaaccacagaaagcagcagctaaagacctaccacatgggacctctgccttctcctgtgttgcccaggacaagtggcccagtgttcttttcccaaggtctggagtcagatgttatttcaacatatatataccactagagttacacacacacacacacatgcacagagtcgcagtgtcttctcaactgttggagactgaattcaaagaaataataaaatgataggaaactactacccttctggatatgagaaatggggtctagagagggagtacttcagaagagagtggaaatgtaggaggcctgaggaagattttggtggtaaggacagtatgagaaatgcacacatgtagaccatcatagtcacactcacgtaggctccttttcctcacttgtctcagtcacggggcattagtttatgttcataatccaataaatggttttgtgaaaatcccacagtctcgggcacatacctatgatctgtaactagataagtcctgtggctgtcagtcagggtcttcactattctttctcctcttggtagacaacctcttgtgcccctgggaagtagaggaggaggaggagacctttaaattggtaacctgtgtgcatgctgcgtgttccctgcttgatctatgggcagcctctcctgggatgaaaacagtagctctgggtcatggctctgcagggagagaagacctggttaagacttgggctttggcaggctgtggtgactcatgcttgtaatcccagaactttaggttccaaggtgggaggattgcttgagcccaggagttcaagaccagcctagacaacatggagagaccccatctctgcaaaaaaatacaaaaatagccagatatggtggcacatgcttatagtcccagctactagggaggctgaggtgggtggatcacttgagcctgggaggttgaggctacggtgagctgtgattgcgctgctgcactccagcctgggcgactgagattccatcaaaaaaaaaaaaaaaagacgggctatctgatcctgtttggcttctgcctacctaaagctttttgctggtccaaaaaggcgcttcattccagtcatgcagctgccccagtcttggtctttatttaggagtgctcggctctttcatctggtcctgcttctaaaacattccggtactgctttctccactccagctttcccagatctccaggaagtctttttttttttttttttttccaattgagctatcatttacatacctaaaattcaccttttaaaaatgtataattcaggggttttagaatatccacaagattgtataaccattactatctaattccaggacgtttcatcatccccagaagaaaaacttcataatccccattagcagtcactactgattctcccctccccttgcctctggcaaccaccagtctattttctatctctgggtttgcctgtgctggacatttcgcagaagctgacccataacatatggcctttcgtgtcaggcttctttcgtcccagacagctgtttgtgtatacacagttgctctgtgctgttctggggcatgggaggaggaaacatcatgagatgggcatggtctcaaggagtggccttcctgctgcagatactggggccataagcctagataccataaatgaatatgagagtcttggggatgaaacccagcagttagaacagaaactcgtggattgatttggttcttcttttctaatctggtatgacagccggaacttgaccatctcttagccacctgggctgagatttcttggtaggggtcctctcctgtccatctttatcccagttctgcttccctggcatagtttttattactacctcccccccgccatgccacccccacatactctacacaccttgtagggcccttggcatttgtattacggctgctacctttgaaggggtgggaaagagctaaggcatgtgggcatctgttgttggaggaacacgtgggagtgcggtgtcagtgcgtggctgctgttcctctttgcgggagtctctccagccacttacggaaggttgccttctgctagggacaaccctcccagggctgactgagaagtgttttggcctaggagtttcctgggacctgtcaagaaaacaaaaataatactatgtactaaactttagtctatttaattccaacatccctattacgagaaaatagactttgaatacttcatctctccttaagtcacatagctaacacttcagcccagttctgtctgtctgtgttcaaacttttgtgctgttttcacacagggaagcaagggggcaaggcttgctttcctgttgcaccacactctcttacattctttgccacccaacaatatattccacatgctggatctctgcccctttcttcaaagtaagggcctctgtgaagtggccaaggtagtcatgtctgcatggcttacgctgattatctgctgtagagtttgaaagaaattagaaatgaggccttccatagacagaatctctcgtcttctcttgcagccaacaggaaggccgggtgtgcagtcacatctctgctagcttcggagctgaccaaggatgatgccatggctgctgttcctgccaaggtgtccaagaacagtgagacattccccacaatccttgaggaagccaaggagttggttggccgtgcaagctaatgtgggtcctgtgaccgcggcagctcctcagcggagccgcagactgtcctgccctgcagcatgtgcctaaaggctcaaggggatattcctctggggtggccactcccaccaccctgaccctgtctttctctctggcctgctgctctctcaacatcacatacagcttcagctgcctggaggccagaaggaaagggcagtgcaggggaggcctgagcccgacttagccagccctggctgttgtattaccaaagcagggtccatgtttgctgccttaaccctgtctcctctctgttactcagagggcctcatctcagacaaggcccagcctgctttttctcagccctgactttctaatgggctttcccccctaggtcagtcttgctggatttgtgcttttcttttgtggtttctctggccctgagaatagcatggggcttgtaaacctttgggctagatccctcctttcattgctgttgtctctgctcttccctctcctggctgtggttatttattattagtggtgtggcactgggagctgctcctaaggaagcagggagcaaatcccacctttaccccaccttcctgggaaaggcctccaaagcaaaggatctggaccagtttccctgctgtgctgtggcccaggccagagcctgtgggcaggcaggcagggcatagcgacagtgtgggacctgcccccagcttctgccacgctttatgcccttgcctctctggacgctctgcaccaaccccaggctactgagccaccttccctcctcatgccttccctgagctttggtgcatctcatctggactatgggttgtactgtgaccatcccaacacctcaccctctgtctacaaggaaatgggaggtggagcctcctggctgagaaattgttttgcaaatggatctatttttgtatgaaaaaaaaaatttttttaaagaaaactgttccttccccctttcccctccataatgtaagaagctttggtggcaggttacagagttctgggatttcttctcacaggcccaatcctgaatgtgcccctggaccttctggacccttgagtccaaggcagatcctctctcccagggaatccgacacaggaggaaccccttctctggttgagctgggccaggcctaagagtagcaggaactctaagaccacagagttttttataaatgtataaatgtatcaagccaaatgtgcagatgctaactggacattctggggaactgggcaccaggagtgccttcatacactgtaccccagctctcttctaaaagagaagtgggtgggcacactgaactgtttggtggccccaaccacaggaagctgcaattctctggcttagggtgatacttttgccctccttgtgcccctctcagctttccatccccagctaggaagaaagaatggcactcttgggcttggcccagaattagagttattagagcaagagagagcttaggaagcatgagggcaactatagtgaggccttattgccaggagggagggttttggttgctggcgcttgtgtataaaggggcaagagcagctcctttggactattcctgggaggactctgatgcagggcgtctgttgctcccctgggtcacctcctccctgctcgctgacatctggggctttgaccctttcttttttaatctacttttgctaagatgcatttaataaaaaaaaagagagagagagagaggtgtgagggacaaaatgcaaacctatttcccttgcctcataggcttctgggatgtcatcacctccagtttgttggttttgtttccaactgttaataaagcattgaaacagtactgccttacagcttcctgtgtgaatttctgagctgttttcttttcactctagtccaggctcctctagtctttcctgcctcaaatccctggttgacctgacaaatcactgtgaaaaagctaaaggtgccagacactttacttgggcacagggctagagatgattaatacatg

SEQ ID NO: 16859 - DNA, 99830 bp, Human
  misc_feature (1)...(99830): n = A,T,C or G
acaaaaggatacagcataactatgagctggtaacatcagctgagctcttgaatcatcatatgcctaagactagccctggacaaaccatgaaccaataaactcctgtctttatttattttttacttcaattagtttgagacatctttttctcttacaatcaaaagttatctgctaaagtgactaaaatattattttgggctacatcttccccttgctcatttccaacaaacacattttcttcttttctccaaatcctttattttagattcagtgggtacctgtgcaggtttgttatgatggtatattgcatgatgccaaagtttgagggcacgattgaacccaccacccaggtagcaagcatagtacccaataggtagtttttcaacacttgcttcccccaccctatacccccttatagtccacggtgtctcttgttcccatgtttatgtccatgtgtacccaatgtttagctcccacttataagtgagaagatgtggtattttgttttctgtttttgcccaacaaatacattttccaatgaaaatgatgaagccagaaagtatgaaatacattgatttaacaattagaactgttctaattataattgataccggtgcctgttttctttttatgattgagtaatgatcacagatttttgctatcagattttgagtttgaatcctgcctgtatgatcttaggagacttttcctaatctcagtgtatgtccttacttcagtttgcaaataaggataatgaaagcacttatccaatagggttgtgtggaggatgaaataatacagggcaaatgtcttagccaagtgactggcacttagtaagtcctcaaatcttcactatgatattaattgaaagcctagcattcacaatctcactggtttatcagttcttttttctggttgctttttagtgacttaaatcagagataaataagattggtgtctcactgggttaatattttttctggagagagttaacttgtgtggcacaggccatctctttattgaattagcaaagaactacattggatttaagattatctggggctgaggctaatatcaaatcctactctatgtttgtagttccttggctacaagcctacatacggtaattgctgtttaatatgaatttttatttttaacccttacatatagtaagggttaattgctatttaatatgagtttttatttttaacccttccctatttacgtcatgctttgcttaaggaccaagatatattctgagaaatgtgtcattaggtgatttttgtcattgtgtgtacctcatagagtgtacgtaaaacctagatggtagagcctattacacaactaggttacatggtatagcctattgttcctaggctacaaacctatactggatgttactgtactgaatactacaggcaattgtaatgcaatggtatttgtgtatctaaacacgtctaaacatagacaaggtacagtaaaaaatatggtattataatcttatgcgaccactgtcatatatgtgatctgtcattgaccaaaaatgccattaagcagtgcactactgtactttctctttactttaaatttgaattctttatatgggttgaatgactttctgacatagcaaataaaaagcatgaggagaagcattatctgttaacaaaattaacacttaaaatcaacaaagttttaatgtttcgttccaagaaaagcctgtggaagatcagttccacaactgagagctttgggctgcttcagacatatgtctgtgtgtacgctgtgaaggtgtttctcttcacagttccccgccctctagtggtagttacaataatgccattttgtagtccctgtacaggaaatgcctcttcttacttcagttaccagaatccttttacaggaagttaggtgtggtctttgaaggagaattaaaaaaaaaaaaaaaaaaaaaaaaaaagatttttttttttttaaagcatgatggaattttagctgcagtcttcttggtgccagcttatcaatcccaaactctgggtgtaaaagattctacaggggtaatgttttattattcttattatgcttattctctgtgatgcttctctacctttacagtagtagaatccttggggaaatctgcagagggaccactttcattttgaagctgctggctgcatgttttagcatgtctcttctattagagaatccaggcatggcagtttcctcccccagtgtgcaaggaccatcttcatgcctatgtctgtcgctaggcatgagggtctctaggaatgggtgaaaaaaatgagggatgttttggaggcactataatactggggagggcagtctgctagctggtagctgaaaggtcctggtttacttcaacattttttttaaataaaactgtgcagtagtttttgttattttaggtttccctctgttttatctggtgtatgctgcagaagtgaactgcataacacatttcactcttagaaaatgcatttcatatatttaaatgacaactctgactcctatagtatgggggtgaaatagattgattttttgaaaagatggaaaaaatagattaagtggcatttaggagtcaagatgttgattgtattgtttcaaatagcatagaaactcctgccactggttcagaggtaacatttggaatgactgatgtgctcttttgagttatctactttagtctggtgaaatatgatttgaataccagtaaaaatctatttaggttattgcaaagactcatataataagagtttgcttgaaaagataaactatcgtaaacttattattttttctcaagtccaaattctgatatggacactaagactgtgatgctacgtttttatgaaatgggcataatttgaggaaattggctatctctacagtatttcctaaggtactgcaaatgtgttaatttaagaagcaattacactagctagcagcaggttgctaagccagggggtccgagctacagacctctgatgtggatgacttcctgcccggtttggcaggagctgggtcccttcctgtgcagcttccgagcagttccaaacacaaccaggcatcttctgctccttcccactccctttctttcaagcaggatctacctatgtttccatagcctggcattttaggatttccagagatttttacccagtgaattgacttggaataaactcttaaatgtgataaagtgagccaaagggcacgtgcaaagacttggagagatatgtgcaagatcctcagctcaggttctacaatttaatatgatgtttcatctcttgttttggatctctgctattttttcagaaagaatgctgaaaaagatggctgccaaaatattcacacaagtgaaacagcaggcacaaaccagtatcctccatttctgagctctgaattgcatattttcccacaagtagcacaatcacttaaaacattttgggagtgggagattagattacctcatagacacctactgaatgtgagagatagatctccatgcgagcaaatggatgcacatatgagattccctgaataccaaatacagctttctttgaaaatattatagctatctgggtttctatgctgtatctcagtgctcagtgtcatgtaactgacacaatcaccttttattctaatggtcattgctttttttccctccctgtttctgtagcactttcttatgcaaggagctaaacagtgattaaaggagcaggatgaaaagatggcacagtcagtgctggtaccgccaggacctgacagcttccgcttctttaccagggaatcccttgctgctattgaacaacgcattgcagaagagaaagctaagagacccaaacaggaacgcaaggatgaggatgatgaaaatggcccaaagccaaacagtgacttggaagcaggaaaatctcttccatttatttatggagacattcctccagagatggtgtcagtgcccctggaggatctggacccctactatatcaataagaaagtgagttcttagtcaagttgccttcactgcctatttactaattggttctgggctagtcccagggatgatggtgaagaaggctggcctccttccctctgtctaaagtatcactaagatgctggatgggcctgaccgtgtaatggaccaatgatcctagaagtcttttggaagcactcatttgaacctgcatttgtgagacaggcagagaactggtgaggcatcctccagcgcgggaattaaggaaggacaaaagcctattcaccttcttgaatacaaattatatgcttaaaccagtgtaaattgaccctgattccctaataatgttgagaagcaaaaactgtaaactaggagtctatttaaattttattttttatatttgcaggagtagtatctaaattcctctttatagtctctagctctccataagtcactttgatcttcagtgggtttaattattcctttataccatactttctcctttctattgctctccacagaaggaataatagcaggtgacttgtaggtgccaaataagattctgagcaaagaacacacctggaaaaccttgaagttctcatgagaaaattttctaaccaaaaaaaaaaatcaaagcctcaattttgtgctttatgtgaattataaatgcggttttaaaatacttacattaaaacttgataaagttgctaagaattcctatggcattgatcacaaattttcttaataatcctcatgtcatttatcaaatttaggaaagtttatagtgctcagaaaaaaaaagcatctatcttcatgtcatatgatggtaattattatgttatacactattttacagggcaatatttataaataatggttttacttttctcttaaaatattcttaatatatattctaagttttgttttatgtgttgtgttttctttttcagacgtttatagtattgaataaagggaaagcaatctctcgattcagtgccacccctgccctttacattttaactcccttcaaccctattagaaaattagctattaagattttggtacattcatatcctttttcaaatcgtcacttaatatgattttcttctttgaccaagttattgagctacacattttccaaaatatctgtggttggcaatgttatgtgttctttctttttctttccttttactcaatcgttagcatgttgcaaaatgagatcacaggtaagtgaattactttcccccgtcttctaagtgtttcttctctacccaactcactattacttctttcttctcttttcttctcccttacgaattgcttgccacatcccaagcctttctcattaattttgaccatgttaccaggctttcctcctgtaagtcttcaatttacaatgttaggtaagggagtaaactccatgagctaattttctttactgcttttacatttggaaaataaatatacataatctgaattacaattttgtatgtttttggtctgaattttatgactttcttctattttagcatttaaaagctttgagttagtaagcgtttacaattgtgtctgtaggtataacaccctttcaaatacttttccaaatttgtttcgcaacagccttcttattgatcttttgctttctattcttttcctttctttttctttttatcacttgttcctatgttttattgaagtcacaagtcttgctacaattatccctctccaaaggattaatgtctatctatccatatacattctcattttattttttatactccttattgaagcacctgctttccaaaaatgagattgatgacatcttggtgggagatggcaatttgattgattccttgaaattaaatagagtagttggaaatgagagattttattctaggccagaaacaagtcttgttgacagccagtcttgggaatgccaatgaagcaaaggcttggaagactgaagctgtgtggggcaggggcatttacacgaagaacacagaagtcatgggaggaggagtgatatgcttcaggaatcagaggtaaggcaggggaactgaaattaagcaaatcctcagattaggacagcatgttatttcttcttcagaaagaatcgttgcttggaattccatgatgtggttagcccagggcctggtattaaggctttcagtataaatattctccacctttagcaggcctagaaaatatttgaattagataaggtatggaactaaattaagtagggaattcaggaaatgggataagcctggtacagggtacttatgtcatttctgggtggaggggatgtaaagcatgtccctagacttgcctcccagtatggcaaatgttgtctttagaagtgtaacattctgtaaagtctccttttaacctctaggttgttcctcttccccagtttaggtggatatcaacatcttttatttgatgtttatgtttcatgttttaagatttcctagtttcttggcattaccttaagcaataatgttttcttacctctctctgttttccaaataagagaacccagtagcatgtggggaaaaagatgtctttgagttagcattagaaataaataataaagttggaatttatatttgggtctcatgattataaattatgatctattattatgtttcaagcatttgtaatctgtgcagtgaataaatctctgcataaactattcattatattttaaaataattgtatgttccttatgcaaacgtaatttatatataaaattacgtggaaaattctagcctagaactagacttctgttcctagtagacattgggaaaatattcattaaataaataagtgactagtaagtcagagattagagaatcagatacaaaaaaagtgaaaaaataagtttgaatggatcagaaaaaatctttcttgtcgtgcatctgaatgatgagatggagttaagaaaacccaatatatttgttttttacaaaagcagatttttgttttaaaacttttgtaatagaccatggaaaatctcatgaaaactattgtccccacttgaaaaaaaaaatcctaggagattatgaatccccatttaaaactccctggaaaagagactcctggtggtagagggtaagggcagtttaagaaattctgatcagagaatatgagtactaaggacacagtttgtgccaggacctctctagatatccagatacaacttgaatctgtgggcttgtatttgcttcctgggggaaagaactcaccctccacaggctgaagtcattgggaggcctgaggagatgcaggttgaaatgtgaagccagccaggcaaatctattaaggtatgccaagttgagctgttgattctctgagaagtttacagatggcttagagtcacaaatttattccaatgtagaaaattagattttaaaaagtctctaatttcctgacttaaagtgttatatttcagatgtctcaccttggagcagagatataacaaaaggcagtgaggctaatagtctaagatacatgaatccttccatgttttggtgatgctggtgcaattgatcaaatagcccagtaaagttagaggtatatagatgctgtagttagtaactgattttcacaataattttgtcctttattcctcttgttgcaaaccctagacttaaatcctgattttctgacttcaagtacagtgtcttttactgtaagttaaaaatgcttggagagatggtcatggttgtttggccacagttgggaggtcattgtatatttattaccactagtttataaaccaacaaggagccattcatgttaaataagtttttattttaaacttggactaatacctctatttcaaacaaaaaccttgacttgtttctcaaagagctgttatctattaggagctattgtgtatcaaattagcttttttaaaaatttattttggctgaatgagaaattatgcttgtgatatttttaccagggtgcattctgaaaactgaaaattcttttgatgtgcctagtgtcttatttgatatttaaataaaacatgatttattttctagataacaaacaagttaaaaataatctatgttcctaaagttccctaccaagcttttaaatgtgtttcctgtcagcttttattattttaagttaatatatgcacactcctctaatttattttgcatttgttactcatttgttcatttgcaagtacttactgagtatctaccatgtggtagatattcttgtaagcattgggatgcaacattgaacaaagtgaagttcctactctcatgtagttacattcatgtgagtgtgtgtgtgtgtttggaagaagaaagacaataaacaaatacgtcgattgggagctagtggtaagtgttactaagaaaaataaattagtgtcaaagggaggagtgacaaggtgttgttttagattgtatggccagtaaaatcctttctgaaaaggtaccagttgagcagagatccgaaggaagcaaaagagtgagatatgggaatctagggataaagtcagttcaaggagaacagcaagtatgaaggtaaagtctgaaggtggtggtgcaactagtatgtttaacaatcagcaaggagacctgagtggctggagcagagtgggaaaggcaggaagcgagaggatgacatcagtgggagtgaaggtcaggggctaaagttgtaggcgaggtgcagtgggtcattgtgaggacaccacatttactctgaatgagactccaggagggttttcagtagcaggatatcatgacttgactcacatatttaaaagatcactctggctgcttcatggagaatagactgcataaggggaaagagtggaagcaaggagactgggaccgattgtcattatgaaggcaagagagcatggtggcttggagtatggtggaaacaatgaggatggtaaaatgtcatcaaattttgaggtattttgcagaagagctgacaggatttgctgagcaattggttgtggtgtataggaggaaggcagggactaaggatgattccaagcatttagtctggtcaagaaagaaaaatggagttgtgttgactgagcttggggcaacttgagcaaaccaatttggtgggtaagatcaagatcttggttttgaacatgttatgtttgagacacctattagacatcattggaggagttgaggagttaggtggctgtgcaaatctggagttcagaaaagggctgggctggaggtgttcaactttgggagctgtcagtgtacagctggtatttaaagtcatgacattggactaggctgccaaagagctgagaccctccctccaaatcacactagtaatgctgaactacctatcatttgaaaatggtaggaaaatggaaaacataggttttggtatcagaaaacgtagattcaaaccctatctctaaaatttactttttagctatatgatcttagtccaagttactccaattctttcgaatctcagtttctctatctgtaaaattataatcacagcttagacattaataatgataaaatgtatgacaagtatctagcaccagatcccatgctagtacttagtaggtactcaataaaggatatctatgacagtaatagctaaaattctagcagcaactgctgtaagattagcaaaaaggaaactctcatattccttaaggaattgcacaaagaactttatagaaatccctactctgactctgcaaacaaaatctttatatagcaccagagtttagacctgcaactgacccaaacaatgtggtcagttctgtctcattttgtagatgagttcactgaaacccagagatatttagttttttctaaggctacattttctatcagtggcagagctaaaacttcagaccaggttttttgattcttggctctttgcattttgcatccaatagaaaacaaatgatttttaaaccctcggatttaatatacttggggcattgccagtgttcttgttttatgcatttcaaaggtgcttcttagttgctccaacttactgattcattaaatagtgtccatactgagatataaaatatcatggttttccatgaaaagaaatatacaggtttatatgaaagcagatgacacaacaatttctctttcttttgttttcaatgctcatatgttatcatttagttatctactggcaaataggagtttgttcatattaaaattaaacaatccaatatttaacactgtatatgtgacatttactcgatttttctgctggctcagaaatatgcactggtatgcagaaaaagacctattctattctacttcaaattatccatttttacattagaaaacctctaacatcaggctatcttctacttctagtttatatataggttaaaaactcctctgcaacttctctggatattatacattattacaaagtctctgaacagagcataatgtcttttccttcctatagaataacaaagaaatgtcctataattttatactctataaatgagttattaatggtaagaaaccaataattattatcttagtggataatgactgtatactgtaagaaaagtattatccacatttatataagaaaactgagcctcaaagaattaaacaaattgctgaagcccacatggctggtaagggatgtatctgaccatggttcattgctctaaatctcatggtgcttcatcctcgctccacggagacaggggtgggtgtgccagtgttatgatgatccaggctccatgtcaagggctacttaaacaattttcactaaaaacttgaagaagtgtttcttcataatatacacaaaggaaatattttacatttgccaactcgcaggttagtatcaatcaacaggtttacccactgttatgtatacctggcataaagaaattaatagattaaaaaacatctttgtcccctgatattataaaaggtttatctgcctctattttattttacattgaaaagttcttaaagcaatattgttccaggatacagtgttcttttgaaaaatgtactctatgacttggattacacatttaaaaaataatataggatgtatgcattttgctactagtttgagccttttgaaatctgctttgacgtggggtttctatacttttttgatgcatggcatcaccaatgcaaaatccatacctacattaaatacttttgtatttgagtttttgttatttgagttttttttttttttttttttttgagacgggttctcgctctgtcgccctggctggagtgcagcagcgcaatctcggctcactgcaagctccgccttccgggttcacgccattctcctgcctcagcctccggagtagctgggactacaggcgcccgccaccacgcccggctgattttttgtaattttagtagagacggtatttcaccgtgttagccagggtggtctcgatctcctgacctcgtgatccgcccgcctcggcctcccaaagtgctgggattacaggcgtgagccaccgcgcctggccatatttgagtatttttaagatcatctgaaactatttcagtcactcaccagaatccaggaatttgtaaagtatgtgactgatgaaataaattaacaatgatttagaaacttagtgaattttaagcctttctatttagagatacctatcaaaccacaagcgtaaaaacttgaccctagttatctactatttttctattaaaagcaaaattgttctttttatgtatcagaagttttaacttaagtgtatacttttattaaaatgatagccatgaaataaggaaaatgcctgttttcgacttattatcagtgactaattagaaaataattatttctcttgttaatgttgaaatatatattttacttttttatatataactaaattataccactataaagagtaagtttttaagtgtcataaaaccattgccgagtccataatgcagcataatcgcataaggctgttaatttccaccttatatttttcttatatttttaccctcaaaaaatgtagaaacttgtgtaaacaatatgtatatatattttagacagagtctcactctgtcacccaggctggagtgcaatggcgtgatcttggctcactgctacctctgcctcctgggttcaagtgattcccctgccttagcctcctgattagctgggattacaggcatccgtcacgcctggctaatttttgtatttttagtagagacagagtttcaccattttacccgggctggtctcaaactcctaacctcaagtgatctgcctgcctcagcctcctgaaatgctgagattataggcgagagccatggcacctggccaacaatatatttgaagacaaactttatgctgtatttttaaataatttatcaaaaattgtttttaaaaactccatttagtaacaaatgaattgcaaaattaatttcattagtcaactgacactgtgaaatagcaaggctataatggtgaataatatagacatgattcctgtcctcatgacgctcagagagtagttgagaagatcatcattaaaatttgtcattagaggaataatataagggctgctggggtatataactggtaataggtcaatctgagtactaaagaaaaagagaggtgacatttccaagaccctaaagtcagaaacagcatataaaacattcataacatttgacaacctaaaataattacagtattatccaaatggggataatgcaatgaagagaaaagaaaatgaaactggagaagtagacaggggtcagacctcctagcgtcttgactctgtgttaagacatttgatcatcatcctaagagtaatagaaagctaccaaaatgatgcatattacatttacaatggtcgtgttagcacagtatgcagaatggattaaatggagccaaacatgaatttggaaacatcagtttagaggagactgcaataatctagatggactattagatttgatgctagtcttgacagacacttggaccatgcagtgatatggggatggaaaaaagtaactgaatccagagatagcaggcagaattgacaatatttgatggttaattagatatgaacgtttaaggggagacagaaatctaagatttctcataggtctctggctatattatgcacattttataagacacagagacgtcaaaggagtaagtaattagcaggaatggaggggtagattaaaagatacttttcaaaagttcagttttagaattcaaaatttgaagtgttgataagatatgtaagtacagatgtcctatggacaatcaagtatgtggaattcagaagagcggtctcacttggagagaagtatctgagaatggtgggtatataatggttatgtttgttgagcaatgtttgttgatggactacactaggatgaggagagtagaagagaggtagatggcttacataccttatgtctttcttttcaaaaagaaaaatgccacatttcaaagaatacagagaaattggtgccctgaggcatgaagaagccagggaattggaacctcctgaaagcagagggaagataacttagtgctaaggggaggaaccatccttgttgaatgctgcttagaaagcatgtcaaatataatctcaaattatccttttgtttttagtgacaaaacgtgaagatgttgccatctttagaaagaaaagctggtaggctgaatatatgatagatatataagaaaaggaaagataagcagctctttcaaaaagtttggccatgatatggaaaagggagataaggctgtagtagttaaggagggttgtgagtcataggagagaaatatcctttcccctatgccaggacaagggagacgtaagcaagtttgtgttgctgggaaaaagccagtaaggtgggagccattaaggataagaaaagagagagataagagattgctgaagtcttctggaatggggaaggtgtccagaataccggtggagggattggaaacctccccactgtaacaggaaggaggaaaggattggtctcaatgtggaaaagtttgttgatttgggggtgggaagtggaggcggggcattgtgatgctgtctcttctctgtaaagtagaaaataagttttcagcttgaaatggagccggaagaaagaagagggttggaagctggaggaaagtggagaatatttgaaatttttctttgcagagagtgggagatggagcctagtaggaaaatacaggactgtgttgaggaccactgaggtttgtgaccataaatttagaatggtgccaatctgccacggggtgttatttttccccaatagggctcagcagaccaacaagcacaggggaccctctagttttatataccaatagcaagtcattctttatttaatttagttttttgtttgttatagcaataaagaaaaattgtgtttctttgaaatggtattttgtgtgtgtgtgtgtgtgtgtgtgtgtgtgtgtgtgtgtgtgtgtgtgttctctagattatagtgccctcacgtggctgatgcacatcatttacttatgagtgttttcatatggatgaaaaaactgagaattaagcatgggccttacagcacagctactaaaattaaaaaataataattattattattgttttgactaaaaccagtactagatgcaaatgaactttctttctagatcaacacaacattgtccagttgtaatagtgttgatatttcattatgtgtaagtaatgtgatcatttatagtaaaaacattaggagtgagaaaagatatgaagagcacgtatttcctctctggaatttctataattgtgtccagattcacaatgataaagagtgccactttacataatggcaactaaatctttattatgctttttattaaatatgaaagtcattactattatctgatactgaatattttcttaaatagttgttttggtttttgtcttttgctgttttttaatgtcaaggaaagtgaagggcattggctatacctgcaaagacaaagtgggatagggtgaaaccaacccaatatttgtaataaactgtgttctgtatgatccaggaagcaattcattgagcaactattacgcactagggccattaagttgaaggagacttacatattttaacaaatttgatcttcatagcaatcctgttacatgattactttttcttacttttataaccaagtcaattgagattcagggaacttaataagtaattttgccttagttacaaaccccagaaatgccagtgctaacacctgccatcttctctcatagttcaggattttatgagcaattacagtatattataccctctgtttagaaaggaccttattataagacattccaccagggtaacttttagaatgatgttataatacatttaattaattacttgaattgtcttgttgaatttttgccagggtttacatatgtgctgaacttgcagttttaatgttcagttgagtctgtcgttaagaaaatttaagttgataaattattcactgatgaactactttctttgcatttaatctttttaattgctaaaggtacctaaatagcctcaaaatagttgatggcttggcctgaagacaagatctaaatatgaggttgctgagttatagaaatggcaaaaaaagggtcaataatagaataataagcaacaaaataatagtaagcactaaagttttaaacttcatggtggtgaaggcatggtagtgcataaaagtaagatttttccattgaactttgtcttccttgacgatattctactttattcaatatgctcattatgtgcacgattcttaccaactgtgtatttatgaccatgagtaaccctccagactggacaaagaatgtggagtaagtataaatatttttcaatattgacctccctttatgtttcatattgtgcttttaacaccttgagacctcctcaatttctttaacaaatcatgctagctactgttaaccagaccctgattcaaattcatttctgtcactaaatgtcttctaggacaaagcttgtagtgggctcacttagttgtgtaaattactgcagtagtttgactgctattatctgcagccctttatcttctttgtgagtcttatgttcttttgaagatcaccagtgatttactaatatctactgataaaaagtatacctagtttttatgttccttttttaatgactaccacagttctgtgttactagtatatgtttgatggcttttaatggtgcatattttatgaaatacaaatgcttcactcatttttgtattaatacctatttgctcaaatcggactgaatgccagtgtatttcagattatgtcttcatatagagccacattatttggatcctttaaattaattaatgtggaaaatgcaatatacatttatttacagtcaatgagaatgtcttttggaatttaatgtttcttttttgacttaagccccacctaaactctatatcgtagggggaccaacctggaagtgtctaatttttgtttgctgtttatgtcatctttaagatatgtacttgtaaattaaccactagatttttaatgtgagcttggctattttctctcaggtatacctttacaggaatttatacttttgaatcacttattaaaatacttgcaaggggcttttgtttagaagatttcacatttttacgggatccatggaattggttggatttcacagtcattacttttgcgtaagtatcttaatacattttctatcctggaagagtaaatcactggtgggagcctatactatattttccttggtggcttgccttgacagaccaagcatttttcttagtaatcatagttttcttccaatcaaattatccagtttggagaaattaggaactatcatagtaaattacatggctttggtttcaattagcactgtaaagtaataaagtttcccaaataacagagattatgattgatgacaatgccattttcctcttaattgggaaagctgatggcgacactcatgaaattaaaaaggtcttgatgaaagaccaaggaagacgtagatttccctaaattctgaataactctgatttaattctacaggtatgtaacagaatttgtaaacctaggcaatgtttcagctcttcgaactttcagagtcttgagagctttgaaaactatttctgtaattccaggtaagaagaaaatggtataaggtggtaggccccttatatctccaactgtttcttgtgttctgtcattgtgtttgtgtgtgaaccccctattacagatatgtgacagagtttgtggacctgggcaatgtctcagcgttgagaacattcagagttctccgagcattgaaaacaatttcagtcattccaggtgagagctaggttaaacaccgaggctgactttagctacagtggtgctacaatcacagcttttgtgcagaagccttgttgctagttgcatattgcaaataaatatgtaaaaaagcaagaattggtacatcattttttggatggatttgattctttgctttttactcgttgctttctttaaaactattctaaatcagcctttgagtttaacaagtgttgcatgaggcatttgcagtaacaggctacatggtttgcatcctataacatcaagctttccgcatagaagctagactaagagacattcagactgatgcaaatttgacagtttaggcctaaaactggcaatcttttaagctgcagataaatgaaagagcaagggatagcatgagtgctgcatggggctcagatttcagatgtcttcctttttttaacccatactcaagcttgcagaattcacaaatatataacctcataattcatcgacttcaagatttcttactactctattcacatagacttttctaaaaccaataaggggttagggagtaagacatctgcaaataaaagcaaaatatttacacaaggttgatgtttaagcatgaataacaaaatcattcttttgctctaaagagtgtttggaaatacacatttggttcatttccattcacagttttctaatgaacatacaagttctgctttcattcattttcaccagctagcaggcttttcatgaaaatgttattcaatcacaaacattaaactaatattgttggcattctgcatgacatttttattttccaggacaagctcatgatatttttgccggtaaaatagctgttgagtagtatatttaaattcccccttctgattttgtttgtaggcctgaagaccattgtgggggccctgatccagtcagtgaagaagctttctgatgtcatgatcttgactgtgttctgtctaagcgtgtttgcgctaataggattgcagttgttcatgggcaacctacgaaataaatgtttgcaatggcctccagataattcttcctttgaaataaatatcacttccttctttaacaattcattggatgggaatggtactactttcaataggacagtgagcatatttaactgggatgaatatattgaggataaaagtaagatatactctataaaccattaagttgtttagttctctaaatattaaatattatatataatggaaattatctcaatttagatgtgaatcaagtgacttagactaatttaagatgatttaatacatataaaagagatatcaaatgataccttattctatttttcttatctgtccattgatatagtaaaagttctcatttgaaaatgtgttgtcttatactcatgttgaaagtaatttcatattatgccatattaaaaaatgtttatttggtagacattaatcaggtttttcagtcattttaataaataagtcagtagtttgaactattcagtgtattccactgaaatgtgttaagaagactgaggggaaataatttggccctatttggttgatgcaacatatgtattgagtacatatgctatatctgaaaatagagaaaccatttatcaagatgaaataagaatttgtgtgctcctcagaaggttaagtaaccctgatttagccattcacttattcatattctaattagtccctttagtgtcatcattgtattgtagttaccagtttagtttgattatatttaaggtatgaacatcagaataagcttatgccatatacttcagcatgatttcttaacattgagcccagcccctctgtcatttttcatatgtgtgtgcatgtttgtatgtgaatataaaaatacgtatgtttgcatgtgtgtgcatgttttctgagatcatctttgcaacttactgaagttatatgtcatgccttaaaaataaaaactagatagctctccatagcttaaaaataaaaactagatatactcagacaacatatctctccaaagaaacaagtttattttcttcatttgaaaggcagaaatcaagcaaaaatttcaaacaaaacacttatttacagtatcataagagggaataaatacctaatcccacttctcacaggaaattaagttaaaattggcgggaaaaaatgtctgaatctattttgagcctggggagaaaagtatatgtaaggtaaaatttatttgcatgaaaacacctagaaacaacaaggctttcttctttcttactttttgtgcccagcaatagactggcagctctttcttaatgtatcccatgcaatttgagcttatatttgcaatgaatgctgatataagaatgttatcatagtaattccttctgaacatttttctttttaacatagatttgctaaccatttgtataatcaaaaatgttatatattgatatttgttcaatattgtgaaaaatctctttagccatatatatttattagtttatccatctcattatgattgaaaacatttgtgagctttgccacctaaacagggtggctgaagtgttttacaggattttaatgattctttctattcctttctctttaaataggtcacttttattttttagaggggcaaaatgatgctctgctttgtggcaacagctcagatgcagggtaagtgatgcttcctactgagtttcagtccacactgctccatcagtgtcaataacctgccacctcccactcatccagtcccactcactcctcactcaaaaccctccataaattctacttcacggtgactctcagaatagccaggataagtgtagattctcacctctttcacacagtcatttactgcaattatttttctatgctaggtcacatctaatcttccaaattagttcaatgtaaaatagagaataaagcagtataatatgcatctgaagcttaatagaattcttaagcacatactttttataagtgtcatattttatatatactaatgtgttctccatagcttaaaatgtaagatctctgaaaataatgttaatatctgagacatggggagtatttagcatattttagcaaagtggttacaaacataaactggagagtctgcatagagtcagactttgactccatcatataatctcatttcttcttgccttcgtttccttatatgacaaatgggtataataatagggtttttgtgatgatgaagtggattaataaatgtatagctatttagatcgctcaataagtgcttgtaattgttattattgggatcatgcaaatgtttgctattaagaaacatggagctaaatcctaggaaaatttaaaaacacagttaattttctttatttagcaagattttagagccacacacaaaagtctaatgcactttctttggacgatgatactgtggacattagtagctaatacctgtagcaaaattcccagtgataataggctttccatttggctcctacgatcagtgctatgctgcctttatcttcagattccaatgataagtaaatcaattgattttcattccttgtttgtactgtactaaatgcgttacatacagtatcttcttcaatgtttgcaaatttgtgagacaggttctcttattagcccattctcacatgcgaggtgcctgaagattagcaagttaagtaacttgcccaagatcgttcagctcagaagtgtcaggcaagacattgaagccaggtctgcttgatcttcaaggtcctcctatgacatttttaccacacagtgtcattcactccttgcagcatgccccacctatccttttctcacttctttaccctgttcccacacttacacacatttctgcctcaagacatcctcagtgaaaatcaactttttccttacagacttttttaactgcccttaagtcccagaagatattaatcatgatatgattgcttttatatggagacataataaatataataatgacaattatgaatcacagaggaatccacaaagtagaccttatagattctgttattatataaatcagtccacttagtgctgagttaagtactgggtaaggtgagagaaatcggcttttttctagtgcctgtataaaacagacattggcatatattaaaacaggaaaaccaattagcagacttgccgttattgacttcctttctttcctctaacctaattatagccagtgtcctgaaggatacatctgtgtgaaggctggtagaaaccccaactatggctacacgagctttgacacctttagttgggcctttttgtccttatttcgtctcatgactcaagacttctgggaaaacctttatcaactggtgagaacagataaaatcatttttctgagaatcataaaacaccgaactcaagagaattgctgtagaatattttattacttagagtgtaagtttgtaacatcctatataaaatttattaaaatctctcttccattttgcagacactacgtgctgctgggaaaacgtacatgatattttttgtgctggtcattttcttgggctcattctatctaataaatttgatcttggctgtggtggccatggcctatgaggaacagaatcaggccacattggaagaggctgaacagaaggaagctgaatttcagcagatgctcgaacagttgaaaaagcaacaagaagaagctcaggtatagtgaacaagcatacggtcctttgtttttctttatctaaattctttaacctaaatgttgaggtcagtggcaaggtagttgacattagaaataggtcatatgtgtttggtaagtgctaggagcctgtttggttattaagaagttattactttattgcaatgatctctgtcaatagtgtcaatagtaatggcatcaaaaaatggataattataattgctttactgacatttttttctcccttgtgactccttgaggaaattaatgattaacaaaggcctcatgtactcaaacttgcagagtagataaacctacatgtcctcagttgaagtattttcttaggggaagaggaattcagttacacttgcttcttcattgcagtatcaccagaggtggtaagggtcagaaaaccagaatcaaactaagaaaattatttcattgagtctggaaaggcaaaggcttattcaatatttgttctgttttatataaagtgtacaaatgcaagtttgtgggttacatcagtaaatcactagtgtgtaaacatattaaaacattagcactctctgcctcctactctacaaatcctttaatttggacttgacaagccttcaaaataaggcaagaatttctctaattatatttgcttgacttaatggcattaactaatccaattgcctatttttgtcttttcatgtatgttgaatacaattcccttttattaccgagtattcctaaatatgtaataaaggtcaaagtatattgctgtaatagcaacaaaactactgttatactttacaagttcatgcagatgccatgatctaggattctcaaataaacactctgtattatgtctttgctgtgcatttcttagtgaaatacccaatttaaatcacggagaaaaatgtcattaaaataaaatacttgactgaattacatttaataattcagactagcactaaatttctttattgtgtgaaaatggaatcaaaggcaaatgtctaccaggtttaaataggaagtctttaattcccatattatttccttcttaaaatattgtttgaattatagaacatgttattatgatctttaagtgtcttgctcatattattagataattagatatcatagtgtgaggacagagcttgaaggttctcataaaagtcgtatgtatcatcttccatatgaatgcccattttactctttgattggtctaataacaatgtactgttttctaaaacacagaataaaatggagaattgtttttcaagattatcttcatgatattgaagctcaattaagcagtaacatgataattactttttaagtttatatgcaacttccacatactttgcgcccttctaggcggcagctgcagccgcatctgctgaatcaagagacttcagtggtgctggtgggataggagttttttcagagagttcttcagtagcatctaagttgagctccaaaagtgaaaaagagctgaaaaacagaagaaagaaaaagaaacagaaagaacagtctggagaagaagagaaaaatgacagagtccgaaaatcggaatctgaagacagcataagaagaaaaggtttccgtttttccttggaaggaagtaggctgacatatgaaaagagattttcttctccacaccaggtaaaaatattaaattacatgaattgtgttctcataaattttttaaaaaaatatgccagaatttaatggagagaaaaccgccttccacctggatggcacaatgctttcagagtagtgatgattatcaagtgttttggctatcacttcagagaatttgtgagttttgcaactttttggaatcccaggaaggaaattttagatccctctgggtttggaaaaatttgcggttttgaggttttcttaaagactgaaaaatcttggagaaattttccacatcaggaattatcagcagatggttcccatctcttcttaactattgtgcgtggatctagtgaactttgggttttctgagtgacaaattcccagaagtggaccagagactcttttaggccacctgcggggttgttcccataaggtgcaaacatcacttgccaagtgcattcttcatgcctttgtttcaaaggggactgaaacaaaatatctctaaaagtagccaaaactctcagataggcaggtactgagggagatttatgacacgaaataaaaagtggtgtttagttgtacttgattatctgtgtttcatgttaaacatgggacttgcatttgaagaatactgtgatttataaactgcaacaaatattcactggatgcctctgccttttgtactcatgcaagttgttgaaattttaaaatttagaatcttaattgtctttgaaattaccaagagaattcacaggaatacacagtacctcagaagacattttcaccaggagtgaaaccttaatacctatacagtaacaataacaattacaacaacaacattgataatggctaatatttatacactgtgttgttatttgcaatattaatgcattaagcctttcactgcaaccctaggtaagttctaatttagttaatatccccaatttttatatgtgaagagaagcagggggctgcattctttgttgagtacctattttatgcttggcattctttctacattctcataattaatgctaacagttctgtagaatagtattattttcattactataatgaaaaagctattttggatcagtaaagttaaatagttgcacaatgtcatatagcaatagaaaaagttattatgatctttgagtgtcttgttcatattagggttgttggtattcaaattttgcctggtactgaaaaccttaaagtttccactttatcaagttgcctatgaagaatgcctttaaaaactgataaggaaatttacaatataactttatttaaaatacacaatggcattatactttctcttttacctttttataatatagacaagctcacataacctcacatgtgatatatataaatttttttaggtcagccttattcatttcaaatccaaataacatcataagattgcatacttggggattaattcaaatttaacataggatctttaaatatcaaaatttacttggtctctttcattttgttgtcacaatcatgattccattagtagaaacattaatcaataaataggaatcctttaaaaggcaaaccccctgtttacagtattagtcattctgaaaaggaaggaagaaaaagaaagggagggagggaggggggagagagagagagaggaaaaaagggagcaaaggagggaggaagatagagtatttttgcctacatttttacctaagtttgtctgaatttttgcctgaagttgtctaagttttggccaaaatttgcctaaattttggcctagatttgaaacttcatatcaacttcatatcaaacacttaccacagagattctcttcaatttgccttatttctaattgaataaaactaattctaggcaaaatagtgaagcctgataaggctaggctctgtccttcctttttctgtacattttgttcatagatatgatattctcccagcagcctcttcttcatacctctacatacctccatttcccagctagttgggtattataagcaatcactgacttagaagacatggcatggctggctcatattgatacttgtttcttaagcagtctctatataaaaatagagttaaagactttattttgcttgataaagaaatagtcaaacaaatgtctaagaggatggagagggagacagaaaaagacagagggaaagggaaagaaagagaaagagagaggggggaaaggagaaaaggaagaagagaggagagacagaaaaccctgaaatcacaccaaccccacttggcaagccctgaaagtaatactgaaaatgtcaaaccagatagaagtacttaatcttggtatagcaatggagggcccatcgtgtctgttagatttttaagagtttgagaccccaaaatattaggaattattgttttgtgatgacatgattgtgttggtaaccatctctgtgtttgtattgaaaaactatacaatgcaagcctttactgcaagattataatttctttagtagagtaagtggaaatatgaattgtttctcagactctgatttgacttgttagtgtggtaaagaggggagaagaaagtcaagaatgtaatctctaaacaagtttcaagataatctggatttttttgaaacctttataaggtacaattgaccttaaatcattactttattatttatttgtgataagctaggagtttaggagttttgctttttaaagattggtttggtatggggaatatttcttactggccatcttttttgtgtgttacagcatttgattactatgcatttatgtaatgaatgtcagcaaaagaagttgatgctaacggatggggcacaatcatttctcatatagctgtcacatgtaaactacgtttttgtatagcttaattcatccatgatccttgagaaacatgcaaacttataacttattttcttccaacccttctatggctccagctgaatggggtactggcagttaaaatataaactcttactaaaagcgatagaaacattcttcattgcaaagcatgtattgtttgcctttcttttttagctaatgaggagcagtatgttacacatcctgcaaatccggtaactgttatttcctcatagctaattcgaagtcccttgttagaggagagaaaggagacacgaaaaaggatggatagtctaagaaaggctttaaaaaataactacttgtatggaaaatgataaaagaaaagaatgaatgttactaatgtagttaataggattaaaaagcatgggaacaacaagaggagagatgacttctgttgtgggagcagtaagtcttcttagaagtagttctaggccgggtgtggtggctcatgcctgtaatcccagcattttgggaggccgagacgggcagatcatgagatcaggagatgagaccatcctggctaacacggtgaaaccccatctctactaaaaaatacaaaaaattagccaggcgtggtggcaggtgcctgtagtcccagctgctcgggaggctgaggcaggagaatggtgtgaacctgggaggtggagcttgcagtgagccgagatcacgccactgcactccagcctgggtgacagagtgagactccgtctcaaaaaataaataaataaaaaaaaagaagtggttcttactgtaaataatgaatagaatcacataagatagtgtttaacatttacagacatttaatagaaactaacagatattattgagaaaaagtaattctttagctggaaagaaaataaaaagcatacttattggtcagtgtattactctgttttcatgctgctgataaagttatacccaagactgggcaatttggcaaaggaagaggtttaattggacttacagttccatgtggctggcaaagcctcacaatcatggcagaaagcaaagaggagcaagccacaccttacatggatggtggcaagcaaagagagagtgaaagccaagcaaaagaagtttctccccatataaccaccagatctcatgagacccattcagtaccatgagaacagtatggggaaaacccctaccatgatttaactatctctgaccaggtccctcccacaacagtgggaattatgggaaatataactcaagatgagatctgggtggggacacagagaaatcatgtcattccacccccggcccctcccaaatctcatgtcctcacatttcaaaatgaatcatgccttcccaacagtcccccaaagtcttaactcatttcagcattaattcaaaagtccacagtccaaacaaagcctcatcggagacaaggcaagtcctttccatctatgagcctgaaaaatcaaaagcaagttagttacttcctagatacaatagggatacagacattagctaaatacagccattccaaatgggagaaattggccaaaacaaaggggctacatgccccatgcaagttcaaaatccagcagggcagtcaaatcttaaagctcaaaaatgatctcctttgactccatgtctcacatccaggttacgctgatgcaagaggtgggttcccttggtcttcagcagctccacccctgtcactttgcagggtacagcttccctcctgactacttccatgggctggcattgaatgtctgtggcttttccaggtacacggttcaagatgttggtggatctattattcttgggtctggaggacagtggctctcttctcacagctccagcaggcagtgccccagtagggaccctgtgttggggctctgaccccacatttcccttcctcactgccttggcagaggttctccatgagagccctgcccctgcagcaaacttctgcctgtacatccaggtgtttctatacatcctctgaaatctaggcagatgttcccaaatcccagttattgacttctgtgcactgacaggctcaacaccatgtggaagctgccaaggcttgaggcttgcaccctctgaagccatgggcctagctctacatttgcccctttcagccatggctggagccgcagagatacagggcaccaagttcctaggctgcacacagcgtgggactctggacccggcacatgaaaccactttttcctcctaggcctccgagcctgtgacgggaggggctgctgcaaagatctctgacatgccctggagacattttctccattgtcttggggattaacattcagctcctcattacttatgcaaatttctacagcctgcttgaatttctcttcaggaaatgggattttcttttctgtcacattgtcaggctgcaaattttccaaacttttatgttctgcttcccttatgaaactgaatacctttagcagtacctaagtcaccacttgaatgctttgctgcttagaaatttcttctgccagatactctaaatcatctctcccaagttcaaagttccacaaatctctaggacagggccaaaatgccaccagtctctttgctaaaatataacaagagtcacctttgctccatttcccaacaagttcctcatctccatgagagaccactttagcctggaccttattgtccatattgccatcaggcttttggtcaaagccattcaataagtctctagaaagttccaaactttctcacattttcctgtgttcttccgagccctccaaactgttccatcctctgcctgttatccagttccaaagctgcttccacatttttgggtatcttttcagcagcgtcccactcctggtatcaatttactgtattaatctgttttcatgctgctgataaagacatacctgagactgggcaatttaccaaagaaagacatttaattggacttacagttccatgtggctggggaagcctcacaatcatggcagaaggcaaagaggagcaagtcacatcttacatggatggtgtcaggcaaagagagagtgagagccaagtgaaagggatttctccccataaaatcattagatctcatgagacttattcactaccatgagaacagtatggagaaaactgccactatgattcaactatttcccaccatgtccctcccccaacaatggaaattatgggagatacaactcaagatgagatctgggtggggacacagccaaaccatattagtcaggcatataaaaacctagatattagtaggtataaaataatggttttagttagttttgaacctttggagaggaaaagatcaaaccaataatacttaaatgatgaagttagtattctttccaataataattacataaatccaatgcaagctggctgaagtaaaaaagagaatgtattagatgatataaattatgtctgtgagtagctttaggcatggatggatccagaagctcaagacatgttaccatgaccatgtctttctccatatctgaatctaggttcctcccacatggtggcaagatgtcactgcagctccaaacttaaagccaatatttttagcagcctcaagtgaaaaagcaccatttcctcaacagttgtaaaagacagggatatctttcaattgaccaagcaggatttcatgaccatctttaaattacgtatcgaatacactgattggctaggcctaggacagtgcctggaacactgggagacccgagcctcaagtcctgctgcatccaggagttgaaattagtgtctcccagataacctggtctgagagttgaggattatttctcaaggctgaacagggtactgatttaaaaaaacaaaaaattaaatggttgtgatcagcctcttagtgaaaattaagtttttgtaaatattgccctcagatttcttgagacagagacaaaggggtgaaaattggggaataaatcatacagttatttcagcttgatttaatttattcatgaagaccatcataaaatatgcaaagggaagtggagaagctgccccgtgtactataattaaacatccctactagcaagattaattatatttcctccatggtaagatttgcatcagggtgtggtcactagcgagctcttactggctacatttttgacctcagaggatctaaaggtagatttgtgtttaattgttttccattgggttgttaactgaaattaacttctaaagaagggtctatcaacagtatcagttctagatgcccgtaacaggacaaaacattatggggacacttctgactatgttgaggtgtgggtaaagtaggagaaaagagagcagaagatggaaaatggaggaaggagaaaaagcgagagtgaaatagaaaaggtgaaccttgtagaaagtgccaaaatgccaccagcagtcatcagaggggtgctttcttccacatgtccaatgacttatccttgagtaagtcaatgactatgacacaatgaatcaaattctgtttttcagaatgccagctcttaactctcttcatctcatttttgtttcttctcttgttattcatagtccttactgagcatccgtggctcccttttctctccaagacgcaacagtagggcgagccttttcagcttcagaggtcgagcaaaggacattggctctgagaatgactttgctgatgatgagcacagcacctttgaggacaatgacagccgaagagactctctgttcgtgccgcacagacatggagaacggcgccacagcaatgtcagccaggccagccgtgcctccagggtgctccccatcctgcccatgaatgggaagatgcatagcgctgtggactgcaatggtgtggtctccctggtcgggggcccttctaccctcacatctgctgggcagctcctaccagaggtgaggccaattaaaattgcagctgatgtgaagagagttgtgactggtgcaggcaggagtgtttttccatttccacatctaagaatttgttgagtttgttgcccaaaggctgggagtttgttcaatcaagctgttaactgtcttgtgaaactgttctattcagacttttctacaaagtaattaaaaacctaggttggctgtcagagaatataattagaagtaatctttcatcattattactatggtatgaaactcgccaaaaagcaaagcaacaatttatcaagcataatgtttgattaatatagttaaattaaatccaaggaaattaatgctcacaaattaaataaatacttaaggattttgtgattgttgttcatttaaaaggagatttgaatacttccacttgcagtagatactattactaaatagatttaaatcccatagtacaacattgcctctctttgcaggtcagagtgttgtaacctttttagcatccactctaatgatctcaaccattgtaaatttatacatgaagagccattcaaaaagtacctggtttggaatcatgggctgtcatttttagagcagattccaatttttatattactgtcataaactcttattgtaaacaaagtggcccaaaaccaatcacatggaaaaggatttcagctacatactagacacttacagggctatattattgaaatttacttcataaaccataagaagcttttaatgttggtattaaataaaattccattagctatcaagacatattttggcaatgtcacttgattgtattttatagcattcaaaatgtcttcttatgatttttttttcacatagctccatttattatcattgaacaagctctttgagccacattaaaatgatacggagttcgttttcagttacctaatggaggagcttcttatcttggattataaaatagccattatcttcttcacattttttgcatggcctctccccacctccttctaccagagaagtgtccaggtatcctgcagtcaggttgaaccatgagaaaagtagaactttatagtggaggaaccaggaagaatgaagagaggacatcagctcttcttaaaaaatgatcatagataaccatgtaccagacactgtccagaacactgtacatgtgttaagaatcatttaagcatcataacaaccctttttgatagttagtaacattatcccaattttacagaggaggaaactgaggcttgtgcgtggtggagctaagatttgaccccaggtatgctggttactgaacctacattctatcaacagtgaaatattgcctcccactgagttatttttaatttctttaaatcaaaaagaagagatggttaaggaaataaacacataaacactttcattttaaccaatgtttctcaaaatatacttcactttcatactacttacatcagaatctcatgggaggcttcttaaaactagagattcctgtgcctacccagaccttttcagaccaaaccactgaggagaacaaggtctgggaatcttcttccttaacaagcatcccacataattcttatacataataaagtatgtttatcactgatcttgataaatgttaattgggtaaacaaaagcaaatctacaattaccatgcaggaatacagacagactgtcagtctgtcagaaattatttagcatttatcaataattatcataaatctcctgtcctatcagagatgatgggacaaatcgctgaaggcaaagttggggccagcttgaagcaaagctttgtgtggtccctttatttcctgcttcctcaacttcattctttaatcttacaatcttaagtgctttgaggcagggcactgtactattgcaaagttgagctgaaggtgcaaacaaatgaagtaggcttttggagaatgcagaggtgaaatgacaatagaaaataaatagctatgggcaaatgacacccttgaaagcacatcatttcctgtactttacacataaattcaatcgagtaatgtcattagcagttttggaatctatttgaaaattagacaaatctaggtttgtacatgtgcttctgtgtagaacagaagggactagatgatcttcatgtgactattttttttttccttaaaactttgcctctttctgacaagctgaaatattttaaattctaagaggcaccctttggattaaaagacttttatttttagagataggttatttcttttcttactaattttacttgtttttttaccttaaaattaattttagaatgacctatatgaatagttatcaccattagtgacaatcatatgcaatgagtggaaattttggttttgaatatgtatgcattaaaataattcaacttacaaaagataaaatactgctaattgttcacatcataataggatgtgaccaaaataaataatattttgatcatattattatattttgatcatattgttcttttagaaatagggaaagtcctcaaaggaatgaaactttttaatttattattaacactcagacctgcatttgaaattctttagctttacctttttttttcctgtgataattgacatcattgtttgatctcctgaagtaggaataaatttccacccatgttgaaatcctgatgagtttattctggagtaggagattatcagatcattgtatcattactaaaaatcacagtcccccacattggtattatctccttaaattatagtctcagtgccaagggtggattgttttgtggattaagttgtttttcaaatataggacaaagttatagactagttctaaaatttagttttgtaattaggaatgttgggaaatattacctgtgtctaatgaatgaaggcattttgcaactggaattcacattttaggggaactgttactgatgcatatgaaggagactttcaaacctttttgttcatatattaaactacctgaatatatgtctataaagatctaaaaactcaacctgggtgaaaattaagaaacaatatgttttggtctgaagtcctaagtgggattggctgaaatgctaaaaggttatctgtccagtagtggacctggtccctccagcccaaatccctgggatagaggcataggaaagcccaccttgacaaacccagggctccccaaaagctgaaaatctgacagacttttaaacaacccccaaagaattatcattccaacaatatcttagtgagctttttacatctgagaaagcatggtgtatatttagttaaataacacctgttgtaggaatgctttgggctttgctgctttcaaaaatagtggttatttcatctgaaattctacttctagggcacaactactgaaacagaaataagaaagagacggtccagttcttatcatgtttccatggatttattggaagatcctacatcaaggcaaagagcaatgagtatagccagtattttgaccaacaccatggaaggtatgttaaaagtcctgcgtcacagttacttggtgctttggtaatgatgaaaaaacacttcataaatttcaataaaatacttcctgacttgatattgtatcattattacacattttactaaataacagtaaaatccgtgcataactcatggattctattatcttccacagattttttttttttatatttagcctccagaaagctgctgcaaatgtaaggtatattttgaacaccactttcatacattaaattctaaacattgaaacttgtgtgcatgacgttgaaaagagtgtaatgataaatgcttatacttatgatgatgctaagccatttggattatattaactgcttgagacacaagttataaaatcctatgacttaaccagaaatataaattaaaaatgtgaattagggtttgatattaacttccttgaagcaaagtgtttaaaattttgtagtcctacttttgcctttctctgaccagattcttacaatatatcagctttctctttagttgcagattttatctgaatagttaacataatgtgtagcagtctggatctcagaatgccaaaataaagactttggggacagcttaatctgtgatcaatttctggctctgccatatgttaaatgtgttaatttgtgactttgaatttcagtctcctcatcagtaaaatgtggatgatgatgtttaggcataaggttgttgaatggattaaataagccttcttagataaaacactgatgtatttggcatgcagaagacagttaataaatattatcaatattagttgttttgttgttgttatttttgttaattcacatgtttttgcctttccatactgtaagtgaattcaaacaactgtcaacttcaactacttggaaagtattttcatgtaaaatgtattctatcccccttccttgccctcctattccctcctctccctatctctttacaaaccttctcccttgtaccccttcccaggtatgtgtgtgagtgtgagtgtgtgtagatgtgtcaagggagaagagaaaaggagaatgaaagcaaaagagagcaagcatacacgtccctttcttattgataattagattttctcttgagattggatagattcctggaataattcttttcctgtctgtatgcaaagatcccataatattattaataccaatacgaaaagcctgaaaatcacagccagaaaaaattcacagtgtagacgactgtgtacatcacagacaagtcagtattacaaaacccaattttcatagtgtcctatttcagtatcctaatgcaattcactgatttcaattgaatattaaactctagtacgttcttccccaacctcgcctgcgttagcttgcactccctcttccccccagctgccagtagcttgctcctccctgtccctccaggtaaatcttttgaagattgtctggccttccgctccttgccatagcaaaaccactgagaggaagctgccagtggttctgctaccgatgtcagcagcatgtctgctccctaaagcaggaagtagagaaggagacagggtaagtctaaatcaacagtcatgctttgcacttctgatagcattaagtttgagctaaataagacattacttaaaaaacctcaaatatccacaagattggacttgccaactaattaagatttggagttcaaaataaatgcacccacacctttctccatggaactatgtgacatggggttgcttaggatggaaaggatgttctaggaataagtgcaatctaggaagctgaagactgagagtgttttcgttttattatctgcagagcttttgacttgtgtatttgtgagaaataatggccaagtttttattctgtttttaatcagttatctagaatgaaaactgacttttctttattcaattgtatgtagacacattgagtgtgacatttgtcaaggttggttgttagcaatatcacatacatgcatactcaagcagacttaagatagtcctttttttttttttttttttttttggtttctgataatggtgcaaagttttcctggttgacataatctcttttcttggggatcctttcttctatgtctgattattgtttatttcacctttcctttttatgaaccaggcttgttgatccggttggcaatttttgttctccttctttttaactacagccaagtctccgttgtccagggtaatggatagcctcatgcttaatgaagcagtagtggataagcaaaaatgaaccatttgcgtttcaaatttttaaaagtgcaaaatcacatagaaatgttttctggtcacacctttgtgaaggatggtgggagggtgagttagaagcgcctgaagaatcaaggtgagccagcaaaagacacagatttactgtaagtgattctatgtggataacccatgcaggaataatggagatgtggctgcagttctctcctgaatgctttgctttgttttaaagtgtgagattccccccttttttttggaatgaataattgaatgattttattttagaacttaaacaactttgctccggttattcctactgtcaagatgagccacacctgctgaatttcattttttaaacttttctccagtttattttttttctatccagttcctgtttgcttctcgttatttgctaaatgacagctggcatggaaagaaaaaaccatattatggcagtatacagacaaaattaaattttgtagtttcttttttgttatttactgtaaataataatacctcctttttaccttcagtgtaaatataaggttatttgggagtttagaagtatttacaaaataactagtgcataataactatatttttctctgaattataaatcaaatattatttattgtttacaaagttatgtattaagggaaatggaaacaaactgggcacttgaagaatttcaatatccaaagagacaattgacaaatctatttttagtggaaattttaaaaacaataagcaataaattaatttacttaggaaaatagtattatagaattaattagtggcaaatgttgattagtagaagaaacattatcatctgtggttgtgattgtccttttatatgctggttccacctttacaaggtttagttcatagcaaactgtgccagatatggacagatgttccagttgccacaatagtattaaagtgactgactagagtcaactatgccatggatttaaaaagaagaaaccttccctctatttcagtgctaagaggtggtggccacattttggcagaacaggtaatagggtgtacagcaatgatattgacagaaaacaacaaattctgcatatttttccactcataagttgatgaagagattatcttgccaaaggaagatggtagacagtttttcacttcctaattccccaaatttctttgccaatattcaccaaatttcagtattttgggtgtgaccttaaagatctgtgcatttctgtcttctctcccaatgtttggttgaaattcttcttgacatcattgtacattttccttgaataaatgcattttaatataaaattttatgtcatgtttgatatgagagttatatatttaaatacatttaaataaatgtttaccatgaaaatgtatgaattatatgtatgtttcacctaaaatcctttgtatttttccagtaataaatgagttccactttgtgaaatgttgatttgtaacaacagtgaggactccagttccttaggctggggtattttctcttcttttatgccctctagttaaatgagaaatgtagagagatggaactttgttgtgtctaatatgcaagcctataatctaataaaatttaatttgagacttttaaactgagattggtgacactgacaaaattatctaattagaagatcaccaaaacatatctaatccaagaaactgacattcagtgtgactgattaaggttcttaggacatctcctgagatatctctgataacatatatacttcttgctctacctggaacatggatgagctttaagtgtacgcaatgcaagttctacccattagtttctagcagccttgaagataagtatcagacagtttagtgttgccaatagaatcttggaagctatgtttagccaggatacatttggaaagcttactagcctttctgtactgatcctttctatgacagcaaacccattgtaaaattttccctgttcctccagcagattaacccataatatcttttaacaactttagattttttaaattccttttaatttaaaccaaatctgcttaatagaaagtaagcagttttcatgaggattctaactttttttcttccagaacttgaagaatccagacagaaatgcccaccatgctggtataaatttgctaatatgtgtttgatttgggactgttgtaaaccatggttaaaggtgaaacaccttgtcaacctggttgtaatggacccatttgttgacctggccatcaccatctgcattgtcttaaatacactcttcatggctatggagcactatcccatgacggagcagttcagcagtgtactgtctgttggaaacctggtaagcctcactgagagtttctcttcctcttgaaagagtttataattgccttagtgaattttacatattgctctcaaattaaatatcaactaattggccatgtatatcttgacatcaaatgtttagcatcccttttaaataacaaaaaaatgttgctaccatagtgcaaaagagtcaaagaatttatgtacaatttgatttagaattgaatttaaattgcttatttattagaagatgattctgaattgtcctccaaggacattgatctatagcaaaattctgacatatttttaagaaccttagaataggttctttaggacatgtctgtgtttactaaacaaatgataaaatatgcccaagtcagataattttgaaatatcacttgtaagtacttgaagatggactatgtagggaggggacatcatctgggggattattattttttgtttttgtttcttctacagtcttagcaatattaaatttagaaattatttatttaattttgttaaaatatatattagcatttactggatacatattgatattataatatagtatactatagtgatagattttaaagtggtcttatacagagagacaaaatgaagaaaatcacgcaaaaaagtatatttatacaagtataaaatgcttattaagttcccagcttgataaatgaacatataagcaggttatatagagattgtaaataatacggtctaaagtataatatacaatatttttaggctctgaagtaaccactatattttcgaattatatttcaggtaggacttaactgaattaaatgataaagttggcatatgttggcctcttattttgtatcagatattggactaaatggtttacattaaatctctctctctagattcccacaaaaccagtcttaagatatttactataaattgtctgtatttcgcagttgggaaactgtatccatgagaaattaacagagaaatggaaggtctgaatgctgtatcagactctgaaagctatttcagagactatcataagctatgggcaaagatcacagacgcttagagtaggaaaggataataattttacctagttcaaatttagagctatgtaagaatttcttcaacattatttctaaaaaaaagcagggtggtggggtggcaattgaaacaagaaagcctttggaggtaatatattgtgatccaaattgaatgagcttaagcaaaaataaagggaattcattacctcactttactgaagcccatttggaactagttctaggttctaacctggctagattcaggttctcagccagcatcattgggaatcagcttcttgtctctcttcttcccaatatgtgaccttcctctctggctgggcattttcctactattgccaagattctatcaacttttattctactaatgtagctccatgtacagaaagtttgtgcctcctaactagtagctttaattaaggcccacaaattgaatatcattgacctggttggagttacatggccatttctaaaccagtcagttaccctagctcttggttttaatgccatattcgcctaaatcagaatcatatcttatcactggaggcagagtaaatgagtgaaattatgaagacaataattaggataccattaccagaaggaggatggattctagaaagaaataaacaataaatagacaactcaagctggggctggtcttacgtgttaaggaatgtaggatctgtatctaaggtgaattatggaatagtagaaaatccataggcaggatacacattcttctcaaatgcctataggatattccctaggataagttataggttaggtcataaaacacacatcaataaacttaaaaaaattaaaataatacagaatatttttctgataaaaaataaaatgaaattagaaaccaataacaagtcaatgtggaaaatcacaaatatttggaaattaaacaacttgctcttaaataaccaatgagtcaataagatgtcatgagagaaattagaaaatactttaggatgactgaaaatcaaaacaaaccaaactgaaattaatgagggcagctaaaacaatatttaaagacaaatttatactctaaatgtctatagtaaaataggagatttcccaaattgctaatttaagctcctttttaagaaactagataaagaatagcaaattaaacctgaagttaacagaaaagacagatattaaagaagagaaaaacaacagagaaaaatcaataaacccaaaagttatttctttgaaaaaatcaacacaattgacaaatctttagttgggctaaccaagaaaaaaagaggaaagacactaattattagaagtaggaatgaagagaggatattaccatggatcttttagaaagaaaaagggagcataagaaataaaataaaattaaacgccagcaaactagataacctatgtgaaatggaaaaattcctagggagtaacaagcgcctgaaactgactcaagaagtaatagactatctcaatatacttataataagtaaacattgaattcacaattaaaaaaaagaaaacttcccgccaaaaaaagcctgagcccagatagtatcactggtgaattttgccaaatgttcaatggagcgttaacatcaatccttaacaaactgttccaacacatagaagagaagggaatacttctcacctcactttctgaagctagaattaccctgatattaatgccagacaaaaataatgcaagaaaagaacacagacacaaatatagaccagccatatcccatatgaacataggcacaacaatcctcaacaaaatactagaagccaaatcacataacatatttagatttttagattatgtactctgaataagtgaaatttatcccagtgatgcagggctggaccagcataaaaaattaatgtaatatatcatattaattttaaaaaactatacaatcatctctatagatgctgtaatcacatggaaaaagccaaagtgtttcatgataaaaacactcagcaaacttgaaatagaaaagaacttcagcctgataaacaccatctcaaaagaccccacacctatcatcattcttaatagttactttagatgcttttatcttcaggtcaagaagaaggcaaggatatttgctcttgctacttcttttcaatattgtactgaaagttctaaccagggaaataagacaagaaaaagaaattaatggcatctagattggaacacaagaagtaaattctattaacgaatacataatcttgtatttagaaaatcctataaaatacacacacacacacacacagctgttagaactaataaataagattgcagaatacaagatcaatatacaaaactcaattatatttctaaacactactaatgaacaatcagaaaataaaattaggaaaattctatttataacaacatgaaaaataataaaatacttaggaataaatttaataaaataagtgtgagatttgtacactcaaagctataaaatattgttgaaagaaattaaagaactactaaataaatgaaagcacattttatattcatagattagaggaaaatattgttaagatggcaatactcaccaaattaatctacaaatttaacgctattcatatcaaaatcccagctacctattttgcagaaagtgataaattgactataaattttatatgaaaatgcaagagactatatgccacacaatcttaactagaaaaaaaataaagttggagaactcaaacttccaaattttaaaacttactacaaagcaaaagtaagcaagatagtttggtactggcataaggatagctatatacatcaatggaataaaattgaaattccaacagtaagtcttcatatttatgttaaattaattttcaacaagaccactagacaattttattaaggaaagaagccttttcaacaaatggtgcttggacaagtgaatatccacatatgaaagaatggaattgaacccttacttaataacatatataaaaattaagataggtcataggcctaaaggtagagctaaaactatgaactgttagaaggaaatttagaagtaaatcttcatgacctattattaagcaatgatttcttagatatgataccaaaagcacacacaatagcaataagaaaaaaaaggttcattggactttatcaaaattagaaactttcatactgcaaacaatatcatcaagtaaaaagacaacttaaagaatggaagaagacatttgcaacccagatatctgatcatgatttgtatctaatatatgtaaaggattattataactccacaacaaataaaatagataactcactaaaaatgatcaaaatatttgaatagacatattgaaaaaggagttagacaaaaggccaataagcacataaaagatggtcagcgtcactggctaattttaggggaaaggcaaatcaaaactaaaatgagataccacttcacacacactaagatggctataatcagaaagaaagccaataccattttttatcaaggatgtggaaaaattagaatggttatgctttactttgagaatataaaatgatgcagtcactttggataataatttagctgttccccaaaaagtttggggtagagttaccacatgacctggcagttttactaatttcttcggatatatatatctaagagaattaaaaacatatttcaacatgaatgcttatagaatattattcataatactaaaaattaaaaacaattcaaatgtctatcacttgatgaatggataaacaatatccatccaataaatgttattcatccataaaaaagaatgaagtattgctacaatctacaacatgaataaaccttgaatatattatattaagtgaacaaagccagtcacaaaatttacatatcatattgctacatttatatgaaatgttcataacaggcaaatccatagagacagaaaggagatgagtggttgccaggcagtagggattagggtaaatgggagcaacaactaactaatgggtatgcagcttctttttaaggcgatgaaaatgttctaaaattcaataatggtgatgattttacaagtctgtgaatatattacaagccactgaattgcatactaatatttcatagtatgcatgtatcactattttttcttccaatcacctattgatggatgttcaagttgattccagatactttacccccatgttgcagtaaatgttcttgtatatatcacctttcataatgctgtattaacttctagaagatagatttccaggattgaagtattcccaatattaaacatattcatgtcacataaaaattagatgatatgcaacgaaatagggaaatgtgactcatagttaatagattaaagcggtacatagaaatagatctggacaggaacaaattgttagaataaacaaaaaaggactttggaggcactattgtaaatatgttgagcaatttaaaggaaaaaaaggggtcataaggaataaacagagaacatgagcagaaaaaaatgaaaactgtaaaaaggaataactcagacattttataattgaaaagtacacattctaatatgaaaaattcactggatgtgtttaaaacaaaattgcagatgtcagaagaaatagttgttaacttggagcacattaatagaaattatccaatttgaacactagagaattaaaaggaaaaatgaactgagtctaactataatatgggataatatcaagtagtctaaatatttatataatgggagaatcagaaggagaaaatagaaagaatggaacagagcaaatatttgaagaaacaatggccaaaaatttcccaaagttggtgaaaaatagtaacttacagaccttaatgttaccttataaaatgttagtgaacatcaacaggataaatataaagtaagccatacttaggcacatcttagtcatgctgctgaaaacaacaataacaaaaagctttggaaacaaccggaagaaaaatatttactatatacatgagactaatgtcttaccagaaataattcaggccagaagaaagtggccagataaaataaagaaataaaagcccattattctacagaaagtgaaactatccatcagaaattaaaatgaaataaagaattttaagataaacaaaaacctaaaaaagctgttaccaccagaactacactacaagaaatgttaatggaagttctttaggccgaataggaaaaatatcagatggaaatttgtttctgggaatgatggtcactagatatgaataaatgtgggtaaatacgaaagactatctttttttccttaatttttttcacatttattttaggttcaggggtatgtagacagctttgttgcataaataaattgtaaatcacaggggtttggcatacagattatttcatcatccaggtaataagcatagtactctatagatagttcttcaattctcatcctccttccaccctccaccctcaagtgtctgttgttcccttctttgtgttcctgtgaactcaatgtttagttcccacttataagtgagaacatgcagtatttggttttctgttgctgtggtaaattttttaaaaagacaactgattgtttaaagtggggatttataacataggtaagtgtaaaattatgaaaagatttgaacttttttttttttttttttttgagactgagtctcgctctctcgcccaggctggagtgcagtggtgcgatctcggctcactgcaagctccgcctccccggttcacgttgttctgctgccttagcctcccgagtagctgggactacatgcaccagccaccaagcctggctaattttgttgcatttttagtagagacggggtttcatcgtgttagccaggatggtcttgatctcctgacctcatgatccgcccgtctcggcctcccaaagtgctgggattacaggcatgagccaccacgccgggccagaacattttatctaaagtgttacaatattaattttacatagaaaattacaagaaagtatccctcatgaacacagaagcaaaaaatcattagcaaaatattatcaataaaatctagcaatagagaaaaaagtaataaatacttcttaaacatgtggggattatctcagaaaagtaagattcatttaacatttgaaaagtgatcaattaattggccatattacctctaaaagaataaaggaaagcctaagatcatctcaatagatgcagaaaaggatctgacaaaactcaacagtcatttgtgagaaaaactgtcagtaaactaggaatagaaagtagctatctcaagttgttaaggacgtttcagaaaaccctacatctagccgggcgtggaggctcacgcctgtaatcccagcactttgtgaggctgaggcagtggatcacttgaggtcaggagttcgagaccagcctggccaacatagtgaaaccccgtctgtactaaaaatagaaaaaattagctgagcgtggtggcaggcgcctgcaataccagctaacagggaggctgaggcaggagaattgcttgaacccgggaggcggaggttgcagtgagccgagattaagccactgcactccacacttcagcctgggcaacaagagtgaaactctgtctcaaaaaaaaaaagaaaaagaaagaaaaccctacacctaatattttacttatcagtgaaatgttgaggtagtgaattcttgccccttagaaaaattgagtgctttccccttaacatagacaaatatgtctatttttaccatttttatttgaccttgcactggaagttttatcaactgaactaaaggaaaaaaaaacaaaacaaataaaatgcataaatattgaaatgtggtaaattatctatttcatcaacatgatcatattgtagacaatcctaataaatctttaaaactgattagaaataaacgcgatattaaatattttatttaccataatatcaaaaaacacgaagaatatagtaataaatttaacaaatcatttcgagacacctattactaaaaacctcaaaacatggctgagaataattacagatgatttaaacaaatggaaatatatatgccatgttcatgcaatggaagattcaatattattaagaaattaattctacccaaatgtatctatcaattcaacccaatcccagtaaaaatgtcacagattttctttgtagaaattgatgaactgactttctatgcaaatacacagtgcttaaaattgccaaaacaatactgataaaagaataatgaaaacattaacctacctgacttcaaggcttgttataaagctgtactaatcaagaatctacagtattggcataaacaaagatatcaatggaacataatgctgagttcataaatagatccaaactacatgtcaatggattttttgaaataaacactacagaaaggaaatagaagaaaggaagtgttttcaacaaaatatcaggaacacataaataaatgtatggaaaataaatgaacctccacttcgatcttatgccaagtgccagaatcaataaggattgtagactaagcagaaaagctaaatcaataaaacatctgaaataaaacacaggagaacatctttgagaccttggggtaggcaaaaatttattggaaaacagacaaaaagtgctatctattatttaaatgtccatgaaatttcaaacaatggagacctactgaacaaaaaagaaaaaagtctagtaatatacacatgggtgaatttcaatttgaagtattcaagtaatatttggaaaagtcactaagactgtcaggtctctgaggtagccacctaggtagagagagattccatttactgagttagcaaatatcagaagagaagcaaaactgtggagaaaaagcagtaagatgaattttggacctgttgaatttgagatgcctgggagatagtctttcaaatgtaggtattgaataggcaggtgggtatgtatttctagagactaggaggtatgcttgaacagaaaaatagattttgaaatatgaactattataaaaatgtaacttattataaaaggaaaactaaagtaagaggggtctagacagagagagttctgaataaatccagtatcaaatgatttgttagaggaagaaaatcaggtgagtagcatccagggaggtgtggatcacagaagctaagggcagaaaatatttcaatgaacaaggaacagaaaacaatgcctgaaacttctaaaagggcaagcaagcaagataattgtttaaaaaatttcgtttggatttattggtgatgtcggtcttgttggtgaagtttgttaaagccatttggtgggttgtggagtaaggtgaagaaatggaactggcaagtgtagacaagtatgcaatcttcgaaagaaatctggccataaggaaaggatagatggtggcacctggaaggggaaatagagtgcaaggagagtttctcttatgacagtggtgatatatatattttttgtttgtttgtttgttttttgagacggagtcttgctctttcgcccaggctggagtgcagtggcgctatctcggctcactgcaagctccgactcccgggttcatgccattctcctgcctcagcctcccgagtagctaagactacaggcgcccgccaccgcgcccggctaattttttgtatttttagtagagaagaggtttcaccgtgttagccaggatagtctcgatctcctgacctcgtgatctgcccacctcggcctcccaaagtgctgggattacaggcgtgagccaccgcgcccggcccacagtggtgatatttttaagggagagaaggactcggtaactgttactttctataaagaaacgggaagtagccagtagtagaaaggttggttaattgagaatgaattccttgcaaagtccaaaggaaaacacataacacaatttgagagattagctcaaaacaggggcacttctttcattttaacaagaagagaaaggcaaagcacagttacggatgtaagtagtctagtagataaagggaaacaaagttcaggctggctgactttcatcacctctaagacgctgaagtactgagactgtgcttctcagatgggaaggcataagcaaaaatggctgaggttatgtgcagaagagaaagtttgaaatagttttagataatagaaatggagaaaggaaaatactgcttccctttcgccaacaaaaggaaatttttttaagagttcttactatctgtagagctagccgtgagcatgtttattacagcttacatgacatcttagcaccagtctcatctgcagggccaagggaggggaccaatccatttggcttggtgatggaagcccgcactgctaggtaatcatttggtaagtttttggagggctagaaagatcagagacagagccaaacagttgatcacaatgagtcagttgcacctttcatatgaaaataatattaattttattgacttaatccgtgtactctttatcatttgataaacattatatatagtgaacaattattgatttgaatgcaaagcatttgtagatactaagttgttggacctaaaccaattttttaaaatcagaatttaatttatatttgttgggagtaaattaagttgctcaataattattcgtgtttcaagagtatttgctcatataatgaactacacttctcatttaggtcttcacagggatcttcacagcagaaatgtttctcaagataattgccatggatccatattattactttcaagaaggctggaatatttttgatggttttattgtgagccttagtttaatggaacttggtttggcaaatgtggaaggattgtcagttctccgatcattccggctggtaaattaactgggagtgttcataaaatgtactttgtaattaattagtcttcattctcatctagtaaaaatggcaagatttcccatcattataatattatttgaatacacttctaaaacaaattggattgccataccaccaaatggtagtttcttcttcatcatagctttaataaagttcacttaaatgaatagtctacacttctcttcttagttattgaatggaaggctaatagagaggaggaaacagggagtcacagataaactcgaatcacaattaaacaacaccatagtcaactctcagtaatctgaggtttgcataactgcgtacaaagcttccttgggacctaggatgagctcccctttctgccaggaactaaagaattatggaattgttcattgctcaccttgtccccgtagaggaaagagttaagacaggggatagtgtacaaaggagaaggataagcaaacagagctccccatatgactgctgccacatcagaaaatcaccaaatcactctttgaaagagttaactgtactatattttgttaattttaaagaaagtatctttctttgatcttttataaaaactattagatcttaaaattcagagataaaatatcacttgacacatttccagtgaaagtttgatatgttttgttatactattactttgagttggctctaagttagtgatttattttcaaataacagaggctgtacacggttactaaggacacgttcctatagatgatttaccttagtagtgattaggctgaagactttttcatgaaatctgtttacaatttccctttctgctttcaatgttcaaatttgagttgtaatccttagaactatatttccttccctaatcctcaaagatagttatgaatctaatttgaatctagaaggatgcaaaaaacagaacaaaaatttaaaatgataaaacaagtaatatgggcaagaacttaaaaaaatatatttagtaaaccttcatgatagtgtgatgcagttaagggaaataggaagcatagtatcactagaatcttacttagtgtgtcaggctcttttgcataaattattctctggaataaattaaatactttggtgcatgtatttactcctttgggtcactttgatgccattaaataatgcactactttcagcctgacatttactgaagcatcagaaataaaatgctgctgctctttaaccataaatggtacttcagtgaactctaaagctaatacaaccaatatgtcaaacacaatgagaaagacatttacacactacactgaattaagtctatgaagatataaaggttaaaaagaagcctagcgttttacttaagtttttttgtatttgaatataatatatgtttaaaatatagcctaaagttacagcaagctaaagatatagctagattaaaacaatctaaagacaaagaaattagttcatttctgcttccactttatgtaatttaagtgttgatattattctcacctgtgcatttcagcatatttaaagtacactgaaaactatatctgctttggccttttaaaaataatgagagttcctacttctctgaaactggatctctgctaattaaccaccattaatctgaaatatcttaattccttaaggagaaacaaaagtgtatattacatatgcttatgtaggatacttgaaaatttggtgtatcttattaaactgccaatttaaaaactgtataatttaattatttcatttacagtatggaccatttcaaaatgaaaaaaagaatgctctatggtagcaagtcactgctatatttgttagtgatcatttgacaaataaataattcatcattctataattgagacagttacctgtacatttgccctgttaataaaattacagatttttcccttcctgtgtccatgtgactaacctgcacattgtgcacatgtaccctaaaacttaaagtataataataataaaataaaataaaaataaaaaataaaaaaataaaaataaaataaaattgcagatttttttagaaatgcagagcattaacactgttcttgcttttatttccagctccgagttttcaagttggcaaaatcttggccaactctaaatatgctaattaagatcattggcaattctgtgggggctctaggaaacctcaccttggtattggccatcatcgtcttcatttttgctgtggtcggcatgcagctctttggtaagagctacaaagaatgtgtctgcaagatttccaatgattgtgaactcccacgctggcacatgcatgactttttccactccttcctgatcgtgttccgcgtgctgtgtggagagtggatagagaccatgtgggactgtatggaggtcgctggccaaaccatgtgccttactgtcttcatgatggtcatggtgattggaaatctagtggtatgtagcaaaaacattttcctcattttcattaaaagataatgtaatcattaaaaagtgtgttcaactgaagaatattttgtattttttaaatcaaggccacttcctattgtctattactcatgactgtaagagccatgtatagtttagaccattgtaatccacacaaacccttaaactaccttttgaaccaaagttattctttctttcattatccttcttgctacaaggagagaaacttttctgttatttatctttcagttcttgtactagagcatggaagtgttacttagaacactcattttatttataagtactagcaataacacctgaaaacgtttcagatttggttttctacaaatttaaaaactagcaacaatctcagtttattaagagctcatggggttttcggtgcctagaaactatggtatgagcaagtaacattgtctctaaaaacattaattgtcatttctgcataaaattaaccacccctaacaccatatatatttaggatagttagctcttcttgttgcattgatcccttttaccattatgtagtgtctttctttgtctttttttaatctttgttggtttaaagtctgttttatcaaagactaggattgcaaaccctgctttttttttttctttccatttgcttggtaaatattcctccatccgttttttttgtgcctatgtgtgtctttgcatgtgagatgggtcacagcacaccgatgggtcttgactctatccaatttgccagtctgtgtcttttaattggggcatttagcccatttacatttaaggttaatattgttatgtgtgaatttgaccctgtcattatgatgctagctggctattttgctcattagctgctgcggttttttcataatgttgatggtcttaacaatttggtatgtttttgcagtggctggtactggtttttccttgccatatttagtgcttccttcaggagctcttgtaagtcaggcctggtggtggcaaaatctcttggcatttgcttgtctgtaaatgattttatttctcctttgcttatgaagcttagtttggctggatatgaaattctgggttgaaaattcttttctttaataatgtttaatattggctcccactctcttctggcttgtagggtttctgccgagagatctgctgttagtctggtgggcttccctttgtgggtaacccgacctttctctctggctgccattaacattttttccttcatttctaccttggtgtatctgacaattatgtgtcttggggttgcttttctcaaggagcttctttgtggtgttctctgtatttcctgaatttgaatgttggcctgtcttgctaggttggggaagttctcctggttatcctgaagagtgttttccaacttggttccattctcccagtcactttcaggtacaccaatcaaacttagggttggtcttttcacatagtcccatgtttcttggagactttgttcgttccttttcattcttttttctctaatcttatcttcatgctttacaaatttaactcaacatggattaaagacttaaatgtaagacctaaaaccataaaaaccttagaagaaaacctaggcaataccattcaggacattggcatgggcaaagacttcatgactgaaacaccaaaagcaatggtaacaaaagccaaaattgacaaatgggatctaattaaactaaagagcttctgcacagcaaaagaaactatcatcagagtgaacaggcaacctacagaatgggagaaaatttttgcaatctatccatctaatatccagaatctacaaaaaacttaaacaaatttacaagaaaaacacaaccctatcaaaaagtgggtgaaggatatgaacagacacttctcaaaagaagacatttatgtggccaacaaacatatgaataaaagctcatcatcactggtcattagagaaatgcaaatcaaaaccacaatgagataccacttcacgccagttagaatggcgatcattaaaaagtcaggaaaccacagatgctggagaggatgtggagaaataggaatgcttttacattgttggtgggagtgtaaactagttcaaccattgtggaaaacagtgtggcaattcctcaaggatctagaaccagaaataccatttgacccaggaatcccataactgggtatatacccaaagggttataaatcattctgctataaagatgcatgcacacgtatgcttattgcagcactattcataatagcaaagatttggaaccaacccaaatgcccatcaatgatagactggataaagaaaatgtggcacatatacaccatgaaatactatgcagccataaaaaagagtgagttcatgtcctttgcagggacatggatgaagctggaaaccattattctcggcaaactaacacaggaacagaaaaccaaacactatatgttctcactcataagtgggagttgaacaatgagaacacatggacacagggaggggaacatcacacactgaggcctgtcgaggggtggggggctaggggagggagagcattaggagaaataactaatgtagattacgggttaatggatgcagcaaaccaccatggcaagtgtatatgtatgtaacaaatctgcatgttctacacatgtatcccaaaacttagagtataataataatttaaaaaaattaaccatacccaacactagtgtcctgaatcttgaaggcatggagaagttgggaaggcatgggaagataaatataacaaagtgatataacatgtactcaaatagaattaaaaataggaagtaactaatatgtgtccaaaaatatgaaaacaaagtgccatgtgtcaagtttacaaaatgtaaaccttgctttacaataggaaggttgatcagggaagtctttgtcaaagagtttggacctaaaatatatttaactgagatgtaagatttagcttggtaggaagaaagaccatcccaaacaaggaaacaaggtacccagtgactgagggatacaggacagtagactctgtgagaagtatcaggctcttatgctttaaatatgaagtaattacaccgagttgcttaattagaacccaaaccaatggaatagaaaaatgactaccataacaagtaatttaatgtatatactcttgccaggctcagtggctcacgcctgtaatcgcagcattttgggagactgaagtgggcgtttcacttgaggacagtagttcgcgaccagcctagtcaacatggcaaaaccccatctctactagaaatacaaaaattagccaggcgtgatgatgcacacctgtaatcccagctacttgggaagctgaggcacgagaattgcttgagcctgggaggcagaggtggcagtgacccgagattgtgccattgcattccagcctgggtgaaagagcgagactctgttgcaaaaaaaaaaaaaaaaaagcatatactctttagacatgatttcctctcatataaaggtaacctccaagtccccaaagatagagaaaggggaagggaaaaaggcaaagtattattttatttttattcattgccaaatttcagcctcttcaacattacttttgataattctgatctatttttaaagtaacaagaaacataaacagtgtacaatctagaattataaacagtggcttaaaacaataaacactgattacttcatagtttctgtgggtcaggatttggggaataagttagctgggtggttctggtttaggatcagtcatgaagttgctgtcgagatgttagctgaggttacagttatcttgactggggctggaggatcagcttctaagaaggctcaatctcatgattattggaaggaggtttcagttcctttttggcagttagttgaaggtctcagtttttctctgcaggaccttttccataggactgttgagtgtccttatgatatggcagctggcttcttccagggaaggtgatgtaagagagaaggcaaggagaaaatcctctttatgttctactcttgaaagtcactcttcaccacttctgccatattgtattcattagaagctagtcactaagaagagctcaagctactataatccccaagacaactttaaaatgtttgctttcagaaaagtataagatcacatagaacagaaagtgccatagggttacatagaacagaaacaaagaaaagataatataattatgttatagatttgatttcattttctctgtatgtatatttggtatatgttggaagaagaaaagaaaacgcagagaacagaatcctttatgacaacatgaatgatcagacagcaatggggaattaagaaatataagtttgggaccagattgggtagaatttaatttatgaaaaggctgactgtgcataataaaatgtattttcctttaggcaattcaaagctacagatgattttttatcaggaaagtgacagtgaaccagtgatatttttcagaaatatacgtagcaggagaatgcagaatagatttaaagaggatgaaactcagcccaccacatgttatctattagtttactgaaattaacatatctctctaatgtataaatgtgcagaaaattgaagttgaaaagagaatttcaggaaatatcaagtacttatggttgacatcagtattaatttagattgtgatgtatgcataaaaagatatagtttataaaataatcatttccatctactgggtgtaaatttaatttttgttcttttaagagagaaaaattaaaggttctcctttctttttgactatcagttaaaataacttctttgtcttgtgataacctgggtatgtttctggagtagctaaggtagtcatatatatcatgtttaccactattaaggaaatgtgcttatataacatttgcttaagactgaatgaacttgatatactcactccttactacaattcttccttcctattctcactggaaaaatgggaaaggtgtcccaaagacaaaatggcataacttccttttaacacacatgaactatcagatgtggctccacccaaatagatgtagtagtcacaatggatgggactgccagcctagtctacagacaagacagagctgggaccacaaactactgtttcccagaccaggatttttatgagccattcttagtttccagacacgatggcaagagacccttcattggttgaagataggtgctgcagaaaaagaatgtgactttctgaaaactgatagttctagaagcagagaagacaacttcctctctccctaagtgaaggtgaggcaatagcacacaggagggatgtgaaggttttggcttcctctcacaagttgggaatcaggatggagaaacaattaaaatatgtaatatgtttcaaccttgaattcaaaatggaaattatggtaacatttccattccaagaggctaatttgagacacaagaaagagttgatttcatttactgagctagcacatttgtgaaacaggattcaggatttcagtccctgagtgagcttgctgaactggtttctttcttttttttttttttttttttttgagacggagtctcgctctgtcgcccaggctggagtgcagtggcgggatctcgggctcactgcaagctccgcctcccgggttcacgccattctcctgcctcagcctcccaagtagctgagactacaggcgcccgccactacacccggccaattttttgtatttttagtagagacggggtttcaccgttttagcnnnnnnnnnnnnnnnnnnnntgtgccagctgttatgcgcatacccttcggtaacaaaggaagtccagaaaaagagaataacttgactcacacaaatatttctagggaaataaggtaaataaaaagatagtgttgtggaggataagttggataatagtaagtgataacagctaaactttctcaaaggttcactatgtgccaagaactgtgctgaaagccacatgaattctgtcactgaatcctttcaacaaccttgtaagctgggcactagaaaaacgattacatttattttatagatgaggaaactgaggctcagattggttatgctacttagtaggtaacagaaaatcgattcttacctagcactcgaattctaaaatatgtgctcctctatgtcaagtaatctatagaactaagataaacatgctgatgaaagttagtgtctagtgggtattaataaacacggtttcaaaactgtgtcaccacgggtagattggctgctttaaaaaaaataaaaacttcaatggatttatgagaaagaaaagtcatatgttccagggatatttatttattttcctgacagtggaatagcattgaattgagttatcaattcataaaagatcagagaaacaattcgaaaattaatagtaaaccctattatactgactaaatatggtagcagttcaaagaaaggaagtatcggtaagagtaaacatggaatactgtttcctcacttattctgcaaacatcacaattaggagaaaagaccttgtagttagactttcaaaaaaaaaaagcttctctacttattaactgtggtcttggacaagtcatgtaagttgtgtagaagcattttcatctgtaaaatagtaataattcctgccttatagagttgtgagaaataaatcacataaaccttgaaaatgctttgcacaataactggtatttactaagagctcaactaaaaagctggttttacttttattgttattatgatctggtattgatactgctctaggacttggctctaaggcatgtttctgaccaaaagatctcccaatctatcagtaaagctgtgcttgttttttttttttttttaaagaatccaatataatgtgatagggatgtggatgagaaatttaacaggacagaatgagaaatgggagcaggctatataaatgtcacagtaaatgacatttgtaaatagagtatttgtccagtacagaggcaatataattggctcccgccctggggaaggattgatggatgtgtatcaagaaaaatttccaaatagacaaatgacagaactttaatatactttaggaaaataagtctaggaaatagcaccaaaatagataaaataaaaattttacatgcaattttttcttcctttgtctgtttttttaatccaaataataagttcaaaagcaaattacaataaaacataattttattggtaaattccagaggcaaaggagcaggtctggtcttaatgtgattatcaggagtcatagtatagagactgacagattgtcagtacactctcaaaatcaaacgtggtcttcattggatcttacatatttttactttaaaaaaaatcaccattggttagactaacttacaactaattagacaaaggtgctgtaagcctcattagcatgatagaagcatgagaatatagcaagaatgtagaatcctttttattgaagttttacttaaaaattttcctaagattctacttttgtactacagtttgagcatccctaatctgaaaatttgaaatccaaaatgctcggaagttcaaagcttttgagcaccaacctgatactacaagaggaaaattcacatctggcctcctgtaatgaatcgcagttaaaccacagtcaaaatgttgtttcctgaactaaattattaaaaatattgtataatattaccttcaggctatgtgtatgtgtatgaaacttaaatgaattttatgtttacacatgtgtctcattctcaagacttgtcattatgtacatgcaaatattttaaaatctaaaatccaaaacacttctggccccaagcatttcaaataagggatatgcaacttgtatttactttgtgcatttgcccccctttactgctatatctttcttttgttctgtatgttatgtgtgcttaaataatcaggaattcattgatattgtcaatcaaatcctgaaaaaaaattatatgactcagtcttgtacccctgagaatgtctgatttcttcgtaagttgtctttttttttttttccacaatagtgagtttaatgtcatgaatcttttcactcattcatactggtggagcctatttttaaagacccaatttgcagactgattactgtccttattcatggcaatacttcaactccacaatctttaattcaacaataacatcataattattgtataataaccattttatagtatttctcactattgtataattatagtagccataattgtcttaataaaaattgggacttttcatccagcaataaatacgtttttgtctgatttgtccagttatctaggtacaaaaaatggtacaaaggcacaaaaataaaatcatatttaaatatattgggataattgttgattttaggaataaattatcagtgtttccggaaatccaaattacatagtcaaaatagcatctgtattaggccattcttgcattgttacagataaatacctgagactgggtaatttataaagaaaagagatttaattagctcatggttctgcagtgagcttggtgctggcatctgcttggcttctggtgaagtctcaaagagctttcaatcatggcagaaggcaaagtggagcaagcatttcacatgatgaaagcaggaacaagcaagagagaatgtgggcaggaggcactacaaacttttaaataacaacatctcatgagaactcactaacatgaggacagcaccaaggcatgagggatctgaccccatcatccaaacacctaccaccaggccccacgtctagtgctggggattacaattccacatgagacttgggagggggcaaatgtccaaaatatatcagcatcccaaataaaagggttttttttgtacagttgtctatatttatcttttggaactgagcttaatagaaatgtttcatttagcaatgatttcagtattttctgcaatgactaaaaagcaaatagtgataatagtattattttatattgaccaagcatttttatttcattcactttttttcagaatagtgtatcatgaattagcagaaatgcatgttagaataaaataaggtgtcaagaacaatcttagaaaactaatgatggaaagcaattgaagcaatagaatgttttgatcacctgtttttcctgctgtgtttcaggttctgaacctcttcttggccttgcttttgagttccttcagttctgacaatcttgctgccactgatgatgataacgaaatgaataatctccagattgctgtgggaaggatgcagaaaggaatcgattttgttaaaagaaaaatacgtgaatttattcagaaagcctttgttaggaagcagaaagctttagatgaaattaaaccgcttgaagatctaaataataaaaaagacagctgtatttccaaccataccaccatagaaataggcaaagacctcaattatctcaaagacggaaatggaactactagtggcataggcagcagtgtagaaaaatatgtcgtggatgaaagtgattacatgtcatttataaacaaccctagcctcactgtgacagtaccaattgctgttggagaatctgactttgaaaatttaaatactgaagaattcagcagcgagtcagatatggaggaaagcaaagaggtaaaaatgtttaaataaggagatattttggtgttatataattctgttgtttaaaattatcaggtgtttttaaattgcgtgtttccttcctgttaagaaaatagaaaatatctgtctagcaatatattttccatggaaaagttggtaataaataaattaatgatagattaaaatatagctagattaacaatatgctgacttatgtttccaatactgacattttgaattcttgatagtattcttgatatgaattttttcagtatttataaataattttaaatttctcaaaatgcctcaatttctccactttcttccttgtaatttgcccacaacagtgttttttgtacgtactggaaaaatatctgatgagagggtagttgcaattctcatcttgctatgttcttagttcttaattcttacgaaatacgtcataaaatagtattgtattttgtttgcacagacatatttactcaaggaagatctgattgggatcttggcttgatatttatgtatagtttatctttcctgaagtcagtcagtttttttgaagagaaggtattgatgaggaatcacactaaaaacatatttaaccctactgagctcagtgttcactgtttaaagaaacaaaaatccttaatacattatagaatgtaaaattctgaatttaccaactcagtaagtcctggtaacttaatgtattctttgatttacaagaagggtatgagcaacagaatatattttttgttttgtttgctattaacctgttgctcaataagtacagagttggaggtaaagagaggaatttaaaaccttgatatttaattgtttatacaaaaatgaagacaagatttccagtaattaaagtttgcactaactaacaaaaataacaaggaaaaacaaagattcgttccttcctcatacgaactgtttggcgaggaagataaaagcttctattcctgatgtcgggaaagaaagaatgacgacatgggggagtgtgggcactgaaaggtaaaatttaagtagcacaacatgatcatgataattaacaatcagccaaaattatgagggaaaatatagttataaaaaaagaacaaagatgggtggatcacgaggtcaggagttcgagaccagcgtggccaacatggtgaaaccctgtctctactagagattcaaaaaaattagccaggcgtggtggtgcgtgcctgtaatcccagctactcgggaggctgaggcaagagaatcgcttgaacccaggaggcagagattgcagtgagccgagatcaccccattgcactccagcctgggcaacaggatgaaactctgtctcaaaaaaaaaaaaaaagaactagctatttcagacactttttctgtatttatttgataaaattactaaagagtatgttattttccattttttcttgtttgtaagttacgtagtattgctgttagtgattaggtagaagtagatgtttaatgggaaattcagacaatctttgaatataggaaggtataaataacagggacataggtatcagtttcacaagaaataactgatgagattcaagggaaaagtaataaaaccttctgtcctggggcaaagaattactttaattggttgaacttaaatttttactaactagattattgtttgaaagttgaataatatcttaaaatcttattaacaaaattttgaacaagtgttgttacaatagttgggttatgctggaagggtggagtggcccaatttcatatacagtgtactgctcttatagaagctgaagtcggcatttataaaatagaattcggtcatttgaattttgatgtatattcccctctcattattttgaaattatgcctaatggtgaatatttccctaatagtaaaaaaagtcaatttttattttcacacatgtttagttttaggctgtcatataaactaagaatgaattatacagtatcaaacgttgaagccattggctagtttaatcttttagctaagtttcagtatcttttgaggaatgtttaacttgacatccagtcttcttaactttaagagattttacagccgtgggttttccaaaagagcgtgtattttgccttaacttaagccattatggctgaagtaagagggaagtccagtgatgtggggtttagagtagggacatctcttgtttctcttgttatcattaagctttttgatttgttttcccattaagttagctctgagttaaatactctaaaataatatttgtgaattcagtatttcagaattggaggaagagaactgacctgccaggtggaagcagacaggattattttattgcttgagttgtggagtccttccaataccttcccagcatagagactgttacttcagtgttaacattatttggaggggtttttaattctggctttatatcaaactttctagacataaatttataaaataataaatgatgagggttatcgccgtgaaagaggttatgtgtaggttttgatctttcagaattttacctggtagctctacactaaaaaactagagaattaaaacaattattgaagaatttcagacactcgcatttgaaatagcatttcttgcctgccttctagtcatttttgtctggtcatttttctaactgggggacaggattacattgttaaatatcacaaagtagtaagaaacatcatgaggcttattaccaatcctttctaaattaattttttaattaaagaaaaaatgaggcttttttactggaatgtctaaatgaatttttttataaggcagactgagtggactcagaggttttttaggtgttcacagtaagtcctctgcaatgtctttgctaaatttgtatgattcttcagtagttttctgtagattctctagagtaggccatttaaaatcatgtcataatcccctatgctttaattttaatgttatttcgattatattaatgtaattccttttgtgattttgaatgattgttttttcttttagagtatttaataatgtggaagccatgcttgaatgactatttttcgaagtgaaatttagtagtgcgatatggtgaccttcaccgcttaccattcttacttctcacaggagtaaaatcaagctggagccatcaagaatgcagctctggtgttttttaaccagccagaggctcgtgccaccacttttacccaggttacccaagcaagttgtacatctataaatataatcagtttctaaatgacttttgactggcctgcatgttactcagctacgttccttgcccttccattggcagtaaaataaaaacatgcacagctgctattatgctgagtcatacaaagcatggtcaggcaagtctgacaaccctaacttaaaaaaaagtgatttagctgctaattttcttacatagattttaatagaaattttattcaatgaaaagtaaaagtgcatgcctttatggattatttaatttccttttaatgttacagagttttgaacatattaggagcccaaaggagaaatgtaggtgctctttgaaaacttgcaaaaatgctttttatcctctgtctttaaaaaaaagatagcccagttactgtacttaagtcttgacagttttttatttagtgtaatgtttttctgaagggtaatcttcaaattaaagcaatcccttattcatatgcaaacttcccaaaggatgttttaatgtgataataatgtaaatgaataggaatgtctgtgtttcagttgctagcagcatgggtataatatttatctgcttcattttagggaaaatggcactgctttatttaggagttgaccaacagtattttgtatttagaatataatttctttggaaagtctgtttatatttacccttaaaactcttagactgaaagaaaaggaaatcatgtcttttgtataccaaataataataataatagtgataatgagagacttatagatggtatgctccttctaaaaatagatttagagtccatcttcttcattttcttggctcctctgtgctttctctcccctctattttattgagacctgctggaaaactttctcccgaagaatattatttaaatttatcatgatccacaaactcctgtataggaaaagaatcagaaactcttgctcctagggtgtttttaaaatgaagagacttccctatcatgtgacaatagcaataaacgtaacatcattctatgggatccattagtcgaccttcatttcttaatgttgaaatcacagttttatgcacaaatatttaaccaaaatgcctaaacccaatttaatcatttttaagaaatgttaattattttgtcacttagatacagtttcctctccttttgccaataaaactataaaacagcactaatataaaagtgtagttggctatttggaagaagcaataatcatgccattcctggagcattcttttatactttggaacaaaatattccatcactggctctccagattcatgagctataatgcctcatatattggaggaatgggatgtaaaatgggatccaagatgcgtaattgtttacagttaaacacagatgcgcatatacacagggactacagataattactttttcctattatgtattaattcttcagaaaagcatgagatttaggcactttcggataatagcttgtttctcggaaagaggcaagggtagtttccttattctctgagtatcccattttgccaatttcctgtttagaaagatacttgaggcatattatccatcaacgtatctaggggattcagctggagtaaaggtggtagaatagaagctaagaaggaactggttcgtttattttcaatcctcacattatggcaatttttgatttccttgtaaaagtctatgattctccctcaggaaacattgtccacttcctaaaaaaatatactaatttctaatacaggggtttggaaaggggacaaaaatgtgcagggaaggtttgcgtaagcaatggtggaatgggttcaacagacacctgtctatgactttatcctggagaatgtgtagtcctcatgggaaagttttccagtgggatagtgattaagatggaaaaaaatgcccaaaatatctttaatataagaacaaaatgggccaaacacgtgtctttgggtcactggtaatctactgagcagtaggacatcatgacataagagttccttttgccatccgaagaaaaatatttaaaatcctattatttgtggttttaaaaatgttataatgtattcattataaacactaaaatgactttctggataatatagtatactgtgagtaattattttgattttaccatattcttttttagttctcagaaaccaaaattgtcagatatgggatacttgatttaatctgtatttgaagttttctcttttttaagtgccaattttttaattaaattaaattaaaatctctctctcttttcccaaattatatacaatatctactaattatgttttcttcgaaatgtatcttagcttcataatgagaagtgagtgtgcccatgaaaaatttaataggaagttatgttttctcttccattttctgttgtgattcattatttttgaaaataatttactttcatttgctcacatttgctgtctaaagaaaaactattcatctggcacattcatatttagtagtattattaaagcagaaagcataagttggaagtataatatctaaaaatacaaaatgaagtattgtaccttgatgtttattagatcattaagcaaaatatgattctgccctgcttaaatcatttgattataattatccagcatataaaagaatcacagtagattttcaataggaagagtcctataatattaggtatccaccaaaaacattgttcaagtaatatttccacctgaaagtaaatgattgccaatgctttttttcagagcatataaaattggctattcctatttgatctcgttattgtcctggcatccttattttgttaaattttaactaggcaagggctatgctacaaacatcagttagtccgctagtttcctgataaataagtacaggtaattaaaaagtgaacctaaatatccaaattataccaaagggacatatatagaactttttaaactggatctgcttctagccagttcatattttggtcacttactaatgtagtatttcaccataaattatgcctagattggagcatttacaggcactctttatctgaaaattcttaagtgcatgagttgtaacagtttcacatagtgatcatctcactgttctaattggtgactatgtactacagttaggttgatcgtaattatgaccttaaatgaagctgaatatttttatattcctaatttgattaattttattttatgggcttttacacattttaactgctttagtcaacatattttataatattatgacatttgcctagaatgtaattttaagaaagtcatttaattgatgttatcaagaagggttttataaatcagaatttcctgcctatgtttcaagatcattgcttaaagaaaactttttgttcatgtaatattccaatgtgtatttagctttactctacattaaaatatgttaacaactatgaatataacttgaattaatactaaagttcatggttttgaaacatggaaatcaacaatatcataagcactatcttgaacctacaatatttgattacatatctagtctactaaatgttttaaattgataaacattgggtttacttttgaatcatcaaaaagattctttagagaagcttggcagaatggggtgcagaagatctggaatccaaccactgattcgctataacttttcacaagacgataaaactcacatttccttctctaaataaatactggattggctgacattaaggatcaatgtgctgcttagattctttgttatttgtaaatcaagtaccacaagtggaaaagtattcaagtaacacatgtgacagatcctgtgctgctccgcttcagaagacagtggggaaggataagattgcattccttaaagaggccccattcatcactggagctatagatccttgtatacagagtgaaaagagggaaaacactgtcaaaatgatttagtaatagttttcctgactccacagttaaactacagttcacctcatacactcacattaggtccgaataattggcagactggttttaagacaatactcctagttctaagagttgttcgtcattgcccacacaattcagaatcttaaaagatttgtgttactctgcaattaagagaaaatattgtgtgtattcttttgaatgtgaaagtaaatatcagataggaagtgttagtagttagtggttggataaaagagtcctcgcactggtcattcattcatttacccaaaatttattaaacacaaacattggtgctagagatacaagggtgacgaaaacatgatctttcctccaaaaaattaagtctgatgagatgcattttctagaaacacaaaatacttttgaactgaaccttggaaaaagtaaaaacttgacctttcaatagataaatatttggctttaggaaaaaggtatcttaattctacatcagaactaaggtagtgcactaaaatgaaagggagcaatgttaattcttctacttttaatgtgatttaaataagagaaaatacaggaatgtcttttataatttgaaattccagagaaaatgaataaaaaagcaattaaaaaaaacacctcaacatgcttctcattttcagccaagtacagcaaactctgtttgatattctctgattttaaccttggatcaaactatttggcaaattgctaatttgaacaggctattgaaaacagacagtgtatctagcaattcattcattcattcaatacttaatgaacagcattttggcaattcaaagcctgttccttgtattgaactatattggtgtattatccatatggcctagagtacatgtgtattattcatattatccatattggtgtattatccatagggcctagagtacgtggcttctgcccccaaatgtcttacaagcatgttaaagtacccaaaatccatccaactgaaataatttgacccatacattatcaaggttcaagatgtgtgataagccatgaaaaggttggtgaatagcctagggtgcatatggtgagtgaagatggatggaagaaattaggagtccagatttattggggagactttatgaaagcaaggaatcatgattgttgcaaaatagacagtgaagaaagaaatggtgtggtggtgaaagtcttcccaaagtcatttaaagtattggcaacccagatacttggcagtaggagtgataattgatgttacaggaatcctatgtaaacttttgcacattttaatgaagattttctataatatgctgtctggtgacttctcccaatcactgtcaagggctagacttcattattttaagatgtctttcattcatttattcactcactcattcttttttttaagcaaaatttattaagacctgtaacatacttagcactgatgtaagctctgatacagtcattcagtaatgtcagcctgagcatttgcagaaccctgaatatggatcctcatttttcccttggggtcacccgaagtcttaccccgttctgtgtttacagtgtgaaccttattcttataaggaatattttttgtttcttattgtggattgtctgtacttccatcagatgtgactcagcttcagtttttctgattacctgtgttattttccaacatgttgcaagtgataagatcagtattatcaggtccctaatagcataacaggttcgtgtgaattagatatattaaaatgagagatttttaagtcattttttagtcaattacgtgtatagaaacatagttatacttatctcagaaagattccaattcaaaggataggaaattagaaaaacatgtaatgtttcttctgagaacaaatatattcaaattttaatgacaaagatattaggattatttttctagtaatttgatatacctgataaattaaaataagaaatcatcaaccttcaagcaccttataatatataatctttgatttaacttttttggacaaattaaaaaataattctctaactcaaagcaggcagaagtatctaatatttatgcttccatcattagtatttttaaagtacaagagacaaaagcatttttaatctcatgtatatcatacatcaatattttttaagtcatcagcatcactatgctaaggaaatattttatataaagaaaattattttcataaaataaagaaaccatctttctagagaaaatccacataatcctatgcccaaatataaatataacatttacagtactgactacagcatccatcttattctagtttaacatacttcagtgtgcattttatcatgtgcttacctcatcctttttataaagtatctcttatcagctcaaccatttcctaatgttatgcactaatggtaataacattgtaacaggtccgagaatgctgtggcccaaactactctgattcctgtgtggcactcacacctggccctgcatcatttctagagcattttaagaccaggttaaagactgggatcccttcatgtatgctgatcccaagaatggaccgacctggctaaagtttattgcatttcaagatataaaacaacttctattatatttttcttttggtgatatttgatttaacctaaaggaaaacaaaagaacaactaaatattcatttctgcctgtactaacagggcaggtaagagtgccagagtaacaagtagtttccaaatgcacaatgaaacacaggagtgcattggccaaagagaatgcaaaatatcagctcttgctatatagctaacaatgtgctgctctttttggaattagaaaattatagaatatatttaataacaatctggtatatgttttcatgtcaatgaaaagtggataaatttagatggttgctgtttatgtgcatttgatcaaatcttttctgaatttgacatgaaaatacacttgtgcagctttcattggttgggtcacaattttagaataaaacaaactatttgaaaaccatttgcaaactaatgtacaaaagcaagatcgcagatgattatatgactctggcagcttacataagctttctgcaggattttctttcagaatctctatacataggctcaaacagaagttatttccgttgttagcaccatattttaaagaaaaaaaatactatggtgttgtatctaatcttgtgacccctgacctttaccaaagcggattggcattatgtttaagttcttaaattacagatcaagaaaatgcatacagaagatgggggggggcacacctaattaatttttatatttagattaaagaaaataattaaatgtgtttttttgtgggattgattttcagaagctaaatgcaactagttcatctgaaggcagcacggttgatattggagctcccgccgagggagaacagcctgaggttgaacctgaggaatcccttgaacctgaagcctgttttacagaaggtaagcaaaacaataacatatgtggtcttgagtatcctcttttctacccattttttcctatttatttaaatgtctgtttatttgtctaccatctattatctatctatctgtatctatctatctatctatctatctagtaatcatctatacctatccaacaactgtacatttatttgtttttttttgcatttgctgtttgaaaaaaaatgcaactttttaaaaggcaaagtttaatttatgtaattagatattttcatttttatgaatcatttttaactctaagaaattattaactggcttttctgtggccttctaaaatatcttacaggagagaaagccaaatcacacacatctctctttagtttaaaaattcaataaataagaaagtgagagaagtaatttattatgtactattttgtgatattataatgggtaataattgataagtgtacatttaaatttgtccttgactgaaacagctcctatttcagtcaaggtcaaatattttttattatttctgaaaaaagatagatcataaaaatgccaaaatatactatgagtcatatgatatggggcaatatgtcactggagtaatcgcaaaaggattttctgaagaaagctaaaattatgtaatttgaggtatggatcagttatatattgtaatagcaatgctgtgtatcaaaccaccaaaaaccctgggctctaagctgcttttctagttttgactcctatttccttctgtgtaactcacagactttcttgtcactaagttttacttgtatcattgtttctctattcttacagcttcattttctacatatgtctcttatatatccttcaagatctagtctcaaatccatttcctccataaagctcagaaattaaagtttaccagaaaactctcataatactttgttttgtgataattgttgctttccataactatagaattgtagacaaattgccccaacttaaaatgtacattctttgaggacaaggctatgttttacatgttatagtattacaatttgttctatgcaattttttgacaatagtagatactcaataagtatttgttgaagagcctttgatctagcaatccagaaattatacaaaggtgtttattggattgttattgataatggccagatttaaagcaaacgaagtattcaataatggtggaattgggctgggcacagtggctcacacctgtaatcccagcactttgggaggccgaggcaggcggatcacttgaggtcaggagttcaagaccagccaggcaaacatggtaagaccccatctctaccgggcgtagtggtatgtgcctgtaataccagctacttgggaggctgaggcaggagaatcgcttgaacctgggagacagaggctgcagtgcatgagccgaggtcaggccactgcactccagcccggacaatagagtgagactccctctcaaaaaaaaaaaaaaaaaaggtggaatagttatattaattatagtaatcatatttagagaaatattatgaaatctttcacaaatttatttacttataataaagatgggaaatagttataccattaagtgaactaatcagaattcaaatatgtaaagtgtccatatagagtggaattacactcataggataaggacaggatggaaataccaacttttggtaagtttattttctttttggttcttctattttttatatattgtgtttttgtaatgtaatccattatagtagtgctataaacataaaaataaatatttattaaacaaatgattaaaaagccatatagatgattttaagatagcttttgtaagcggaagctatcttaaaaattaatgttatttacaatgtattatcaggtaataatgtaaatgaatctcccaccaacacaaatatacctaatcaaagagtaattttttgtcttcatttttttcccacatattttagactgtgtacggaagttcaagtgttgtcagataagcatagaagaaggcaaagggaaactctggtggaatttgaggaaaacatgctataagatagtggagcacaattggttcgaaaccttcattgtcttcatgattctgctgagcagtggggctctggtaggtgatgcatgatccactccttcacctttcatctgaaatcttttccctttcccttcaatcaactcatattacccacttttaaattaaggtgtttgtaagaatgagaagaaatatgtgtgacgtgtttagcacatatgagaggcttagtaaatagcaatttttgtcactctgtctggagtagccctcgggtggaaccaaactcagatcattatggtttcttataatgtttaaagaaggatctttctgactttcagtcatcagaggcagttcttattaagactggttatgtagacatgatgtaggattatcagctaaatatcagactgaagcacgatatttccctgacccctttgcaggtgagaactagagtgcatgggtgccggtaggagcgaactccactcactcactgctccacccctcacaggagggggagcgcaggtgactgggtgcaggagccaaggcaaatgcatttgggcactgcaagagtgaactccataccggccccacaggagcgtctaggggagggtgcctgcgatccttgaagccctagaggaagtgttacagtgcccttttagctttgccatccatggatggcttaaatgttaacagttcagtggagggtcagagtgacagccttttgcacccacacttgtggtacccaagttcatgtccggcgtccaggaggaatgagtttgtacaaatgacttgaagatggtaaatacaggggattttattgccagcgaaagtggctctcagagggaagaggagctgaaaggagatggagcaggaaggtaatcttcccctggagtctggccatccccagccagactcctctccgaagctatgctgtcaagctgtccctctgatgtcaagctacttctctctaatgtccaactgtagtctctgatgtccagctgttcctcctgtctgcctgctgagttctgggctttatataggcacaggatgggggcagggtgcaccatgggtggttttggaaaaggcaacatttaagtgagaaaacagggatgtatattctcactttgggccacggttccaggcttgagggtgaagccctcgccaggtacccgtcctcttctgcccagaatttctctgcctcttgttcctgtcaaaattgcttaacataaactccatgctgcaggggactcctctgtcttcttcacactgattcgctattgccaaccacagtgaatgataagaagtagactcacttaattactgactagcaaaaaaatgatggcattacaaacttatgtctgatttcattcaatgaaatgatcaactggatcaaaatattaatataatgaaaatgatatgacctattttcttaattggtgatacaaatgtggttgcattccttttactgtttcaatttaattaataactagagtgtttggtgagttgatttcattaggagaattactgcattggatctggaggcctctaaggcgaattctgatttgactaagaatcctgtgtcctgccatatactcagtttaaagaggatcagccatgctttattttctttacctttattattattattattattttttagacagtcttgctgttgcccaggctggagtgcagtggtgtgatctcgactcactgcagcctccatctcttgggttcatgccattcttgtgccttaacctcgcaagtagctgggattacaggtgtgagctaccacacctggctaatttttgtacttttagtaatagagactgggttttgccatcttggccaggctggtctcgaactcctggcctcaagagatctgcccgtcttggcctcttaaagtgctggaacgacgggcgtgaaccaccgcaccttgccagacatgctttctaaagccaagtagagagagaactatgaagtctcattagtgactagtacctttgctgtaggagctctttgttctcagttacacccagtcagtgctcaccaaattgcacaacgtgctggcacagtggctggctcctcaggggtttacagcttcagctataagcaaagcccagaaacctttaggtccttgtatggagctctggttacaagccctgattcttgttatctaaaaaagaaaatgttcctttgtctttaatccaggctgtcaggttttcctgataatttttccgataagaagatcaagttagataaatagtcttttcattctggaagcctcaggagttcctgcaaatgagttacccactctttcccaagggctctggaaaattctgtcaaagggaatttccaaacgtacacccacccgcctccacacacacacagacacacagagagagggagagagacaagaaagtgagcaatgacaatcctttcctttttctgtaggctgagggacctccctgctttatatctgcattactagaggatgcattccattgagtctgcactgaatgagaccaatctactcccaggcgttccactgcctcctgatgtagagagaagcagctggcagtctctcaaaaattttaagctctttgggggtacactgagaccaaaatttaaaaattactgaaacccttggttgactgaaatgcccagtcagcagtcatttatgatcagataatgataaagtaaaattcagccatgggaaacattaaaccttccagccttaggcacctgataagagcttgcatcgtttccttttttaagaaatcatcaattagagactgtttctgatcataaaatttaatagaattttttgacttacaggcctttgaagatatatacattgagcagcgaaaaaccattaagaccatgttagaatatgctgacaaggttttcacttacatattcattctggaaatgctgctaaagtgggttgcatatggttttcaagtgtattttaccaatgcctggtgctggctagacttcctgattgttgatgtgagtatgctgcactttgctgctttattcattggcatatatgtaatagttctagcaatggtgcctgacacagtgtaggcactcagtaacactgtatcagcccaaatataaattatgtttctcatttcacagtgagaggatgcctcaaaacattttttaccaatttaaatacatatacattcatagataaaaatcaaatgccatcatactatacttattcacttaatttcaaattaatatttaaaatctcaagttatgcaaaataaaatatgaatttagaaattttgctttttgcacgctcacatttcgcaaaataacttgtatttaaatttttcacaggcatctttgacattagtatgtttgtcatcactaaagcctgttgagtttaggtcacacagatgaatcattaattacaaagaaatttgaaagtccaaaaagcaagagacaccacttgatttgtatgatatagaagcaaattggctattgaccaagtagccaaagattttattaaaccacattggtgttgaaataaaataagatagagtactaaaatatgagggtttttatataattgaatatgaggcaaatctaccattaaatgtactactactattaaatgtataaaggttacatgcagaattacattaacagtctctggcaataaaggaagacaataaataatatttagaactacataagtgtggacattacaaacaatagaaaatgcaccaaaactataaccattcttttatttgtataatgggattatgcatgatactatttcttttctctattttctgtatgtacttatcataggttggtaaatccataataaaaatatctgatacttgatatatctatgttaggataaaagtatcaagtcagcactgcttgaatataaggaaactcttcagagaaatctagttgtcctgcagctaatgatcatattacccaaagtactctgatatttacctttttagatttaagaaaactattatgatagtatatgaaactgatcaacactttgccttaaatcaaatatgcttattgctcatctatttcattatgaaagatacaaatataaataagtcatttttctagtcctgcagtagcttacagttgaaaagtgaggacagctgcgtacacagtaagtcgacacctgtattacaagtgccacctctttacttgaggaaggaggaaaggcttcaatagggaagtggagtgtgagctggagcttgagagatgtgaatgctagcaggcacagctgagggaggaacacggattcgttaaaacgttggtgcatgacatgcagggcgggttccagaaacaagtagatagggtgaggtaagcctttgtaatgggatgataaggtaagaaagataagttagaaaagatctgaagaacctgagatgccatccaaggaaatttggacttattatttaatacagaggaagctattgaagaattacatatagggaagtgacaagacctgcttgttcttttagtgagggaagttaggtggaggtgagaatgacggaatagaaaggagatttatttagagatcaaaacaccaattaggagattgctgcaatgtcccagaaagagaaggcctatatgtatcttcttttccacatttagctacacaagtcacataaaactgaatattttacaacttcttttcagccagtaaatactaccccattcaaaatattttcctctgtctaacttttatctttcatcctttaacttatgcttatctctttttggttctgtcttcagagaaggtaaagtactacaggtccttatatcttaaatacagaaaagcttcacaactcatgataattcagtaactatttttcaattatctgttaaaaagggacttacaaagcctaagagtttggattttaagggaactatatgaactatgtaagacataattttacaactcattgttttctgtattcaagaggcttcactttcaaattgcatgtgcaaaattattttgaataagttgttttttgtaacaactttcaatgtgcttcacttattttccttaaaaaatatatttttcaaatatattaacaccatactcttaaaagctgtattgcatatttatttttatttatctgcttttgaaattcaggtgtactttagaacaaaatagcttatataattttaataatttttctatatgttttcaaggaaattggacatgtgtatgtcccccgaccgtttttctttttctttttagctaagactttataatttttctcaactacattagtcaactgtatgaataactaaagacaacattgttcttgcaatttctaatttatcataaaatctcaactttttttattcactaattttgtctgacctaattaatgatattatgcccttcaaactgaaatttacaaaagtcaaagctgctttttagaggcctattcctttttaaatgtgttcatgctcatattcaccagtggtttgtatagtttacttgtgtatcaaatgttactttccatttcagatctgctcaatattattagaaatgatacagaaataagttttacagatctgtagaggaagatcacatttctctctcttttttttctttacttttaattttttaaaaacatttcctaccaagaatcttgaaaaagagcacatatatgggcttcttttttataagtgttcgcagattagtatcattaacttcaccctgggaacctgtagaaatgcaaattcttaggcctttccccaaacttactaagtcagactctgctattggtgtttttaacaagacccctgggtgattttgaaactcatgaaagttcgagaattactgattcattgcatagagcaaggctgaactgtgtagacatttttatatgtaaataagaaaattgtgttgctttttctgtataggtctcactggttagcttaactgcaaatgccttgggttactcagaacttggtgccatcaaatccctcagaacactaagagctctgaggccactgagagctttgtcccggtttgaaggaatgagggtaagactgaatgccttagagtttgtcagaattattattgagagcagactgacactttgtaccacggaaatgtcaaatttatggagaatttgtgtcttacacattcatactgacatagctaatcaatcaaaaataatatttaccagatgcccataatacttggcactgctggagtcactcacagagtagtatattgccagagggattgtttctgattagctagattttcacttcttggaaaatctctatagttatgctgctgatttgaatcaagattatttatgttcacttcatttataaatgtgcaggaaatcctactcgctgtagtttaagcctaccaaatcattgctcatcatttcttcactactccgctgtgatacactttgagccttttgatgtttgaatcaggccttttagttcttaaacacaggctgaaatggctaaaaagtaggtcaactggaaatctaacgctcatttagaagggtggtacaaaagaacagaggagtttgtgctgacatttgtcgtcccctgaggcacaaaacctgagaccacataccctcaccacctagaaaatgatgatgccttgtctcagttgttttagctggttcaaagaggattttaaaaaaatgatactttttgtgatatttgaaaataagttgcttagactttatctgcatgttatagtgatactagctcatattttctaactaagaaaatagttacttagactttatctagtgttacaatcacaactagagatgaatggtgtgtgtagatgtgtgtctgtatatgcatggttacatagaaaagtgttattagcggtaaaattctttttactttaccaattagaaagaacagtttttgcagtagaaggcttaataaacaaaaggtatcaatctttcagtaccagaatactgtttatattttctgtgtggaatttgatccccaagtggtctcttttactctcaaattttggacagcaaattgtatggtttgtatgattttttgaaagtgatgttcacttctatattcatgccactgtttatactcttaattatttttggcatttgctgttagttccatcctttgaggtaaatttgctacatgtgtgttattacctcttgagaaaacattctccaatataaaattcgttgtatactcttctgatttataattttaaaattcttagttggagctaccagagtctagtttctacccaatattcaactttgaaacagatttttttaatcatttgactgttcttttaataatgtttaaaaataagtaaatatttgttgttggcttttcacttatttttccttctcatcctgtgccaggttgttgtaaatgctcttttaggagccattccatctatcatgaatgtacttctggtttgtctgatcttttggctaatattcagtatcatgggagtgaatctctttgctggcaagttttaccattgtattaattacaccactggagagatgtttgatgtaagcgtggtcaacaactacagtgagtgcaaagctctcattgagagcaatcaaactgccaggtggaaaaatgtgaaagtaaactttgataacgtaggacttggatatctgtctctacttcaagtagtaagtaatcactttattattttccatgatgtgtaattaaaatgagtctaaagtttttcttcctcataatgagatatccacctgttagaatggctattatcaaacagataaatgacaataaatgctggcaagaatgtgaagaaaagggaacccttgtgcattgttggcagggatgtaaattagtatagcttttatggaaaacagtatggaggtttctcaaaaaactaaaaatagaaccactatgtgatccaacaattccattactgggtatatatacaaaggaaattaaatcaacatgtcaaagagatgtctgcactctcacactcactgcagcactattcacaatagccaaaatatggaaacaacctaattgtccatcaacagatatgtggataaagaaaagtgtgtgtgtgtgtgtgtgtgtgtacatatatgtatatgtatatatatacacacacgtatttctatatacacacgtatagatatacactgtatatgtatatatctatacacatatatagacatacacagaagcagtgtttgtgtatgtgtgcgtgtatatagaagtagtcagggaaggggcagagcctgtggcactaagaaactgagaaaatgtacaagacttttgttttcagaattactatgtccgcacaacagaaaaagtatttcaaaaagtaaatgcgcttgaatgtatttgttttcagtttaggaaactgcttctttttgtagagtgccttaaaatagtatgttcaacaatattaaaaagattttcaaaaataagccctcatgattgatgattggtaataatcatttaaaaacttattggatgtatatatatgtgtgtgtatacacgcacacacacacacacacacccctatagacatacacaatgaaatagtattcagcctttaaagaagaaggaaatcctgtccttttatacaacattgattcacctggaggaaattaagtgaaataagccaggcacagaaagacaaatgacacatgatgtcacttatatatggaatctaaaaaacacaaactcacagaaacagaaagcagaatgacaatcaccaggggctgggggatgatgggagatgttggtcaaaggatacaaaattcaattcgacaggaagaatacattctgtagagctattgtacagcatggtgactatagttaataataatatattatatacttgaaaatagctaagtgagtagatatgttttctcatcagaaaaaaataagtataagaagcgataattatatattacttagcttgagttagccatttcacaatatatatatatttgaaaacatcattttgtacaacataaatatattcatttttatttgtcaattaaaaaatgaatatatttttgaaaagcaattaaaataaaaatgcatatacattttaggaactctatatagatgcactaaaactatataaaaatgatataatactatacaacaataaaataaaatttttcttcctctgtgtttacaaatacttccttaggcccatctgcctagattcctcttaccatgattgaactatcttttctgccccacgctggaaacatgatggttctaaaaactttattgtctccctgactatgcatttggtagcatagccaagtcctttgttactgggagtttaatctaggcactcattgttttcctcccttcctactctgaggaaagaagtgctggccccaaggggggttgaaaaggggtgtgtgtgtgtgtgtgtatgtgtccacacgcgtgtgtgtagatagagaaagagagagagactttcaaataggaaaattgctctcttgcaaatgaaaactttccaattaagactattgtgtctgctatgcactcataataattcattcagctattcaactgactgcagtattaaatctccactagctcctggacacaatccacttacacgatcctcaagactattaaaatagtcaggaaaggggaagagcctgtggcactaaggaactgaaaaaatgtacaagagttttattttcaagatcattatgtcaacggagcagaaaacaaatatttaaaaaaggaaatgcagtagaatatattgttttcagattaggaaactgcttcctcttatagagtaatcacctcaaaatagtatgatcaacaatattaagaagattttcaagaataagctgtcatgattggtgattggtgtaataatcatttagaaaagaataagtagaaaggaagcattaagataaataatgcagcatacttttgagcttgtctcatgctgctactatacacatgaaattttttcatcaaagttcatgatatatttttatataaacacatcagagtcaaagattgttcatattgtttttatgatagcatattgttacagtagatcattatttaattatatatgctaaatatccacataagatgttatagaggaatataaatttgaagtattttcaatgcatatcgcaaaacattgccccaaaagtgaatacaaatttcaagcttatttatatgcctgtattgaatacatgtcaaatagaattttgatcaattattcaatttattttctaaaattataattttgggaaaaaagaaaatgatatgacttttcttacaggccacgtttaagggatggatggatattatgtatgcagctgttgattcacgaaatgtaagtctagttagagggaaattgtttagtttgattaaatgtatatttctacaatattgtaatttagtgatattgtcaataaaataaaattatgtgcttaatttataaaacccatctatattataaggataaaatatttaatcatactatttctttcaaaattatcataggatgattttctctaatcactctgtatcttttaacatatcttttctagtatttagcaaggcacctgacacaaaactttattgtatgtattttcaaaatgagacattttatttttggctctgatagtcctggtcatttgtgcattagaagttctcacaggcaatattttttatctgtaatatatttcctccagcttttgatcttccttataataggaaggatatgactaaaaacggggacaaaaataaacaatttagtgtttctcttgggaaagtgagattaagtggtagaagggagggacttccctaatctactttatacataccagtactttgaattcttttctataattttcattaatttctcactatttaatgaggaatgaagtcacattttgaaaaaaaaaaaaaagagattgatttctggtatgccagagcatgataataaagctcaaaatgctctttccctagcaccagcagctagctttctgagtgaagaattcctgaggtttttttttttcttttttccacttcataaaaacagagagggagcaagaaagcatgaaaagccctgcattgtatctctataagtgctatcaggaattccagttatgagatttttctgaatagtaataataatttattgattatcactattcactgtgccaaggactttctcacattatcccatttaatcctaaatgacaaccttattgtataggtgatactagctctattttactactgaagcaaagaggcttaatgcgttaaatgggaaaacaagtttttgaaccctgaccacaaataatggctcatacccactttccacagtggttcttacctttttgattaattaattcaatgctctctccaccttccttatcaatagcttatatgccatgaaacattttcagtttcttctttaataacttagcagaccttttccgctgcaaaactcctggaatttccagcacattacaaaagatgaaagccaattgagcactacatttatgaaaagttgctggatcttgaactttaattagtaaattgcatcagataaatgcaaatttaaaccaaaataaaacattatctacacacctaccagattggcaataccaaaaagtctgacaataccaagttttaccaaggataaacagcaataagaacactcgtacaatgctgataggaaaaaaaatagttaaataatcctttaaaaacagttgggtatgatcacattatttgagaaagttaaagatattttttaatactgcaattctactttgaacaacgtatcctaaagaaacttatgcacatgtttaggataatctatgtacaaaaatgaatataacttttttttgcacttgcaaaaaactgggagcaactcaaaaacagtagaaataggcaaataattgaatactatatagtgatgaaaatgaatgaataccgccatatacaaccacatggatgagccttaaaaatacaacattgagttaaagaaactagacacatactataattctacttatataaagttcgaaattgacaaaactaagcttattgttcaaaactgcatactgaggtgttaacttgaaagaaaaagcagggacatcattaccataaaagtcaggataatgattacctccagcagggatgatggagtttatgtttgagaagggtacaccaagggtttctgaagttgtagcaatgtcctgggttatggatttcacttataaaacatattatattttgcatttatgtattatgcactttcctgtatgtatattgtcttttaaaaattttaaaaatataattttacatcactgttaactaaactcacatacacaaataaaatctcatcgaagaatagcagttttacaatattcctgatattttccattttgctgtatttccttagaaacaaaattatgctggtcataatcctctaaattgatttcataacacagtgggttataacttgcatctattatcatcatcagggattggttaactgagttggttagaacaatgtcctattagacctgtgaaagctacagctaaggcgcaaacctactatcacacagttttctaaacaaaagtggattagacaagagatagtatcattgttacagaaacagtccctactgaataggataaagcaatagattcattttcagaaaggaaagatcaacctatatacctacatgcagacctactacaatgattcttgcctatctaaagaaatgtattataccaaacccttacacttagcaattactactggccgccactgttctaagcatatttatatgttaatatagttaatcttcacaaccacactatgaggtttaagtttgattattttcatctcacagatgagaaaactgagtcagagaaagtaaatcttaaaagttttgacatagaataatgtgacgctgacatctcttttgtaagaagaggaaatctttaatttgcatgctgtgttgggaactttgcttagaaaggaaagtgcattcataatctgggcatttgttgggtgaaattgtctataatcattcagacttctatatggttatttcattttcccaggtaatgaatagtcttgcagaactcttcaataagcatgtgagatttgaaggttcataaaatctgtttagtgtttggtttattttcattccagagattaaaacatgcttagataattaaaaactcactgatgtactttttgtgaaacaagtactagatataatggttacaattcttcatattctttaggtagaattacaacccaagtatgaagacaacctgtacatgtatctttattttgtcatctttattatttttggttcattctttaccttgaatcttttcattggtgtcatcatagataacttcaaccaacagaaaaagaagataagtatattaaaacttcatccttgctctgaaatatgaactaaatatttcatactctttcctttagcctccaaaatgcaatcaccaaaaaaagaatataaaattcagaaattattttgagacatttgataatcgataagcttttaagcaattaataattcagatagcatgtttttgatatttttagtctagaaatatgactaatatggcataatttatatattgaataaaggcatctctataaatacagatattagcaacaatagaatgaaatgtgggagccaattttcacatgattactaaggtggattttatagccagcaaagaacacaattttaacaagtgttgctttcatttctttactttggaggtcaagacatttttatgacagaagaacagaagaaatactacaatgcaatgaaaaaactgggttcaaagaaaccacaaaaacccatacctcgacctgctgtaagaataacatattttcattgcctgttaaaactatattacctaaccgtttcacagcccgaatttctagaaactagttatttttgtggatttgtaacacaaagttttttaccttaacaatgggactagctagcctaaatagcttgaaaaatgtactttacatatataatatgtataaattatataatgcataacatattttatatgtaaacatataaaatacatagaaataaaatttgctatacttaagtgccagtggtatcatacaagctgatgtcattaagacacttctaataacatcaaaaataaaatacatacatacataacgtgaaaatattaaatgttctcagagtacagaggagacagatcggaataattggtacgtcacagattggcctcagtttttgtccaactctgcagattgaatggaatcattaatgaaacaggccacaggttttgcttttttctggttaaacaaaaaaaagacaaacctcatattttcccctactatcccacccttaaatgagatgatatcattctttgtagggctttttattggctcttccaggtgtacatttgccagtgatactgttcgttcagtttggctgctgcagggagttgctgccaggagaatcgctaagtttttctatcactcctgaaggactagctcatatattaagtctcagaaaatcttccccaacgtatacgtggtataaaacacttcagtgtttctcagaaatcttgactctataaatctattggtgacaatataaaacagaccgtaattaagtgttcagttggtaagccggccaataactcaaagaaaatggatagctatattgggtcaaacacaaagggtgtacaacttgagcctagtctttaggaaataatacaatttgaatgaatagagagagaagcagagaacatttactgtatgagaaaatgtatacttcatagccatatagacaaatatatcagtgcagaatagtgatgcatttgaattagtgagtagtagacactggttttccgagttacatgagacaaggttaccatacgagtctgaagaaatttgttctaattaagcaatacaaatgcaatatagttaacagaacagcctagtaatgtgaaaagaaagattttagagagtttaacctagagactggtgtggaacaatattagaggcaaaataaccctcggccatagacaagaagataaacccttacatacaagaagatagtccataatctgtgtccaaccagcaggactggaactactccaggagtgaagttagccaataagaagactcaattgggatgaaacacaggaaaagagggaggatgcaatgaaaaaactgggttcaaagaaaccacaataacccatacctcgacctgctgtaagaatagcatattttcattgcctgttatgaaacacaggaaaagagggaggatatgtagataacagagaatctaaaatataagctagttgatattttgtgaaactgttggttccactatcatatactgaagtcatatgaaggcactgggaaaaatagtgttagagcctatgaaatgtccagactgaaataaggattttagcattgtcagaacaaaattcaattgagctctgaaacacagattcatttttgaaaaataattagaatagagaaaaaaacaaaattctcagaatgaggccttgcatacttcatcaagatataggaagaaataaatcaatgaagaaatgagcttgagtttgtttccatcaaatgacatggatttacctgtagtggtaggggtgtgtggaaaaagttcaacacattcagctagaatattatcagtgtcaatttggcaatttagcaagtaactagtaaaatccatttattcctgcattgacaatatgtactatgtagtatgctaagcatttgaacttaaatatcgaacagtatggagtctagttaatgcaacggatagtaatcaaatagtcctgccaaaaaatggaagtatcccagaaaaaaagggatactttcagctgtgagagctgattagggggaaggggctgattaatcagggaagttagggaaggctttattaaaaaaatatactagctgaggatggaaaaagaatagaaagcatcaatagccagagtgggatgagaagagccctgtagaaggggaatgaatttgtgaaggtccttatgtaggagggctggtgagactggagtgcagaaagtcaaggttcatttgggacacactgagaataaagaggttaggataagcccaaacttttctgggccttggaggccgtgttaaggagtagttttcatcctaagagcagtaagaaaccgttaacgtggacccagtcagtctgggctttgtggtgatcactcaatcagtttcacagaggccgtgtgaatacattgtagacttgttttggagctatttcagagatggtaggtagcctgaaccatagcaatgtgcagattaataaaagtggatggatttgtgagctatcaccagagtgaaatttaaaagtttgtctattaattgaatatgggaactaaagaaggaaccaacaagaatgactggtgtctttctgctttgcacaactggataaatactgatgtcatgcaggaaatgaagaagggacagaaagtggtgagaaaattggagatgctagtttgcagaatttggcaaacgagtcagagtgagagagtgagaggaaggaggaagggagagaaatgatgaatatttagaagtagcaaaataaaggtttcttaagattcagagattaggtttaaaggaaagcaaaaggaattttagagaggaaaagatcgaagacagagggaataattacggcataaaaatgcacaagatgtgggacaaggacatagtggtctagggtagctttagaaagaaaaaggggctgagtcctctaatgaatttggagtaatatatgaaaagaacatggaaattaaaataatatgaaatgcaaaaggaaacagaggagtttatttaaactgtttaaatttaatgttctaaaaaaagtaaaaatagagggcaagagaatggaaatttatgagaagtttggaattatctttggagcaaatgaaggacaaaggattgctaattgttaaatctgaagggccaagatgaagttagagaacataaatttttggtgaataagatcttcagaattatacatcttgttccagcatatttgacaccctaggatttaaatgggagaacagaacacagagactcgagactggagttgtacattgagatgtctgtctcattggacaactctatgaacagggaatctaaacagttttttattagtcatggtgatattaaaattaagaccaaatttctgcttttaagatattttgaacttactatactctaggagccatatctgagagaaaaatgatactgctcctgcttttgaggggcctcaaaacaagtggaagggaaagaaaactaaaattgaataagagcaaaccatttgcaatacaatgccatacattttatgatcaatgaaagcactcagttttctgagagcactaagtgctttaaactcaaaactgagttagaattcatgagacagagaaggagtgggggacatgtgttttagacagaatagtagacagataaactatgtaaaatgatacagtagaacctgcctaagcttctaagagtggtaggcaggaaatatcagagggtggaagtaaggggaagatgccagacttggaaagttaaactacagtaaattaataattaataaggaagggtttgaactaaaagtagacacatttattgggttgaaaaaggccctgagaagacagatccagctggagtaatagaaatctagttcagcaggccaaatacgcattcagagaaaagagcaaaacaaaatagaacaagtagtgtttgatgtccaaaaatcaccattggaagtaatagaagcctcccaatagaaagagggcagaacactaagatgtagaatccaggccactaaaagtgtcaggatctgggaaagcaagccattaggtgtatatgtagcagagtattagtcattctagttgagaaggtagagaaaggcagcccaacagaggttaagtcaagaccagatccctagattacctgagaaacaaagcagatacgtgcaaaatggaacaatacagaaaccaatgatcagaactggtttacaagttggggacttcatttcataagcaagacataaggcaattagtacttggaaataaggtccaaatagactagggcaaagattgaatatttccattgtgactttttaaaagataattttattcttacagaagagttactcataatgaatactctaatgaatctatacacagtgtcctcttgttttaacatcttatgcaaccatagatcagttctcacaactaagaaattaatcttgatataataccattaaataaaatacagaactgagtcagatttcaccagtttttccactgaagccttttctctagaatgatgatttttaaaacatcttagctgaactttaaaatgaaatttaagatgctgtagctttagtgagagaatataaagtcagaaatcagacgaaaaatttaaaaagagagaggaaaacttggagaagtatttatttattagttgcttaaagtaaaattaataccctcccaacacatgggataaaaaattttattacatgacaaatatttactaactgtccgtcataacatgatggtgttctgtgcactgagaacataatacgtgagtttataaaacctggtatcaatgtgagtataaataaaacaaatacatttgaatacagttgaatatacaatatacaaaattttcttccaagtataaaacgaaaataaaatacactactttctttaatagaatagaacattgtaataatgttccattgcatttgaccctcacataaatgctatgaggtagcattaagagataagatttgaggctgggcatggtggctcatgcctgtaattccagcactttgggaggtcgaggtgggcagatcattaggtcaggagtttgagaccagcctgaccaatacggtgaaatcccgtctctactaaaattacaaaaagtagtcgggcatggtggcatgtacctgtaatcccagctactcaggaggctgaggcaggagtatcgcttgaacccgggaggcagaggttgcagtgagccaagatcgtgccactgcactccaacctgtgcaacagagcgagactccatctcaaaaaataaaaaaaattaaaaaaaagagagagagataagatttgagatctgacatggagcttccctatttacactacttacctgctttgtgacctaaggcaagttacctcagctctccaatcactggttttgcaaggaatttttttttttgtaaaatgttgtgaggattaaagatgtgtttttataaaagctacattttttgttgctttcttaaaatcagaagaattgaattcgattttttttaaggtttctaatggaacttttacatattatttgttccagaacaaattccaaggaatggtctttgattttgtaaccaaacaagtctttgatatcagcatcatgatcctcatctgccttaacatggtcaccatgatggtggaaaccgatgaccagagtcaagaaatgacaaacattctgtactggattaatctggtgtttattgttctgttcactggagaatgtgtgctgaaactgatctctcttcgttactactatttcactattggatggaatatttttgattttgtggtggtcattctctccattgtaggtaagaagaggtgcttttattcagttaaggaatatagtggtaaaaatatgtgttttaaaactttagaggtgtttttcactaatctttctcattcatcccaaactcccaaataaaaatctaatagtccattgttttagttttagtttgccatttctctaattgcatgctgtgcttgaaatgatgagtggaatacaaggaatttatattttcagctttcatttattctcatttaatattttcatctgttctcatctcagaagacaataactgcaactttggtagaatagtcttgtacctggtcatactcctgtggtattgacagttactgctttgaataaacaatcaatccacacacatatatacataaatcatttgaagtagtcacataattcataaatatgacctcttaaataattggaatagtgtatatgtgcagttatatatataataacacatatataagtttcatgttatctttgggtgcagacagttttctgtggtttgcaatatctctttttggaagcagatagtttgtttgaaaatccaaaacagatttgttatcatcaatgatacattaatgttaggatacatacatacattaagtcctaggaatgcaaaagatttattggaaaaaatatatatatacagtgtttatgtataagatattaaatgaggtactggaagtaaatataagaagatttaagagaaggttctacctatttggggaaacagaacattcacatggaggggaaaattatatagcactctttaaactactttctttagtcgaatagaacattgtaacaatgttccactgcatttgattctcacataagtgctatgaggtagcattaagaggtaagatttgagatctgacctggagcttccctatttacactacttaccttctcagtgacctaagagaagttacctcagctctccaatctctggttttgcaaggaatttttctgtaaaatgttattgtgaggattaaatcagattatgtatatatatgcacttagcactgtgcctagcatgaagaaaagacttagtaaatgttcagtttgaccacaagaaaaagttgatattatcaccatttactcatgcataaaagcaagtgccaggattcagtcccaagtacatctgtctccaaaacctatgttttcttctgtacatcacgctgcctactcccaaataacatagaatctcagaaagtaaagaactctcatattcctgacccaaaatcatacacctttagttcttatgcaaatactagaactagtattttggacatataaattaatttctgtacttggccactgtatgcttcatgatgtctttggaccttccagggttgagtcatttttttgatagatgctttccttgaactaggaaaaatggcccttattatcttcatttaatataaagatgtaaatgttataacaccaaacataccagtttcattttgctcaacaaacattgcagattatttgcatatatacatgtacctaactgtcctgttcacattttgtaaaactaatgtacttatgtaaactttcatttgctactattaagtataacaatatttttgttatttgttgattttctacaggaatgtttctggctgaactgatagaaaagtattttgtgtcccctaccctgttccgagtgatccgtcttgccaggattggccgaatcctacgtctgatcaaaggagcaaaggggatccgcacgctgctctttgctttgatgatgtcccttcctgcgttgtttaacatcggcctccttcttttcctggtcatgttcatctacgccatctttgggatgtccaattttgcctatgttaagagggaagttgggatcgatgacatgttcaactttgagacctttggcaacagcatgatctgcctgttccaaattacaacctctgctggctgggatggattgctagcacctattcttaatagtggacctccagactgtgaccctgacaaagatcaccctggaagctcagttaaaggagactgtgggaacccatctgttgggattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcgacccagtttatagagtttgccaaactttctgattttgcagatgccctggatcctcctcttctcatagcaaaacccaacaaagtccagctcattgccatggatctgcccatggtgagtggtgaccggatccactgtcttgacatcttatttgcttttacaaagcgtgttttgggtgagagtggagagatggatgcccttcgaatacagatggaagagcgattcatggcatcaaacccctccaaagtctcttatgagcccattacgaccacgttgaaacgcaaacaagaggaggtgtctgctattattatccagagggcttacagacgctacctcttgaagcaaaaagttaaaaaggtatcaagtatatacaagaaagacaaaggcaaagaatgtgatggaacacccatcaaagaagatactctcattgataaactgaatgagaattcaactccagagaaaaccgatatgacgccttccaccacgtctccaccctcgtatgatagtgtgaccaaaccagaaaaagaaaaatttgaaaaagacaaatcagaaaaggaagacaaagggaaagatatcagggaaagtaaaaagtaaaaagaaaccaagaattttccattttgtgatcaattgtttacagcccgtgatggtgatgtgtttgtgtcaacaggactcccacaggaggtctatgccaaactgactgtttttacaaatgtatacttaaggtcagtgcctataacaagacagagacctctggtcagcaaactggaactcagtaaactggagaaatagtatcgatgggaggtttctattttcacaaccagctgacactgctgaagagcagaggcgtaatggctactcagacgataggaaccaatttaaaggggggagggaagttaaatttttatgtaaattcaacatgtgacacttgataatagtaattgtcaccagtgtttatgttttaactgccacacctgccatatttttacaaaacgtgtgctgtgaatttatcacttttctttttaattcacaggttgtttactattatatgtgactatttttgtaaatgggtttgtgtttggggagagggattaaagggagggaattctacatttctctattgtattgtataactggatatattttaaatggaggcatgctgcaattctcattcacacataaaaaaatcacatcacaaaagggaagagtttacttcttgtttcaggatgtttttagatttttgaggtgcttaaatagctattcgtatttttaaggtgtctcatccagaaaaaatttaatgtgcctgtaaatgttccatagaatcacaagcattaaagagttgttttatttttacataacccattaaatgtacatgtatatatgtatatatgtatatgtgcgtgtatatacatatatatgtatacacacatgcacacacagagatatacacataccattacattgtcattcacagtcccagcagcatgactatcacatttttgataagtgtcctttggcataaaataaaaatatcctatcagtcctttctaagaagcctgaattgaccaaaaaacatccccaccaccactttataaagttgattctgctttatcctgcagtattgtttagccatcttctgctcttggtaaggttgacatagtatatgtcaatttaaaaaataaaagtctgctttgtaaatagtaattttacccagtggtgcatgtttgagcaaacaaaaatgatgatttaagcacactacttattgcatcaaatatgtaccacagtaagtatagtttgcaagctttcaacaggtaatatgatgtaattggttccattatagtttgaagctgtcactgctgcatgtttatcttgcctatgctgctgtatcttattccttccactgttcagaagtctaatatgggaagccatatatcagtggtaaagtgaagcaaattgttctaccaagacctcattcttcatgtcattaagcaataggttgcagcaaacaaggaagagcttcttgctttttattcttccaaccttaattgaacactcaatgatgaaaagcccgactgtacaaacatgttgcaagctgcttaaatctgtttaaaatatatggttagagttttctaagaaaatataaatactgtaaaaagttcattttattttatttttcagccttttgtacgtaaaatgagaaattaaaagtatcttcaggtggatgtcacagtcactattgttagtttctgttcctagcacttttaaattgaagcacttcacaaaataagaagcaaggactaggatgcagtgtaggtttctgcttttttattagtactgtaaacttgcacacatttcaatgtgaaacaaatctcaaactgagttcaatgtttatttgctttcaatagtaatgccttatcattgaaagaggcttaaagaaaaaaaaaatcagctgatactcttggcattgcttgaatccaatgtttccacctagtctttttattcagtaatcatcagtcttttccaatgtttgtttacacagatagatcttattgacccatatggcactagaactgtatcagatataatatgggatcccagctttttttcctctcccacaaaaccaggtagtgaagttatattaccagttacagcaaaatactttgtgtttcacaagcaacaataaatgtagattctttatactgaagctattgacttgtagtgtgttggtgaaatgcatgcaggaaaatgctgttaccataaagaacggtaaaccacattacaatcaagccaaaagaataaagg

SEQ ID NO: 16860 - DNA, 6942 bp, Human
ccgcctcatctagacacccccctccccaagccccctttatccccagatgccgcccccaacccgagcctccctttctgatcgcgtacccttttccaaaccgcctccccgggccccgagcaacccttctcccggacctgcggggcccagatccctttcctagatcccccgtcccagccccctcctcgcaatcgcagacccttctacccgctcctcggggctgcagatcccggacccctccccaagcccccgagtcggactcccggttccagccaccacccccgcttcgggtgcccgcgcccccaacacaccgtataagtgtccacaagctccgagcccacgacgcgcgcttccttggccggctcggcttcccgctcgggcccgaaggtgcgcgcggtcgccatgttcgggtctccgccgccaccgccgcccggcgcagactagcagcagcagggggcggggtcaacgtcccaccgccccccggcccccgccgcccgtcgcccccgccgcgcgctgcgccgccatcttggccccgccttcttcctgcgccctcgccccgcccccgcgcgtgactgacaggggccactcagggcgcgcgtgcgaggtgctcgcttgcgtaatctacctgcgtggcgccgccggcggtaccctgcacagcctgctagaaactgagaccccgggtggtgacagctctgggcatcgcccctgggtcctcgggaagaggggacagaaggtcccgagtctcccaggccacacgaagcaagtcactgctcttcctggcctcagtttactcctcctgataaaggaggccataatagtgcctcacctggctgttgggctctttctctttagggcaaggcaggttggaggggaaaataggacctgtgcttaccgccggagcagggcgagagtgattctgggccagttctgaacctctctgagattcggagatctcttgtcagtggggcttctggacaactgagtgggctgattgatgcgcggcccagcacgcggcccagtgctcgaggcagggagcgtgtttatcaagagggataaacttgatacgaactctgtacgaaggaaggtgtaggtggatggaggggtgtgtgctgccactgagcacaagaaccccacggggtggcctgccaaagttcaaaacgagggagacaggttgatctggacccaggaactacagtgctgaatcctaaaccggggaaagatgagacctagaagagggaggtggtaacctaattggagggtgaggagggaaagagcctgccacagatggggcatctataggggtgctgttgaataacagagcagctgacttaagcccgaagtgggtacttctccctgggcagatgggaggtctgggacaggctcctctggcagaagggctcctggccaccctgtcctaaggtgggtcagtcacttcctccttcaccagttccacagcatcttactatgagcttggcattcgaggcttctcttggcagggccctgcactcctagcctctccttgcacattgcacccccattccagagaggtttagttaaaggcgggggttaccaagtcagtcagatcttgggcaagtcaccactcctccagagcctcagtttccttatctggaaagtggaggtcatggcaacccgccaacctggttggatgggagcctgagctgttgtgttgcaccttgcctggggcccacgactttgtagctcctgtcctgcactgggcttatgttttcattcattccagaaaccttttcagagagtccctttggggagtgtgggggacaggagggaaagaaacctggtccttgtagccgttcgtctgctccctgccctgggcagaggacatggggactcaggccagcctgagatcactgggaccagaggaggggctggaggatactacacgcaggggtgggctgggctgggctgggctgggccaggaatgcagcggggcagggctatttaagtcaagggccggctggcaaccccagcaagctgtcctgtgagccgccagcatggatgacatctacaaggctgcggtgagggacagggctgggtagggctggggtgggcaggcccactgggggctcactcagctgagagtgcggggttagtagccccagggaagtggtggggaccaaggagaaggcctacgtgccttcaacccaggccctcacagggacagtgattctggtgtttgaggatgcagaaggggtagggggttccgggtctgaagggtggtggaggaggttgcagctttcagcatcgtgtctcactctctgtttccaagtgtctgtggtctgtggcactgtcgctcagccacatgtctctgcatttgtctctggacgtttttgcctttctcttttcatctcttcctcctgagctgtctgagtccccattactgtctccctgtccccaacccccatttctgcccctcacattctgcttctcacatgctcaaaatctgccaccccactccagccccttggcgggccgaagatgctttggagggtggagggtgtgagaggaggggtctgtagagcctgagtcctgggctggagatggggctttgaagtttgaggcagggaagttctggacatgagggagaaccaaggaagaaggaacagagaactggggccccagctcccatcatgcctggcaggctcagggctcagtggcttagctaggggtgagagcgagggaatgagggctggagagtggtcaccccaagcccctgcaacctcctgggtcactgagggtcttcagatgctattctatcctgggtggtggtgacctcccccaaccccagagcaaggacatcctggcatggccagctgtccccaggggaacccctccctcagcctccctcactcctgggcagggaagtgctatagccagctctgggggcacgcctgcttatcctgtgggagtccatggagccggggtggggacagccctccacccagtgcccatacaaggcctggcggagttggggactaattttggcttctgaggcggcactagcaggccagggggccagataacgctgccccaccccctgcatgccaaagtccccagaacaatcaccaggtttaactttgttcctcgttaaaaatagcccagtggccaccctggtcaggttaccgtgggtggcttgcctgcctccacactggttttattatcccaacttgagggacagctgtccttcgggccacccagcttgagtttcatcaggggccgaaagggcattgagtggtcactgactattgttactgagggtcaccttggtcctgaagggggtgcccacctgtcaccctggccctgagcccagtcgcagtgaggccagctgggtcacgtcagggctttgggggcagggagggaggactgagacctccactctgtggcctggaaatagcctgcctcctccagctccagccttctcacctgtggaatgggttggtttcctcagcagcagctatacctgagtctgagccttgagattccctttcctttctaggtagagcagctgacagaagagcagaaaaatggtgagaatccctatcacacatgtgggagaccagcgggtccaggctggcatggggaccccttatcagaagaggaccccaggccagagaccagaggcttggtccctcttgctctgccctcagagaggtctccgagggaggtgggcaggttggcaggtggccccagggttctggccctccgtggtcctggctgctgagccctgactactgtgccccccaacccctgaacacagagttcaaggcagccttcgacatcttcgtgctgggcgctgaggatggctgcatcagcaccaaggagctgggcaaggtgatgaggatgctgggccagaaccccacccctgaggagctgcaggagatgatcgatgaggtggacgaggacggtgagccccctcctccccaggctccagaagaaccccagctggctgggggctggaatgctggctctgtttagctgggagcaatttagcctatccgagccttggttgcctcatctataaaatgggcataagggctacacaagcctggcgtttggtgtgaggatgcggtgagaacatgggggttcgtgtcgaaggtgctgcctgcagtacctaccctggcctctgtaacggccatgctgcccacccccaggcagcggcacggtggactttgatgagttcctggtcatgatggttcggtgcatgaaggacgacagcaaagggaaatctgaggaggagctgtctgacctcttccgcatgtttgacaagtgagcacgtgacccttgacctctgaccctgacccacactcaagccgagctgtacaggagggcagtctcagattccaggcctagggaccctgtggcctctgcctgataggggagagggatgccccatctcccagtgtccctgctctgcctcctggggcatgggtggggctgcctcatgccctccccacagccctaccctgagccccctccccacagaaatgctgatggctacatcgacctggatgagctgaagataatgctgcaggctacaggcgagaccatcacggaggacgacatcgaggagctcatgaaggacggagacaagaacaacgacggccgcatcgactatgatggtaagcgggtgggtgggctgatctcctgcctccatgccctgcccagcccctaccctcaacccacacctgcccctctttccacagagttcctggagttcatgaagggtgtggagtagatgctgaccttcacccagagctgcctatgcccagcctccaactccagctgagtcctggggttggggagggggtcggggtcccaggacctgagcctggccatgtcctcaaccccaaatcccccgactccctccccagatctgtcctgggggatgcaaataaagcctgctctcccaaggtctgctatctggctctggtgtccctgggccgtggactcatccccaggacccactcttacccaatggccgcttccttccctgtcctaggcaggctggctgcagagcctggcgcctgaccaccgctccacactgccttctgcaggggggtgagatgagatcggagactgccgtgtggcctgccctgcttgctgccctctatcactcctcaggcccaggcaccatctctagggattcagcatctggagtctgtgggggcctagaacccccacaagttcctgggggccatcactttggtcaaccactgtggcagcctaggggtcctctacttggagagagtggttcactgtggtacacagccaggcccttggatgctccctggcacagcaacccctgttacctctcagccgtggctggaatggagctgagcctgtggggtccctgcaggctcacagtgctagtccacccgcccacttgcttgtatttcctgccagcaacattgactcccagggacagaggggcatggagtcggctctatctcccctcacctgtttggcccagagaggtgcagggacctgtcaaggtcatccagtgagtgtgggggagagcagagccaactggcttccagccaagggccctgtcggatgggccacatccaaatggacatgatttccagttcccgtgaacctcagaggctcatctcttgtggcccagtctctctccctggcagggatggaggcccaaggcctggcagctctcagcttagtgggagcacccagtccagagctgccgccagacagtgatgctgtcttggaggcgtgggcgttgggggctgcaaggaagtggaagtgtcagcagaggtgttcgcaggagggacagctgccagcagcacccaggctgtagccagaatgccgtcagctgaccttgccccgcccagccactccactctctctgcacctgtgccccagccttggcattccccagacaggcctggcattccagagatggtcttggaattctaaaaatgcctctgatggaggccagcgctagcaagagctttctggtccctggagagacctgaggggagcagagaggagtcccttcaggcctgcccttgtgagctggagaattggggacctctacagacacccagagtgacccaggaagggtgacatccgaggataaaaggaagcgccacatcgggcagcaccagcagccggtgcaccacccagtggttcactcacacacccaccacgcgcacagcacagggctggatcctggggcatgtcacagtgaggcccagtccctaatctggtggattttttttttctttttttttgagacggagtctcactctgtcacccaggctggagtgcagtggtgcgatctcagctcactgcaagctctgcctcccagattcacgccattctcctgcctcagcctcctgagtagctgggactacaggcgcccgccaccacacccagctaattttttgtatttttactagagatggggtttcaccgtgttagccaggatggtctcaatctcctgacctcgtgatccacctgcctcggccttccaaagtgctaggattacaggcgtgagccaccgcgcccggcctttttctttttttgagacagagtctcgctgtgtcaccagactggagcgcagtggcacaatctcggctcactgtaacccctgcctcccaggttcaagcgatcctcgtgcctcagccacccaagtagctgggattacaggcacctgccaccacacccggctaatatttgtatttttagtagagacaaggtttcaccatgtttcccaggctagacttgacctcctgagctcaagtgattcgcccaccttggcctcccgaagtgctgggattacaggtgtgagccaccgtgcccggcctaatctggtggaattttaaggagatgagtacagtgggaaagccagcgtgggctggagtggggactggaggcatggtgggcccatga

SEQ ID NO: 16861 - DNA, 20116 bp, Human
caataagcctctgaaatacaggacttcacctgaccctcctgccagccacaagtggcagggcgggagagctttacaaatcaggaaaccaagccttgaagaggttgtggcctgcccaagtctatggccaagtaagattcagagctgggtttgaaacccatgcccaactccactatccagttctttctgctttggctttggctctgatcacccccaaaaaaaccctatgagggccaggcgcagtggctcatgcctataatcccagaactttgggaagctgagggtgatcacttgaggtcaggagttcaagaccagcctggccatcatggtgaaaccccatctctactaaaaatacaaaaattagctgggcgtggtggtgtaatcccagctgctcaggaggctgaggcagaagaatcgcttgaacctgggaggcagaggttgcagtgagccgagattgtgccactgcactccggcctgggcaacagagggagactctgtctcaaacaaacaaacaaaataacaacaacaacaaaaacaacctgtgaggcaggcatttcagggattatgatcctattgcccagataaggaaagcaaggcccaaagatgagcaaagcactcaatatcatccttattctgttcccacttccagctgcacttgggtccaagtccaagtgctgaccttttctctctcatcttctctgggtgatgggcactgcccaggatctcttggctgaatggcacagaactgggtctcgagctctcagaccaaagccctcatcctggactggtcccactgccactctgaacccaggtgcctcctctgaaggtggagactcacctcacctgccttgcagccagctgggtgctcagagacagaaatgcaaagtacctggacacaccctggtcaccatcattctggactttgtccctcttgttaatgctcagctgggaaaggaataccctcaaaggccctttcctcaagaatggaggagagtacctctgagcctggcacaggcccagcccaacacagcccaagccaagctgggaagggtgtggggcaaggaagccagactgacattcctgagacgggtttgccaagccctacactttatgtgttgtacccgggaaactcaatggaggtatggcccaacgctgacctttggcatggaggcctaagccaccctgctggtgcccagggtggccagcaaggggcttcagacaaccctggatggaaaataaaaatagtggctaatatttgttacacgctaactattgtcaggccctgtgccttcccctcctccccaagtgctcagagctgtggagtggatgggttccaccctagccctgttcctctgtcccctctggatcatcttagaccagaaagtgccacagctgagtgtcccgcttcttccgcatcctgccaggaccactccatttgtgggcgatatagccagctccacctcctccgggaagcccttgttcacagtttccaaagcaagccgcaggcgggatggatcctgcttaacaccccggcccagaaccccttggatctccttcttcctccatgtccaagacacccagcttaacaaccctgtagcccccaacttggccctagcggcacctcgcctcgaccttgccattttatactcaattggggcgtagggttctgaagcccagggtagttggtggggaggcagcacgagggtgcaggatgaggtcgggaaaagagacctcgtccgcccaccgcctagcgcttcctcctccctgcaggcgagccggggaatccccggcagcaccgatatccgcagagcccaagaagtgggcctctctgccccgcccccccggctcgccgagggctacgcggcgcgcctgcgcagaagaaggcagcgcccaaggcgcatgcgcagcggtcactcccgctgtatattaaggcgccggcgatcgcggcctgaggctgctcccggacaagggcaacgagcgtttcgtttggacttctcgacttgagtgcccgcctccttcgccgccgcctctgcagtcctcagcgcaggtgagggcccgcgcggtaggtgcggcgccggccgaggaagccccggggtgtcctgccagccgtggcaccgctgccccgggtgctgggaccccatcccccactgtcccagtcacccgccgccttgaggtcagcgtttatcctccagatcttttgcctagacggccgcctcagtttccccctttcggccccttccggctattcccggttgaacccgccgctttagaattcccttctcatacccctcccgtcattctcgagacctcgaccgcgggtcacctctgacccccactgccggaggactgccttctttctccagactcaactccctcgactttataagcccctgcgcgtccccagtgaggcccaaggcgctggccctcatacccctaccctcatttgtgcccctcctttctcagttatgcccagttcttcccgctgtggggacacgaccacggaggaatccttgcttcagggactcgggaccctgctggaccccttcctcgggtttaggggatgtggggaccaggagaaagtcaggatccctaagagtcttccctgcctggatggatgagtggcttcttctccacctagatgtaagccaagatgtcttatctgcactgtgcatctccctaagaaacctctggcctcccaaacctgttcttgacctttccctcatccttccgcccccttgattatgtactgtcagtattcatttggtgaagttgctttgcaggtgcctttgtgtagcgctggagaatgaagaagttggtgacccgggtaaagtgtggtcaccattccttagctcacatcagtgctgtccttaggcatttttgagggagaagtgttagtattccagggtaccctttatataaactgcggttgacacctgaatccagtgagcttgcagtgatatttgcctgattattaacaactgttgatgtcactcttcatcagtctttccacaggagccagcatacttcctgaacatggagagtgttgttcgccgctgcccattcttatcccgagtcccccaggcctttctgcagaaagcaggcaaatctctgttgttctatgcccaaaactgccccaagatgatggaagttggggccaagccagcccctcgggcattgtccactgcagcagtacactaccaacagatcaaagaaacccctccggccagtgagagtaagtgtcattgacaatgaaggagcaggtatgggtgtttgtgctcattggtagactagaagcagtccccacagtggtggtgagggtcacactcactcacagagggctgctatgtgcaggctgggctctgagcacagattatctcatatgattgtccccccaagggtaggcacttttagcttttccatctttaaaggtgaaacagtggccagtgttgcacattacaggtttttggattgcacgttagtgtctataggggttttagtgtttcctcagtgcctcgttcacataaatattaaattggaatgttctaatttccctcattaaacatttagccttctaatttccctcattaaacatttggccttcggctttttatttatttaatttttcttttttgagacagagtcttgctctgtcgcccaggttggagtgcagtgatgcagtctcggcttactgcaacctccacctcccaggttcaagtgattctcctgcctcagccttccaagtatctggaattacaggcatgcaccaccacgcccagataatttttgtacttttagtagggtttcaccttgttggtccggctggtctcaaactcctgacctcaaatgatccacctgcctcagcctcccagagtgctgggattgcaggcgtgagccaccgtgcccggcccctttggctttttaaagtagtgattttttttttcttaaaagtttttgttctgttgtggtaaaatgcccaagaaaaattaccattttaagcacttaaaaatgtgcagttcagtggtacattcatattgttgtgtcaccaccaccatccatctccagaacttttttcatcttcccaaactgaaattctatacccatcaaacagtaactctccattcctctctccccaacccctgacaaccaccattctgctttctgtctctatgaatttgactattctaggtacctcatataagtgaaattgtacagtatttattagtgatttttaaaaacaaatttatcttggctgtgtgcagtggctcactcctgtaatcccagcgctttgggaggccgaggtggtttgatcacctgaggccaggagttcgagaccagcctggccacatggtgaaaccccactgttacaaaaaatacaaaattagctggatgtggtggtgtacgcctgtaatcccagctatttgggaggctgaggcatgagaattgcttgaacccgggaggtagaggttgcagtgagctgagatcatgccatgtatctttatttgtatatacatttgttgttgttgtttttaacaaagagactagagttgaatttagtttgctctgcttctgataggagagaacaaagcttttcaggttccacttaatcccagagaatattttacaggtttttcttaggcgtgttctctgggtgtgggcttgtaagaaaataagttttttttttctttaagcagaaaggatttaatcctttgtagggtttattttcaagagttagttacgtcttttttaccaaaatgcttgcaatggctatgttttaaatgataggatttttttctttttctagactttaatgaatatgtattacttttataataaatgaaattaacttcaaaataatttttttggccttccgttatagaagattttaatgaaaactgtattgagacactttacccaagttataggaaaggctagccagtgactcacaggagtgttccagaatgatgaagaaagacttttctagaaagaaggtgaatgaatttgctcaaggggagagggaagtcactgtagctagaaggataattaccagccaacggtgtttagtcagcagactttgatgaatttagatgagaaagtagatgaggtatgtgaatgtgatatacccctattttttcttactttattagcaatctaaagacctaagtcttagtctaatttctgttgtttagatgaaaaccaatagcttttatgttaagcaacagcaagcctctttgtcaagaatctgtttagaaaatgtcagcagagacaggatgtggtggctcatgcctgtaattccagcactttgggaggctgaggcgggaggactgcttgagcctaggagtttgatagaagctagggccacataacaagactccgtctctacaaaaaataaaaaataaaaagaattagctgggcgcagtagaacacctgcagtccaagctacttggagagctaaggtgagaggatcacttgagcctggaggtcaaagctgcagttagctatgattgcaccatgcactctagcctggttgacagagtgagatcctgtttcaaaaaaaaaggaaaggaaaatgttagcagagaaaaaaatgtgtgtgaatatttcccgttaccttacagagtgtgtcctctcataaaataagctgagtgtagttggggtagaaattactggaaatgatccaactcaaggattccgggttgtctaaaactagaaaatggtactttttttggatttatgacgagaaatactgtgggtttaagaggcaactggaatgtgccagttaactcttcatagacgcattgtttcctgtgaagcagatgaaaaactagagagattagcagaacctaataaaaataggcttgtggctgagtgcagtggttcacgcctataatcccagcactttgggaggccaaggcaggtggataacctgaggtcaggagttcaagaccagcctggacaacatggtgaaaccccatctctactaaaaatacacaaattagccaggcatggtggcacacacctgtaaccccagctacttgggaggctgaggcatgagaatcacttgaacccaggaggtggaggttgtagtgagccaagattgtgccactgtactccaacctggggtacagagcaagactccatcttaaaaacaaaacaaaacaaaaaaaacacttgtgtctggatggtggggtacagtaagtattaagtttatctttgaggcaataaaagaaagaaataagtggttttcttacatactgtgcaaccagatctgatgcttcactttttccatttcctccctcagaagacaaaactgctaaggccaaggtccaacagactcctgatggatcccagcagagtccagatggcacacagcttccgtctggacaccccttgcctgccacaagccagggcactgcaagcaaatgccctttcctggcagcacagatgaatcagagaggcagcagtgtcttctgcaaagccagtcttgagcttcaggaggatgtgcaggaaatgaatgccgtgaggaaaggtaagagatgagttgtgaaccattagtggtagtgaaggggtccttttagttcttttgggccctcagatttgtgtatgagctattattagggcagtatttatggaaacaccttcctcttttagggccagagaggaaggtcttcaagatagacagtcaagggactgtattgcgaaagtgggactttctttctggtgcgtgtgtgggatgtgaccagcttttatagttactacttaatttctgaaaataacctgcagtcttgagctgccaccagctgccttttgtccctttggtctttcccatcatctgctaggataaagatagaaaataatggttttactgcagtaagtgctggtcctagggctcccaagccgtgtgtcttactgatggtcattgaattgcaaccttaactccacaatatataggtgtggctatatctgcagagaactcaaggctccccaaaagcctaaccagcagaaattatgcatatggccaaaattgttttctatgaagaaaattgagattaggaccaggcccagtggctcacacctataatcccagcactttgggaggccgaggcaggtggatcacttgaggccaggagtttaagaccagccaggccaacatggggaaaccccatccctaccaaaaatacaaagattagctgggcatgatggcgcatgcctatagtcccatcttctcaggaggttgaggagggaggatcgcttgaacccaggaggcagaggttgcaatgagtcgagatcgtgccactgctctccagcctgggtgacagaatgggactctgtctcaaaaaaaaaaaaacagaaaattgagattaggattggggtggggatgtagtggagtgaataagacatgccaaccagcaagaaagctttggactttattgttcattaaagctggccagtagctctgaaaacaacaccaagagtctgccattacagtaactaaaatagaagagatgctttgtacactcagttataactaactttggttatgcttggccttttttgtgaactaggccataagccatttttgacaatatgtttggaagatattgtgaactcagaatagaaagttggtcccatttgtttcttgttacttttgttccagaggttgctgaaacctcagcaggccccagtgtggttagtgtgaaaaccgatggaggggatcccagtggactgctgaagaacttccaggacatcatgcaaaagcaaagaccagaaagagtgtctcatcttcttcaagataacttgccaaaatgtaagtctcattgttatttgcctgatgtagaaaagaatttataattcaaatgtacattagattaaatataaaattgcatggtgaggctgggcacagtagctcatacctgtaatcccagcactttgggaggctgaagcgggagaagatcacttgaggccaggagtttgaggccagccttggcaacatagcaagacactatctctaccaaaacagtttttttaattagccaggcatgatggcttgcatctatagtcccagctactcaggaggctaaggtaggaagattgcttaagcccaagacttcaaggttcagtgagctatgatcacgctattgcactccagcctgaatgacagacagagactcagtttctaggaaaaacaaaaaaatgtatggtgagttgaggcttgaaagccatatcccttgcttgcgtgagcaggtgcttttggttgtggtgactacaggtgctgttggtagcctgccttctgtcctttaatacttaccgtctacacatggcactgagccaaacacgacatacagtcttatttacttacaagatgaggacatcaaataacctgcccaggatctccctcagttgccaagctgagacttgttgtatttcaccaaaacgcagctgtgtttcacaaccatcattctgtactgtcttttgttcaatttttagctgtttccacttttcagtatgatcgtttctttgagaaaaaaattgatgagaaaaagaatgaccacacctatcgagtttttaaaactgtgaaccggcgagcacacatcttccccatggcagatgactattcagactccctcatcaccaaaaagcaagtgtcagtctggtgcagtaatgactacctaggaatgagtcgccacccacgggtgtgtggggcagttatgtaagtagcccttggctttcaaatattactgttgttatttggcaagccaatgatgatgtataggggttggatcttttatggagggaacattcagtagctgaaagtgtgccatagcaaaatactattcttagcttctgaaaaatatctacagattacttttaaaggaactctaatatgcaggtagctgctggagccccttaacttgtgagggttcaagcttataggctcaatgaccacacacgtcagtccactttctatcactctgcaagtgagtgtgcctttaacaccaggcagtctttcacagagacatccttggttgtggctgtgagtggagaaatacgaatctagcagcgctagagaaaaagctactccaaaagacatgttaaaaaggatggtagatcccatcactcgtccttcaggaggctcaccatcctagggatgctggagagagttgctggccagattctccaaaggcttgctaaagagggtcccggtttgaggtttaatgatagtgatatatccaaacattacatgactggcttgcagagggtaaccaccatccaggatgtccctctagagtttgctttttcttaagctaacatgttattggaaagaataatgtttctcagaaaataaaccttagtttcttagaaaagaaactcagctaataccaagcacttactgactgttaaatgaacacttgttcttgatgattcctggaggtatcatcaccctagcattgacaccttctcccacctagtctgaagatgaaatcagttgaaatttctgaccccaggtttcacagtgagagagttgctacatcaacatgtttcagtctcctggatcctagaaaggggaaaaaattcacatggtgttgagaaccatgagctttattttctggttttgtttgtatttttaaacagggacactttgaaacaacatggtgctggggcaggtggtactagaaatatttctggaactagtaaattccatgtggacttagagcgggagctggcagacctccatgggaaagatgccgcactcttgttttcctcgtgctttgtggccaatgactcaaccctcttcaccctggctaagatgatgccaggtaaggaagcctggcatgagtgccttcgagttttttgggtttcttagtaataacaagaatattggcaacaaagaagccttaccagaacctctcaattgaaaatcataatcctatctgggcatttgttctggggtcaagcatgaaatgctgactgtacattatgggttccaggagaacgtgataccagtgaaaattcaaacttgaaacgtctcatccttgagctaattgcctcaaatatgttttgtattctaagatgatcctttggagaagtctcttaatcatttagttagctcttgattgagtttggagtgaggcagtcagatttaagagcagattaatggcctgccacaaggttattctacacctttgggccttctcacaagggaagcactaactagttattttgccaggaagaaactggcacacagtgtctttttcctactaggcattttcaaagcatcatttccaaggaaaagtctgttgtctttctctaggaaataatttgtcttcgatgcacatggcaataaatagcatttttgttgtcttaggctgtgagatttactctgattctgggaaccatgcctccatgatccaagggattcgaaacagccgagtgccaaagtacatcttccgccacaatgatgtcagccacctcagagaactgctgcaaagatctgacccctcagtccccaagattgtggcatttgaaactgtccattcaatggatggtaagtgtggatagaggttcctctgaaacctaagatgaaaaactatgcctgaactctttaaaagtatggtgttttgttgtgttttttaattttttttttttgtgaccgatcctcgctctgttgcccaggcaggagtgcagtggtgcgatctcgactcactgcaagctccgcctcccgggttcacgtcattctcctgcctcagcctcccgagtagctgggactacagacacctgccaccacgcctggctaattttttttttttttttttttgagacggagtctccctctgtcacccaggctggagtgcagtggcgtgatctcggctcactgcaagctccacttcctgggttcacgccattctcctgcctcagcctcctgagtagctgggactacaggcgcctgccaccacgcccagctaattttttgtatttttagtagagacagggtttcaccatgttagctaggatggtctcgatctactgaccttgtgatctgcccgcctcagcctcccaaagagctggaattacaggtgtgagccaccgcacctggcctaactttttgtatttttagtagacggggtttcactgtgttagtcaggatggtctcaatctcctgaccttgtgatccgcccaccttggcgtcccaaagtgctgggattacaggcgtgagccaccgcgcctggcctgttgtgttttttaattttcttttcctttctgccaggatttttttttttcttcttccaacttttaggttcagtgggtacatgtgcgggtttattatatgggtaaattatgtgtcacagggtgttggtgtaccaattatttcatcacctaggtagtaagcatagtacccaatggtagtttttgatctcaccctcctcccaccctccaccctcaagtcggtccctggtgtctgttgttcccttctttgtgtccatgtgttctcagtgtttagctcccacttataagtgagagcgatatttggtttttccgttcctgtattaattcacttaggatggcctctagctccatccgtattgctgtaaaggacatggtctcattctttttttattgctgtgtagtattgcattctgccaagatttgtaattggtggacttttttctaatagatttgggtgaaagtggattttctattctggcttttactaggctctgggaccccaggtaacctagaaattagaggaagttcattttctttccaatattgaaaatgataccttagaatagaagtttacgttgttctgactctaaccaaaacagaaatttctgaagcggcaaaagctcttcagagcagtctctggtctttcctcaggggcggtgtgcccactggaagagctgtgtgatgtggcccatgagtttggagcaatcaccttcgtggatgaggtccacgcagtggggctttatggggctcgaggcggagggattggggatcgggatggagtcatgccaaaaatggacatcatttctggaacacttggtatgtatacattgtattacatacactaaaattccattatcctaacaaggccaaggactaactagtctaactgggatcaggtgaggagacagcctgacagcatatgaagcctgggccactctttcttttggcccagcttagtggaatcccttgggtcatggaggcatggctcttagaatcaaagtaaatcccacagcctaacacactgatagaccatttattgctatctgagctcatttcagacatagttgtgggtctagccccatgccatggcaagagcctgtactctctgtgcctcaggctgttcttaattaaaaagaaaaaggaattctagtacttttctcctggagcacttgttaggttcaggtgttgtgaagtgctgaactccgtgcctgccacgtgggaacattctaattcatcctggttttcctctgctcttcctcatacagaggctatgtctcgtggtagatgggagctagactttggagccctgccacctcactagttgtgtgaccttgagttggtagttaacctttctatacctcagtttcatcatcaatataatggagaaaacaataggacctaaatcaaaatatatgtggagaaggtaaataagttgtatgcaaacagttattatagacattccctctgagaacctatgagaaccctaaagagacgaaaattacataaatttgaagaatttttgtaattttgaagaatttttttaagccttcagaagtgggtaaggcagttggaaacccatctagcagttagctaaaatgccagtttatagcctatgcttggtaaaggaagggcaggctttttaaaaagcgtccttcagcactgtcaaggggtatgagaacctagtgcagacccagaaagcctgggagttctaagggtggaaccactaccaggagaaaaacacctgatcatgtgtcttaattcaagaagctcttttcttttttttcttttttttccgagatggagtgtcactctgttgcccaggctggagtgcagtggcgcgatctcagctcactgcaagctccacctcccaggttcatgccattctactgcctcagcctcccaagtagctgggactacaggcacccgccaccatgcctggctaattttttgtatttgtagtagagacggggtttcaccgtgttagccagaatgttctcaatctcctgaccacgtgatctgcccgcctcagcctcccaaagtgctgggattacaggcgtgagccaccacacccggccagaagctcttttcttttaaggatgtctcctgatgtgggctctttgaaggtatggtcattgtgagatggaaaaggctggagagagaaactttataccataggagattgaaccaacccagctttgcatgtggttttagcaaaaacattaattatagaatgttatgttaagatctatgaagactcttctggagttctttttgttttttgagacaggctctcactctgtgcccaggtgtgatcacagctcatctgcagcctccacctcctgggctcaagtgatcctcccacctcaacctcctgaataactgagactacaggtgtgcgctagcatgcctggctaatttttgtatttttagtagaaacggggtttcaccatgttggccaggctggtctctaactcctgagctcaagtgatttgcccccctcggcctcccaaagttctgggactataggtgtgagccactgcacctggcctcttctggagtttttaatcctgaaacttgagatgtagatcacacaaaaggactcaatgagaattgaaaaccaagtctggccctaaatcaatcctaatgcattaattgtcaagagttttgttcttaagtaggaaataacaccagtcataccaaaacagttaatgccttagctgggtaaaattccagcctctgggataatgttccctgtgggaggatggtacaagcactgcagagccagtcttgttccaaagagcacatgcagtgcagacatggggagtggagctgtgctggctgtcagagcagcaagcctgggtgagaaagggaaaggagaataagatggtgggaagggaggcagcagcagggtatttgggcacactgggaccagtcactgaggtgtcaggtctgattggaagacctgcattttgatcctggttagacaccagcttggccatatgactttgggcaagacccttttgtaactttccttagcttttttacccttttaaaagtgagtagccaggcacgatagctcacacctgaatcccagcactttgggaggctgagacaggaggatcacttgaacccaggagtttgagaccagccctgggcaacgaagcatggcctcctctctacacaaaataaaaatttaaaaaatcagccaggcatggtggtgtacacctgtcctagctacttgggaggctgaggcggaaggaatacttgagcccaggaggttgaggctgcagagagctatgatcatgccactgcactccagcctgggtgacagagcaagaccctgtctctaaaaaaaaaaggaagattagatatccttttatagtcatgcattgcttaacgatgggggatgtgttctgagaattgcatcactaggcgatttcatcattgtgcaaacaccatagagtgtacttacataaacctagattatatagcctaccgcacacctaggctttgtggtatggcgtgttgctcctaggctgcaaacctgtacaacatgttactgtattggatactgttggcaacaccatggtatttgtgtatctaaacatacctaaacatagaaaaggtacagtaaaaatacagtattataatcttatgggaccaccatcatatatgtggtcgtcattgactgagacatcattaatgtggtgcatgactactccaatcagtccaggaacaaattaaaaagataaggagaaaagtcagtgctttgaggctccacaacaccttgctgtgtccatttagagcaatttacagctgttgctgtaattaatgaagctatctcctcccaggcaaagcctttggttgtgttggagggtacatcgccagcacgagttctctgattgacaccgtacggtcctatgctgctggcttcatcttcaccacctctctgccacccatgctgctggctggagccctggagtctgtgcggatcctgaagagcgctgagggacgggtgcttcgccgccagcaccagcgcaacgtcaaactcatgagacagatgctaatggatgccggcctccctgttgtccactgccccagccacatcatccctgtgcgggtaatggcctgtctctgattggacttgccgtggggtgtgcctctacacatgatgtacggatgttctgcttcataccttcctgaagttgggcttgagcggggtgactgccagggcaggggttgtagccagccaccctctgtcatgtttccgccattggctgacttcaccaagagaagaaagcctttgaacccagcaggctggggcagaagttccctctccggagcactgaccttaacagggtaaacacagagcttgtatctagaaagctccagaagcctgagcttggccagctttgaagtatggctttctacttagtaaatttcaaaataggttttgcccttcccactacaaatggtagcactgttgatgtcacagttgaattagtgtaatgaatacagctagtataactgaatctagattatacatcgtgggtatgagagtctgctggtacgaacagaaccagtgttttctgattaaaaatgtatttctttttaataaggttttggttccctggtgttcacgaaacaacactggcttcttttaaatgacaggtgtttgggcagcgctttccctctgccccaagcttgcatgtgttgctacagtctggtcttgagcctgagcgttgtggggactgcgttcgttaggatctctgctaagaggtagtccttcctgttgtgaccttaccttctgctctcattgaacttaggttgcagatgctgctaaaaacacagaagtctgtgatgaactaatgagcagacataacatctacgtgcaagcaatcaattaccctacggtgccccggggagaagagctcctacggattgcccccacccctcaccacacaccccagatgatgaactacttccttggtgagtacctggggagctgctggtgcctcactgaggagttgcataaagctgtctttgcagtgtttataattgaagcccttcagaggcattcagatttgtttcttcttctttttttagttttttttttgagacaagagtttcgctcttgttgcccaggctggagtacaatggcacaatctcggctcaccgcaacccctgcctcccaggttcaagcgattctcctgcctcagcttcctgagtagctgggattacagccatgcgccaccacgcctggctgattttgtatttttagtagagatggggtttctccatgttggtcaggctggtctcgaactcccgacctcaggtgatccacccacctcagccttccaaagtgctgggattacaggtgtgagccctggtgcccggcctgtttcttctttttccaagtaactaagcatgccctcaaatggttcaaaaccctaaaaggtatttattgtctgattcacatcaagagggtggagagtcattttgggagctctgagggagcctgggaatccgctcagtgtttccagtgcccccttgtctacgtggctgaaggatgcacagtaatgacttgcagggagaagaggcctctgaaggcttgagtccccgctgtccctccggagtccacctcacatttgtcttcaccactgccctctactccatgatgttgtataatccttgaataaccccacacctaatcgcctctgataagaggaattgctcaatattttcaactgccccgtggttctatactgctccacccatgtccaacctaaaggcagagatggaagggggctattagccacaggtcacctctgcctcgaaggtacattgccttcccaagcccgcccagtgtggctcagcttcctcacaggctctctgttctgttggaaatgctgggtttaaactgtcacgtggcagtgttggagcagcttcttccctacaggcctgtgaaatcaagcccaactctgggttttatttttctctttatttatttttataaaagccttaaaatttttataaaagccttatctcagtagagatatagctcacttaccataaaattcacccttttaaagtatccaagtctatgatttttaagtacactcccagtgttatgcaaccatcacttctatctgattctagaacattttcatcacctcagaagcccctacccattaggagtcactcctcttttccccatccccagcccctgtcaaccacggctctttctgtctctatggatttgccttttctggaccttgtgtctaagtggaatcataccgcctgtgctcctttgtgtctgccttcttccagcatcatgtctgcaaggctcatccatgctgtagcattcatcagcacttcatttctttctgttaccaaataaccttccattgtacagatttaccacattttgtttatccgtctattggtggacatttggttgtttctcttgttaactattatgaataatgctgctatgaacatttgtgtacaagtttttgtgtggacatatgttttcatttctcttgtgtatattactccctttaatatttaaaaactgtttctcctcagagaatctgctagtcacatggaagcaagtggggctggaactgaagcctcattcctcagctgagtgcaacttctgcaggaggccactgcattttgaagtgatgagtgaaagagagaagtcctatttctcaggcttgagcaagttggtatctgctcaggcctgagcatgacctcaattatttcacttaaccccaggccattatcatatccagatggtcttcagagttgtctttatatgtgaattaagttatattaaattttaatctatagtaaaaacatagtcctggaaataaattcttgcttaaatggtggttctttctgctattggctactggataacattcttcattggctagacacagtggctaacacctgtaatcacaacacttgggaggccaaagcaagaggatcactttaggccaggagtttgaagctgcagtgagccatgattgctccactgcactccggcctgggtgacagagcaagactgcctctgaaataaaaaataataattgtcatcatccctttaagttcagtctgtattctaggaatgaataaactgaatgaagtactggagctctggtaatggcttcagaggaggagcagcagaacctcccactgcttgagccctgctacctccttaatgcctactgtatccagtggctgacccagccgcacccggcaactgaacagttttgaaagagtgacaccaccttggcggccggtttcactttaaacttctcacttcacatcttcaatggacagtcagtgctgcccagcagtcctgctacagctgcctccccctgactttccctttcagctactgccttgaccccattcttccctgtgaaagtctgggcgtcagaagactggcttgtctgtcaccaccctgtcctccagcctgtcagcttcctgcacctgtagttgtgtcccatccagcaaaggcagaggggtttgtgctcctcatcctgcctctctccgtttgtatttcaggtcctgttgtttcttgcatggtcctgcagccatctctttgctgcagaatttctccccctctgctggttcattctccttggcctgcagaggctttgtcccccttctgaaaaataagctctctctgtccagacccccttcttgctgcccctgcccctctgtgctgcccctgttctaagcagttgccctttcatccctgttctctaggaaggctgctcgtctctcacatctgtctctatcttgccaagtccggtggccagttctgtcttcctttggtggatctcagtggtatttgcagtggttgtccttggcctttttgaagcttctcctctaagcgtctgtgccactaacctctgccgattgttctccccctgccccatgagctggttcttgttccatttgggtgggtcttgctgtgaatgttgacggccccaccaggctcgtctcttaactgtactcaactcccccaccccacagaatctctcgcagcctgggctttgagctgcatctgtgcactgccatctctgcctgggtgtcaaacaggtacctccaaccacacaggcacggagggcacccagggtctgctgcccctcgctgcctggtcttcttcttgccttctcatctgcccaggcacccagacctctcctgtggaaatcagccctttccctcacatgcacactactagcaagtcctgtaagttccacctctgaagtgcatctcaggcccggccacatctcatcccctcctctgccgccaccctcatcatgccaccatatggcatctgcccaactcaccccaagagcagccttcctagagaagatcttttaaaaataaaatcagatcatgtccctaccctgcagaaaactttcctgggtcttccagtcacaatccggttaaattctaaattcaggctgggcatggtgggcatggtggctgatgcctgtaatcccagcctgtaattccagcactttgggaggctgaggtgggagaattgtttcagcccaggagtttgtgagagcagcctgggcaacaatgggaaatcctctctctacaaataatttaaaaattagccaggtgtggtggtgcacacctgtagtccagctgctcgggaggctgaggtgggaggatcgtttgagcccaggcaatcgaggctgcagtgagctgagactgcatcactgcactccagcctgggagacggagcgagaccctgactcaaaaaccctaggccaggcatggtggctcacacctgtaagtaatcccagcactttgggaaggcaaggcaggtagatcacttgaggtcaggagttcgagaccagcctgg

SEQ ID NO: 16862 - DNA, 9905 bp, Human
tgagaaggctaagaatgcgccacttcctaagtgcctggcctcaccactctgtgcctgagtttccttatctgtaaaacgggtatgatggcaacacctaggttggagggtggttataggactgaatgagtctggataactgagtacttggccacataaggctggggaattgctggtgggaggcggggtgtattactgctgctgcatgaccacagggattggtgggaaatccagggtctggacagccaagccaaggaagtcaggaacctagagggtatggggaacgcgatttaacaattagccagcattggccgggcgcagtggctcacacctgtaatcccagcactttgggaggccgaggcaggcggatcacgaggtcaggagatcgagaccatcctgactaacacggtgaaaacccgtctctactaaaaatacaaaaaattagccgagcgtggtggcgggtgactttagtcccagctactcagtaggctgaggcaggagaatggtgtgaacccgggaggcggagcttgcagtgagccaagaccgagatcacaccactgcactccaccctgggtgacaaagcgagtgagactccgtctcaaaaaaaaaaaaaaaaaaaaaaaaaaaaaaaaaaaaaaaaaaaagcattagctgggcactgtggctcacatctgtaatcccagcaccttgggaggccaaggcgggtggatcacctgaggtcaggagttcaagaccaccctggccaacatgacaaaccctgtctctactaaaaatacaaaaattagcccagcgtggtggcacgcacctgtaatcccagctactctggaggctgaggcaggagaatcacttgaacccaggaggcggagttttcagcgagccgagaaggagccactgcactccagcctgggcagcagagtgagactccatctcaaaaaaataaatagctaaataattagccagcattgttatgagttaaagtctatttgcccgcatgaataaataggtaaataattagccagcattgttgtgagttaaaatctatttgcccgcatgacagagtgagactctgtatcaaaaaaataactaaataaagaattatccagcattgttatgagttaaagtccatttgcccccatgttatgtgtgagcagccaagacttaaacctcaggaaaggtgggacagaacccttcccacagcgtgcctccttggcctagagattgaagtctttgtccctcacccttccccaagctgactcagcccctggagcagagggcagacctggctgggagtacaaagggcagctggggcacaagtgggcaactgcagctgtggcctgcagggggccagtggtacacctgtgcctgtttagcctccccctctggtggctgcagaagagccagtttcctcacactgtccatccagggtcacaattacatccattcacagtgacttcatcacacccacccaccatctcacactgtcacatacacaatcatatccactgatagactgcacacgcagtggcacgcttaaaccgtcacacgtgctcttgtccatgcattcattcccattctaggcactgtccgggctcggcacggccccgggcagaaccttgcaggaagtggagctcacagcctcctggagttcagtgtgggcagacagacattggccaataacttcagtacaagtggagctgaggcgtcagggaggacctccccgaggggctgaggcctgcagtggggagccgttggagacttgccgaggagggcgagggcgcaggcccagggctttgcagctctgcatcttgagagcctcggggcggccccctttcctcccgccctatccgggggctgaaggaggaggcgcccttaggggacgggaccgtcctgagctcccggcgcatacctgggggcaggagtggcaggcgtgtcgtgtggggcggggcgagcctgtcagagcagggccagcccggagctcgcaactcgcggggcggcgctggccgcggcggccgctgcccggggacgggatccggatctaatcctccagtaatctcgctgaggcccgaaccagaggcgggcggggacatccgcgccgacgcggccgctggcgccgggacggccctcactgacggtcttcggtctccgccccgacatccggcctcggccacgtggtgggcggaccggggcggtcctgagcctgcgacctcgcaggcgacctcgctggaccctaagtccaggccacagtcagggaagggcgctgagaggcgagcgtgagcccagcgacaggagagtgaggtgggggccctggggagggatagagggactggggctccgtggcttgaaagccgggcaactgggaggcgttggggtttttcttgtttgttttttgtttttgtttttgcctttttttttttttaggagggcggggggagtacaagtctgggttcaaaccttgctcagctactctatgagctgtccttgaacctctctgagcctctcagctttctcctctgtaaagtgggcattctgagcacaaacttcatggggctcttttggggattaaataaggaaatgtgctggaagcagacagcccagcgcctgaaacagaatgggtgctccttaatgggggctccgaaacacggtatcctacccctgtgggaagtccgggagccgccgtggggacaggctgtgtgcaggagctcaccatttccagggtcttggaggggtagttagccattcactttgcccccagctcaccacgcgcagcgccatgaccagcaagggtcccgaggaggagcacccatcggtgacgctcttccgccagtacctgcgtatccgcactgtccagcccaagcctgactatggtgagaagacggtggttccagagcctgtgacggggcctaagggacggggactgtgctctaaaccagcctccaacccctgtcacccagctgagccccactctgctgtcccaaatggctccccaacccctccagccattccccaagtaaatagactgaggcagcccctccaggttagggaggaaccctttccccagagactctgctgctgaccaaggttactcctggcagctggttaaagaaaaacttcacctcactctccagggcaggagtggtgggggaagcctgaggcagccacagggaaaggagaggccctccagaagcccactggggctggacaaaggccacagcccttagggagtcaagcttggtggctagggcctgggaggtggctcctgcctgttatcccagcacttcaggaggttgaggctggcagattgcttgggcccaggagttcaagactagcttgagcaacatggcaagactctgtctctacagaaaaaatacaaaaattagtcaggaatggtggcacacctgtagtcccagctactccagaggttgaggtgggaggatcgcttgagcctgggaggttgaggctgcagtgagccgagatcgcaccacttcactcctgccttggtgacagagtgagaccctgtctcaaaaaaaaaaaaaaaaaaaggaaaagaaaaaaaaaaaacttagtggctgggaattgtgtacatgggtccaaattcctcctctgtgattaatcagctgagagatggtgggtgaatctcttcatgtctctgtgccatagtttcccatatttaaggaagataacaccttcctccaaccctgtgtccagacatccccctggacttccagaaagggtcactgagtagccaaaaatatcttctttcttggggatggaaatgcaagcatctctgagggatatggagtgtgtcggggaggcagcagcccatttctgggtatgctccactctccgggctgcctgggctggtgggaagctgtgggtaggcagaagcagccccaagacactctgtgcctccaggagctgctgtggctttctttgaggagacagcccgccagctgggcctgggctgtcagaaagtagaggtgagcctggggccctaagcggggaagggaggtgggcctgggcacttcctcaccctgctcagaccacctaccctcctgaccatctccaggtggcacctggctatgtggtgaccgtgttgacctggccaggcaccaaccctacactctcctccatcttgctcaactcccacacggatgtggtgcctgtcttcaaggtgtgtaaggggctggggaggtgggcagtgcaggccttggggacagacatgatgcagaccccaggattcaacctcaagttgctcatggtcctggccccagtcctgacactaactctcaacatccttatgacattacaccactcaagcagccttcatccagcagcaagttctgggccagagtggggtggggactggggggtgggaagcaggagacagcaatgggggatggcaatcagctgccttcttcagcccccgtctttcctctcccaccactccacctgtcactccaaccctatggtgggctcctagggcagggccactgttgaccagagtggattaatggctaaatttggggtttgggcccctcttcccatccctgcccccaggaacattggagtcacgacccctttgaggccttcaaggattctgagggctacatctatgccaggggtgcccaggacatgaagtgcgtcagcatccagtgagtgtcctccattcctactcctccacaatgtccccactggtccagtggattgaagcaggacctgagggggtgattggagaaactcaaggccaaggaacaccgtgacctcttggacaggaactactgccatgaccattgcatggatagggagattcagaccagagaggggcagggactttctggagtccctatcagggtgtggcagggtaaagtccaggacacaggactccagcctgctggccctgcctgtggggccagcctgcgcatctggtggctcccccagcacctggcttatgccccctcaggtacctggaagctgtgaggaggctgaaggtggagggccaccggttccccagaaccatccacatgacctttgtgcctggtaggagtggctcagatacctttgggaaaggggagggtggggcggggcagcctcctcatctcacgtccctgctgcttttacagatgaggaggttgggggtcaccaaggcatggagctgttcgtgcagcggcctgagttccacgccctgagggcaggctttgccctggatgagggtgagcaggttggcaagccaatgagcagccaggcagggagtaggaggctgctagtggggactgagctgctccaccctctgaaccccctttccctcctcaggcatagccaatcccactgatgccttcactgtcttttatagtgagcggagtccctggtgtaagtatgagcttggagggagggctcactctacaggcgggaggctaggccagaaagggcacggtcctatgcagggttgcacagcaaagttgaggcctgagaaggccttgaacccagggcctctacctcccagctctttcctatctgagcttctctgagggcaagccctgaatgggcagaaaccagctgtatgctacgggccctgagtggggacaggaccctgccagaggagcctggaatgagggggagacctgggcccaccccaggctgattgtgtctccagcccctcaggctgaagacactgccttccccctacacctccccaggggtgcgggttaccagcactgggaggccaggccatgcctcacgcttcatggaggacacagcagcagagaagctggtacgtggcaccccaggagggagtctgggagttcaggaggctctatcctgaggccactgtcccatttaacctcatattctcatagcacaaggttgtaaactccatcctggcattccgggagaaggaatggcagaggtgaggcagcctgggaggcagtggggtggctctgggaggcggtaccacagaggatagagtctgagccacctcttttatctgttgctgccgctaccctgcccccacaccacaggctgcagtcaaacccccacctgaaagaggggtccgtgacctccgtgaacctgactaagctagagggtggcgtggcctataacgtgatacctgccaccatgagcgccagctttgacttccgtgtggcaccggatgtggacttcaaggtgccacctccacctgggtttggaggagggatcctgggtcctcagtcttgtcctagaggcctctggaaagcctgaaggatcagctcgtctcccttctcttaggcttttgaggagcagctgcagagctggtgccaggcagctggcgagggggtcaccctagagtttgctcaggtatggacttgggacatgtgatgggagagtgtgggagccgggggagacccaagtgtgcaacagtggagtgtgtgcttggtgtgtctgcatatgtctgggcatttctttatctgtgacagacacattttattccaacaagcattcattgtagaggccactgtgggtgctggggaatgctgtggggagtaaaattaggcacagttcatgcccttgtatggtgaaacggggagatataaatcaaacatttatgtgatattacttttttctgagagaatctcactccgtcacccaggctgcagtgcagtggcacaatctcggctcacctccgcctcccgggttcaagcaattcttgtgcctcagcctccagagtagttgggattacaggcacctgccaccacgcccagctaatttttgcatttttagtagagacagtgtttcaccatgttggccaggcttgtctcgaactcctggcctcaagtgatccacccaccttggcctcgcaaaatgctgggattacaggcatgagccactgcgcccagccgtactttcatataacccatgtggtacaggaaagggtggccccttgcactctgaaaacctgtaactggagtatccaactagtctgagaggtctgggggagccatcttgaggaaggggcacttgggctaggatctgaaggatggacaggaggtaagtagacggagggtgggaaggtcccagacctaggacatttgaggggctgaaagaggacctgtggctggactggctacccagatgtctgggtaggtgaaggagtgggggtggggaggtgttatgtactaggcacagcccactctatgggaaatagggcaagatgcccaggcccatgtcctgatcctgccattcttcctgtccctcagaagtggatgcacccccaagtgacacctactgatgactcaaacccttggtgggcagcttttagccgggtctgcaaggatatgtgagcacgctggccagctctcctcacagcccagccccctactcctctccttcctgctgccccctcccttctccctccttctcccacctctttcccaccttcctttgccccttcaattcttcgctttctccctccccattcatcaggctctttctcctacaggaacctcactctggagcctgagatcatgcctgctgccactgacaaccgctatatccgcgcggtgagccacttgcatatagtgcctgggcagtggactgggcctgagtgctggcttttccctaacggctcttcctcacccctgcaggtgggggtcccagctctaggcttctcacccatgaaccgcacacctgtgctgctgcacgaccacgatgaacggctgcatgaggctgtgttcctccgtggggtggacatatatacacgcctgctgcctgcccttgccagtgtgcctgccctgcccagtgacagctgagccctggaactcctaaacctttgcccctggggcttccatcccaaccagtgccaaggacctcctcttcccccttccaaataataaagtctatggacagggctgtctctgaagtactaacacaaggacactcgtggagcaagaattttccttttcctggggacatgttaccatctccatttcacagatgaggaaactgagcctggctgttagcacttccccactaccccacactgctctgtgccccttgacacagcacacccattcagtaccatccagccatgtctgtgcctagcaagaaagggccacagttcctatttgagtggccaccatacttagttctgacctatcagggattccattcccattaaagagggatactaaggacctcaggaaccactcccatcttcctgggtgtacatctgggatcctgagacagtaccagaatagcaccagctgggcccctgctagatgaggggcaggcagagggccaacggtgactgctggctcctgtcaaaacctgtacacccttgtgttggcagcaggggccacagaggggcagggtccctggtagactaggtcagttcatcttagaggcctcagcaccctggatctgtgtgtgcagaggcccaggaactgggctttcatctcagccttgctaggacccccaggtagtaccaagagtaaactatggccccagtagcagagcctgatctagccagatctgctctatcctgttctgacttccctgagcatggggcaggagagacagggctggggtgggatagttggattttttaagtttctagttgtagccagaagtccagagcctggctctgggctgcaggcttagtactaatagaaataacaatcactcctgctcacagttgacaaggagccaggacttgactggctttttttttttttttttttttttgagatggagtctttctctgtcgcccaggctggcgtgcagtggcgcgatctcggctcactgcaaactccgcttcctgggttcacgccattctcctgcctcagtttcctgagtagttgggactacaggcccccgccaccacgcccagctttttgtatttttagtagagacggggtttcacctccgcctcccaggttcaagggattctcctgcctcagcctcccaagtagctgggactacatgcgcgtgccaccacggccggctaatttttgtatttttagtagagacggtttcaccacgttgaacaggatgatttcgatctcttgacctcaggggatccgcctgcctcggcctcccaaagtgctggtgagaggtgacagcgtgctggcagtcctcacagccctcgctcgctctccccgcctcctctgcctcggctcccactttggtggcacttgaggagcccttcagcccaccgctgcactgtaggaacccctttctgggctggccaaggccagagccggctccctcagttcgcagggaggtgtggagggagaggcgcgagcgggaaccggggctgcccgccgcgcttgcgggccagctggagttccgggtgggcgtgggtttggcgggccccgcactcgcactcggagcagccggccggccctgccgtccccgccgtccccgggcaatgaggggcttagcacccgggccagtggctgcggagggtgtactgggtcccccagcagtgccaggccaccggcgctgctctcgatttctcaccgggtcttagctgccttcccgcgggtcagggtttgggacctgcagcccaccatgcctgagcctcccaccccctccactggctcccgtgcggccccagcctcccccatgagcgccgccccccgctccacggcacccagtcccatccaccacccaagggctgaggagtgcgggctcacggagcaggactggcaggcagctccacctgcagccccggtgcgggatccactgggtgaagccagctgggctcctgagtctggtgggggacgtggagaacctttatgtctagctcagggattgtaaatacaccaatcggcattctgtatctagctcaaggtttgtaaacacaccaatcagcaccctgtgtctagctcagggtttgtgaatacaccaatggacactctgtatctagctactct

SEQ ID NO: 16863 - DNA, 48181 bp, Human
  misc_feature (1)...(48181): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatctatgaaatagtcgagatgtcaaagaacagaattaacatggtaagagttttaggagtgtatatttaaaacatttaaactatgatgtagagaagtggcttgaaccaacctagaaggctttttaggctgtgccatgttttaggctgtcagtttctgtgctgttacctgttattgagcttgtctgattagaaagtaagcagtctgttaccgatgactcggattagttacccaatgggagttcttttctactggtgctatctaaaatggttataaataattaaattctgctattttcagaaaatggcaattacaaggtgtgcgatagacatttgtaaagttgcccactttacatcttgggtggtaatacagtttttactctgaaaagttaatctgagggacaagcacctatgttgacagtcaggaaaaatgtctgtcttaggtacatttgccgttttgttgccccagtattttctggccagtgaacctcttttgtcctggagaagggaaaagattggatgtattgtgtcttagagcaattgttgagcactgtttccccacaaaccttgttttgttttctgcaggtgtaatttctttgttagtgatatggacccttatttagaattgggtgcaaatatttacctcaggctttttgcatagagcgcttataatttatggtagcaaaacctgtgcacctcattttggcagcccatggtcacatgtagattttaaaatggaaattaattaaagatttagttacttggtcatagttggcaggtttcaggtgctcagtagttacatgaggttagtgactactgcattggacagcacagacaagcacagatagaatatttccatcattgcagaaagttctgttgtatagtgctgaccgtagaatatgtagttcagttttgacagcctgtgctacacacacacacaaacacacacacacacacacacacaaacacacgtacacacacacgcacttcataatttgcaagcttttgtggtcttgtaaaaacttgaactcagtaattcaatctcagatttacatagtaggatattaactttgatgtcatttttcatttttttaaaaagaaatatcttgagttattttttctttacaatatttctattgattgttgttagaacaggcatgtaagaaaaatatgctgtgttccatttgtctcacaaaaggcaaaaatatactgtttttgtggttacttgtgtttcaggaagcaagaggctactatgagcagactggagttggacctctgcccgttgtgctgttcaatggaatgccctttgaaagggaacagctagaccctgatgagttagaaaccatcacaatgcataaaatcctggagaccaccaccttcttccaaagagcggtgtacttggtgagtcacgtttcaaggctgattttttaaagagaacagttggcttatattttttgttgcctctatagtaggcagtaaaattcttagtatcactatttgggaggctgaggcgagaggatggtttgagggtaggaagtctgagaccaacctgggcaatatggcaagaccccatttctaaaaaagaaattaaaaaattagctaggcttggtggtgcacgcctgtagtcctagctactcaggaagcttaggtggaaggatcgcttgagcccaggagtttaaggttgcagtgagctgtgattaccccactgtaccccagcctgggtgatggagtgagaccctgtcccgttaaaaaaaacaaaacaaaacaaaaaactattttctgtaagtcacttgtaattggtttgcaaactcttggcaagtcctatgatgaaaatattcataaatcttctatatatggtaatttaaataactagtattattgatttcaggattaaatgtttattttaaaaattgcaggcagttctaagaaacatttattctatttgtagggaattttggctttggagagactcaatattatttttcatttatatataaatattaatatatatagttcttgagatataattcagacagtataaaagtcagccttttgaacggtacaattcagtagtttttattctctacacacagttatgtaactaccacctctaattttcagaacattatcatcacccccaaaagaaaccccacatccagtagcaattactcctctccattttgcccattttgtcctactcccagccaccctgccattggcaaacacaaacctactttctgcttaatagatttgcttgttctggacgttgtatacaaatcaaatttgcagagaacaggatgatattggacagatagcttgttgctcagaaccccaactctctaatcatgtggttggtctttctagtgttaccagcccccaacctgagtcattgcattagcacagactctcgggccccactgtgcatcaacccgtagtataaaccaccatgtgtgtcctaaggggctcaccatgaatgacaaagacactcctatcactggatttagagtttacatcccagaaactagggccagccaaattatttaccacacacagtccttttctcttccctcctctcattctggaaatatgcacatggtggtactctctcatgtcccacagatctctttatgttcctcagactggataatctcagtttatctatcttcaaattcacttattctttcttctgtcaactaaaatctgctattgagcctctctagtgaatgcttcatttcagttattataaatccagatttctatttggttctttttgataatttcctttggtttatagatattatttggtgagatgttggtcttaaactttactttggtagacatggtttcttttagttcttgaatatatttgaaatcatttatttaaattctttttctaattaagtccaatgtttggacttactcagaataatatgaacataatgtaagaatatacattacacattttacttatataatagtaagaatagtatgtcttggcctcttctcttcctgagtatacaccatacttttttctttctgcatgtctttttttttttgtttctgatacagggtctcgctctgtcacccgggttggagtacagtgacatgatcttagctcactgtggcctccaactcctggacttaaatgatcttcccaactcagcctctcgagtagctgggactataggtgcatgccaccatacatggctaatttttgtatctttttgtggagatgagatctttctatgttgcccaggcaggtctcaggtcgcgaactcctgggcccaagtgatctttccgccttggcctcccacagtgctgggattacaggcatgagccaccatttctgcatatttaataattttgtttttgacaactaggaatttgaaataatataatgtgacacttcttcaccgtaccagggtttatgttgttctttgttgttgttgtaactgttatttgtttagtgactttcctgaaccaattctttcttttattttctttcctttttttgagacagagtttcgctctattgcccaggctggagtgcagtggtgccatctcagctcactgcaacctccgcctcctgggttcaagtgattctcctgcctcagcctcccgagtagctgggattacaggagcacaccaccacacccaactaatttttatatttttagtagagatggggttttaccacatcggccaggctctaatttcagaacattggtctcgaactcctgtcctcaagtgatccactcacctcggccttccaaagtgctgtgactacaggcatgtgccaccatgctcggccctgaaccaattccttaacatctgtattctttttcatgtgtggcttctgaagtttcagcttgtttaacttactggtcagctgatgaacgaacagagatttcctttgatgcatgaattcaaaaagtctcccagttttccccaagggtctctgtgttgtgttggggcacactttccacactcaaccaggcagttggcaactctgccttagtcttccatttttgcttgcacagagccccaaggttagaggcaagggtttaagaccttctaagattttccctgggcattcacgtacccctgggcatggtgcttatggtctctcaaattccaagaagtttgtcagagcttttcaaagtcccttatggacatcccattccccagcctttttttttctttgttttttgaccagctttgtgttagcccatgtgttatctgccacctcaggcagctaagatgttaaacaattgcccagttgtgtttgacagatacccccagggaaaaggctgttggcactgagtgaggtctggttcagcccaaataaagagaacccctgagaattctctagtgtcctagttgttttattttggggccattgattttcaaggctttgtgcagctggggagatgtaaatagtagtggggcaaattaattgttacaaaggtcactttccttaccaaaactttttttgagacagggtctctctgtcacccaggctggagtgtagggattgtgatcatagctcactgcagccttgaacttctgggctcaagcagtcctcctgccacagccttccaagtagctgggaccataggtgtatgccaccacatgcagctaatttttgtatgttttgaagagttgggattttgccaggttgcccaggctgttctccaactcttgggctcaagcaatttgtctacctcggcctcccaaagtgctgggattataggcatgagccaccgtgcctggccagtattccattattaaaaataggnnnnnnnnnnnnnnnnnnnnattccattataaaaaataggccgggcgcgatggctcatgcctgtaatcccagcactttgggaggccgaggcgggcggataatgaggtcaggagattgagaccatcctggctaacacggtgaaaccctgtctctactaaaaacacacaaaaaaaattaggccgggcgcggtggctcacttgggaaaccgaggtgggcggatcatgaggtcaggagatcaagatcattctggctaacatggtgaaaccccatctctactaaaaatccaaaaaaaaaaaaaattagctggacatggtggcgggcgcctgtagtcccagctactcaggaggctgaggcaggagaatcgcttgaacctgggaggcagaggttccctctgggaaccaagtgcagccgagattgcgccactgcactccagccagggtgacagagcaagactccgtctcaagaaaaaaaaaaaataataataataattagctgggcgtggtggctcatgcctgtaatcccagctactcgggaggctgaggcaggagaatcgcttgaacgcaggaggccgaggttgcagtgagccaagatcgtgacattgcactccagcctgggcgacaagagtgaaactctgtctcaaaaaatatataagtaaaataaaataaacatttacttcattccctagtattggacattacttctacattttcactagttacagacagtgctacagtgaatattctaatatgtatatacctttgtacattgtcttgaaaaataccaagtactggaaaatttgaactaaatgcactacaaaaagatgtgttatcagccagttgtggtggctgacgcctgtaatacaacacttcgagaggctgaggctggaggattagttgagcccaggagattgagaccagcctggctaacataacgagacctcatctctacaaaataaaaaaaattagccaggcattgtggcatgcacctgtagtctgagctacttcgggagactaaggcaggagggttgcttgaggattgaggctgtagtgggctataatcatgccactgcactctagtctgagcaacagggcatgaccttgtttctttaaaaagaattaagagatatgctatgccagtggtatgaaattcaaaacagaaatgtaaatgaagagaaacttttagccatacacccctgtgctgtactactcatgatttcttcctcaagacaactaccgtgtgtgtgtgtgtgtctgtgtgtgcacgcatgtgtgcatgtgtgtgtatacaagggctggtcagaaggtgttacatttacaattatttattttttttaattaataacttttttttttttttttttttacaaatgtttattatatgtacaacaggcttcaggacaacacttcattccagctataggtggcaaaagatgctatggcagggaatacagatgtttaaatatgaatgaaatcaagggtcaccatctcctcaggcacaaggcacagcttacttgttgccagatttttttttcttttctgtttttgagatggagcctcgctttgtcacccaggctagagttcagtggtgtgatctcggtttactgcaacttctgcatcccagattcaggtgattcacctgcctcaggctcctgagtagctgagattacaggcgcccgccaccatgcccggctaatttttgtatttttagtagagacagggttttgccattttggctaggctggtcttgaactcctgacctcaggttatccacccgcctcagcctcccaaagtgctgggattataggcatgagccattgcacccggcccagatttcttaatttcacctgcagccaggggtcccttccccatagccttctattttagctcctatttttgtttcttctgctcctctttttgtttctgcttgaaagtcttaccttcctcgtccatctccttggcctgcttcttgggctgtttcagcagcaccttcacaggcagacatggcgcctgccacaccttccccaggccctgcaaccctacttttaaaatttttatagactttgccaaattcccctccttgaactcgatgggcttctaattggagtcaagtagatttataatattgaccaaagttgtatacatgggccaacatgtacagtgagccatctaatatctttgtcttttgatttgtatgattggttcatatgctccttattaaatagctacaaataatgtctaattggaattatttagacttgaatgtgtatatttgattcacatcttttatcttgaaaatgacttcaggtcgggcacggtgagagaggatctcttgagcccaggagtttgagactagcctgggcaatgtggtgaaaccccatctctacaaaaatacaaaaattagctgggtgtggtggcacatgcctgtagtcccagctatttgggaggttaaggtaggaagatcgcttgagccctggaggtcaaggctgcagtgagctgtggttttgattatactactacactccagcctgggtgaaagagcaagaccttgtctcaaaggaaaaaaaaagaaaatgactttaaagtatacttgtgtgttaaatattttaagtttgataaatctgcacatttgcacagttgttgacacatggctctgagatcaccttcaagaagtataactatttctgtaatattagctgtgcaaaagggaagaataaatgacaatgatttcctatcctctcattgtaattctgactctggagatgtaagtttatttggatggctgagattgaacaaagatgggagtggtttttattacaaagtatattaactgcttgagagaagaccttttcctattttttttttttccttgggacagagtctcactctgtagcccagtgcagtggcatgatcttggctcactgcaacctctgcctcccaggttcaagtgattctcctgcctcagcttcctgagaagctgggattaccggcacctgccaccatgcccggctacttttgtatttttagtaaagatggcatgttggccaggctggtcttgaactcataacctcaagtgatctgccttcctcagcctcccaaagtgctgggattacaggcatgagccaccattcctggcctgggtttgcatttcataatcactttgcattagctttgtgagtttgagtaagttatttaacctttctgtgccttagcttcctcatctttacaatgaatgtcaacaatatctgcctcacgttgttgatagaggtagagatgctgtaggtgatgtgcccaggtatactcggcagtgacagggaccaataacatagtaacttctgtcttaactattattagcacagaggaagccatttataaagttaataattttttggttcctaatgaattattattgctaaaatttgctttaccctcccccctcaacctcctttttttttcttgcagggtgaactgccccatgatcaagatgtggtagagtatatcatgaatcagccaaatgttgttccacgaatcaattctaggattttgacagctgaacgagactacctggatttaacagcgagtagtaaggagcatttcaggaacaaccttatgctttttttgacttgtgcttcagaatctttacatttttcagattttaatattctgattatcttctgcagtgttcagaagatagcccaagattgtgacaaaattttatgtgtaaactctttgcacctttagttcataatatgagattctaaattcacaagagtttcctcctaaagaagaaaacatcttctgggcaaaaccctgtgaactttgaaaaatatttagtgccatttaaatgccaactaaacagacaatagatgatgagaatggacctggattgttcgcttctctagtcataaagcagttctctttcttcatcctcattctagagtcagtcagccataatgtcaacaaatatctcagtgaattttactctgagaacttaggaaggcctttagcagcttcatcaagatatgatgtatatgccataaaactcaaccttttaaagtatacaattcaatggtttttttaatgaaaaaaaccccacaaagtttgtgcagtcatcaccactgtctaatgatacatcattatcatcaccccccaaaaattccccagaattccatgtacctattagtggtcactctctgttcctcccttcccctatcctctggcaacaactaatctactttctgtgtctatggatttgcctattctagacatttcatataattggaagccttttgtgcctggcttgtttaatttagcatattgttaaggcttatgcatgttgttgtgtatgtcagcatttcattcctttttatagtccactttatggatagtccacatatatctgttcctcagttggtggacagttggcagttttctgctagaataccttataagagccaaatatgttaagcccaggtgcaatttgttccttgtgccttcctcgagattctgaggcctcttcagcaaacacctggaaataagatggaactgtcatcactagcccatgaaatctcactggggaaggaaagatgtgtgtaatgaagtcataaccagctatttattgttatagttgagtataatgaacatatcaatctatttatggttgttaacgtaatgcactatctctaatagacttgaaactgaaagtttgttttaggtagaggaaaaatacatgtatatatacacacacacacacacacacacactcctatacataagcacacacacactgaggaaaaagtgtaaatataggcttatatttgagaaagaaactacccagaaagtgagctttttcttcacagccgggttttcctttcttccctgaagtttcagtagagcaaggtgagcgtgttgtggctcttcatcctaagtgtttattgttttcatcatttttatttaaatttgaagggttgtctctggaatacacatgaataaggaacataatagcggttttgtttttgaatttccttttccattgagtgttgcagcaatgagctatgaaacagtgctagtccacagtggcaaagtgccacctgtcagctgaacatagtgcagacatcaattaggaggctctggcatcctcttgacctggtggtggtggcattgtcactcaggtttctttggctttggctgtcctggaacctttttagtaggatactaatttttaccagcatggtaaaatttttaattttatactaatttttatcggcatggtgtgctctcccttcccccacgtgatatcatggaccgtgtgtgacttattttctacggttttcctggatagtattctatggatagtaggtgttcagtgtgcattgtcaagtgacagtgtagatggatgagcatgtgcacagatgaataaatgagtgggtaggcaggcaagctgtgtctgacagactgtgatgagaagactgacatttgtatagggtgcaataatgtttaagattggggagattgttagagacagagagtttacagtactaggctgtaagaaattactgggtagtttagagcaagagaatgacttgatgaaactggaattctaggaataataatttgagggaaaatgagtaatgaggattgccctttgacactaattggagaagggacatatgcaaaaagagtgaaaatgaccttttatttctgttaagggtttaaaaggtgatattttgttagacctgaaaaataaaaatcagttttcttacgtattttctcttttacccctgcttcctctgtaggaacaggaagagcttactccactggttggactagggaagggagaaatgagttaaggggatctctttgagattgtcctccagttgacaagtgacaggaatgggaataggatgaattcagccattaaactgacacatacttatatgatagctgtgtgagatatgtatgtttccatcaaccttgtgtctttgatgtgtgacttcagtagggataggggccatgttgtgaagttgttcagtaaacatggaacttaatatacttcactcacgcatttctataaatcttatattatgatcaagtcaggttatcagttgaatattaagaatagattgaactggaactaatatatacgtatttcattttttctcccagataacttctttgtggatgattatgctagatttactatcttggattcccaaggcaagactgctgctgtagccaatagtatgaactatctgacaaagaaaggtaatccatttgaggcttattatcttgcattcaacatttttttgaaagtatttgcatattcatcttaatgtgcaaattaagagagaaaagggaaagagacttcataatttttcttatttcttataaagctttgagtctagaacatatctatttaaagtttaattctttgtatatttgttgaaagtatatatttgtttaaaaattcagatgtcttcataaattttgtattacctgttttaccttttgactaaagtcaaaaggaaaaatatttcatagttcaaatggaaaaacatttgtgatgtaaaaatgggttaatgaattaaaaatgactgtacagggttaatattattttggggtttataagataaagttggttttagaaagccttgtataatctttgaagctgattttatgcagaggtatttatttaggctaagattgtgtaaaatgacgccctgtagtggcggacagattctgtcgccctcgggtcagtgcttcagaaaagcactggctgttattttaagtcagctatttttaccgcctttttaaatccccgctgtggtctctccccaagagaagttctggtttctcagctgtatgtaaagtacaagcaattactccatttggttctttaaagaaactgtttcttagggtactgggacagcgccatgacaccgacaggactaagcagcaggaagaaccatagaccgtgttagccattgtttagactttcaatttttacagtaggcattcattccagaaatgatactttttttctactcttttctctttacctttgttcaggaatgtcctccaaggaaatctatggtaacttaaaacttcagaatgttctatttcttaattttcttctttggtttcagtgaccattgtaatttagaatttatcaacacttaattgtactgtttccggaatctgtgggtaacaggaagctatatcaatgtagataattttttttttttttttttttgagacagagtctcattctgtcacccaggctggagtgcagtaccatgatctcggctcactgcaagctccgccttctgggttcaagtgatttcaagtgattctcctgcctcagccttccaagtagctgggattacaggcacccgccaccacgtccagctaacttttttgtatttttagtagggatggggttttaccattttggccaggctggttttgaactcctgacctcaagtgatccaccctcctgaacctcccaaagtgctaggattacaggcgtgagccactgcacccggccaatgtagataaattttgtataaacatttgtaaagaattagtttcagaaaattacaaattagtatgattaaaaatgacaatatgttacccacatgttcaaaggctgtttttcattttacatgctaacagatgcccagaccagtgcattaatcagtagaattaatcagtgcatgttcctagtctgtaactaaactctgtggaagattcccctgctttcctatagtaaaggtttacgactttttcttctatctttattaagcttgtcattttcttctttttgcatggttcttacaaattatttggtcaatttcattttcagaatgttgaaacacagaatgtgcttctctcctctgactcaattagctgtttttgtttttctacagatgattcttttattaggccagtaactttttggattgttggggattttgatagcccttctggacggcagttactgtatgatgccatcaaacatcaggcaagtatctatgacttcattttatatttttgtttgtggctgtagttgtcttcatgggcttcgctgtgcggctaggattgttcagtgggagttgggagtcctgctttcttaatgctcgagggaacggagaattgtatctctagagatctgccagctctcaagaaaagagatctaagactacagtatccaggctttgttgaacgggatagattcttatagagaaaaaaataaatagcgagatcctcatcatagacaagttttattgcatacctgttcatgttcttggagcagagttgctccaacaattgtgttgtgtactgtatcggggagatggggtccttaccacgacagaggtctggacatgggggcagtagcacacaggaatggtagtgtgtgtgtttagtagaagtagatccagatgcactgagggatacacacataggtgttctgaaaagatatgctgccattaatagttgggcttgagtgagtggcaatggcaggtggttgggaagcagctgattcttctggagagtgtcatcgttagaggatgagatgtcaaaattctttttcctgggctgtttcagtttgcatcttcatccatacctcacaaccctcctcatggtcccctttccaccctgtacctgggaaggtttactgaaataaagaaatatccaggtggtttcagttttactcatatgccgagttcctttattgttcaaggagtggaccaaatgctgtggtcaatttgaagttagaacagggcagttctagctaagggcgatagttatatgtgaaaggcactctaacacaaatgcgtaaatcttcaaatggtagtagggtaggagaatggggaaggagagttgcattttttaataactattttaattgaagtaaaatgtaggttcacaagaagtgctcaaatcataggacacacagtgtcacaaagagaacacactcttgtgaccaccactcaggtcaaaaaatagagaattctcaagttcctgaaagccctcccacacttgtgcccacccacacttgtgcccagacactacgcctcttccctcttctcatattagggaataggtttgcctatcttttagtttattaaaatggaatgttatgcaatttcatttgtgtttggtttctttacccaatcttttgtaagatttattcatgatgttacaagtaggggtatagagtcctttttcattctgtagtattatatcatatggctgtaccacaaagttttatttgtttaagctatttgaaggacagttgggtttttagcttggtgctattataagactgctgcaatgaatattctcgtatgtcttttggtacacccaaatataaatgtctgttgcttatgttattggtacaagcccttttttggctttgtgtgtcctgggtgtattcttccacttggattcttgtcttttcacccagggagagattgaattgtactaggaatgtgggaaggctgtatgaatgaagaagggtttgaggagagcactgaaaacacttctaaaacaagtgcgttagaagaatacaaaatgtgtggcataagaatataaactgtgttgggtaaagataggactctgagggtctgtaatttatgctatatttaccgggaaggtaagaaatgaagttggaaaggtgggctgggggccacttcatgtagggttttgaatgcttgatgatggcatttttaattttattttgaatgaggaggagaactatctgagactttttttttttttttttttttaatgagacggagtcttactctgtcatccaggctggagtgcagtggtgtgatcttggctcagtgcaacctccacctcccgagttcaagcgattctcctgccacagccttgcgagtagctggaattacaggcgcccaccaccatgcctggctaatcttttgtatttttagtagagacagagtttcactctgttggccaggctggtctcgaactcctgatctcgtggtccgcccgctttggctttccaaagtgctgggattacaggcatgagccactgcgcccggcctgagacttttaagagagatattatttgctacttattgaacatgactgatgttaatgctgctttttaagttcaaaaatatctacaatatgactcccgtttcccattttgtgaacagaaatccagtaacaatgttagaataagcatgatcaataatcctgccaaagagataagctatgagaacactcagatctccagagcaatctgggcagctctccaaactcagacttccaacgctgctaagaacttcatcaccaaaatggccaaggagggggctgcagaggccctggctgcaggagctgacattgcggagttctctgttggggtaaggctctgagcctctcatgaggctgccccattttgtctgccacggaagctcacccactgcagcttacgtgtccggttcatgatcacgatttgtcattttagtcctgagtctcagggaatttttttttttaatttggaagtttccctttattacttttaaccttgcctagctttcatgtggtgcatgatttgagtttttgtgtgttttaagtatggagccatttgttatgcacagtttttaagagagacaatatggcttatttatagagcaaaaaacggagatttgaaccacttataggttcaaggcttatatgttcttgatgtgtttccagaataagcctgtgtttattcatttatattttatgttacttatttttttgacacagttttgtagtttttaaattttttacagaatgatgagtatatactatttgacgtttgagttaggaaaacaggctgtcactggaaattagcaggatttaaaaatgcagagtaaaggaatgatgaatagtctgctagtcgaacaaatcacaggaaaagataaggaaatagcagttactctaagtagtagggagatggcggggagactggagaattgacacatcttaatgttaattatgaaaattagttattactttccagggaaagaaatttttatggtttattcactgtgtttatttgtttatatggtttgcttagtaacgactatttttccttaataatgattactttcctagggaatggatttcagtctttttaaagaggtctttgagtcttccaaaatggatttcattttgtctcatgccgtgtactgcagggatgttctgaagctgaagaagggacagagggcagtgatcagcaatggaagggtgaggatttgtcaagcttgacttcacattagatccgtgaacagtctttgcagcattctcctctgaagctagtaaactcttcagacagagccactcttttttcaaaggtgattggggcttatgaagtgccattgatgtttctgcctcctatttccaaggagctgtgctttttgacatagacaaatatccccatatggagccttcctgctgtcggtgagagtgtggtggctctcagaaagtcagtcagtatggactttgacacataaagtagcctttgttgtttttattcaggtagaattaatgaaaactactttacgattttattttactttgtccttgaggaattgataagtaaataactacaagtatttgctttgggcttcactttgtattatttcactgattttatctaaacatgtacctgtctcaggtctttaagatgttctggcgtatgaggtagcctgaggacgccagagggttccttaccagcttgctgagtgcaggcagccttccagagctaagcgcctgctcttctctccttcacagatcattgggccactggaggatagtgagctctttaatcaagacgatttccacctcctcgaaaatatcatcttaaaaacctcaggacagaaaataaaatctcatattcaacagcttcgggtagaagaagatgtgtaagttttgccataggaggaattacaggggttatataattggactttcctcattgatcagttagaattatatgttgttactcatactacatatcccaaggagttttatttccagtttaaaatctaataatactcttcaattccagttttaatgtatgcttctgttgaaacaagataatttattttgtagggtactatttaaggaactgaactagttctctctttttatttttataatttttggttgtggaaaatttcaaatatatgcagaagtaaagaggctagtttatttattacctggaatacttatgtaaagtgatacttttcatcattatctatttggttacccttcagttttattttgttcaggaaaggaaaggcagtttaaatgtttcttttatttaccagtgcagaatactgagttgtttcccttgtatcttcaaaggtgatgatgaattggttgttgtcggtttttaattttaattttcagtgttattataagctgatgtgttttagtgtgttattttcttaatggaagaaaataaattgtttggatggaccctggagtccattgttacatatatgtagtttctgcattaaatatcaaatgactatgtagttggaggatctatttctatgtttaattgtttgaggaaccacaatacctttcccacagtggctgtaccattttacattcccactggcaatgctcaagggtgccggtttctccacatcctcacaacacttgtaattttctggggggttttttgtttgtttgtttgctttttataatagccatcctcgtgggtatgaagtgctgtctccttgtggtttgattcacatttccctaatgattggtgatgttgagcatcttgtcatgtgcagattggccatttatatatctttgggaaaatgtctattcaagtcttttgcccatttttaattgcgttttttttttttgtcgttgagatgtagcagttctttatacattttggatgtcactttcttactagatacatgatttgtaaacattttctcctattctgtggagatgtgttctttgatgcatagttggaggatataaaattttaaagttctgcttgcgaggttgcaatgagctgagattgcgccactgcactccagcttgggtgacaaagtgagactgtgtctccaaaaaaaaaaagttctgctgggtttttttcttacatcatcatgctgcagagttcaagagcatgttttagagaagtgttgacttggatagctgtcaaagtcagctgttgccatgtcttgtatgacctgggaagaaatcttttctcattttggccaatactggggctacaaataaggaggatccatccctcttacctcagtggctcctgagtgatgccccttgtcccgacctgtgaaatgcttccctgatgtaggtcaggaggtactcgtgactcgaagcagccatgtcacaggcataggcttggtgtggcatgctgttggaccactgcagggagctccttggggtcttcttgggctatataactgccagactgtgcctagaagacttgccttttgccaatgagagatggctctcgatctttcctgggtgaatttagggaaatcaggtagtcatggggccaaaagactaatgctaaaactcttaggcttcccaaaattaccttgtctgcatcaggttttcattagcgccagagctgctccaccttggagtggcccccttccccgtgacagccacagctatcattcatgacccagtctgcatccccaaggctgccctgaagcttggctgtgtatactttgatcattgttcttcatcagccttcagggagtttcttgttggcctgctcactccagtccacgtaaccaagtgccccttgacatgttttgtagccgtgttgacacatcacaggaagagaatggcctgtattatatatatttggcatttatattgagaagttgaaccaaaatagttaattttatatatttgctgggttcataggaaatgtatgtaggcttaattacagttcaaatacattcacagtgctcttttaaaattcttattcaggatttagtctttggttcagcaaattggagtgttttttttttttttttttcaggtttagttcaagatctttttcagttagaaatcaattttaggctgggcgtggtggctcacacctgtaatcccagcacttgggaaggccgaggcgggcggatcatgaggtcaggagatcgagaccatcttggctaacacggtgaaaccccgtctctactaaaaatacaaaaaattagccgggcatggtggcgggcgcctgtgatcccagctactcaggaggctgaggcaggagaatggcgtgaacccgggaggcagagcttgcagtgagcgagatcgcgccactgcactccagcctgggcgatagagtgagactccgtctcaaaaaaaaaaaaattaattttagaagaggcagggacaataaaattctttttaaagtggtttacttcagtgttaattgtaatagtgaaattagaaacaacacagatgttcagtagttggcttaatatttagattattttgtatccataaatgtaacattatgcagtcataaatatattgaaataggctgggcacggtggctcacacctgtaatcccagcactttgggaggttgagatgggcagattgtgtgagcccaggagttcaagaccagcctggcctgtactaaaaccctgtctgtactaaaaatacataaaaattagctgggcctggtgctgcatgcctgtagtcccagccagtcgggaggctgaggtgggagaatcacctgagcctggaaggtcgaggatgctgagatcaagccctgggcaactagagtgagaccctgactcaaacaaacaaacaaacaaacaaaaatattgaaatatcactgtatttattaaccaaggaaaggatttttataatatgtttttaagtgaaaaagcaggctgccagtataatttgtttatatgtatttaaaagtatagaattatgagccaaaatatcagaccttgttacttgatattatgtgtaatttcaatttttggcttttatgtttattttccagtgaattattactctaatagtcataaaaagtaatagttttaaaaggacaagggagaatgtaaataatactgacagcctgtaatgggccagggcctcagctaggtgcattgcagagttgtgcagttttactagagtcatgcagcgtgggtgctgtctccatttcacatgtgggaaagtgagtaacttctccaaggttataccactaatcactctttctcatgcctatcagtacggactttataccttgttcaaaccatcttgttagaattcagtatttgggctgatgatatgtttggcaataattggaaaactttcagttaaaaagatgttaagatttctctaaccccttctttcagggcaagcgacttggtaatgaaggtggatgctcttctgtcagcgcaaccaaaaggagatccaagaatcgagtaccagttttttgaagacagacacaggtatagaattaatgttgaatttgtgcatattcttgaatattaaactcttatgtttgctttacctcagctccttcatttttccatataagatttatatataagttcttacaggaattgaacatttgtttggtgtgcagttttcacatgtatatatttgtgttcatatataaaattcatatgcaaatctcagttgtatgaaaactgacatttatttctaaatgaatctgaaataactctgagtgcacccttgtagtagaaaatagactgcatttaattaaacagagaagttgtacttttcttaaattcgagaataaacacaggcaggtcaagatagctcatgcttgtaattccagcactttgggaggccagtgtgggaggatcgcttgagcccagaagctcgagaccagcaaacaaagggagaccctgtctctacaaaaaaattttaaaacattagctgggtgtggtggcatgtgcatgttgtcccagctactctggaggtagaggctgcagtgagccatgatctcatcactgcacttccagcctgagcaacagactgagaccctgtctcacaaaaaaattaaacagagattggctgggcgtggtggctcatgcctgtaatcccagcactttgcgaggctgaggccagcggatcacctgaggtcaggagtttgagaccagcctggccaacatggtgaaaccccatctctacaaaaatacaaaaattagccagtcatggtggcagatgcctgtaataccagctactcaggagcctgagacaggagaatcgcttgaacccaggaggtagaggttgcagtgagcagagatcgtgccattgcactccagccttggagacagagcaagactccatctcaaaatcataataatagtaagataaacagattattaaagtacttgtctcattcatcttttattgaaaactttttttaaaaaaaaaaaacagggtttcattctgtcatctgggctagaatgcagtagcgtgatctcagctcactgcaccttccgccttctgggctcaagtgatcttcctacctcaacctcctgtgtggaagagaccacaggcgcttgccaccatgcctggctagtttttgtattttttatagagatggggtctcactgtgttgcccaggctggtctcaaactcctaggctcaagttattcatctgcctcagcctcccaaggtgcttggccgaaaacttttgttttaaataagcttagcatagtgagggagtttgcctttttgttcttcacttttttgttttgaaaagtttaaaacctagaaatagttgaaagactaatataatgagcacccaaatatccttcacttagattcaccagttgttggtgtgtcacatttgctttatctctgtcatctgcacacgtgcatgttgtgtgcgtgtgtctgcatgtgtgtgtttgtgtagtacttctagtaactgctttagtagtttatttatatgtttgcatacacacggtcatattttttcctgcaccatttggaaatacgttgcagacatcctgatgtaacatgtctgacgttttccgcatgtgtatcctgagtgctaggacttctccgcagtactgttagctgacctcagaaatgtaaccttgatacagtaatattaaaacacaatttctgttcacatgactccagtatctttgtaatgaccttctacaactgttttttgtatttgttttggtccagattacatattacagagttgtgtctctttggtctcctttaatctggaagagttctttgccattttttttcctagtcttttgtcttttatgatgacattttttaagagtccaggacagttgtcttatggaatgtctcacagtctgagttgcttcctcatgattagatttaattgtttctaggaaagagccctgcgcagtaatgtatatagcctttgctgtagctggcaagtatatacatatacactgattgtgcctcggaatccccagggaggctttaaatatagatgcctgtgtcctattcctctgtgtttctgagctgatcagtctggcatggattggactttggtttagtgggcctgtgttttttatgacccatccttgtggggatcaggtgtgcgtggtgagatcatttgatgattgtaggctggaatggaggccctctctgtttgcactggttgtgtgtcctaattttttatgtcagcagtgggtgaagattcttatggctcctggataatccttgttgaatttggccattagcacccagattgcacccattttctcaacattttgtgaactttcaggaagtaactcattagtcaccagcgggaggaaacctttcctaatcaacctgccatcttgtttacccttcttgcccaaggtagcgagtcctgagcaaagacctcttcccttttcagaaatcttcttctccatgggtctccatgttttgtataattaaaataccttaattataaattctattatgagacaaattataattcctattagagaagttcctcttattgggagttgtgtcagttaaatgaatgtttattacatttaactcagaagtttctcatttatgctagaaatagaaagatctgaaccatcagttatgtatattcttgccctcaaagtgtggtccatggaccagcagcaagacattgtctgggagcctgttggaaatgcaggctttggacccaccccagtcctgaggaatcagcacctgcattttaacaagttgctcctgggggattcccgtgtgcattcatgctactaagcacagtattcgttgacatttactctacgaaccataggcaaatgtgtataatctccaaatcttgttcctgtctctgtcacttttagttttattctggtcttttctctgcacaatatagtgaatacatttaaacatgatgttgttcatattgttcccatttccacacaaatactcctctttccttgttttttttcgagtccctttttcttgttctagagatgtggggtaagtaaaggacctcacaaggtcaatttgtggtgtgcctgttgctgatcacctagaacactgctggctcagaatgtgaacatgttgtgtgaatctctaccccaaacctggtgtgggcaggcatgaccagatgttacactcttgtgtagagtcctttttgagactctctctctggttcccttgtgagcctttgtataatgctattttctaatgagtttttccttctagaattctagaatagcagagaggtgcaaattatattagggcagtggctctcaaaatttggcttttacttagagtttgttaaaatgcagattgctggacccgtccccagagtttctgattcagtaagtctgggttggatcctgacttgcttctcacaaatgcccaggggaagctgatgccactgctctggagtcacactttgagaacagttgtattagagtaacagaagttttgttgtgttagaagaataatgattggcagtggacttaatctgaaattgttaataatgccagagatcgaaagcacctacctcaacacagatacaaagctattctcatggttatttccaaagcagtgaagatgtgaagtaacctccatgagcatgtaaattgtttccagttttcttcgttatgctgttttgtggtattcttttgtattcatcccacttaggtaaatgttgtttggtaaaaaaaaagtaaaagtagtggttagtattgtaaccacattatagtattgttcagagcaaacaaagtataatggtttaaacagttaatggttttcaaaaattgggtataattttaaatcctttcaagttgagtccttttaaaagttcattagaggttcctgctccttttaagtcaccagtctgtgtgacttcacagggagtccatgcaacaggaagttaccattcagttaagaacagacaagggggctgggcatgatggctcatgcctgtaatcccagtgctttgggaggccaaggcaggcagatcacttgaggccaggagttcaagaccagcctggccaacatggcaaaacaccgtctctactaacaatacacaaattagctgggcatggtggcatgtgcctgtaatcccagctactttggtggctggggcgcgaggattgcttgagccggggaggtggaggttgcagtgaaccgagatcacgccactatactcccagcctgggtgaatgagcgagactctgtctttaaaaaaaaaaaaaaaaaaaaaaaaaaaaaaaaaaaaaaaaaaagacaaggaccaggtgtggtggcttatgccattgctttgagaagccaaggcaggaggatcacttgaggccaggagtttgagactagtctggtcaatatggtgagacccgtatctctacaaaaaaatataaattagcccggcatggtggcatgtgtctgtagtcctagctacttaggaggctaagttgagaggatcatttcaacccagaagttagaggcttcagtgaaccatgatcacgccactgcactccagcctgggccacagagtgagaccttgtctctaaaaaagtaaataaggaaaagaacaggcaaaatatctatctataacttaatgctgacgaaggatgtggtgaaatttattttttggccttgtaaatttgtttagttcttcaggaaatgtggttgacaatacttattagccgcaaagtatttgtatcctttgtctccataatctcatgtctagcacttccttgactctaaagaaatttccaaatgtggagaaagttggttgtacaaattgtttacaggttgaaagccatctctatgtccagcagtaaagaaaagctggagtaaactctgacagcttcatttggtgaatagcatattatttcttatagaggatgcttgttgtgtaacagcatgtggaaatctttatgctacagtagtgagagacggaaggaaattgttttgaaattgctaatctgtatctacaactaatgtttatacaggcatctagaaaggattacgtagagatgcagctaagtgggctgggatagtgaatattttgtgattatatttttcctttttctttgttttgcaggttttctggaatgttctttcattattttttaaaaattgatttattccttttctttttgtactcttcttgccaagaagtaaaaactggcataatgttatcagaagctaacttcagtagcttttctcagtttttggttaaatacagtttcaagctgcttttcctctctttacatggacctttcagtccatttcagatccattattaaggttttgcaatctttgggatagacagaatcatatagttggccactgtcatagtctagtctttctagatctaaagttctttgaaatgctaagaaggttgaaggttatattgtacaaaaaaaacttttgtttcctgtgtcctccaggttaatgttttatccttgtgatctttcagtgcaatcaaactgaggccgaaggaaggggagacatactttgatgttgtggctgtcgttgaccctgtcaccagagaagcacagagacttgctcctttgctcttggtaggaacgctgtgcaggaagtgtacatcacctttgtttgaagttgtcacatgctctgaaattcactgagagcttcgttttccttgagttgccttcaacaggcactggacaatgctatggggttctagggcagagcaatctttacaaagattgacagtggctgtgaaacagcctcacagccctagaaagttggtgcaagtgtggttggctgcctcatgtaatttaaaaaagtgattaacatcctcatttagagtaaaacatcctggaattaaggtatgctatattttaatttataatatcagagataaaataaatatgttttttcatttttccttttttataactaccatggattttttgtcttggcatgtcttttagacatgtacagtgtgttacaattttaggacatttaaaagacctttgacaaagacagtcgctccaacattcattgccgaataaatctctaaccttttttgtgagtattggtatctctgttttttcatcctttggcatgtgagcggtgactctgaggcctgtagtttttccatgatctgcctgctgcttccccacaggaactgccttcgtgtgaggagcagtgagctgcagcagcctacttcccattgcttttggccacgtcctatgtatgtgtgatgtagattgtgcagtagagttgtgatttccagaagtttcgccagtgcagactctgtggctgttatctttatatcttttcttgagatattaatagctcagtgtcaaataataaatttctgaagaaaaaaatcctaaatattttgtcatctggttttccttctaggttttggctcagctgataaacatgaatctgagagtatttatgaactgccaatccaaactttctgacatgcctttaaaaaggtaaaacatgctatgtaagaaaacagttgaagaaattgtactgaatccaagttctgatattgcatgttagaggatcagatggatttataggtggacatcatgtttgaaatggtcatttactaaatgttcagttttgccaaatttcattctaatcagaagttctaagaacatagtgtgtttgtagcatttaggtggcattaacccaggctgcttgcatttgtgccttttctttctttttttcgagatggagtctcgctctgtcgcccagattggagtgcagtggcatgatcttggctcactgcagcctctgcctcccgggttcaagggattctcctgcttcagcctccttagtagctgggattacaggtgcacactaccatgcccagctaatttttgtatttttagtagagacggggtttcaccatgttgaccagcctggtctcgaactcctgacctcaagtgatccgtctgcctcacttcccaaagtgctgggtttacaggtgtgagctaccacgcctggccccatttgtgcttttcatcttaaaagaagaatattcatttcaagttggaatatacatgttagaggaagcttgcttagctatatattgtcatgagctttggaatggtcatttatgaaaaaagtgatacagaaagcagttagcgttgtggctatgggaaatttctaacttgccagtgtgctgtgttttataggttagcttctaagtggattgaaacagcatttgaaagtaaccaaagggttcccagcttccaccattattctcgtataggggaaatgtttacattattagtgttttcaggactagcctgagagcccaatcagtatttaggaattggttttaaagagaaaaatgagtcctccttgaagggaggaaaatgcccaggacctaactgtgaccctgacagccatccatgtgaacgagtggcctccgttcaagtgattggattttggcttgcaggtggacagtatagtggctgctgagtatgagctagagtacctgttactagaaggtcattgctacgacatcaccacaggccaccactgagcactcctcctcagtgctgtccttgtttgccttttcttgcatctgcagcaaccacaaggaggcatcataaggtcaaagatggttttggaaacacttttcccaatctggaagggtactcctccaaatctaatttgttttaaccagttgttacctgtgtaagggctgtgcactcaagtcctgttgtcacatcgaaaattatctaacactttccttttcaatttcagcttttaccgttatgtcttagaaccagagatttctttcacttcagacaatagttttgctaagggtccaatcgcaaaatttttggatatgcctcagtctccactgttcactctgaatttgaacacacctgagagctggatggtagaatctgtcagaacaccatatgatcttgataatatttatttagaagaggtaagaccatatctattgcttccaaatacctaatcatgtataatacagcagattgaatcatagtctaggtgggcctctgagacatcagtgttcaggtatgatatttttttaaacaacagctttattcacatggaactcatataccataaaattctccccattaacgtgtacagttgagaggttttagtatcttcacggagttgtgcagccatcaccactatgtaattgtaggatgttttcagcatccccagtgaaagccccatactcattagcagtcactcttcatttccccagcccctggcaactgctggtctactttgtatctctatggatttgcctattctgacattttgtctaaatagaatcaaatgtggtcttctgtaactggcttctttcacataacaaattgttttcaagatccatccatgctgtagtatgtatcgacgcttcactctttttaacttgccagataatattttatttatggacatatcacgtttcatttatcctttcacgaatggacatttgagttgttttcactttttggttgttatgaataatgctgctatgaatgttgtgtgcaagtttttctactgatacgtgagtacaggatgtctttgcatttaggtctttaatttttttcaacatttagtatcttatcctcgttcgtatttttagaataacgtccttattgtttttttctcctttctctttccaacctagtttttataattgtatacagtcattaaccaccactatagccacgatgcagaacatttccattaccccaaaaagttcttttatacccctttgcagacagtagcctcctctcgcctggtttcaggcaacaactgatctgctttctgtcattatacttttgtcttttcttgaatttcttaaaatatgatcatatattatgtaagtcctttttgtctgcttcctttactttgcataatgcatttcagatttattcatgttgtctctgagtgcattcaagtgattggattttggcttgcaggtggacagtgtagtggctgctgagtatgagctggaatacctgttactggaaggtcattgctacgacatcaccacaggccagcctccacggggactacagtttaccttaggaacttcagccaacccggtcattgtggacaccattgttatggccaatctggtaaataatctgttcatcagatagtgatattgtagttacgttaatttgggcactataatttatgatggagcaattagcattcttaaccatagagtgagattaaaattcattatgggctgaatttggtcaatatagaaatcattagttcagctaaatttgtaggttagaattacatgtcaaaagaaaaaacatgctggaatactcagctataactgaattggccccctgaaaatagattgctcatgagctgacagcctttttcttttctttggaagtgcaacacttattcatgcatcacacgttgattcttccctgaagcacagctaaagagcagatgatttattggtgtgactggcctttattgtactagtttttttttttttttttttgagactcctgcccaggctggagtgcagtggtgtgatctcagctcactgcaacctccgcctcccaggttcaagcaattctcctgccccagcctcctgagtagctgggattacgggcacccaccaccatgcccggctaatttttgtccttttttagtagagatggggtttcaccatgttagccaggctggtctcgaactcctcacctcagttgatccacctgccgtggtctcccgaagtgctgggattacaggcgtgagccaccgcacctggtctgtgctagagtttttaatgtgtagttttggttttttaagagttgcattgatttgtttactgtgttattcacattatagttgattgatatttcagaaatagaagtaactgttcctcagaaataacattttggtgttttgaagagagctaactggacttttcttcttgtcctagggctactttcagctgaaagccaacccaggagcttggatcctcagacttaggaagggacgctctgaagatatttatagaatttacaggtaggagtaagtgatgcagttacattatcccagaacttttagaaatgagcattagctctaattgaatactaccctggcagttagccaggcaacatgaatttaatttgcagttgtatgtgatgaaacagtggtttttccaggaaattaaatatggaagaattgttagaatagaattagataataagaggtatagatgctaatgagtatagtcaggctttattctttaattattcctttgtgctaacaatatcccagaatcaaatcattctatcagtgtgatgcggctcatagataggcagatgagaaacttgaagaaaggagaaaagaaagaaagaacagccacacttttctgcccagagagtgtatgtgttgaccctgagtgatttgcaaatgcacagtacatggaagctttggtcttgaagctgtgctgttagtgctggtattccttggtctgtggtggcatagtaagaacattccctctatagccagcttttaccttaaggtttactgcacatatttattagtttaaaaataattatgttgcctttaaaaaagtttgatataaattctgcttaacacaatttaaattagttttaaactgtgtgaagaggcttcccgtcaggttgtgtaggggatgatttccattagggcacatttgaagcactctgtagtatgtccttgccttaattagctccgtagcgacacacatgaaacagtggattagtgcctggttcttacccaggaaatagaagaattctgtattataataacaccattgtaaacagtagaagctttttttccacataacattttcctcagataaggttttacaaaatttgggatgcacttccgaactccttcccttttggatgccctggcccttgccagccctccccttcccaggagcatggtgccccctcttcctagctgttcagggccccacccccattagaatcttcctttgcctgagaaccctactctctgctagatgacagcaaatgcagtgaattcatgttgtaattatgactttctgcaccttgaaatttggtgactggaaattttaggcattgctgttgattagtagggaaacatacatttaatttttcttcctctgctcctgtctgcctgcaaatagaatttgttacagtttttctggtagcgtatagacaccaggttgagtacagggcctattgttgactgattgttgcctccggcagaaagagcgagcagatttcctttacaacactattccagttaaagagtagtggccgggagtgatgggtgatggctcacgcctgtaatcccaacactttgggaggccgaggagggtggatcacttaaggtcaggagtttgagaccagcctagccactatggtgaaaccctgtctctactaaaatacaaaaattagccaggcgtggtggtgggtgcctgtaaactcagctacctgaaggctgaagcaggagaatcacttgaaccccggaggtggaggttgcattgagccgagattgctctactgcactccagggcaacagagcaaaactctgtctcaaaaaaaaaaaaaaaaaaaaaaaagagcggaggcagtgtggttccaataatggttcagggggcctgttccctgcattcctttatcgaaggctctgtgcttggctcagagcttgtgaacacaggcggttgtttagtactcaccatgtggttaccacacatgggtgcctctcactacgtgatgggtaatttgcaagaggactcacaaaggaggtttgggcatgcaccttatataaagagaggtttcaacacgtgcttctgtgcagctcgaaggagcttaaggagcaagaagatagctggatctggaaaactcctttatgagaaggatgatggactcagatgctctgagagcatttgctgccttttgagaattgtgccttgtaatattgatctttcttttctcgcaaagccacgatggcactgattctccccctgatgctgatgaggtggttatcgtcctcaacaacttcaaaagcaaaattattaaagtgaaggtgagtttggtaaaagtagtggcattctgttattggacagctgtcatttaaaaatatgtatcttggaaccagcccaagagtctctttggaatttgctatggcaattatagggatactgctttaaggcaaaatgtctttgtaactgtgagtttgtggcttccctcaactgaaagattgtaccttttgggtaatctcggtgtgcagaacatgtcccatcttatataaaatattctcatagatgctatgttgtttatatagccacaattcatagtgttgttgatgattcttttctcaatattgggggaactggcaatggaaattttcaacaataataaaatgatagtcctatttaatttcttttgacttgtactttccgttctctgaatgttgaagctcttagtgccttaaattcaagtacagtatattcttgaagaaagaatcattacacacagtgaaacctaaaataggccatccattgttgagaagaaaaatggtcactgtactgccaagaagaaacccctgtttgtgctagtgaatcctgaaaactggtcataacatgaaatacctccctcccaacagctagagcccccagcagccacactcttccctggaactagctgttgactcattgaatcgtgcttctggtttcactgcacagttgagtttgcggctctttgcctatgttgcaagctgaaaatggggttcatctaattaaaagaggttgctgtctcctcacataaggttatgatgtgaatgtcctggcgaagatacttctattgaatccttctagactctgggtggggttgtgcctgtttgtgagagaattgattgataattccctattgatgacaggctcacagtgtatatccagtgagaggcagttttatgcctgtgagacatactgggagtaaggtttatcacatttgattgcaggttcagaagaaggcagatatggtgaacgaagacttgctgagtgatggaacgagtgagaatgaatctggattttgggattccttcaaatggtaagttgacattgtaagagttatgtttttaaggaaaaactgagatataagcaccatccatccctcctttttgcatcttgtgattctgtctgggcctttcacattctactttgtgcagctacatctcacacttatatttggcatagatgagtattttccactcgattgatccaaaagaggttcatgtctcctagtggggaagttacttctgctccatactttgtgactctcattgcctgtacctgctctttggaaatttgactgctccctgctcagtttacttcccgttgtgtaagttgcattctggtgcagcctgtgttcagtctcttcctaaaacaacactgtcggagagtgaacattctttttgtaggttggttttgtcagtcttgtggtctctccagggtgtgagggaagcttcataaccactcctgctgcagctcacccgctagggaaggatgggaagcgcagtctctttcctcttactttcaaaggccgtgtgtctgtatgagtgtttcaagtggtcttttttttacccttattgttataggggctttacaggacagaagactgaggaagtgaagcaagataaagatgacataattaatattttctccgttgcatctggtcatctctacgaaagatttcttcggtcagtcttgttgattatttcattatatatgatgaatgaattggtcagtgttcttatttagagaggaaaggttttgtgggattctgctcattatactcctgtgtctttgaagcactctgagcattgtgactggcttgccatttatcattggatttgttttgatcccgccgtctctgtgaagttgaactatgtagtgagtgcttctggatattacaaggctgcagccctttaacgtcactgtacacattcatagactgtactgtttactgcctgccaaacattgcttaacccagagattaggaggttgacatagagaatagaatcagaacagaaccatggaatacttcactgccttgtaaagattcacaggattttagagccaggagagagcttagttcttacatgtgaacacttctgttttataaacaggctgaggccccgagtgtgaagggacttgtctaaggtcacacagctacagccagaagaggccacgggctagggctgcctgatgtagtggtcaccagaggcactgtcaggaaggcctgagagtcacttttctcattgccagggctctgttcactcttaatttttcactacagatctagtatagaaaatcaaaatgtcatttgtctcatttttagccctcttatttccaagaaataatatcctacctaaaatagtgacaataataacaaccgaatttggttaaattcctccattcaaaaatgtggttttgttttctgagtaaggaggccggagctggtagccttcctctctaaagcagggcctctgtgtaggctgcaggaggcgctgtggttacacattcttcccttagcaccagatgctgatgtcatgtgacaggagttttggggagtgatgtcagttaccccgatttccagggttcatctggaccataactaatatatcagttcatgaagcagtttatttagaggtgtaacagaattaaaacatttgcctctgtcagttaagtgtagttttataggtgaggaatgccccttctctttagtgataacttcataagttggagtaagtacaatttttcattttccatcactgagcgtctccctcggcctaattgagccattagttagctctgccgtaaagagcatttaggtgtctcgtgattgactctacataatgttgaggttaaataacattggaaagctgttattaattacctgcttttgtttggcagcataatgatgctatccgtgctgaagaataccaagactcctgtgaaattctggttcttgaagaattacttgtcccccacatttaaggtttgtttcacagagaaagggaaaacattcttattaaggagatatttactgtatatttttcatgacttttgttttatctgtatactttagcaaattttccatttactaagataccctaatttggttgcatatttttattttgattattcttccagattggtctatttgaaggaaacagttaaattgtgtttaaaaacttggatgatatggtaggagagtcttttgttgttgttattattagcagtgtcttactgagataacgtttccttcctctgaagcctgcatgcttgctttaatttagaaagcacagcgatggtttacattgaagagaatgattggtgttagcatgaaccactcctagatgatgtatggaagtagtgcttcctctgtgcaaaacaaaacacgtacttggaatgttttctgcattacttatatcagtcagtatttgtcatctaagttgatttatttgcatcctttttttttcttgtagaatttactaagtgacttttaatatattcaataaccattctccttgataagcactttactgctggcgcctaaaggtgcttatacttagaatctgaaagacttattcaaaaaggacaacacatttgtccagagttctggctttgcagtgttattccctgggttagatctggcctcgaggaaggcttgtcatcaagctcagtaaatgccttactgaaatcaagtttagacaaatggacttaaagttcatgtgctgtaaaaacacacacagagggatatacatctaaaatccttctcttgaacattctgtcatttcatgtggtgaccagaagtcataaagaaatggggatttgacaaaggtttatatctgttcttctatgtagtcatgagtgggtcacggccggtctttgtaagaccactgttttggtaaatgtgttttatttgtcccgtatcatggtggttggcttacattatgaaagcagttttcttaatcagaagaaatgattatttgttgttcccatgtctaaaaataggagtttataccttacatggcaaatgaatacaatttccagtatgagcttgttcagtacaaatggccccggtggcttcatcaacaaactgaaaaacagcgtatcatctggggttacaagatcctcttcctggatgtacttttcccactagttgttgacaagttcctgtttgtggatgctgatcaggtaggcccttaaaggccaagttttgacagtttgtattaaaagcaacaaattgcttctttttaaatgctattttttccacttatggaaaaggacatgcttattttacatttagaaaatatgaaaatatgtatcacatagatgtcatcactttttaaatttgcatttagcttatctcctttacatctttttctctgtctttttaacatcattgtgatgacataatgtgtgcagttttgtatctgacttaattcatttaacatgaaaactaaaaattagaaaattaacatttagcagtgcttgccatcatctctaattatctgcccaaaagataggagttattgtcatgggtaatagacgaagcttaagtggatacatggctttggcagtagggaacctccggatattcttccggccgtcagggtttgacttagtgaaagggaacatgtgattttagagcatacaaactcaaacagcataagtgtacgtctgcccacagccttccacttcagcccgagcgggcggaaacccaagtcagccacctgagtggaaggatgtaatgtgtgtgaaagtcactgggacagagacttcactcacctctttggaattctcttccactggcttagcctgaagtgtgccttcctgattgtaacatagccacatttaatccttgttgagtacttacgatgggcaaggcattattctacatctgtccatccatatgttaacttacataatcctcccagcaaccctgtgagataggtactgtcattatcattatctccattttacagatgaagaaactgaggcacagaaaggctaagcagttgaaatttgttttattcctactcccacacaccttgctaagaagtgtcttacatgttagtgagtcaaccaggtaataagtggagcaatcaaagtgcatctgcccctagtgcctgtgccactaaccacggagcagccttccatgctgccttaagcgagccactctgtatctgaaggaaaccgcattagagctgtctgcatggttgcttaacaaatgactttttatattctccagattgtacgaacagatctgaaagagttaagagatttcaatttggatggtgctccttatggttacactcctttctgtgacagccgaagagaaatggacggctacaggttctggaagtcagggtactgggccagtcatttagccgggcgaaagtatcatatcaggtactgaaaagaagcactcctaacactgttacggggttttccttaaaattgattttgtgtggttaaaattgtgaataggtaatacattggtatggttgaaaaataaaaatgataaaaaatacacagtggctgggtgcagtggctcatgccttaatcccagcactttgggatgccaaggcaggtggatcacctgaggtcaggatttcaagaccagcctggccaacatggcgaaaccccgtctctactaaaaatacaaaaattagctgggcatggtggtgggcgcctgtaatcccagctactcgggaggctaaggcaggagaattgcttgaacccaggaggcggaggttgcagtgagctgagatcacgccgctgcactccagcctggatgacagagtgagattccatctcaaaaaaaaaaaaaaaatacagtgtaaaaaaaacttcctaatcctgtctctctctttcctactcagttcctgttctcacagcagataacctcccaacttattgactgtctatccttccagattttcttaattcttacagaaacagctgtgaatgtgtattctttttttttttacacaaaatatgctacctatttatacattttgtaacttggcttttttttttttttttttacttaatgtcatatacatcttctcagtgaatagagagagacctgattccttttcatagctgcatattattccagtgtgtgagtgttatttatagttttccctgtgacctacaatgttgcaatgaataatctactaaataatttttcatatctcatatatttgtgagataaattcctagacgtagaccttttaggtcgaacagtgtgtgtgttgttacatttctaatgagcaccccattctcttctctgcgagaagtgtgatttgaagatgtgcagggaagaggaacgtgtaggaagcggcacatgcagagatcactgctggggtttagtgatggtggcttcattctttacattcctggtccaaaagaactgtaaggactgtaacactctggggttttcccccccctgtaacattgaagacatcatcaggatatcattgaataatggttgtttatcagttactatggcttttgttactgccgcatatgctagaaatctttggtctgagattatttctttcggatggcaaatacagaacagtaacaaaagcatagcacagtatagattttgcagtgactttcttagagatctttaaagtagcacactttaactccactgtagggctgtagcataccttttcaaagaaaagccagaatatttggctagtggcctgttccattattcattgggtttagttttcctgtcgtaatccatggttggttgtaacaagcgggtcttctttattcagtgcactatatgttgtggatctgaagaagtttaggaaaatagctgctggtgacagactcaggggacagtaccaaggtctgagtcaggaccctaacagcctttcaaatcttgatcaagtaagtgtccattttttatggttaactgtgagtgacgggtatacagtgttgcatcagaaaatgaagtattacttgtgtcttcagtcctctcctcacaggatggcgtcttgttttttcatggtgtgtgtgtgtgtgtgtgtgtgtgtgtgagagagagagagagagagagagatttttatctgccctcaagacatatcagcgtgaaaaatgtcatagatttgatgctggctggggagagagatggaaggagaatgctgcctctctgaaccattagcatatctttgtattttgtactcaaactaatctcataggtttgtttctctacctactagggtcagtttgtttttctgctgtaggaactaaatagctcaggattcgtagtatagaatcacagtatagtatcacagcttcccctttttctatgtcagaaaccatgatgtgtttcaaggctagctaaattactgtttgttaatgttaagcatttttcagaggtgagattgtagtttaagggttttggatacatatttcacatattttaagcattttattttgcttaagtctacttaaatgtttttaaacctttattgtgatatgtagcatccataaagaaaagtatacaaaaaacatacatacatattcacatacatccaggaattattatgaagcaaatacccagataccacaacctagttcaagaactagaacattatcagcatcccagaagccatccttcctccctaacaaaagtgtctagcatcacgacttttatggtaatcatttttgtttctttatagatttactgtttaagcatgtatccataaacactagtttaatttgctcattttcttctcctctatctcaatggaataataaaaggtaaacttttttgtttgtttgtttgttttgagacagaatctcactctgtttcccaggctggagtgcagtggcatgctctgggttgcactcactgcaacctccacctcccgggttcaagtgatcctcctgcctcagcctcctgagtaactaggattacaggcacgcaccaccactcctggctaatttttgtattttcagtagagacagggtttcaccatgttggccaggctggtctcaaactcctgacctcaagtgatccacccgctttggcctcccaaagtgccgggattacaatcacgagccacagtgcccggctctacttactttaaaatttgtgtgatacctggtatcttctaatttatggagctactatggatctgattctgttgtattatttctgttattcttttgttcatactgtctatcacatatttgtttatcttctgtagtgtgtcaggcgttgtttttgcagaattattttggggaataatttgagttcaaaaatggtatcacccaacagtatttgtttctctcttttttttttttttttggagatggagctttgttcttgtagcccaggctggagtgcagtggcgtaatctcagctcactgcaacctcagcctcccgagcaggtgggattacagaggcgtgccaccacacccagctaatttttctgtatttttagttgagacagggtttcaccatgttggccaggctggtcttgaactcctgacctcaggtgatccacccaccttggcctcccaaagtgctgggattgcaggtgtgagccaccgtgcccggcctttttttttttttttttttttttagacaaggtctcactctgtcacccaggctggagtgcagtgatgcgatcatggctcactgcagcctcgaactcccaggctcaggcgatcctcccacctcagcctcctgagcagctgggacgacaggctcacaccaccaggcccagctaattttttgtattttttatagagatggggttttgccatgttgccctggccagtcttggaactcccgggctcaagcgatctacccacttcagcagctatttttaaattttagtctgttggcagggttttgtagagaagtatcatctatttatttttgtaccatcatggaacattctttacaagtatcgcagtcaatcatttctgtacatttccttgttccatgtaagtcttaggacaatggaacattttattgtggcaaagtcagaaggactccacaggaaaaaggtttaaagcatagggtagcattggctagaaaaaatgtcgtctatttgggagcaagtctcaatagacaaggtagattcagaacttccttgacagaagcctgcaaaatttacgaaccaccactctatttagttgactttcagaagtcagtaggagtatttttctcaggattgccctaatgaagggagggttaggtgcaggctgtttgtaagttttaagccaaagcttttcagttgcttattatgggcagatgttttatggatcctctaaaatttgtagttttgaataacttctctaaggcattggtaaggaccttttccattttaaacatttgtgattggcatgtgatctgtaacgagcagctgtacatcactgatgttctatacgtttgtctccacacgaactggctgggtgcagtggctcatgcctataatctcagcactttgtgaggctaaggtgggtggatcgcctaagctcagcagtttgagaccaacctggggcaacatggcaaaacgcatctctagtaaaaatacaaaaattggccaggcatggtggcgggcccctgtagtcccagctactcaggaggctgaggcaggagaatctcttgaacctgggaggtggaggctgcagtgagccgagatcgtactactgcactccaacctgggtgacagagtgggaccccatctctcaataaataaataaataaatatcgccagaactttagatacatgtattttatttttatttttttttaaccaaacaggatctgcccaataacatgattcatcaggtgccaattaaatccctccctcaagaatggctttggtgtgaaacgtggtgtgatgacgcctctaagaaaagggcaaaaaccattgatttggtaagccgtatgtggtgtgcttctgcatgttcatccactggatgtgtgagtgaatcacgattaatgatttttatttagattcttaaatttaagaatttcctagattcttatttagactttctctgtaattgtgtagtttgtcggggctattcttatcttacagaatattcttataaatattcttatcttatagaattagtatcgtttgttgtatagtaagcataagtatatagtttgttggggctattcttatagaatattcttataaatattcttatcttatagaatatttcactggttttatttccctgcttacattaggaaaccaaatcccttagcacttaatgggactgttttcacaacttacaatctgctgagtcactccttggcttccagtttatctctgtgccttgtaatttttccaaatggactttcacttttcctgccttccattagccactcacacattctttgtagatgtaaatacagctttacatagcccactaccatattgcttctggtagtatatcatttggttccttactattgttttcttgtccagttaggacttgtaacccaagaacctttgaattctctatcatgtggcctttcttcaactcagctgaagtgtgttcttttggtttcacagtgtaataatccgatgaccaaagagccgaaactggaagcagctgtgcggattgtcccggagtggcaggactacgaccaagagatcaaacagctacagatccgctttcagaaggagaaagaaacgggagcactgtacaaagagaagacaaaagaaccaagccgagaaggtaagcacaaaccgttggttttaggacagtacttctttccatttctgatttctgcttgttgtaaagacaatagaataatggataaaaggaagagaaaaatctcctattaatccttccattctaacatcaaccagtatatatttttcattttccttttatgttggtcttctaaacagtatttattagtgcaattgctatgtttttttttttttctcgtttttctggtgagggggagaaagggtattttaattgtgattatagttatttaggttcatgagttttgtgatacataaaccaaaccttttgcagagttcttcttagattccttgttttttttttcattaaatctgtcagtgtactagtgaatgaaaaaatttagatcaacacaaatatgtagttgaagaaactttttttttttttttttgagacagagtctcactctgttgcccaggctggagtgcagtggcatgatcttggctcactgcagcctccacctcccaggttcatgtgtttctcatgcctcagcctcccaagtagctggaattacaggcatgcaccaccacacccagctatttttaaattttatttattttttattttttgtagttttagtagagacagggtttcaccatgttgcccaggctggtctcaaactcctgacccaagtgatccgcccgcctcagcctcccaaagtgctaggattacagacgtgaggcactgcgcctggccgaaaaaagtattctttaaaacaagcatgttgggatggagatggaatgcttgtatttaatttagtgttaagtctttaatgtcttccctgttgtgtgtgtcttgaatgatagctacttgaaaaaatcattagaatacgaaattgactttttaaaatattaataagttgggctctagatttaagaaaaattttaaatgtatttatttttaaattgtcacgtaataattgtacatatttgtggagtccatagtgatgttttggtatgtacatgggctctggatttttaagatttattctgctttagactaattctaaaaaagtggctgggcacagtggctcatgcctataatcctagcctctcaggaggctgaagtcggaggattgcttgagcctggaggtcaaggttgcagtgagcgactgcactccagcctaggtaacagagagagaacctgtgaccaagcaagaccctgtctcaaaataaaaaaatccagaacatggatcttgggtgatttgcctatacatccctcagactgtactatgatattaaatatcacagctggaaggttatatagtaaccataaaagtaattaattccgattcatcagtaaaaccctgaggatttccatagataaatgggcaaagaatgtggacacactgttcaagtaagaggaaacacaaataataaatgaatttgaggaaacagtaatcaaattaaagcagtctatcactagtatctgctacatggaagaaaacagacatagtgataatgccatttgtttgggaggcggtgatgaaaccgttgtggatgtagcttgatgaagctttgtgtattggaatagcccttgttacaaagcagtacatctgccattagaagcccgtaaggcgtttatataccctcaagaattactctcttgagaatatatctgaaagaaataattcaacagaaaaaacaaagttgtatacatgaaaaaatttattttactattacttataagccagaagcatcaaaaacagtttaaacatccaagaatgagctacactgatacatagaaaatgtttagatgctattaaatgataaaagaaaaatcccgactaaaaaaatgcatgcaacgtttactgaaagtaaatattgtatttgtgaaaacaattcagttggagtggggtttacagatagtttccatttttaaaaaatctttaatttagtttttgctttcaaaatacagtacaaaagcacaaatcccaaagatttagtaagtgagataagatgaaggtggaggtacaaagaataggttccagtgatgaaaaatgcccactcagtggtgtttgtaatttgaagatcatctgttttcttttctgtggttctccttttccttaggtcctcagaaacgtgaagaattatgatctctggagaaggacaggaaatcaccccatttgaaaaacagtttttataataaatgctagttttttctgatctgtctatacaactgctgataagccggctgggcaggagtgccacaccttttgattctgagcatttgattctgacttctgtactctggtggccactggatctttgggattaaagctctgttggatttgtacctcagaggaagaccaagtggctgatcctttggactctgtaaagagcattcttctagtcagagggtggaatggcagcagcaactggaagaaaatgagttttttggtgcccacacccaagagcacacacatgctgcactgtctcggaaagcagggccagctagagccaccatgttcttccttacctcagtttacctgcggcctgcgctgcactgcagatgcccaccctgccctgggtctggccggcggaagctctgtccaaggtccacacacctccaggtttacgccaacatccttgtgccctccccaccttctcttccaacgcattaggtgcattgtttaattgaaatccaaccaacaattgtgtgtcaaggctggtttggtgcagtggctgggcaaattaattttgggccaggatgggggtgggttgcagtgagggtagggaaaatgtcaggagtaggaaggttcgggggttaagggaagggaaggaagaccagaactggccatcctcttttataatccattagtagcaccatggctcatttgaaatgaaaatattacacttattccccacccaaccgcagtgaactttctaggtaattgttttgaaaacaatttttgtatctgtgaaagtctttgctttttctttccaccttctagaaaagtctgctaccagtttccttactgaatacagccatactcagcccctctcgcatccagcccgtcagggtcagggtcagggtcaggctccctcaagacgagcaccgcattgtctgccctcttttgcgtaggatttttctctcagacccaggggacattgccttggacttttctctacaaatgccctcagatgtaagaccagaaatgattctgcttgtggaactcgtggctttctgtcctattttccttttatgtgagccctgcaggttgcctttggcgcccacaccagttctgtcttcatgtcgctgcatcgtgaagccccatttgcctttagtccctgctttgtgtgtcttcacttccacagccagtgttgcccctcagggcatactttgctggtgaacgggctgtagagtcttgagtatgttattggcctaagtgggcatgaggccccagcatccgactccatctgccaggctgcagggcacagcagcactggcatagacaggcacgctctgtcttccaacgtgcaccagccttttcttacatattttgcctgtttttaaaaaatacgaggagagggtgcagatggatactgtgccctcaccctcctaagccaggtaatatattgatgtgcagacttttaagaaatcttagtcttatcacaaatatcaagtaatttattttttccattttcaaatgcaaaagttagcctaggaagcctcccagtcatcctgaaggaccttttgactttgcttttataattctgttaaaaattgaggaggggattaatgagtacaatgaaaacaaaacaaaacaaaaaattaagaagaggaaagctcaaaagaggataagagactgaaaaggcacctcagaatggctgctgtgggcagagtctgtgacatgacttttccccgccctgcccctctgttcagagcagctggaaagatgggatcagtaagattaaaaaacttttgttcggccaggcgtggtggctcacacctgtaatcccagcactttgggaggctgaggcggacggatcatgaggtcaggagttcaagaccagcctggccaatatggtgaaaccccgtctctactaaaaatacaaaaattagccgggtgttgtggctcaccctctattcccagctactcgggaggcagagacaggagaatcgcctgaacccaggaggcagaggttgcagtgagctgagatcgtgccactgcactccagcctgggtgacagagcgagactccatctcagaaaacaaacaaacaaaaagaaacttttgttcaagctgcatcttcacattgaatgaaagcattcagacgggtgactgctgctgtcc

SEQ ID NO: 16864 - DNA, 40905 bp, Human
  misc_feature (1)...(40905): n = A,T,C or G
atctatgtaccctagtcaaaactgtccaggtttctgtggagatgggtgattgggtctataagccacacacctaatctcttgcaaataaatggttgtccacatccttagtgtttctccagagcatactttctctctctctcttttttttttttttttttttttttttttttttttttacaatgtgagtataagaatgatccaaatcttcaagttctggttcctttttgttgaataattccaccttcagtgtatctcttctcacatttcactataagcaataaggagaaagcaggcctcagtttttttttttttttttttttgagacggagtcttgctctgttgcccaggctggagtgcagtggcgtgatctctgctcactgcaacttctgcctcctgagttcaagagatcctcctgcctcagcctcctgagcagctgagactacaggcgcgcgacaccacgcccagctaatttttgtatttttagtagagacggggattcaccatattggccaggctggtattgaactcctgaccttatgatcccctgcctcggcctcccaaagtgctgggattacaggcgtgagccaccgcgcctggcccaggcctcactttgaaccatcatgtagaaatttcctcagcaaaatgtccaagcttatcacttataagttctactttccacccaacagaatacaattcaggcaagctctctaccacttgcctccagtttcaataacatatttctcctttccatctgagccgtcaccagaatcacctttaatgcccatacttctaccaaggctcttcaagacaatagaggcttttctatcatgcgcctcaaaattctttcagcctctaccgattacccaatttgaaaaccacttccccattgttaggtatttgttacagcagtaccctatttccccgtaccaaaaattctgtgtctcgttctccagagaaacagaaccaagaggcccactgagcaagcgagattgattgattgattttaaagaattggctcatgcaattgggggggttgggcaagttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttgagacgaactctcggcctgtcgcccaggctgtagtgcagtggtgcaatctcagctcagtgcagcctttaccttctgggttcaagagattctcccatctcagcctcccaagtagcttagactacaggcgtgtgccaccatgcctggctacttttttttgtatttttcgcagagatggggtttcaccatgttggccaggctggcctcgaactcctgacctcaagtgatccacccacctcagcctcccaaagtgctggaattacaggcgtgagccaccgtgctcagccaaattttttttaattaaaaaaaagaattcttccttacccatggactcaggtcacattctctctctctctctctcacacacacatttattgcccacatggcttcattaaaatttaagttccagaaggatgaggcctttaattcgcgcactacacaggtgctcaacacacagtattttccttcagttgtagagaaatgaacagtggaggacccccgccgctgggtcgcacgagctaacagatcggcggtcgctggctctccgctcttccagccacccacatcacggcgcctagaggcgggacatcctgtgtggacaacagggagcttccggattgagccggaagtccccccagagcggatgccgcggcgggcctgtgggagcggggtcatcttctctctgctgctgtagctgccatgggcaaaagagaccgagcggaccgcggtgagacgttgcgcgggcacgctcagccacgactgcccttgccggccctgccccccgctctgcctcggagctgctccgggcctctgcgccggccgaccctgctggccctcccgcgcgcaccccgttgggacaggcctttgggcgggagagatgctggacctgggcgcagcccagcgaactcggcctaggggagacgggtgaggggcgcaacgcctgcgggatgcaggtggctcttagctaggagtttgcggcggcgcaggtgaaatgctgccaagcggtgcggagggaaccctgaaggctcctgctgggcttacttctgtgttggtatcttgcagacaagaagaaatccaggaagcggcactatgaggatgaagaggatgatgaagaggacgccccggggaacgaccctcaggaagcggttccctcggcggcggggaagcaggtggatgagtcaggcaccaaagtggatgaatatggagccaaggactacaggctgcaaatgccgctgaaggacgaccacacctccaggcccctctgggtggtaagcatgcccttagcttgggcagggcccaggagtgtgcggagcggcagctaaatcttgggcatcctcagagtcaaaactgacattcaggatactgcccctagaactggccgggagagaattttcatccacacacgttggaacagcccaaggcaacagcgagcagttgcgcacacgtgtggcggccggacctgggcttccaacagctctaacccctcggtttactctcactccttccccagccctaccccatgtagtgaatccttttatctgccgaataaatagcatttatcatgtaacagtttgtttcctcaaataatggaagacatgttcggtagcaagcttttgctctactttaaataattaatgttatacatttagttgaaatctagccaaaaggtaacttgaggatagccagtaagatgggctttctctgtgcagaatagtaggaaacagctgttgactttggaaacactttcttctatttttctttactcttctgtatctgattaatgtaacaggccccacagttgtctgaaggagtgcttgcaagaatatctgtggtgttgggcagcttattctttcttgataatgatatgggcaagagcccagtagtctctgcaactcatgtttccttgtctgttttgtccatttggtatctctcaggctcccgatggccatatcttcttggaagccttctctccagtttacaaatatgcccaagacttcttggtggctattgcagagccagtgtgccgaccaacccatgtgcatgagtacaaactaactgcctactccttgtatgcagctgtcagcgttgggctgcaaaccagtgacatcaccgagtacctcaggaagctcagcaagactggagtccctgatggaattatgcagtttattaaggcaagtgacagctgagaccagcaattccacctgccctgctaatgtaacaatgggcataggtgctccatgttgtcagcctgtggcagccatgagaatgtgccattcagatttcctgtggggagcataacgactgattaccccagccgctacactctggatccagcattgtgttctgggtgaggccacgcttctcatgagccgctacactctggatccagcattgtgttctgggtgaggccacgcttctcatgagccgctcccagctgtgggtattaacacagaggggctactaattcaggcccattgtagccagggagaatttggaaatgcagcccaaagtgagtgtgctggggactgaattgtgtgtgttcccctcaaattttgtcttcaaaacctaatatccaatggtaatgtatttggagtaagaaagtagttaagactaaatgaggtcgtgatccgctatgattagtgtcctcctaagaagagacaccggagcatgctttctctcacctgcccttcttgtcatgtgagtacacaatgggaaggtggtccatagacaagagccttcaccagaaactgaatcggctgataccttgatcatagactttcagcctccacagctctgagaaaatacagttctaatgttgaagccacccagtctggaattttattatggcagcccaagctgactaacacaggtggtaaactctgtctaaagctaagtatctgcaggagaccaatagtcaacaagttccatgagggaaagtcaaaaacaacttcagatgtttttgacaaaacaaagagggttccatgtgattaatagttgaacatgctaggtttcttctgcgagatgggtgaatgccatttaaaagagatggacagtggctttcattgcctttggctgatccaaaaggagtcagattcagaccttgggatctggagtggcagaagagtgccacaggaattcagtatggtactgcagccagtcccagagaagctgcaggagtcctggagagaactctcttttcctgtgatgtgaaagcgtgcccggccaggtgcagtggctcactcctgtaatcccagcactttgggtggctgaggtgggtggaccacctggggtcaggagttcaagaccagcctggccaacatggcgaaattcctgtctctactaaaaatacaaaaattcgccaggcatggtggtgggtgcctgtaatcccagctactcaggaggctgaggcaggacaatcacttgaacccgggcggcagaggttgaagtgagctgagatctcaccattcattgcactccagcctgggcaacagagtgagactccgcctcagaacaacaacaaaaaagaaagcgtgcccaaggagaggaccttgtaccaacactgtggctctgcctggtcttggctgcgaattgcctgcagggatgtaggtgttggtgcactgtagtggtggatcagggacaacagcggggataggcagcccctcaaagtctgactggcaaattttttttttctttttttttgagacggagtcttgctctgtcgcccaggctggatagcagtggcatgatcttggctcactgcaacctctacctcccaggctcaagcagttctcctgcctcagcctcccaagtagctgggattataggcgcccgtcaccatgcccggctaatttttatatttttagtagagatggggtttcaccatgttggccaggctggtctcgaactcctgacctcaggtgatccacctggctcggcctcccaaagtgctaggattacaggtgtgagccaccgtgcctggcctgagtggcaaatttttattgttgccacacagcctctactgtattccttcctaaaggtggttgggaacctgggaggatttaagctgtattctctgccatcaagatgcttacattctatttggggaaataggagcattggtgaagaggctttgcattttatttaagccgcaattactgtgcacatactctgtggagttgtagtaatactggtgtggtcttctctagactagggtgggggctgtgggaatagagaggaaaggcagaatgcaagattttaagcagcgttttataacttaatggatatgcatcagaattacccaggcaagaggaagattttgttctcagaaagcagaggccaatggaaaaagctcagtttaggcacatctgaccactttaggattgcaagttgggtttccctaaagtaaaatgaacttttcacttggttggtaggtgtaagatgtgaccagtaatgaatgtgttctgagttagctgcacatttacctgttggatgttatctgtatttgcagttgtgtactgtcagctatggaaaagtcaagctggtcttgaagcacaacaggtaagagattccatgacaggcctgtcccaaggcactgtcactttctgcgcaccagcaggaataaagggatatgggaaggacctgatgtttatgctgtcttttctgtgaagcacagataagagaagagaaacaagagatgtggcccagactggaaactcatccactggccactgtatttcctctagcagtggagctgggctcaggcccctgcctacttgacctcaaagtcacaaccctcatatgttaaatcatggccggcagctcatggtacagatttggcgaagggttgtggggagagtcatgaggcttgtatttccagaccatctaattgaatgagcagtggaatctccaggaggtacctgctggtcagtagaccccttcttcctcccctgcttgcagatacttcgttgaaagttgccaccctgatgtaatccagcatcttctccaggaccccgtgatccgagaatgccgcttaagaaactctgaaggggaggccactgagctcatcacagagactttcacaagcaaatctgccgtatgtggactcctgggccacccttgggtgggggcaggcatttaggatttcagttctctcaggtgtctttaacccagcacttacaacctagcagccctgctggttctaccctttacaacttcacccattgcttgataacagcagaattaaatgttgtgtgcacgttcagcacctacctctctcacagatttctaagactgctgaaagcagtggtgggccctccacttcccgagtgacagatccacagggtaaatctgacatccccatggacctgtttgacttctatgagcaaatggacaaggatgaagaagaagaagaagagacacagacagtgtcttttgaagtcaagcaggttagtgaatgtaccttcctcctggttccttcactgagctgctgttagaagctagtccagccatgtgtcgactctgcctgtagtctgtgtgaaaggaaggagtccctgttggtccctgaattgctttctcctttttattatctgtgagccatggcatcatttctcctgatggagttaaagtcccagtgtcctctttttcaggctggtaggctggtcttcacaggttcctgaggagatgtgagaaatggtgcctgaaggtcaattttgcctgctgattagatttcattttcaaagtgttgttagtctgggttgcttttctgtgctttatcccggttgttgactgagcaagatctaaaatcttgtataagtttagatagaatgccacttttttgaccattggacctcttagaagatgtaatgtttttgagcacagtaacaagattttaaaaccccttttgtgccctctttccaggaaatgattgaggaactccagaaacgttgcatccacctggagtaccctctgttggcagaatatgacttccggaatgattctgtcaaccctgatatcaacattgacctaaagcccacagctgtcctcagaccctatcaggagaagagcttgcgaaagatgtttggaaacgggcgtgcacgttcgggggtcattgttcttccctgcggtaagtggtaccagagttaagaaggtggtcaggctgttgtgtctggatctgccagctgcctcccgctttctctctgcacatttccctaaatcacaccttgctgaaaagccaagatcaggtgactccctgattcatgacttgacaaatatttgagtgcttgctgtgtatgggccctggcctggacactgggggtattatggtggctagaacaacacttctgacctcatggagctcactcttctggggaagagacagatggtaagcagatgtgtacaaccttgggtggtgctagagtcagcgaagaaaaattagagcacatgaggggtgagattgtaatgatggcaaggggctgttgcacttagtggggttaggttcttgttcttgaatcagccttaggggttgtgtatttggagactccctagcgcagaaactttggtgttcctggatgactaggatggtgtgcaggtccagggaaaggcaggagtggccccctgggcacctgtttgaccacttatcccagtagtgtcaggtcctagcctagcttcttggccagagaccacagcagactcaccttgggaccccactgaggacttacagaggcaaggtcttcagggaaggggaggttctttttttccaaaactccaagggttattttgatgttgttttccttttttatttcactttacaaattttttttatttacgtttattcctggtaactcacagtgtatttttataataaaggaaggatctctgtttaatggaaaagcttgatttttctcttgatcttcaaatggtggatggtagtaaactcagaagctcctggaatttcattttctctgtacacacatagcgcatccctgaattctcagccccgtttgctgtgtaataataatagtggtcttttgccgagtgcctccttctgtgggccaggcatgctgggacccagtagcttcactgtcccgtggctgtgggcaaggtaaagtactcctcagctttagtttttcaatctttcttttttctttttgagacagagtcttgctccgttgcccatgctggagtgtagtggcgccatcttggctcaccacaacctccgcctactgggttcaagatattctcctgcctcagcctcccaagtgaccgggattataggcgcccgccaccatgcccggctaattttttgtatttttagtaaagatagggtttcaccatgttggccaggctggtcttgaactcctgacctcatgtgatctacccacctcggcctcccaaagtgctgggattacaggtatgagccaccgtggcacggtggctcagccaggtttttctatctttaaaataacaataacaggcatttctcttctcactggtttgttttgagattttgacatttaaatgagatgtgtgtaaagtgctacagtaggccccagcgcctgccatttctcacatatgtatgtgaagtgggcatgtctcctcattataaagaagaaaacaggctggagcagtgtgtgtcgctcagatgtcagctatgtggactgttacaagacattttcctagattgctgtacttgtgagtcattctgcctgtccctgtccttcatttcaacctgtccttgggtgggattgcactcttgtttcttgtaggtgctggaaagtccctggttggtgtgactgctgcatgcactgtcagaaaacgctgtctggtgctgggcaactcagctgtttctgtggagcagtggaaagcccagttcaagatgtggtccaccattgacgacagccagatctgccggttcacctccgatgccaaggacaagcccatcggctgctccgttgccattagcacctactccatgctgggccacaccaccaaaaggtcctgggaggccgagcgagtcatggagtggctcaagacccaggagtggggcctcatgatcctggatgaagtgcacaccataccaggtaagcaggctggagctgagctgtccacttgctgaacagacaaaccaatttccagttgttaggttgggaaagggactgctgtgtagcccacccaactggctagaaagacttgctggcttgctgggtaaagcttttaatagttcttttttttttttttgagagggagtctcactctgtcacccaagctggagtgcagtggcacgatctcagctcaccacaacttccacctcccaggttcaagcagttctctgcctcagcctctgagtagctgggattacaggcacctgccaccatgctaggctaatttttgtatttttgtagagacagggtttccccatcttggccaggctggtcttgaactcctgacctcgtgatccacccacctcatcctcccaaagtgctgggattacaggcgtgagccaccgtgcccggccagtaattcttaagtgggatgcaggcaggagtgttcacattcacagtttgcttaatcactggctcagtagtgatttagaaaatgatattttctttcctccatcttccttttgctgctcagcttcatccgttttttaatggccctctaaaaactgggttaggagcactgaaaagcccttcccaaaatggtggtgatgtgttttatttgaagcccggaatattgatccttagtcaatatgtaatagaagccctacttctccaagtatcatgggcaaacctttttttttttaagctgctctattgatttaatttatataccataaaatcaccccttgtaaatatataatccaatgagttttagtaaatttgtggaccagtgcaaccatgaccatgatccaagttttcttttctttttttttttgagatggcatcttgctttgttgcccaggctggagtgcagtcgtgtgatcttggcccactgcaacctccgcctcttgggttcaactgattcccctgcctcagcctcccaagtagctgggactacaggtgtgtactaccacacccggctaatttttttttatttgagacagtttcgctcttgttgcccaggctggagtgcagtggtgcaatctcagctcactggaagctctgcctcccgggttcaagtgattctcctgcctcagcctcccgagtagctaggattacaggtgtgcgccaccatgcccagctaattttatatttttagtagagacagggtttctccgtgttggtcaggctggtctcaaactcctgacttcaggtgatccgcccacctcagcctcaccctgggattacaggcgtaaagtaccacacctggccaaatttttgtatttttagtagagaaagggtttcgccatgttagccaggctggtcttgaagtccagactttaagtgatctgcctgcttgggcctcccaaagtactgggattatagacgtgagccactgcattcggccaccatgatccagttttagatttcctttgtactcatttgcagtcaatctttgtttctctatctagcttcagatgactactgaactgctgtcactatagatttgctttttatggaaaatttatataaacacaatcatacaatatatattatgtctggcttctttcacttcccataatgattcatctgtgccttagcatttatcagtagtttgttccttttattgctgtatagttttttgggcgaatcttttttgataaaaacagattaagggattaagattaacaaattaggagtgggcatggtggctgacacctgtagtctcctagcactttgggaggccagggcaggaggattgcttgagcccaggagcttaagattagcctgggtaacatagtgagacatgtctctacaaaaaaaaatttttttaattagccaagtgtggtggtgtgcacctgtggtctcagctgctgaggaggctgaggtgggaggatcacttgaacctgggaggttgaggctgcagtgaaccatgattgtgcaactgtactccagcatgggtgacagagtgtgagactctgtctcaaaaaaaaaaaataaagatgaacagattagggtaaattaaggagtctaatagaggttactatgaacaaaatgaaatctgaggcattttcacaggtagtgttcaaaatgtcaaaatggccccagcatctggttctttctgtgcatgagagctcttcagccctgatgggtttctggagatacctagagatgttcacagctggccagggagggattggaggtctttctgatggaagcccagggtgtgggccctgctgtgggaaagtacttggcatagtgagacagcacaaggtggccatgcggccagaggagagcataggaacagtagtcaaggctgaggaagattagcggtattggggcaggtcttgtaggaccttgtaggccacgacaagaactttggcttgtactcttagtgtgaagccatctgagggatttgagcagagcatgacatgagttgactttacactgtaaaaatactgccctggctgctgtgctggaaatagactgaaggaagcaagacagaagcggtgaggtgagtttgtggaatcccagtaaggatgaaggcgtgatccgactctggatatgttgtgaagctttaattgacaggtcaggtgtggaatcagagagaaatcaagaatgacactaaggtttttggcttgaacaaagggaggatacagtgggcattaattgagatggggaacactctcaaaggagctggtctggaaggtgactatcaggagttgggctttagatgtgtgaatttgagtttcctgttaggcattcaggccatggcaaaaaggttaagaaataggccaaagaaattgatagacatttcaccaaaaaaggatatacatatgtcaaaaaagcacttgaaaaagggttcaacctcattagtcatcagggaactgcagatttaaacccaccacaggatgctcccatatgccagttagaagggccaaaataaaaaatactgatgtgcgggtgctgatgaggtcacagcaactgaactgtcacacattcctggagggatggattgcaaagtgtatggtcactgtggaaaacagtttgtccatttattatgaaattaccacatgacccatcagtcccattcctgtgtatcctggatacatgaaaagaggtttacacaaaatcctgtacacgaatgtttatggcagctctgttcataatatccaaaacccaggtgctcatcagtgggtgtctggataaacaagctgtggtacatccatacactggaacactactcagtagtgaaaaagaacaaacttgctgcatgttgcaacctggatgaatctcaaaagcatggtgctgagtgaaagaagtcagcctcaaaagcttccatagtatgtgatttcatttatacaacgacagtatagtgctggccagcagatcagtggttgccagaagtggggggtcagagatggatgactctaaaggagagcacaggggaattttgggggatgctgtctttatctgtaccctgattgtggtgctggttacaaaaatgtaaatatgttaaaatgcatagaagtgccccccccaccccccgccccaagtcagttttactgtgagaatttaaaaactcaaaagaaaaaaggtggaagggtgggtattgggtctgctaggattgaaaattgatggtacagagaatcactacccacaaaggagtctggaattgttctgtagcagtttggttggaagctgtgttcagggcttgaggcattctgtctgactatatgtttggtacacgttcatgtttttctttaacccaagccccaggtcccaggttccaggggacaacagcacagatttgggattggttatctgatgaacaagtacaaaaaggtgcatctcacactcacatatgtctgtgagtttgtctgtctctcgtctagttcactggatgagttagtctttggttgagttgcggagtgaaaccaacaaactctaagggatttttgagtacaggccccataagcccagtggcctggccatgctcattgtcccagagagcaaatgttaaataagggaatgctaggaagtcacagtaagtctcctgactgtcttaacgtctgctgtgttgggttaggtggagtgatcaatctttgagatttatctcaaaggataaagattgctgtgctgttttacagatttttcaaaaggagctctgttatgcctttttattaatgattcatattatggtacttgtgtatattaagtgcttcctgtgtgctaggtactgtgccagtttcattatttctacaggtatttattgagaacctactaagtttaggcactgtacttggcactggagacaaagtggaagggacagccaagtaaccacacaaataaatgccaaatgacaaccatgacataatgttgagtgatacaagccacacacaaaagtgcatactatgatttcattcatgcaaagttcagaaaggaggcagacccctctcagaagtcagaggagtgtttccctcaaggaagagtgctagttattgacagaaggggtcaggggagagacctctgggtgcctggttctctatatcctgatctaggtggttccacagctgcatgtctgtaaaaatatattgagtagtatgctgtgagttattcacctgtgacagctgtcagggctgtaggagagtgtaatagaggggtgtgatggggtcacgggtgtccaggcagagtcctacctgccttatccttgtcttgggtcagtatgtcccccagtgttgcctctctggggcccacactgggttggtgtagccattgccttgactaccatttccctctaacatggggagcttggtctgaggttcttggctactgtattttggagccagcacagtctttccttagacataaccctgagctgattttgttttctgtgttgtgtgtgtgtgtgtgtgtttgtgtgtgtgtgtttgcatgtggtgttgtgtgcaaaccatgtagatgtaaaaactaaacatttacttagagttaggcaaccctatgttatttcactgtgaacgtctttgtgttttggtgcattcaggcctctttttccttagatttttgtgtctatttatttctgaaatatcattagccctactttcaattatattgtaagataagcatgactcaaacattttaaccttgcttcagagtattagaatttttaaaaggtgagcccgtggaaatccataaattaggttttttaaaaatgaataactcataccctttatgtgtttattttatttgataaaccagagagaattataatgttcaaaagaaaggaagaaaaagaggttgctggttgaccaaagtgattgaattggtaaagtttggagaggggagtttcctaaggcgggccggagggcttgggcgaacagttcctggagtttcatcactcccgtgggcttggctttcttctcggtttctgggaaaatgatgggaagctgagaagagctggcttctttcatttcttcctctccctagattgtcaactttcttttcagtaacctgggtacaagtgttaggggaaaattctttgcgtaatttagagcttaatggtattaatagtaagtattgcaggttgtatttcaaattgccatctgtacttctactgataactgttgtgaggggaatgctgggattcattaacttggagattccttaagctcatttcaccctcttgttctccttttcattttcttttggacaggtctaaaagtgatggtgaagcatttgcctagtcattcttgtctagagccagcttctgtggtcctgaaacccaagggttagttcaggtggtgtcataagccagtgttaagttgcacagctatgagcatttgaaaaagtgacagtgtaggctgggtgcagtgggtcacgtctgtaatcccagcactttgggaggcgaaggcagggggattgcttgaggccaggagttcaagaccagcctgggcaatataatgagaccccatctctacaaaaaatattttaaaataaataaataaaaaataagaaagaaaagtgacagtgtgaatgctcccattgtttcctcagccaagatgttccgaagggtgctcaccatcgtgcaggcccactgtaagctgggtttgactgcgaccctcgtccgcgaagatgacaaaattgtggatttaaattttctgattgggcctaagctctacgaagccaactggatggagctgcagaataatggctacatcgccaaagtccagtgtgctgaggtagctgggcctgggctgggggcgtctgggaaagggcctcctcctatgggcaggggagtgatcagatcgattcctcatgggcagacacaggtcaggacttaggctcacctgctaccacttcatacaggatcctcagtcaccctgtggttgggtggtactagacccacttgctgcatatcttctgtcttgtcacatatctcacatacccctgaatttgtgatgattctttttcctagccatggggtttaccagtcatggatttctgtgggtgaggattagcattcagggcacagggatgaatgaaggcccctgataccacagtgctgcctgggagcctggcagcaaagggctttgctctgatagccccaagcgcctaactgatatgctcccagccctgctgggaagtgtgtgaagaggtggcggtactcagtagcagtgctgactcgtgtgtggaagtgtggcctaaatggaagaattgctgacactaccaattgagaatctggtttcgcacacttgcagctggtgtgaaaataactccctggatgtgattgcatttaaaaatcttttaagtggttaacatgtgaaaacgtccagttcaataggaggtattaggttgggtttagttttgtgcatgcatttattttcagttgtactgatttctaattcacatagcatttttttttttttaaaacagggtctcactctgtcacccaggctggagtgcagtggcgtgatcttggctcactgcaacctccgcctcctgggcaagtgattctcctgccttagcctcctgcgtagctggaattacagacatgcactaccacacccagctaatttttgtatttttagtagagactgggtttcactgtgttggccaggctggtcttgaactcctggcctcaagtgatctgcctgcctcagcctcccaaactgctggcattacaggcatgagccactgcacctgactggttttgttttaaagctaattctgctagagaaaggtcttcaaaagttttaaattgtgtggtgtttaaacttgtaaaatgacccctggttcttactgtattacaggtctggtgccctatgtctcctgaattttaccgggaatatgtggcaatcaaaaccaagaaacgaatcttgctgtacaccatgaaccccaacaaatttagagcttgccagtttctgatcaagtttcatgaaaggaggaatgacaagattattgtctttgctgacaatgtgtttgccctaaaggaatatgccattcgactgaacaagtaagaattgaaaacttggagcttcctccaggccagtttctcttccccattgagagtgcagaaggtggctgttgttttgtttttttgtttttctctcaggaacttcttgggctccaaagatcttgttctgtggccctggtctcagaaaccagggaagacctgaagtaggtggttggagtcagaggttagagcatagagaaaaggggggctagtcaccttgagcccaaagaacagggagcagagacttggactgagctgggtggggccccatggaagatctgggctccaaaggtgggtgggagttggcatttggagctttgggctgtgtgagctctgtgggtggagaggaggccagactggatggcctaggggctgggaaggcaagatgggctgggctggcatcccaagtacggactggcatctggaaggagcttagaaatgcccacgcagtatcctcatcaacccatggctccacccaaatatttgtgcttaaaacctggcttttgtaaagctctgccaagtaaggaggaagaggtctgcgcttgctcctacagtgacacaggacttcaggtgctgtaagtgttgcagaaggccaggccctctatggagacaggtcaagctatgtgctatgggtactatacataggttttacttaatcctcacttcagccatataaaatgttgttcccattttatagaagggaagacaaactcatagaaagattaaatttcttaagtttctaaaattatacctttatttaatttagaaagactttttaatccaagtcaacatttagattattgtgaaaaacagcaattccctgcttctattttcccacccacaattctattccttgaagacagccgcttttgactcttttttgttgtttaccttcatatttctttctttcttccttttttcttttttttttttggagttagggtgtcactgtgtcacccagtctgtagtgcagtggtgtaatcacggctcacggcagccttgaccccctgggctcaatcaatccttccacctcagcctcccgagtagctgggtctacaggcacgcaccaccacacccagctaatttttgttttttgtagagatggggttttgctatgttgcccaggctggtctcaaactcctgagctcaagcagttcctcctgccttggcctcccaaagtgctgggattagagtcatgagccaccacacctggccagccttcatctttctaagcaatagcttatgtagtaatttcttgatgatcagttatagaaattgcctattaacttcctactgtaggagttgagggtttagctttcttacatacaccactctccccactcctgttttctctcctaccattctcccaatatgggaatagcacaagttgggggttactttaatattcagttacattattttgactgtgtaagtatgttcaggcagagctgtagagtactattacattttccttttttttttgagacggagtcttgctctgttgccaggctggagtgcagtggcgctatctcagctcactgcaacctctgccttgtgggttcaagtgattctcctgcctcagcctcctgagtagctgggactacaggcacccgccaccacagcctggataatttttgtatttttggtagagatagggtttcaccatattggccaggatggtctcgatctcttgacctcgtgatctgcctgcctcggccttccaaagtgctgggattacaggtgtgagccaccatgcccggccttacattttcttttttgtaaatgtttttttgccttggagttaataattgccttgtcattgtttttgcttggttttctgtgcattgaataattattcccctccaaagtcttcacataaccataaactcagtagggtcaggtaatttctcagttctgtttttctgtttccccagtgggatccccaccagcactccattcgcttactctgttctggcctgcttgctgtctaggactagagacaccaccagctgttaccatggggtttcccttggacactaccccatgacttccctgggcctctttgttgtgtttcccaccctgaaatctccaccctcttggttactcattttgatggagcacatgttccagtaggttcctgagagaagggatgtaggaggagaagctttggagacttcacatgtttacagatgtctttactcgactttacacttgatcagtagtttggccaggtcctagaactaacattggagcttccagtgcagcagtttggcagtctgatgccctttgcttcctctcagtgtgttgtctgctgtggtggctgtgcgttttccttcccttgaaaactggtaggatcttctctctttttggaaatttgaaagtgatattcttaatgttttttctttcatcgtgatgggcactcagtatatcctttccatctggaaactcgtgtccttcagttctgagaatttctgtttttttgttgttaatcactttctctatgtagtcccttcttggaattttgattcatcagatgttagatcctctgaacagcttctccagtttgcttatcttttttctacttttttatctctttgtcttctaacccttgtattgagacttgttaatttctgagagttctttcctggtaactgttcttgttttgtttgtgaatagagtgtcttctcggaggctttgaaaacttttgaagcttccgtctgtttcctgccatgtctcttttcttcatttttttgtcttaattgtttttacctgtcttttgagtctttctgagttttggtaatccttgactgtattttattggtttaaagtcactgaaaacctggcaggcctttctgtgtggcttagtgggtttgccagcttgtggacctcaccagagtggctgggcagggcctggctatttcttcaggaggttgccaaatgccagtatctctaggacttttctcttgggctggacggtttcttcagtgaggaatttttcagtcccctgggcaccaccgtgtgttaggggaagaggagggcttgtggaatctttgcattcagtcttgccttttccctcatctctgccgggcatccctggagaataagcctccagtgccccaccagtggaggtggcctgcctgctgccggccggacccaactgctcctcacactcacacactgccagtcctcctgtgcacctccccaccttctcaggcaactggtgactagttcctgagccctcctgcgtgctgcagaggacacagaggcggcgggttttgtatcggtcttccctcctgccggctccagcttctgctttctctagtctgttagctcaggtactgtgcctgcatctgtctgcttttcagcttctgaaatgttacccacttctctcatctgctgttatttcttctcctgttttctttgtgggtttgtgttctgtcacattagtgccaatttgagcagggcaatgagacagttcctatatttactttgccttatttaagaactattctctccccatccttcctcccacagcaatgctcctccagtcttctggagcctcactccaggggcctcccccacctacatttgcagcactcctgaggcttgtgccttagccgcagcctcccgagcatctgcttgggcagggacgttaatttgcctggcactgtcaattccaagccagtctgtcacagtgaagggcagcagattgtggctgtctcctgtgtactagaatgatcattacaatgtgtactttttaccttttttttgtgtctctggcctttaaatgtatgaagtagtgttttttcttcttggttttctcgcttctaaaatgatcctgcgggccaggcgcagtggctcatgcctataatcccagcactttggggggccaaggcagaaagatcacttgagcccaggagttcaagaccagcttgggcaatatagtgagaccccatcctttaaaaaaaaagtgatcctgtggctctcgggcattgctccattctttgctcgtgtgtggtggggattctccaagcttttggctcctcccagccttcataagaaaggcattggtatcaccaaagcactttgcaagagaggcttagggttatatggcagtgtggggctgtgggcagagcatcgtttttgggatcagacagactggatgtgggaaagttgtttacctctgaactccttttgtactttggtcacatggagctactgccacccaatgtgtactgggtcctggtgtcccttgatggtggggggtggattcttgtgcctggcagcttgtaagtatttagtaaatgtgacattctccacttggagggtgcttttccttctatttcatctgtgtgggggaacctttagaaactgagggctccccactgtgcaagtagtttttcctggtgatgggggaggagaaaaccacctaaaaacctgggtctcaagagtcaggctgttctgacgagtggggcttctaacctttttcactgcatgacatgcatagaaaatgataaaattatgtggtggccgggacattctggatcacggcaaggcagcttgtgactgggctaatcagaggccatcagcctgggtgtgcagctgcccaggccctatccagcttccccacaggcaaggggtttgctctttgaggtacatccattaatgggcactgctctgggtgctaacgggcctcggcagtggagcagccactcccaggttccacctgctcaggcttctgacccttggtttcccacatgtaaattggggaacatgaaacctgtcttttacaatgctgaggaatcttggcagggctggctggatttttttcttttctttttcttttttttttttttctgagacggagtctcactctgttgcccaggctggagtgaagtggtgtgatcttggctcactgcaacctctgcctcccaggttcaagtgattctcctgcttcagcctcctgagtagctgggattataggtgcccaccaccatacccagctaattttttttatttttagtagagatggggtctcaccatgttggccaggctggtctcgaactcctggcctcaggtgatccacccacctccgcctcccaaagtgctgggattacaggtgtgagccaccgcgcctggctggatttttttttttttaatgtaatactcagctcaatgcctggtgttggtaggtcctgcgtacctgtagtttgtcttcattgtctttgctgttgtcatcatcatcatcactgttgttatgattcttgggaagctacaaaaactgtccaccgtcacattccaagacagagggaaggagtgtgacattcccaatgctatgggatgataaccattgagttcattgatagggttgtaccctttggcagggagctggaaaatttttttttttttttttttttttttttgagacagagtttcactcttgtttcccagggtggagtgcaatggcgcgatctcggctcaccacaacctctgcctccccggttcaagtgattctcctgcctcagcctcccgagtagctgggattacacacatgcgccaccacactcggctaattttgtatttttggtagagacggggtttcttcatgttggtcaggctggtcgtgaattcccaacctcaggtgatccacccgcctcggcatcccaaagtgctgggattacaggcgtgaaccaccgcgcctggcagggagctagaaattaaagagaagtttttaaaacttagtgttatgggaaatcagcacaataatggctgaagggcacttttctcctttctgctcatctcttggagcatgcctgtgtcttggcaaacagttgcttccagcctttttttggaaatagcagtggtttctgtgcacctctctttgggcttcatgaaatgtggagatgctccttgtatagactctgtgctgagagtaagagatgttgaagcaggaaaaagcatagtccaaaaagaaaacgaaaaatggaaaggagggaatcccgaagagaatggtgggcctaaacctagaatcagtggggaaggctgggaggtgcatctgtagccagtcatttttttgggtgtaacgatattcctacatgacgagggctttctacttgagaagagctagcctgagctcctttttccctctgatgtgttttcaagataactgaggcattattctgtggtctaacacagcttcattcttctctagaccctatatctacggacctacgtctcagggggaaaggatgcaaattctccagaatttcaagcacaaccccaaaattaacaccatcttcatatccaaggtttgtgtggcatatggggtggaggtgaggcccctagcactctggggacctggggggtacactatgattcctggacagtgaattcatgtctgctgaaggaacttctcctgcatgttttcatttccgacatgtccagggatagggggcactgcctggggttagtggaaggagcagactgaggatttgcatgcatcatggataatctataaaggctatttgaggtttttccagttcttttggggatgtagaagttttaagttgtatttccttatttataaaaggaaaaaaagttcatttcctactctggcaaaagtaggcatttagatgaagttctctttacaagttggagatcctgtgtgtcgcggcagcctttgtcctggttcctggtgtcccttgatgatgggtggtggatgtcagcacagacttccgcaggcccagctcagggatggtttactctgcaatcagaagctgtagccccacagtttagaatagtcattcagattaagacagacccaaagcccaaaagaaatgagattttacaaccgggcgcggtggctcacatctgtaatcccagcactttgggaggctgaggcgggtggatcaccggaggtcaggagttcgagaccagcctggccaacatggagaaaccctgtctctactaaaaatacaaaaattagctgggtgtggtggcagacgcctgtaatcccaactactcaggaggctgaggcagcagggttcagtcacttgaacccgggaggtggaggttgcagtggagctgagattgtgccgttgcactccagcctaggcaacaagagcgagactccgtctcaaaaaaaaaaaaaaaaaaaaaaaaaaaagaaatgagattttatgtgattgtggctgggcgcttataagcaccaaaccttcatgtctgtggctgggaacctcgatgtttggagccccagagctgaggaatccacctacagtcagaattccatatggggcagttgttcctcccaggtcacatcccacgtgtgctgctggtgtcagtggccaacaggtaagagtatggatggttttgtggagacatatttctgtagccaaaaaaatgaatgactcaaagtcagtctctgttcaagggccctctcatctctgggctcctggcacccagcactgaatgtcactgatgcctggtattaattcttcaggatgactcttagcagaactcacacaaggtcctggagacccagagatgcctttctgaggtttattgcttcacctctctctgcctgcatcagatagaccctggtataaagaggagaaaagagtgattatgtttcaaaattatctacagaacttatttaaattctggatcagttgactttttttttttcctcatatataaaaaccttccaacttgtttctgtaggtaggtgacacttcgtttgatctgccggaagcaaatgtcctcattcagatctcatcccatggtggctccaggcgtcaggaagcccaaaggctagggcgggtgcttcgagctaaaaaaggtaaagtggcctttcatcttctgttgcaggaggtcactcctcttaaaccactttagttaggaagacgataggggtgagagctgccatgtgccctggggctaaatagactctggagggagggaatcccaaagcaaagacctagatccttatggcccatcattatttctcataccttgggggtgaatatgcaggtgttttccatgacagtgtcacggaatccacacagatgtgctctgtacactgtgcagctgtgttggtagatggtgagagggagccagggcaaggcagtgcttatggggtagacatggaagggagaaaacagagctgggccaccagtgtaagtggaggagctggaagctgcttctggaacttgatcaggaggcagggaaaggtttggtaggagcagcttgggcagacacacaatgggcacgtcattcataacctgtgcagagtgccgccctggtggcagcttgcagcaggggcagggcaagctcagtgagtgaggaggtgagaatcctcattgcaaaggctttttctgaggaggcgtggcacccctgtgcttgcttactgcggtaaaagggcccagactgccattgtggacatggcagggactgacactcttgctaagagatggccgtgtctgtcttactgggaccagggcacatcctgagacaaggacacaagccctatcctcaaggagtctgcttattcaaggaggcatctggactgctagaatgtttgaaaatgacaagattagtgggcatctgttggaactgtactgcgttcagatgtgtttaagaagcgtctagtagcttgtatttaaaatggagatgaggcagatagcatggactagaaatagcatggactcaggcaccaagccagctgtgtcacctttggcaaattattttctcctctgagacttggttttcccatccaaagtgggggtgacaatcctgtcttgccaagactgctgtgaggattcagcttataagtcataaaatgtagtcggctggctgggcacagtggcttacacctataatcccagcactttgggaggccaaggcaggaggatagcttgagcccaggagtttgagaccatcttgggcaatgtagtgagaccccatctctacaaaaaataaaactagctgggcgtggtggtgtgtacctgtggttccagctacttgggaggctgagacagtagcttttataaactgacaggactatgatctgctagcaaatgtgaatataattcattacttattccttactctaatttgaaaactcctttattgattgattgattgattgattgattgagatagagtcttattctgtcacccaggctggagtgcagtggcacaatctcggctcactgcaacctccatctactggggtcaagtgtgattcacctgcctcagcctcccgagtacccggactacaggcgtgcaccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgggcgtggtggcgggtgcctgtagtcccagctactcgggaggctgaggcaggagaatggcgtgaacccgggaggcagagcttacagtgagccgagattgcgccactgcattccagcctgggcaacagagcaagactccatctcaaaaaaaaaaaaaaaaaaaaagtgaatagaattgttttcttactcaaaacactgtttaacatgacacttggctcctttctttgcatctctgagctcttgtaagatttgagaaacaattacattcaagggcagtatgcttaacctactgacatttgaactacaaagcaaagatgttcagattttcctgaaggatcaagtctttcaggccacagaattttctgtcctagttttttaatacagtagtccccccatatctgcaattttcctttccacattcaattacgcatggtcagctgtagtctaaaaatattaaatggaaaattccagaaataaacaattcataagttttaaattacacactattctgagtagcatccatgatgtgaattcttgctttgtgcggcatattcatgcttaaattctccccacccattagtcacttagtagccatctcagttgtcacggactgtcactgtatctcagtgcttgttttcaagtaacctttatcttactaatggccccaaagcacaagtgtaatgatgctagcaattcagatatgccagagaagctgtaaagtgctttcttaaagcgaaaaggtaaaagttattaatttaagcaagggaataaaaatcatatgctaaggttgctaagatcgagggtgagaatgactcttcctgctgtacaagatgatcatccccagagcacatagccgtcagactttccaaggtcaatacaaaagaaagaatcttaaagacagctagagaaagggtcatataactcatcatgctaacagcagacttctcagcagaaactttacaagtcagaagagattgggggactgtttttagcattcttaaagaaaagaaaagaaatcctggctgggcacggcagctcacacctgtaatcccagcactttgggaggccaaggtaggcagattgcttgaactcaggagtttgagaccagtctgggcaacatgatgaaaccctgttcctacaaaaaatacaacaattagctagctgggtgtggtggtgtgcgcctgtagtcccagccactccggaggctgaggcaagagaatcgctttagtctgggaggcagaggttgcagtgatctgacatctcaccacggtattccaccttgggcaacagaacaagatcctgtttaaaacaaaaacaaacaaaaaaacaggccaggcgcggtggctcacacctgtaatcctagcactttgggaggctgaggtgagtggatcacctgaggtcaggagttcgagaccagcctggccaacatggtgaaaccccatctccactaaaaatacaaaaattagccgggcgtggtggcaggtgcctataatctcagctactcaggaggctgaggcaggagtattgctggaacccaggaggcagaggtttcagtgagccgagattgcaccattgcactccagcctgggcaacaacagcaagactctgtctcaaaacaaaaaaacaaaaaccaaaaaaccatagtgagacccagtctctttaagaaaaaaaataaaaaagaaaaatcctaaccaagaattccatatcctgccaaactaagctacatgagcaaagaagaaataaaatctttcccagacaagcaactgctaaaagaatttgttatcaccagactggccctacaagagagtcttgagagttctaaacatggaaatgaaagaatggtgacacctgctaccacaaaaatacacataagcacatagcccacagaccctgtaaagcaactacacaatccaaactacagagcaaccagctaatgacaccatgttaggaataaagcctcatgtctcaatattaaccttgaatgtaaacaacctaaacaccccacctaaaagacttggagtggcaaattggattaaaaacaagacccagccttctgctgtcttcaagagacctctctcacatgtaacaggactcataggttcaaagtaaagggatagggaaaaaaatctatcacacaaataaaaaaaaaaaaagagtggggcagggggtcactattcttgcatcagataaaagagactttaaaccagccacagtaaaaaaggacaaaaaggtcattacacgatgataaatggttcaattcaacaagaagacttaactatcctaaatatatatgcgcccaacattggagcacctagattcataaaccaagtacttttagagctaggaaaaggcttagacagccacacaacaatggtaggagattttgacaccccactgacagcatgagacagattatagaggcagaaaactaacaaagaaattctgtacttaaaattcaacacttgaccaattggacctaataggcatctacataattctctacgcaacaaccacagaatatatattctcatctgcccccagaatatactcttaagattgatcacatgggcctggtgccgtggctcacacctgtaatcccagcactttgggaggctgaggccggcagattgcctgagctcgggagtttgcaaccagcctgggcaacacggtgaaaccccgtctctactaaaatacaaaaattagctgagtgtggcggcatgcgcctgtagtcccagctactcgggagcctgaggcaggagaactgacttgaagccgggaggcagaggttgcagtgagccaagatcatgccactgcactccagcctggggaacagagcaggactctgtcacaaaaaaaaaaaaaaaaaaaaaaaataattgatcatgtgtttggccataaagcaatgtgagactttatgctcgactttattaaagtctcaataaattcggcagggtgtggtggcttacgccgataatcccagcactttgggaagccaaggcgggtggatcacgaggtcaggagatcgagaccatcctggctaacacagtgaaaccccgtctctactaaaaatacaaaaaattagccgggtgtgtggtggcagttgcctgtagtctcagctactcgggaggctgaggcaggagaatggcgtgaacctgggaggcggagcttgcagtgagccgagatcgcgccactgcactccagcctgggcaacagagcgagactctctcaaaaaaaaaaaaaaaaaaaaaagactcaataaattcaaaaaagtcgagatcataccaagcattttcttgggtcacagtggaataaaagtagaaatcagtaccaggaagaactctcaaaaccacacaattggccaggcacagtggctcatgcctgtaaccgcagcactttgggaggccaaagtgggaggatcatttgaactcaggagttcaagaccattctgggcaacatagcgagacctcatcgctaaataaaagaaaaaagaaaaaaaaaaacccacacaattacatagaaactaaacaacttgctcctgaatgacttttggataaacaaattaaggcaggaatcaaaaattatttgaaacaaatgaaaacagatacaacatactaaatctctggggtacagcaaaggtattgttaggaaagtttatagcactgaacacctacatcgagaagacagatttcaaattaacaatttgagatttcacctgaaggaactagaaaaataagaacaagctaatcccaaaactagctgaagaaaagaaataactaaaatcagagcagaactaaatgaaattcagactcaaaaacaatacaaaggatcaatgaaataaaaagctggttctttgaaaagatagataaggccagtcgcagtggctcatgcctgtaatcctggaactttgggaggccgaggtgggcggattacaaggtcaagagttcaagaccagcctgaccaacatggagaaaccccgtctctactaaaaatacaaaaattagtcgaatgtggtggcgcatgcttgtaatcccagctactcaggaggctgaggcaggagaattgcgtgaacccaggaggcagaggctgcagtgagccgagatcgcacctctgcactccagcctgggtgacagagcgagactccgtctcaaaaaaaaagataaataagattgatggactgctagttagattaacagaaaagagaagatccaaataagcagaatcagaaatgacaaaggtgacatcacagctgatccccagaaatacaaaagattctcagagacttaaaaatacctctgtgcacacaaactagtaaatctagaggaaatagataaattcctggaaacatacaacttcccaagattgaatcagaaattaattgaaaccctgaacagatcaataaggagaaattgaatcagtaatttaaaaaaaaaatatggccccaggcatggtggctcacacctctaatcccagcactttggaaggctgaggcaggtggatcacctgaggtcaggagttccagaccagcctgaccaacatggtgaaacctcgtctctactaaaaatacaaaactaggtgggcttggtggcgtgtgcctgtaattccatccacgtggaaggctgaggcaggagaattgcttaaaccctggaggtggaggttgcagtgagctgagatcgtgccactgcactccagcctgggtgacagagtgagactccgcctccaaaaaaaaaaaaaaaaatctaccaactaaaaaagtcctggaccagatgtattcagttctactgaaactattcaaaaaaattgaggaggagagacttcttcctaactcatactacgaaaccactatcatcctgataccaaaatctggcaaagacacgatgaaaaaactacaggctagtattcctgatgaacacagacgcaaaaatctgtaacaaaatgaggacaaagcaaatccagcagcatatcaaaaagttaattcaccacaatcaaataggctttacttctgggatgcaaagttggttcaacatgtggaaatcaataaatatgattcaccacataattaaaaatgaaaagcatataattatcctaatagacacagaaaaaggttttttgtttttttgaggcagagtcttgctcttgttgcccaggctggagtgcaatggtgcaatcttggctcactgcaacctctgcttcccagattcaaactattctcctgcctcagcctcccaagtagctgggactacaggcacgcaccaccatgcccagctaatttttttgtatttttagtagagacagggtttcgccatgttggcagtgctggtcttgaaggcctgacctcaggtgatccacccaccttggcctcccaaagtgctgggattataggtgtgagccactgcgcccagcccagaaagagcttttgataaaattcaacattccttcatgataaaaaccctcaacaaatggcatcgaaggaacatatctcacaataataaaagccatctatgacaaactcacagccaacatcatactaagtaagcaaaagctggaagcattccctttaagaactggaacaagacagccgggcacggtggctcttgcctgtaatccgagcactttgggaggccgaggtgggcggatcacaacaaggtcaggagatctaggtcattttggctaacatggtgaaaccccatccctactaaaagtacaaaaaattagccgggcgtggtggcaggcacctgtagtcccagctacttgggaggctgaagcaggagaatggcatgaacctgggaggcggagcttgcagtgagccgagatcacgccactgcactccagcctgggcgacagagcgagactccgtcccccagaaaaaaaaaaaaaaactggaacaagacaaagagcccaccctcaccacacctattccacatagtactgaaagttctactcagaccagtctagcaagataaagaaataaaaggcatccagataggaaaaaaggaagttaaattatctgtcttccctaatgatgtgattctatacctagaaaaccctaaagactccaccaaaaggctcctagacctgataggcaacttgagtaaagtttcggaattcaaaatcaatgtacaaaaatcagtagcatttctatacaccagtaacattcaagctgagagccaaatcaagaacacaatccaatttataatagctgtaaaaacaaaagacaaaacctaggaataactacagaacactcctgaaataaatcataggtgacagaaacaaatggaaaaacattctgtgcttgaggattggaagaagcaatatcattaaaattgccaaactgcccaaaacaatctacagattcaacactattctatcaaattgccaacatcatttttcacagaattagaaaaaaaacttataaaattcatctggaaccacaaaagcacctgaatagccaaagcaatcctaagcaaaaggaacaaagccaaaggcctcacagtatccaacttcaaactatgctacagggcttacagtaaccaaaacagcatggtactggtacagaacaggcacatagaccaatggagcagaatagagagctcagaaataatgccatgtacctgcagccaactgatgttcaacaaaattggcaaaaatatgcagtggggaaagtactccctattcaataaatggtgctggggaaactggctaactgtatgcagaaggatgaaaccagacccctgcctatcaccacatacaaaaatcaactcataatggattaaagatgtaaatgtaagacctcaaactataaggatcctcgaagaaaacctaggaaatacaatattcacaaagttgtgcaactatcaacacaattcatgtttagaatattctcatcagctcccaaaagaaaccctcatccatgcacagccactcctaatttcctcttgttcccaacccccagctctaggcagcccctaatctactttgatgtctgtaggccttttctggacatttcatgtaaatgcagtcagaccacttggggccttctgtgactggtttcttttcacttagcataatgttttgtttgtttgttttttggagatggaatctcgctctatcgcccaggctggagtacagtggggcgatcttggctcactgcaaccactgcctcgcaggttcaagggattctcctgcctcagcctcccgcgtagctggaattacaggcatgagccaccacgcctggctaatttttctatttttagtagagatggagtttcaccatgttggccaggctggtctcaaactcctgaccttgagtgatccacgcccacctcagcctcccaaagggctgggattacaggactgggtcaccacacccggcagcataatgttttcaaaaagattatctatattgtagcatctgtcagtacttcattcttttttattgctaaataatattcgattccatggacataccacattttatttatccacacatctgttgatggacatttgggctgtttccactttttggctcttagaagaattctgctatgaaattcatgtacaaatttttgtgtggatatagtttcatttctcttggatttatgcctggaagtggaattgccaggtcatgtggttataacagtgtgtttaacattttgatgaactgccagactgttttccaaagcagccgcatcatttacattctcaacagcaatgcatgcgggttctagtttttccacatccttgacaacagtggcagttatctgcttttttgattgtagccatcctcggagaggggcgtgaggtgataatctcattgtgcttttgagttgcatttccctggtgattaatggtgtggagcatcatttcatgtgcttactggctatttttatattgtttttggagaagtaatctgttcatattcttctctcatttataattaatttgtcttgttgttgagtttcaacagttctttgtataacgtagatacaaatcccttatcagatatatgctttccacatttttttattctgaggattgttttttcacttgatggtgtccttggaagcacaaaagacttccaaattttgatgcaatcccatgccaagttcaggtggtaaccccgagtgcagggcttttccactccagtgcttgcttttgagcctgggacccttagctcttggcattctaatggctaatgttgtcttctttattgccgtttctcattttttcctgcagggatggttgcagaagagtacaatgcctttttctactcactggtatcccaggacacacaggaaatggcttactcaaccaagcggcagagattcttggtagatcaaggttatagcttcaaggtacatatccatttggcttctggttagactaggaccaaggccttcttgataccctggcctccaggagaagcgagggccactgtcagcaggcaggcaccaagcattaggagattagaggccttgcctcaaactccctttatctctgcatgaatctctgagggcagctgttggtggaaagtgtgccgtcctggcaggactgaggtgccatggcactatgaccagcactgtgtgaatctgagccccgcagggctgctttctcagggatgcctctctaggtagctaggagagctcttcctttcatcagctggtaagctccaggccttagtttgcctcagtttgcctcccagacatcagagctatcctgtactacaaatcaggtattttaataattgggaaattctaaagctttggctaactttcactggctgaggcatttgctttctttcctgttacacaaatattacgtttatgtcagtatttggtgtccagagggctttatattttggggatagatggagggttctagaagtaggggaattaaattccccctatggtccactaaaaggacatccctagaacattagactcccaggttcttgattgcaaaagaccgcaatccaggctgccttttgagatacgtttttaatgtgtctctttatgcattggtgagagttcccattattggccttaggaggacagggttgtctgaccttccctcttttagctagaggcagtgacacttcagacctctcatgctggcctagaggacaagatgcttgggttttgagcccagttttttggaggatttgcatcatgacctttttatccatccatgaaaatccctgttggtaatagcattcctacctcctgattcctgccgagctgtgagggtaagaggagcaccaggtcagaaagagcaattctttgaaaggtgacctcgacaaaaaggcacaatgccatgccgtagtagtttgtgttggttggagctgtgtcttcggtgctgcctgttgaggagcagtggttggagttcccagagtcatgacgtggagtggctgggcctgggcagatgtgcacatcgtctgtactctggatccctggcccagaaggactcagatccttacttctaggaattttcatttaatgaacattatgagaattggagggaaggagaattccctttacagaatcaacccaagttttctgcagggatagggagcccttgtagtaagttatccccatagaaatgaaaacccagtctccaccatgctgttcttactctctcagagaagctctataaataatcttcctgatatcctatcattttcattttcacgtgctcattcctgctggaagccccagttgcggagcacagcagatgccagggaccttcacaaagggccacagcctgtgccttccagtcacttgtcccttcctttgtctgctccaagatgtgaaggctacccgaaggagccttttaaaatcactaagattcttcctgttgatcttccatacatgatcatttagatgctgtgtgctgggggcagatttctctgaaattcctgcatccctctggtcttgagatcattagtcaagctccctgttaaaggcggctcctgatgctggtctctggaatgctagggaggagctctccattgttggccaccagggtggctgggcctggggagggaagtgaccaaagcaggtggacccaggagaaggcagaggagggctggggagagagagcagaaaggggcatgtctgctggcttgggctttgcaggtgatcacgaaactcgctggcatggaggaggaagacttggcgttttcgacaaaagaagagcaacagcagctcttacagaaagtcctggcagccactgacctggatgccgaggaggaggtggtggctggggaatttggctccagatccagccaggtgagtaaatgggtgaggaggttccaggtgtcagtgctctcacagggcagcgtttgtagacacagacacagacatgtagtcctgcctggatgggcccatgggatttttttggaaatgttggaaaacacggaagagatgaacagaaacaatccttgttgcccttttggtgtgtgccccttgtactgttgcacacagctgagctcacagtggctgtgactggtctcctgctttgctcacacgagtatttgttaaatcttgatgttgaagcccaggatggcaagcaggtgaccccagctcaccttggtggtgactggagggagcatgatgggctgggggtacgtagttcccacacacagggctgccatccctggctgtggccacacagttctcctctggttcctcctcagtgataaagctgagccctctagcccctaagactgctctgaggatcaactcttgtggtagcttcgatacttaactttgaaaaatgtagagttctgtgaaaatactcaacctttcatttattctacaaatatgcctgctctaggccaagtaaatatatggtctaattagtgagagcatcattatggagaattagcaggcctgtccaaggggagaagtgcacttcagtcaggtgcgtttgaaattcagttgccattagagccggaaggtgagcaactgctggaccaaggcaagaaggaaacagctgtccctgggaaggggctgccctccctccagcctaaggctttcctcccccgacccagggggcactctccatgggaacccaggagagtgctctcattgctctcactggttttaaggaggtgcctggttcattctcctcacaggatagcaatgtcagcactgatgtggttatccccattttacagatgaggtcattgaggtgcagacattaattacttgcctcagggttactcagggacaggaggagccaagagtcaagcccagggctttctgtccttccacttgattcaaagccttatggtggtgtctcaggagattttaaggaacttttgccctaactgttaaaaaattctgttcaggccaggcatggtggctcatgtctgtaatcccagcactttgggaggcctaggcgggaggatcagttgagtccaggagtttgagaccagcatggtcaacatatcgagaccctgtttctctcttaaaaaaaaaaagtttgttcagaagttgttattaagtgaggtagtgtggcattatggttaagaacagtctgaagccaggctacctgggtgttcaaatcccatctccttaagagctatgtgatcttggataggttagttaatctctctgtgtctcagtttcctcttctttcaggtgtggattatagtagttttgaggattagaggagataatgcatgtaaaatgcttagaacaatgcctgagacagtaagcgatctgtaaacattattaaaaatgatgtattaaatttatgtaagtcttataaaatttgctgtgattataagtattataaaaggagtatcttttcttctggagactaacatgggctggttcccccttcccggcaggcatctcggcgctttggcaccatgagttctatgtctggggccgacgacactgtgtacatggagtaccactcatcgcggagcaaggcgcccagcaaacatgtacacccgctcttcaagcgctttaggaaatgatgcttaggcagggtacttcgttcaagaccggcgcttggcacccttgttggaaagggattttcagcataacattttccttccacctctttgaccttccctccagcgttggccaaattgtgctgaggaagatgcatcaagggcttggctgtgccttcataggtcatctagggttttataaaggaggaggagacaatattttttcaaactttttggggagtggggtcatttctgtatataaaaaatgttaatatttaaggtgtatttatgttaccgttctgaataaacagaatggaccattgaaccagtcttcattgtacaagtgtttttatgcttcgtcctgggcatgggttatgtctggatgaccaacctccatcaaggccctactttgtagcaagcacagatgagtaagatggagcccatccccagggagctaccagagagatgtaccctgagatagaagaaacgttggcaggaaaggcctggggaacggggagggtgatccagccagagggaagagcctgggtagttgactgtggtccctgctcacagcttagcctggtggattcagactggggcttcaaccgcacagcttcctgctgttctggtggtcacagctgttcctacagcctcgtccgaggtagacacccacgtcatgaaggccttccaggttggctcctggtgcctcatcttctctgagagagtgacctcttgtttctccctcaaagtacgtttttagaaattgctgagaggctagattcctcttctaatagcagtttagtgcccttgggtgttttaattgctacttcctttatttttaatggctttgggcttttcttttatgttcctggtatgaaagcaaaggtgttgaggaatagacaggccaggtaggattgcttcttgaaaggtaggcacacataaggcatattcgccttgcagaaagacttgtgattctgaggaggaagcccactctgcctgtaacaggaaacagcgctcacacttggggagtgttgaaaccctggctacataaggcttccaagtggagtccctccccatccccacagctcggcagcagcttcctgtcctcagctctagcacaggtgggctactctctgtgatgcagccacagactgaggagaagaaagtattaggttggtgcaaaagtaactgcagcttttgccattactttttttttttttttgagacagtttcactctttgtccaggctggagtgcagtggtgcgaacttggctcactgcaacctccacctcccgggttcaagcgattctcctgcttcagcttcccaagcagctgggaccgcaggcgcccgccaccacgcccagctaactttttgtatttttagtagagatggggtttcaccatattggccaggctggtctcaaactcctgaccttgtgatccgcccgcctcggcctcccaaaatgctgggattacaggcttgagccaccacacctggccaccattacttttactggcaaaaaccacaattacctttgcaccaacctaatacctctcttatcagggggctttgaagcaagagccacctgccccacataccgcctctctgagctgaccttttggtgacaaacacactctcatagtctggtcagtagctggtgctgccaggcatctagccactatcagtgcaagccccaggaaccagcaacagggccctcgctaggagtagggggcccgagcagccctgtctgaggtgcgggcttgagcccacagactcgcctgtcatgtaaccctgatgggtcggcactcaaatgttcaaacttgactgtaactcttttcagtctacctcctgtcttgcctttacacttgagatcctcaaacaatactgagcatttcctgtattttcacatttctggcccctgttttcttgtctactgacaatgttgaattttacctgagcactgtgatcctaggaaatagatacatttaaaggaatcccttgtccttggtgttctggaaaatggcttactgcagagaaccatccttcctggtatgactcatgaatgctccccttgaagaccccagtcgaggccagacacaggccttccaaattcccattctttgcctcataaattagctaaactgcttgtccccagtgatcaatgggaacaaaatgcttgtgaaccagactttgctttacaaactttggctcaccctcccctccacccctcgagagaatagactggactcagggtaagtcactgattggatctactgtcccaccatgctactccccttcatcccacttcctgtcttttacttgcttcccct

SEQ ID NO: 16865 - DNA, 17476 bp, Human
gccccgccgagccgggccccgcgccgcggccgagctttccggggagcccgagaggccccgcgctcggcgccggctcggtccgcgctgctggcgccgctgggctgcggcccgagcggccgggccgccgcaggccttcggggccggggctcccccacttcgcccccgaggtgcgcctggcgcggggccggggcagccacctgcagccggggccccgcgaggccgcgccttcctcctgcgcggggagcggcttccggggtcacggtcgccccgcggacggataggatgggccgcggggggagagtcttggattgcaacatcgctggctcgcgggggtgggggccggcgagcgggcttgttttcggtgccttaaaaccaaaacaagtgtaagttttcttgtgcctctgaagatgctccgctggcgcttgctggggccctgaacgtgagcgcctcgctggagggggagttttattctgttttggacatctctttttatcggttgaatagtagttggttctggtagttaacgtgcgtaggaggaatgtaagggaatgattagttgggcttgtgatcgtggcctgtagtcacgcttgaatcgcagaatgaagtggttttgtttgtataattggaagttacgcttagtttctctgtttgcaaagtgcctgtctttggggagttcggtttgtttccttttacaggacctaccccaagtgtttcttgctcttcaagaaacgttgcctttgggtagagaacctatgcaacggaagacgggacggatcctcagtttgccctgattgctcattcagagaggtccgttccctaggccactgggtgattgctggtgtgcgcttgtatggtgtctcagggtttgggatcttgcttcagaaacattctcggggcctggggcagatcaggtgcggccaggtaagcgtctcccgactgcaggtgcttgggtcttgcagaagggaatacctccccaagcctgggagagtttgcatttgggtgcaggagggcctttaaaggcttcttgtgccagcctgtcgtggcgaccacccgttgtggagatcagtgcggtggagttgtgggaggtgagtgctttgctcaccctcagccaggaagttgctctgaagtcggtgctgtcaaccagcagagcaaggcggtgatccgagaagctaaagctcagccggttgcgggcgcccagcaggaggacagaaggcagactttcgggccgctcctggagtgcccggccctgtccccgtttctgcagtgtctgggccttgcctggctctaatagatgagggttgtttttgtctttgcatcataaaagtttcttgctctgaagcgtttagtaactactagccgttcactaagtgcctatctgtgaatttggaagggcaaattcgattttcagcggaattttgaacgcttgatctgtgttgtgattacattgtaacagattggccgctttctccagaaggccagtaggagggggtgcagggggaggggcctggcttctgtctgggacacggtgggtgtgcacctgtggctccttgccctggcggtgcagtgcctgtgagaccaccccgtggtgctgagtgctttggggcaggggacacagcagcagcagccaggtcttggcaggaggtctcgcaggaccacccctcacgacttctcacacctgagacagcaatagctaggtgctgggacgggggcctctaggcggctctgtccagtcctcagcaggagggctgcctgtggcagggtcccaggcccgtctggcctctctgtggcctggccttgcctggctgtgaggatagccttgcccatggtccttcagtgtctggagcactggcctgaggcttcagagacttgcctgatgcctggcctcgctcagaccccgggcacctgggaggtcgtgcctccttgaaatggccactcgccaggctgctttgcaccgcaccgggcacaggctgcggccactcaggaagcccatcctggggctggggaagcgagagctgtgagtcctcaagtcgcagctgggctgctccacgtgggagtggagggtggaggaacgtgtggagtttcggagtccagcccagtgcggagacagccttgaaaccgtggttggcgggcgctccactccgctctgggctcgaaccctgcctgaccctagctgtgccccccactttctccctgtctggcccctggctccccgccccctcacttagaggagggcacggggaagggcaaacggtccagagggcgggcggcctgcgggctcctctgcatcatgtgaggagggcgtggggaaggacatcccggtggggcccgatctggggctgcctccagcccgggctgcctgtcttggacttagtcgtggacctggaggccagtgcccggctggcccctgtcaccctctcgctgtgacgccagcgcctgctgactggaggacccaggttccttcgcctgctttttctcaggctgccctgaggatctgtgtttggtgaaaaggagccaaattcacctgcagggcaggcggctctagcagcttcagaagcctggtgccctggcgacactggacctgccttggcttctttgatcccaaccccacccccgatttctgctctgctgactggggaagtcatcgtgccacccagaacctgagtgcgggcctctcagagctccttcgtccgtgggtctgccggggactgggccttgtctccctaacgagtgccaggtgaggctgcggcggctccgacgcaggtggagctgctgacctggcccctttctgcggctgcgaggtgtgtgaggttcgtgggcctccacaggtgtgggagccatccaggtccccagggcccttgtggctattctaggacagcccaagccgtagtagggacggccccccacagcttagaagacctggctcagtcccccagctttgtagaggtggcccttgtttggtgttgagatatcagacttgggggtagtagcttcagtgttcccatggactttgaaaaccagcacacacttaggtttgaattcttgggcaagttttgtatcttgagcgctgtttttcgtgggtaaaggtggccaccagtagggtgacagttgagggtggcattgaggctgctggccctgtctgcctggtgtccccagtgacagtgctggccgacaggctcccgccgagaacgcaaaggcgaaggtgccaagcccccgaggtcccgtgcagatgtgtggagctggaatctggcgtgtgtgccgctgcctctgatcagggacctggtcccctaccccatgctcctgccctgccctgcaggacccgtctgtcccctgaagccacagggacgtggtagtggctgcacggtctgggaagggtgtccccgtggagggctcctctctcagtgaggctgagcctctgccctgtggtacttgttctgctctgtcttcaacatggtgaaaccctatctctactaaaaatacaaaaattagctgggcgtggtggcacacgcctgtagtctcagctactcgggaggctgaggcaggagaattgcttgaactcaggaggcggaggttgcagtgagccgagatcgtgccactgcattccagcctgagcaatagaatgagactctgtctcaaaaaaaaaaaaaaaaaaaaaaaaaagaataacaggtgtcccctggcccagcctgagtctcagttctgagcgcctgatactaaggcagggacccagcaccccacatccatctggggccccagccctgcctagtccccacctgatggtatggtgaggaccctgccatgtcagccaccacagggtggcagctaccccccagccgcagcggcccagcctctgaacatctgtctcctcaccttcgagcagaggccgcagcatgtgtcgcagaccagggctgggttggggccatggggaggggtcctacctgcccccgcctcccggtgatctgggcgccgctcacaaggcctcccctggtagacccccggggtcggacgacggcttgcaagaagagagtccctgctgggccaggccaccgtatgttaggagcaagcctgcctgctgcgggccacgtgcgcgtgctggggtggcaggagcccgctcgcctctcctgaccccgtgctctgcctcctgtgttccagggactttgaacatgtcggggatcgccctcagcagactcgcccaggagaggaaagcatggaggaaagaccacccatttgtaaggagggcttcatttctgtgtgcagtgccgcggacaggccccctcggctgaaaccgcgccctccctactgggagggagctggtcgcgtgcctgggctgggccggtgggactcgcaggccggttcttggtggttttgctcaaactagatgccgccacgctgatatgcttttgtggttgtttccttttctctcagggtttcgtggctgtcccaacaaaaaatcccgatggcacgatgaacctcatgaactgggagtgcgccattccaggaaagaaaggggtaaggggcgctgccggcctcctgcctgtcggggctcagcagatgcgtgcggcagtgccatggggatactccgctcagatccctgccgtccgtgacggccacccttgtcacaggccgcggtcaacagctcagatccccagctgtggcctggcccccgccccgtgaggacttgagctcagaaggtggtgctggcaaggttggggtgacagctgtgtccctaccgagggcatttctggttgagaaggaagcaggctgggcctggccgggcacagggctgagctgtggcagaggggaaggggctctgatgtgtgttgggagcaggcctgaggggcgggcagcctttgcgtgctggaacccgggattctgctgtgtccttccaggtgtggctccggtcgcgggagctgggtttgcaggagagccaccccggcctaaaaccgtctactggagaacctcctggggcacagggactggcggcagccacctaggatgcctgcttggggccccgtgtgtctgtggcaagcagggcggcccatgtgcctgtcctctttgcccggctcacatgaagtgcttggccagggactccaggccggcttgcacataaggttcatgctcgtggactctgaaggaaggagagatccctgaggtgttggtcctgcccgaggccttgttccctccggcccatgccagcctctgggtttcgctctgaaactcacagcagctccggccccctgagctgagcagtcccagcaggactcagctttgcccgagacaggatgtggcttggatttgtcacttgtctgaggctctgctgagaacgtcccttgcccttcacgttacggcgaggcaggtgcgcgcgcggccccaaggaagacaggagtggtgtcgggttgtggggtggcaaaggcgcctcatccaggcgggacctggggcaggggcttgcagaacacactggggtgagggcacaggtgtgctcttggcgctgccggccccagtgtgcggcactcgttgccccccagcccagcccccgacccccgtctcctcctctcctttccaggagggcctttccgactcactctctgggcatggcagaggtcctgaccgcccccttggtggggctggtccaggcttcaggctggtatgggagccgcctctgtcgggcctctggcccccggtgtcctcgcagtcctggaggttgtgtcctagaagcgatccccttcctcctgggccggcctgcggcaggcaagcagcccatctcaccacggtttatttccccacagactccgtgggaaggaggcttgtttaaactacggatgcttttcaaagatgattatccatcttcgccaccaaaatgtaagtagctccctgttcagtgtcctggaagtcggcctgttcctgcggggattggagtcctctccaaagaggcccgtggctgtggccgtggcgccctggtccgggcgatccatggagctgggagggagtgagatcacagatttggaggtcggctttgatccctgatccccgcctcaggctgcagatgcgagtctgtttccagctccacgggtgggcggtgcacgtaatagacttagtctctcatcccagctaattggctgggaagctccagagtcctttgcagggagaggctgtgagatccaggctggagctcctgggctaggagtgcctggaccctcagtgattgttggcgatgaagacaggatttggtgcccacaagaccccagccctggatgggatggacgtgcagaagcgccaccactccgagtctcactggagggtttatcttgccccacctcactgctcttcctgtgggctctcgcagtctctcccacccggggctgcgtctgcagccgggcaggcatagagcaggggagcagcagagaaggcgcgagaagaaagggctgaggccaggttcgacattgagcctacagctaagttagtgatctcagtcagttcagcaaaactcaggagagggaggagagggccgccacgtccctgccgtcccatagctggaaatcggcaggccctttctgtggtgagttccacgcattaacacgtgcccagcacctagacagcgcctggccacggtgaggcgagagtgctgtgtaaaagcttccactgcaattgtcactcaagacacacaagtgttttccacagtggcagtgaccagaggagcttgaggactgctgacagcaccagctggtcgagacttgcttcatttttggattgtcctttgctgtttgattttttttttaaaccatgagcaggtattacttaagatgacttattttaattaagaaaaatataagaatgagacacagtagctgctttcattgattctgttcaaccgttgattggaattccaagcaaatgcagcaagacaagaaaaagaagtcacaacggaagaggtggggaggaaggccaggacaacagctcagtaaagctgaggtgcaaggctgggcacggtggctcacacctggaatcccagcacttttggaggccgaggtgggaggatcacctgaggtgaagaccagcctggacaacatggtgaaaccctgtctctactaaaaaaaacaaacaaacaaacaaaaattagcgggtgtggtggtgggtgcctttaatcccagctgctcgggaggctgaggcaggagaagtgcttgaatccaggaggcgggtccagtgagccgagatcgcgccactacactccagcctgggcagcagggcaagaccctgtctcaaaaaaaaaaaaagaaaagaaaagtagcacaggacctggtaaaggaaacaaagctaaataataaatataaaaatgaagtcgagattgaggtacacaaatctgcttttatatcatttcagcgagcaaggttttaaaactgccatttatagtagcatgaaatacgttggaataaatgcaataaaagattggttcaggacctctgtaccgaaaactgtagaatattgcaagggaaaccaaggccggcctgagcggtagctgagctctgccgtgtgtgtggaggggaacacacgacattgtacagacagcccttctctccaggctcgtctgcagattccatgtgatcccagttggagtcaagcacatcttgttggaaactgtcccatggacccaggaaatgcagaaacgtggaggccttggcttcttggtggggtggcgagacccaggctgaggctccgtgggtgcagagcacacccacccacccccaactagacctgccacgggacacggtgatggagactgcaggattgctgagaagacaggcaggcagacccgcggacagaacgaggagtccggaggccacgcatgtggtggtttgggctgtgacaccctgagggatattccagcaggagagacgagctctgcctcccaccatagagaaacagcttccagatggcttgtggtgcccaagcaggacagcgtggagaggaagacccgggatggtgtccgtgagccctgggcaggcagggatctcttcaccagggatgcagtgaagtgctggccggagggagattgacgagttgactaagttgaaattaagaatctctctttatcataaagactgcagttggcgccgggcaggagggcacactacagtgtatgtacgtacctcagccctcaccctgaatctaccaagagctcctgggaatcagtaagaaggctgccatgacgtccagcgtgtccctcacaggaaaggcctccacccagccagcaaatgcggcagggatgcctggctttgccaaagagtgaaagcctccccagtgggatctgccgtagcgcacaggggagcagacggagccgcggcgcagggcagcgggagcctcagccaccgctggagagagcggatgttctgaacgtttcccctggacgctgcctgccacaccagtggaagctgagctcatgctgtaggacctggctgttcacttgagtcagtcgagattcacagaagcacatacatgtgtccaccagaggcacagatgggtgccggtgtcacccccacttgccccagcccagacgtcctaggatgacaggtagggaagagtgaagaggccacatgatgcctggcggacagtccagacaggagggcaccccctttgtgttccttctttgaagcgtgggagcggccaagccggaggccatgaggaagtaggaggcagcctctaccttgggagggacaggtggacctggcagtgctggcatccagcatctgtgcctttctgcgggtaagttgtgatcggcagaagaaacgagattgagaatcagattaaattgaaattaggcaatttttgtttttgccaaaagattcccttagaagaggaaaaggtcgggccgggcgcgttggctcacacctgtgatcccagcactttgggaggccaaggcaagtgaatcacttaaggtcaggagtttgagaccagcctgaccaacagtggaggaaccccggttctaataaaatagaaaaattggccaagcttgatggcgggtgcctgtaacctcagctactctggaggccaaggtgaggcgggagaatcacttgagcccgggaggtgaaggctgcagtgagccgagatccagcctgggcaacacagtgaaactccatctcaaaaaattaaaaaagcaaaaagtcaagccccaagcagaagagccctgtaagacgtatcgcttgaggaacttgtgcgaagcagtcgccaggaagcagcctgggccgaaaggggcgctcagcggtcaccagcaggcgcagcgtagcaccacggagtggccgccgtgcacctcacccagtggctggaatccgccagcgacgcagcctgcgtgagcagcctggaagcagcacggcttgagggccaacaccgtgaccccacattccacagcagcgcgctcacgcgtgttcgcactcaggacagccacgcagctgctggtgtcgcccgtgtgctcctgcggtgtgggatggtcgcggtgtgggacggtctgcggtggtgtcttcgcgttccccagggagtgtgccctgtgcatctccatggtacctgaagtccaggaagctgcctgcggatgttgcagttgggattacggggcagatgcagtggtcggtaggagcgagtgttcggggaagctgtaggtgttcgtggcgcgttggctttctggtaattcctccggctgcactagacatgccgcactgtgtgtccttccgtagcattgagagagaagagggaggatgcccaggtaaaagatgggaaatagcctagaatatcaactgtgatggtccctggtggggctaatggtggcaaacttttctgcttttttgtaaagaaataacacagggtcctaaaagcccgtgtatcctggaagcagagggtctgcgtcggaacagccgactctggaagggcgttggctatgtccctggacgtctcctgcagctcctcccatctcccctgagtctggcccagctggaaaggatgtgggggccacaggttaagtggccaccctggggcctgtgttcccagactgcctggctgtgctgggagttctgtcccgggagagacacagcttcgtctcggctgcggccgtgtccccaaggctctgttccctgtgtgcaaaggtggatatgtcttcctttagtctcctcatggccacaatttaatttttttgaaaagtttttggccaaataacctggctaccaacccggggccccagtgttgggaggagggtgatgtggggaaggacgtgactctgggacagtgcctgcctccaaaaagtgcttcctttcttcctcttcctccaggtaaattcgaaccaccattatttcacccgaatgtgtacccttcggggacagtgtgcctgtccatcttagaggaggacaaggactggaggccagccatcacaatcaaacaggtacggggcctccgcctccggcacgggcagggctgccttagtctcccctccggacacgtgggtctgtggtcattctctgtggctgaggccgagtctcacggtgtctccctttcaaactgctcacacccgtcttgtgtttttgtctctggcacagatcctattaggaatacaggaacttctaaatgaaccaaatatccaagacccagctcaagcagaggcctacacgatttactggttagtagcagccctggccccgctggtggcagctcctccccgtcccagccaaggccgcctggcaggacgggagtggagcacacaggctcaccctagggacagccagggtccgcgcctctgtggggaaggtcggggggcataaaccctgtgggcagcaggcaccgttgcacaccgtctgcggtgggcatggatggcgccggagccgtgtccaggggagggagcaggccaggtgacaggggctgtcttgggccactgccccagtgagttgtggccagctaggaggggaaggaccctgggcgtgggtgccagaggaggccatgctgagaggcctctccaccggctcagcctcccgtggaccccagcctcccgcgccgcccttgctgcttgtccccatcccctctacaacttggttccttctgtgggggggcccagcccagcagggctcagtgacgtgatgctgtcacacggaccctgggcttccaccctgtccctgtgaggtgctgctgtggctagaagggtccccgtgggcctggggtcctgtctgcaccgaggagggcctggtgtgagttaggatgcagacgacagccaaacagtgctggggaaagcagggaggaccctgccctgagcagaggccatgcgcccgcctgtcctgttccctctgcagctgttctgggcaggtccataagaaggtgggttggggcctccgacccccactgctccgcctgcagggttgagaaacccagccccatctcaccacgggtccccacacctctgaggaggtctcagggcccccaatggccagggacccagaaggctcacctgcagccaccccacacatccctgccactgtgggcatcagaggccctctccctccagggtgcatctcctggtcaggaggggggaggcccggttgccttaggcccggcctgcacaggtcgtgaggaaaagcacctggtttcggccgggcgcggtggctcacgcttgtaatcccagcactttgggaggccgaggtgggcgaatcatgcggtcaggagttcgagaccagcctggccaacatggcgaaaccctcgtccctactaaaaatacaaaaaattagttgggcgtagtggtgggtgcctctaatcccagctacctgggaggctgagacaggagaatcacttgaacccgggaggcggaagttgcagtgagccgagatcctgccactgctctccagcctggcgacggaggaatgctgtctcaaaaaaaaaaaaaaaaaaaaagcacgtggttttggagagatgtgtttctccctggatgcgggcccagcccaggtgtctgcaaggtgccctccctggtggccgagggtggcacagaggccccaggcagggagcaagtatcacagcagccaccccaggctcagcctggctcccctgcatggtggtgcacacctgtagtcccagctatttgggaggctgaggtgggaggactgcttgagcccaggaggttgatgcgcagtgagttgagattgcagcaccgcaatccagcctgcttgacaaagcgagaccctgtctcaaaaaaaaaaaaaaactcatagccgctcagtcagccaagccattgctggaagtggctcgtgggacgtggcgtgacctgggtttgtgtgctggcgtgctgtgccctaggagtccgtgaaatgcattcccttggacaggaagccacagtgctcgtgggtgtccacatggcccttgaggcagaaaatgttttcttttttttttttttttttaaacagagtctcactctgtcgcccaggctggagtgcagtggtgtgatctcagctcactacaacctctgcctcctgggttcaagtgattctcctgcctcagcctcccaagtagctgggattacaggcacccaccaccacacctgactaatttttgtatttttagtaaagacagtgtttcaccacgttggccaggctggtctcgaacttctgacctcaggtgatccacccgcctcgcctcccaaagtgccgggattataggcatgagccaccgtgcctggaaaatgatttctaggccaagtgtggtggcccaacacctgtaatctcaacactttgggaggccaaggtgggctgattgcttgaactcaggagttcatgactagactgggcaacatagcgagaccctatctctacaaaaaattaaaaaatgtgccaggggtggtggctcatgcctgtaatcccagcactttgcaaggccactgtgggacgttacctgagcccaggagttggagaccagcctgggccacatggcaagacctgctctctttaaaaaaaaaaaaaaaaaaaaaattaagccggggatgatggtgcatgcctgtagtcccagctatttgggaggctgaggtgggaggactgcttgagcccaggtggttgatgctgcagtgagccaagattgcagcctgggtgacaaagtgagaccctgtctcaaaaaaaaaaaaaaagcatgccgggcgcggtggctcacgcctgtaatcccagcactttgggaggccaaggtgggcagatcacgaggtcaggagattgagaccatcctggctaacacggtgaaaccccatctctagtaaaaataaaaaaaattagccgggcgtggtggcgcacacctgtaaccccagctactcgggaggctgaggcaggagaatggcttgaacctgggaggcggagcttacagtgagccgagatcacgccactgcactccagcctgggcaacagagccagactctctctcaaaaaaacaaaacaaaaggcaaatgttttcctgcctagcccttagatggtctgccatccccagcatggtgtgggcgtgagctctgtctggcctgcaccccatttgccgaccatctccagagctgggctgtggctcccatctgcggcgtgggctgggcagggttgcagtcccccgccccgtgtgactctccccagcgtctcctgggcttggtgcctgctgggctgcactgtacacttgcgtgcacgtaaacaaacgttctttctcctacacacatccgcttgaaaagcaccctttgtgaagcatgtttgcgggtttcagatcgtttttcctgggtttcctggaggccttggaccgtgttcctgccctggcaggtgccttttctcggggcctctgcttggtcaaggaagagctgggacgtgtagccaccgcctctggttccttccacgcccacccagctgagctgctctgccctggggccggctggtggcccaaggagggcgctggggtctgggctgcggtccaggcccttggcgtgggtgggggtggcaccggcgctgctgccgtcctgggctgttccaccatgcagagtgaggctcagtgtctcagaccaggtccaatcctggcgagactgccaggactgcgaccccaggagccacctccataaatgtcatggtgttcccccatcctcagggtcacactgcaccctgtgacccatcagcccctaggtgcagcctcggccgccctcccgcccacctgttttgcccgggcagtgtgtgccatgccactctcctgggcagctgcttgcaggctgagcctcactctacccagctccagacctgttcgctgatgcccctgcactgcccagctcgggcacagcgccttctcaaccaggcctgccttcccacacctttgcccctgcggctgagagcctcatggaaaaaccctccagaaattggtgtctatttttgggaattaacaaaaacagtggcaagcagtcagtgttttcagtttattaggactgtccccagacctacagaaaagagaagctgctgattactagttaggaccagacttggcatcggcaacgatgttgcaggccctggcgtgggccctctggggcctgagccctcctcgcagccctgcgggacccctctgtcccccttgaacaccacgttcacccagcgtgggttcctctcctccctgcccttctgcccccgtcagaccacaggacagtctcagccacgtcagagccagcatgggctccccaccacgcaggcctccctgcttctccgggcttctgcttctgttactatgacgagctccacactgccctcccccaggaggtcccatcctgcagcctggtctgcccggctggctccggggcgagcgtgagggccaggcagctcagccctctaacacgtctcttctcttttgacctcctcagccaaaacagagtggagtacgagaaaagggtccgagcacaagccaagaagtttgcgccctcataagcagcgaccttgtggcatcgtcagaaggaagggattggtttggcaagaacttgtttacaacatttttgcaaatctaaagttgctccatacaatgactagtcacctgggggggttgggcgggcgccatcttccattgccgccgcgggtgtgcggtctcgattcgctgaattgcccgtttccatacagggtctcttccttcggtcttttgtatttttgattgttatgtaaaactcgcttttattttaatattgatgtcagtatttcaactgctgtaaaattataaacttttatacttgggtaagtcccccaggggcgagttcctcgctctgggatgcaggcatgcttctcaccgtgcagagctgcacttggcctcagctggctgtatggaaatgcaccctccctcctgccgctcctctctagaaccttctagaacctgggctgtgctgcttttgagcctcagaccccagggcagcatctcggttctgcgccacttcctttgtgtttatatggcgttttgtctgtgttgctgtttagagtaaataaactgtttatataaaggttttggttgcattattatcattgaaagtgagaggaggcggcctcccagtgcccggccctccccacccacctgcagccccaccgcgggccaggaccaggctctccatctgcttcggatgcacgcaggctgtgaggctctgtcttgccctggatctttgtaaacagggctgtgtacaaagtgctgctgaggtttctgtgctccccgcatcttcgggctgtagagcgctgggcagctaagatctgcataggtcgggattggcatcgagaccctggcaactgcaccggtgccagctgtcttgggggccacaaggccaggtccagaccagggctgggggctgcctgaggactcctatccgggcagcctgctggcgggggttcccctcttcagtggccaggtcacagggatggagctgcgctgtgcatagggtgccacctcaggtgtctgtcccttgtgtcctcaggaggcagccttgctaccacccgtggcaaacgccaggtgctttttctgggagagcccacagccgtggccctccagggcttccccgacccttagcgccaggtggagggccctgggcagcctgtgtatggaattcttcgtcctgaggccgcctgagtgtggtctgtcctggggaggctgtgcgcctcagcagccgtcctgacgctgagccctctgcaaaggttgggccggccaggcctcttggggctgcctgagccactgcaggaagtggcctggctgggaagttgggtgccggtcacctcccagcaggaaggcacagtggacagagatgggaagccctgggggacacagcccggtgctcccagccctccaacctctggctcccaacccagtctccccatcctagcgagcttggccctcctcagtttcgtttcaagccttggggctggagctggccctgctgccctggcaccccccggtggctggagctgggtccccgtggcccaagtgcagggtcccaagagggcagggcggggctccccaaaggagcaaagaatgcagggagggcggtccaggcccctgggaaggggagctcggcaccctccaggtccgtgtgggaccccagccgctgttggctgggaatcgaagttagaggtgacttccaaaggccccccgagccggcagtgccccccaccacccccccagcgactctgcggtgccagtgccttgttggcttttccggctacgcaccctgcagtcactgagctctcggtctgacgtctgatgtttgtggtttgtttataacacggggccttacctggggaattcagctggtttgaatatttgtagcccgctcccagaatgtcttattttgtaatgactgaactacatttagtaatagttacacatgtatatggttaatacatatggaaattcaatatattttgtagttaacgtattctgaagtaacggatgtttctcgccaatcgtagtgacttcagctaacgaaatgttcttttgtagtaccacggtcctcggcctaacgaaggacgtgaaccttgtaagaggagagctctgaaacgcggtcacctttgtttagtggaagggaaagtgtgttcccggcatgaggtgcctcggaattagtaaagaattgtgggcaatggattaaccactgtatctaagaatccaccaattaaagcatttgcacagactgcggcctgccgggtgtgtcctttcctgccctgtccctggctcccctgggctttgggggtgggagcccactggggccacagggcgtcccccgaccccaaggcccagccctaccccccagggctttgttctggtcctgcttccagccccacgtcagcccctccgggtgacatcccctctagccagcctcggggtctcttcacctgcacctccctggcctgctctacgggtctcctccctgggactcaaggctgctcttgctgtccctggcaggggacctccttggggagcagggaccccaggtgtccagagagctctcctcacagggcccatc

SEQ ID NO: 16866 - DNA, 9036 bp, Human
taactagaaaatcggcaagagaccgaaaccagcagtggctgaggccagatgaccctgtggctgtgtgctggacaagatgctcggtctcccaggtgatggccaccgtccactcgccactggcctgagtgtagacaggtatgcacccacaggatgcagagccacagggctcggtggcattgctggaaacagtgagaaggacagggacagatgtattccaggacgtgacctagacatggcctcacctccctcgggtcctgtcctacagaaagccaggccctgtgcggcctgaagacaggcagaatgcggctcatggaggagcctgggaggccaccggccttgagctgggagaggccacggggagtggggccattgggggtggcggcagtgatgggggcctctggaactcaatgggctgaatgtgtgtgtaggcctctgcgttaccacaggaatcaaagaggcctggagcccccttacgcggctgccgcaaccctggtgaggctctgcccgcccgcgacacccggcccctcccaaaggaagagaacagggacagattctcccttcccacttggaatgtgtggggctcccaggtggggtgcgcggcctgacggaggccggggcccccacggggacctctcctgagaggaggccgcccgggtctgctggcctcaggccccaggcccctgctgagtctgcgttttctgctgagtaaacggatcgtgggtctttctgggtgtggactttctccccgtggatctataatttctcagaagaggagccgagacgccacctggaaaatgatcaattctcgataaagggaagacgatgacagtgggccggcggcttcccacagctctgcacggggcctgccaggtgaggccggagctgaggatggggtagggccctggaaaactgtggtctccccgagccccggctgtgcccccgcctgcaccccttccggctgcttccctgcacactttcccactgccgagggactggtgggcaggccccactgacagccaggggaggggcctgcagggacctggaggggaggggctgcacctgctcaggccctgggggagagagcgactggttgggaagtggtttgagcaggtggagggggaccaggggcctctggaggcaggtggagatggagcccaggggtggccttggacatggctgggcacacattcctgtggcctctctgcacacaagcggtgactgtggggcggccaggccctcaccagagccttgggggacagcaaggggcaggtgaggcttgtctgaggcacaagacctggctcccatggccaggccacccccacacactccccgaggatggcgcagggcaaaagcaaacaggcgcctgcagccctgccaggcattcctagaagaggctgggggcggggcagtggccagacaccagcgcccctggggtcacgggagaggcagggtgagcttgggccctggacagcaccgtgggcctcaagcccaaacggcagctcccacccaggctgtagggaacccccgggagggcgggtggatggctgggtggggcacggggaaggggcggcagccccttagccccacacggctggctgctcaggccaggggtgggctcaagaccccaggagctgcccgaggagccccctgcccgcaacaggacctggtaaaaccctgggctccccaaaccggcctcaagccccagcccctcccaggctgctgcaaggggtccccaccccaacctggctgcccagccctccccagtcagccctgcagggggcccgggcactggccgtcagcccccagggccgcattacggctacctcgggccccgactgaagctccctcaccccctgcactgtctgcaccccagggctccgggctgatgccggccgcccggcacgagggggttaacagagccagggccagctgggttgggccagccaggtgacaggcgcgggctgccccgcagtggggaaatccagagggcaggggtggccggcacagcagacgtaccctccctcgctgcctgcctgcggcctgccctgcatgcaggatggccctgaggaaaggtgaggcccccgagtgccccgccacccactctaggggtggccagtctgtgaccctgagcccgctggggagaggccggggtagcccccaaggaagctctggggggctcagctctgggggtctgcgggggactctggggagcccacagtcggaaatgcggctgctggggttggcagggggacacagctgtgcctggcaccaggggtctctgtcccgtcctccaccctaagggcgctggcggcggcacaggggaggagggccaggtgcaggccggacccttcagctcccagcacagcggcgggaagtgctccgcacggcccgcgttgtgggcccggcccaggcaggagacgttggctcacaccccattgtctctgtggggtgaccccttgcagcttcggccacccccaagcctgagctgagctccagagctggctcaggccactcccaacccatcgtgacagaagggcagtcgggggggccccacctcgcccctgccaccatcccagcaattccacactctctgaggatgggggggccatacagtagaggttttgggtcatcgctgcttgggaggctgctggctgggtctgtggggcctgtggccccttgtcctgaaaggcaatgtgagctttggtggccgacggtccagggttcctacctgtcccccgacggcggtgccccggtcccctcccgcagcacccgaccaaggcctggatgcaggcaggtgagaccccgctggggggcctaactggggcaggaggtgcccagctccctgtccagcctctgagggcagtgagcgagtgcccaccaagacctgctccagaatattctgaaaatggccggaccttggccaatggctcagttccctccccttcctctaggccaacgtggcagactggcctggctcaagcgcctgccttgggggtgcggctgccacatggccagacagcccgagacccagcctggccgagcccacgtggcctgcgcacagctggagagccaagccctgagcgtctgtgcagcggggcggggcggccactcctctgtcccatggggtgggaagcgcagtgtcagcttttgagccggaggacctgtggggctcaccggcttcttcgcatctcagcgggtgacctcgagcctcagttcacacctgagcgccgcttccggctgtgctggtatcaggctcactcgggcagagccctcctcgggccgcctccccaagcctctccccccgcaggaggcctggccctggcgctgctgctgctgtcctgggtggcactgggcccccgcagcctggagggagcagaccccggaacgccgggggaagccgagggcccagcgtgcccggccgcctgtgtctgcagctacgatgacgacgcggatgagctcagcgtcttctgcagctccaggaacctcacgcgcctgcctgacggagtcccgggcggcacccaagccctgtggctggacggcaacaacctctcgtccgtccccccggcagccttccagaacctctccagcctgggcttcctcaacctgcagggcggccagctgggcagcctggagccacaggcgctgctgggcctagagaacctgtgccacctgcacctggagcggaaccagctgcgcagcctggcactcggcacgtttgcacacacgcccgcgctggcctcgctcggcctcagcaacaaccgtctgagcaggctggaggacgggctcttcgagggcctcggcagcctctgggacctcaacctcggctggaatagcctggcggtgctccccgatgcggcgttccgcggcctgggcagcctgcgcgagctggtgctggcgggcaacaggctggcctacctgcagcccgcgctcttcagcggcctggccgagctccgggagctggacctgagcaggaacgcgctgcgggccatcaaggcaaacgtgttcgtgcagctgccccggctccagaaactctacctggaccgcaacctcatcgctgccgtggccccgggcgccttcctgggcctgaaggcgctgcgatggctggacctgtcccacaaccgcgtggctggcctcctggaggacacgttccccggtctgctgggcctgcgtgtgctgcggctgtcccacaacgccatcgccagcctgcggccccgcaccttcaaggacctgcacttcctggaggagctgcagctgggccacaaccgcatccggcagctggctgagcgcagctttgagggcctggggcagcttgaggtgctcacgctagaccacaaccagctccaggaggtcaaggcgggcgctttcctcggcctcaccaacgtggcggtcatgaacctctctgggaactgtctccggaaccttccggagcaggtgttccggggcctgggcaagctgcacagcctgcacctggagggcagctgcctgggacgcatccgcccgcacaccttcaccggcctctcggggctccgccgactcttcctcaaggacaacggcctcgtgggcattgaggagcagagcctgtgggggctggcggagctgctggagctcgacctgacctccaaccagctcacgcacctgccccaccgcctcttccagggcctgggcaagctggagtacctgctgctctcccgcaaccgcctggcagagctgccggcggacgccctgggccccctgcagcgggccttctggctggacgtctcgcacaaccgcctggaggcattgcccaacagcctcttggcaccactggggcggctgcgctacctcagcctcaggaacaactcactgcggaccttcacgccgcagcccccgggcctggagcgcctgtggctggagggtaacccctgggactgtggctgccctctcaaggcgctgcgggacttcgccctgcagaaccccagtgctgtgccccgcttcgtccaggccatctgtgagggggacgattgccagccgcccgcgtacacctacaacaacatcacctgtgccagcccgcccgaggtcgtggggctcgacctgcgggacctcagcgaggcccactttgctccctgctgaccaggtccccggactcaagccccggactcaggcccccacctggctcaccttgtgctggggacaggtcctcagtgtcctcaggggcctgcccagtgcacttgctggaagacgcaagggcctgatggggtggaaggcatggcggcccccccagctgtcatcaattaaaggcaaaggcaatcgaatctaacaggcacagtgggtgactgcgaacgtgaaaccagggagggggctgggggctcggcgcgcagctgtggtctcagagctttgggaggccgaggcgggcggatcgcttgagcccaggagtttgagagaccgtcctgggcaacacaagagagaccccgtctctacaaaaaataaaaaaaattagcatagcatggtggcccatgcctgtggtcctagggaggccgaggcaggaggactactggagcctgggaggtagaggctgccgtgagccaagactgcaccactgcactccacctgggcggcagagcaacaccctgtctcaaaaaaacccacctggctcaggggaggggaggatggtgttgcctgggtacgccttggtctcctcacctctctcctccccggcttggccacgcccagggcccccgcctggatcctgccccgccaccgccctggccaactgccccacacccatgtgtcttcctggtcccgtggctgcccctcgggctccccagaacatcctccaggaatgatggcaccaactcgaatccccaggggctctgcgtctcacccctcctctttgagggatcgccctgaggaccaggcagtgtccccgaggggtgtggtccaggcagccagggcgcggctgaggtggggtgaggagggagcgcggggcgggccgtccgccttgcgtgggaagccgcaccccctgcagatgccgtgggcgtttgtctctgccccccccaggcaccggcatcgtcagcccaggtgctcctggtgccctctcacccacccagaggccgcccgggttggttccgggcccccacctccagggtcctcccctgctgaaggctgagctcttcctttgggaaaaatggcgcgttctgctttctggaagggctttcctttcgggtctcactgggaagaggtgcaggggacccctgggattggagctcccttctcaacctgacttctggtctctgtcccgggaggggcccctttagtgtcccagggaggccattcttccacggcgaaggggccggctgtcaggtttatcacaaaatctccccgaattcccaccaaataagatgcaaacacatcagcacctgggcccaggggcttgttgacaacggaacgaacgaacctgccggcctggcccagtccagcccagaaacttacagaagcaggtgctgtctggccccgaaggacagaagactctagaaacatcagatctgtcgccacagcagcggacacgtttaatggcaggcgcctctacagttacaagacatgcctgaggtcagttcgcccccttagggggcactccccgagctaaacacagatgacagcgacccagggtgctggaggcccggggtcacctgaggactgcagaagtcctgcgctccgctaactgtgtggacacgcggctgccaggggcacaggtaggcaacatggatgggaagagagcccaggccgcccccgtctcacagctgcagagcacgcagaccacggcactgcaggccaaccaggcagagctgctggtgcgacacatcctggggctgggctggtcggggagaagctctcccgctgacgctgcctgggcctgcccctgcagggcccgggaaccgagcccaggcctctgtttctctgagaggctggagcagagcccttggtggccctggaaagcggctgcaaggtggccttagtcaggggaggcacgcgggcgtcgcgtccagaatcttctgggctatggaggtgagtgcagcgaaggcggggctcccggggaactcctggatgaagtcgtggccctcctccagggtcctcatgagcgcagggtccaggggcacggagcctgcagggcacagtggaggcggtggcgccatgtccgcaccttccactcccaccattggctcagctggacgcacccgaaccacccgtggccttagaggggattgaggcgctgccagacgatttccacctccagacccgcggccctcccagcaggctgggtcctgccacccgagagggccctgagaagggcgcgggcgaatgacctgcaggtctcagcggcatggcgtgtggcccgagaagagaggaggaaaccgctcccgtcccctcctctcccttgggcactgggggcatggaggtcaaacccgcccagggcagagatggaatgggaggccgcgaccccagcaccagcttgggacactcacctaagaagggcaccccggcgagctgggccagctcctctccgccgcccctggagaagacgctggtgcactcctaggagacggtggtgagcccagcactgcccaaagcccccaccggccaggtgctgcctcgccccctctgcaacccccgggactcaccgtgcagtgtgggcaggtgaagccgctcatattctccacgattcccatcacccgcaagcccgtcttcctacagaaggtcagctcgcgcctcacgtcccccacggacaccgcctgcggggcaggagccgaggccacggtcagccaggcgcaccggcagggacacccgcccagccctctgggaagccacccacagggactcgggaaggtgccgcagcgctacctggggcgtggtgaccacgagggcccccaggggctggtagggacgcagggcttctatggtggccatgtgctcatcggaggtccccgggggcgtgtccaccaccaggtagtccagctccccccaggccacgtcggacacaaactgctttatcagcgctgcaaagacggggcagacggggcggtcagggcagggcaggtctgcacacgtggccctgcgccactaagaaccagccaggtcaggccgaggggctgcagtccatcaggtgtcacttgccaccagcctccatcacaggctctcgggaggccctggcccgctgcaggagtgcaaagatggggccggggccattacagcgtccctttctgcagtgtctggcccctgcccacagagcccccgctgactccccgaggccccaaatcagaacacggagccaggaccctccaggcgtctgtacccacacatgggagcacccacattctccgtggtggatgccccactggtgcacccacagcctgcgcctcactcccaccagcctctccctgcctttgggggcgtctaatgccacctgctccagaggcaccagaaccccctcagctctgcccctatgacctgccacactggggcctcaggtccctgcatgccatggccagggtctcagcagaccccactccctctgaccgggagttggggacagctgtgtggcagcacggacccaactggagacacaccgccagcctgagccctgtgcctggtcgtgggtgtcatgtgcaggtccccaggaacaggcctggctgctgaagaggaacatttccacaggagaggccggcacggacgctaacccccttcaccaggacggcggacgcgccgcccggccgttaccgtttttcttggggcctctccacaccacggcctcgtccggcttctccagcaggaagcccacagacatgagcgagatgctctgctcccggtccaggaagacgggtgcccagccgcggtcgcactggtgcacagccctgccctgcgccccgagcatgcggggtatactggggccacacaggtccacatccaggattcccacctgcaaggagcggcacagcctaggccgggggcaccgccaggcctccacggggatgcgggcagctgcccggggctccgcccagtgag

SEQ ID NO: 16867 - DNA, 17896 bp, Human
  misc_feature (1)...(17896): n = A,T,C or G
ctcctcagggatatatgaagatattccttttttttttttttttttttttaaggaacaggttattgtcttgtcacccaggctggagtgcagtggcacagtcatagctcactgcagcctcaaactcctgggctcaagtgatcctcctgcctcagcctccggagtagctgggaccacaggcatgcaccaccatgcctggctaatttttaaatttgcaaagacaaggtcttggctggtcgcggtggctcacacctgtcatcccagcactttgggaggccgaggtgggcggatcacaaggtcaggagatcgagaccatcctggctaacaccatgaaacccgtctctactaaaaaatacaaaaaattagccgggtatggtggcgggcgtctgtagtcccagctactcaggaggctgagacaggagaacggcgtgaacctgggaggtggagcttgcagtgagccgagatcgcgccactgcactccagcctgggcgacagagcgagactccgtctcaaaaaaaaaaaagaaaaaaaaaaagacaaggtcttgctatgttgcccaggctggtctcaaactcctgccctcaagcagtcctcccatctcagtctcttaaagcgctgggattcccggcaagaaccaccatacctggccagaatattccttttcaaaggaacctagaaaggctgggaagcactgcagcttgcgcgtcctgtcttggagggcctggcgcggctgcccgctgagttgtgctctgtgtctgcaggtccagccctgctgggagttttctgccacacagatttgcggaagaacctgaccgtggacgagggcaccatgaaggtagaggtgctgcctgccctgaccgacaactacatgtacctggtcattgatgatgannnnnnnnnnnnnnnnnnnnttagataaatgccagaattatataatttcattttatttatagttatttagagacaagttctcactgtcatccaggctggggtagagtggcatgatcatggctcactgcagccttgacctcctgggttcaagtgatcctcccgcctcagtctcctgagtagctaggactctaggcacgcatcatcatgcctggctaattttgatttttcgtagagatggggggtctcattttgttacccaggctggtctcaaactcgagcactcctcccgcctcaaactcctgaagtgctgagattattacaggtgcgaggcactgtgcccagccctcatgcgtttattaatgttaaataattgggtgactttattatttttatttaaattaattttcgtaagggacaggaccttgatctgtcacctaggctggattgcagtggcatgatcatagctcactgcaacctccacctcctgggctcccacttcagcctcctgagtagctgggaccacaggcgtgtgctaccatacccagctaattttctctgtatttttttgtagagatggggtttcaccactttgggacgcaccggcctaaggatcacaaggtcaggagatcgagaccatcctggctaacaccatgaaacccgtctctactaaaaaatacaaaaaattagccgggtatggtggcgggcgtctgtagtcccagctactcaggaggctgagacaggagaacggcgtgaacctgggaggcggagcttgcagtgagccgagatcgcgccactgcactccagcctgggcgacagagcgagactccgtctcaaaaaaaaaagaaaaaaaaaaagacaaggtcttgctatgttgcccaggctggtctcaaactcctgccctcaagcagtcctcccatctcagtctcttaaagcgctgggattcccggcaagaaccaccatacctggccagaatattccttttcaaaggaacctagaaaggctgggaagcactgcagcttgcgcgtcctgtcttggagggcctggcgcggctgcccgctgagttgtgctctgtgtctgcaggtccagccctgctgggagttttctgccacacagatttgcggaagaacctgaccgtggacgagggcaccatgaaggtagaggtgctgcctgccctgaccgacaactacatgtacctggtcattgatgatgagaccaaggaggctgccattgtggatccggtgcagccccagaaggtgcgcatggctgtgcctggctctccctgccctggtcacccagctcggagtcctcacccccgatgggtttcctaaccgcagtgtccttgcaactttgcctaagctaaatggaaattagtctccggccactctgttaacagggccccaagaagggtggaggcgagaggcagtgacacagaaagcgctgtgcagtacaatcctgggcacttgagtcttcttgggggctttctgcccctgcatgctgcctctgggggtggtgccctcagagctggaggggcttggagcggtcgtaggtggttgcaagagtgtcaggctgagcaggaaggagaaggtgctttcactggctctcctggagcagggcaagctggcagggtcaggacgggccacgtcagcggcccctcatggcgtgtcctgggttctgctgggcaccctaccatataggccagcaagccaggcctaggagtgtgacaggcctttgtccttccccggggccactgcaggtcgtggacgcggcgagaaagcacggggtgaaactgaccacagtgctcaccacccaccaccactggtaagtgccgcgtctcacctgggggtgtgggacctggctcacttctcgccccggtgggtttagggacatcaaggcctgtctccccccacggctctgtctgctttgtgaggacaagcccccagcagacttctgagaaagactcgggactcaccgtagcccccaaggggcaagtctggtgctcagtgactctgaggccccgagggtgaggggagaaggttacagccttaccctcaggccccaccccccggctctctcctgggccatgcgggtttgtgccctggcacgttggcctcaatgttggggaggaaatgagtctacaggtgagtggtttttaaaaaaaaaaaacaaacaaaaaaaaaaaaaaacaagcagccagccgggcacggtggctcatgcctataatcccagcactttgggaggctgaggtagttgggtcacttgaggtcaggaccagcctggccaacacggtgaaacccagtctctaccgaaaatacaaaaattaactgggcgtggtggtgggcgcctgtaatctcagctactcgggaggctgaagcaggagaatcacttgaacccgggaggcggaggttgccgtgagccaagatcgtggcattgcactccagcctgggtgacagagcgagactccgtctcaaaaaaaacaaagacaagcagccatatctggagaggttgggtttttaaaaatccttgaaaatggatgaataaaatgccctgtctgggttctagggctggcattgcctgctcaaggccgttgtttggcttttagaaatttttgaggctcttcaaagctagagagacttacttctttttgccaagcaagcgcccgagggcaaccggcacctttctcctgagccaggacccgtctggcactgccctagggcctctcagctgtggcttccccagcctctgtgttggggtgaaatgaagcctttggtcctctccttggtggtgggagcgctgtgctggtggcttggccaaggtttgatggaagcgtcatggttcacacgcagctggacttaggcctggagagtctcaggctctgtgagttgggcccctcgagcctcttcggggtcatcagaggtgtccgtgcagggacctgggcttgaggggcggtgcctgcagcctccctggcccttgtcctgtgtggctgagctgctgtctctcagcacgttggcctgcctgtcgtgcgaggcccttgctgccaccatgcctcctcctggggaccctggtggtggcctctgtgtggctgcctggcacatcacagcttgctgcagctccctgcctctcccggcctcgccgcagacgtctctttctaacactgtggtgctttttagttccccggcccctctaacattcatgccgacacgtgaagtcctaagccaggccatagcttcagcggggtggggtttgctcaccgatggtgggtggtgatgggcagaccaaggcctgtggtgccgcgccctcctgaagggtgggaggggcagagggcagcggccaccactccaccctgttatcttggggcccagtggtgccaaggcaggcggtttctggtgtggttgctggagtcttcatgggaggcacacgaaggagtctgtgatatcatgtgagacccgggaagggccccttcaaccgcccctttctgaactgcgggtcaggcaggctcccctggggaaacctgggcgcgtaggaggcacctccacctgctggagctggcccaggctggcctcccctgcagacaggccgcgtctagggccagctgctcatcccagacgcacccaggtgattcccatgctgaacagtttgatctcctgccagagtgtcgggccacaaactgggcagcacatcaggatcacctgggggccttcaaaaatcaaaaatccacccccaggccatgccctggacccactgcaccaggacaagaaatccaccccaggcctctccccagacccactgcaccaggacaagaaatccacccccaggccacgccccagacccactgccctaggatgtgggggtgggaaccaggtggtgctttgtaaagacgtgcaggtggtaaccccaggcccccacgctcggaaccctggccacaggatcatccaggtgtctgtgatttgcttcctcggtttcctttgtgagtggaaaataagtgttgcgtttgactagggtttaagagcagcaggcagcccctcagctcagcaggcagccccctcagctcagcaggcagcccaggtctcctgtttgacttctagggaccatgctggcgggaatgagaaactggtcaagctggagtcgggactgaaggtgtacgggggtgacgaccgtatcggggccctgactcacaagatcactcacctgtccacactgcaggtaaggagtgagccctggaggtgctccagcgtggccctgtcaggagcgtggggggggggtctcgattctctctgctcccttaccccagtgacccgggagtgctctcagtggtcctctgtggcagcgtggatggtcttctctgtctaggcacaaggagaggagtgtgcaaaacgcggctgtgtgcggggctgtgaagcagggctctgagaccctggggagcgggccatgtgggcagggtcttggtgccagagcacagcacacaggtgggagggccctgcgagggtgtctttagcctttttgagggtgtgaacatttttgaagtaaagaattggggcagatggggacaggaaaacaaaaggccatgtgtgggaaggaaagccgtctttcctagccagacggcgagcgtggatttggcccagttttgaaggaggaaacaagccccttggttttttacacgctcttgctccagggtggccctgcacttggggcgcacccatggagtgagcgagtcccccagtcccgtggtggggagcacctgccccaccttcacgggcatttccctcagagctgaggaggcccagtagggcccaggcggcgcgccgtgaccccgggagatggctctccagggtgtctgggagcacacgcggtcgcctgctttgttgaaggtggggtctctgaacgtcaagtgcctggcgaccccgtgccacacttcaggacacatttgttacttcgtgagcaagcccggaggctcggagccccctgccgtgttcacaggtgcgtgttcgagtgtgggtgggggcgggggttcttcgtgaagaccctgtgtctcctgccaggcaggctcacggggcagcttcgtggccttctctgttgcaccggtgtgagggggcccaggggtgggtgctggggagcctcatggtggggctggccgattcctcccatgatgggtttggatcgtggtctggaaggaagttacgcttgcagcaagggctgtgctggcggagactgctggacagctggggtccgggcgggtcccacgggaaaggagtcagtttcttccagcagggcgaggggtggctcagccctggggctgtgttccttgatgccgtagtgtggactcagggacctgtgctagtctgggggccctgcctgcctcccagggtggttgcagacctgtggagccacctgtggaggtcatatggccgggggacggcctcactgtaggccgggcccttcatggctgcggccttctaaggcggtgcggaggctgctggtggtgggggctgcctcccgtgcttgttactgtggccttgtcccgactggcctcacagtgcggggtttcacccggtgactcgatgtgggccttgtacggctgggaggcctcctggtgggaggtggcagccccagccttgaacccaggtgggagtgacccagggccacactcggacccctgggtggagtcaaaccaggggtgcagggagaaggtgtggccagggagccccagaggagggcggagggcatggcgggagggacgggcgcctcgctgtgagggataaggtgccttcaggctgcagtgcgcagggctgggggatgagcctgggtggtgccggtgtgggagggatggagttggggacctcagatttaggattcttctcagggcagcgagcacggagtccctgggtctcacctgtgcctcctgggctgtgtgcctggcgcaaggacagccctgtggagcagaagccccaggccccaagttcgcctctgtctgcccttccctatctctggggactccatggcctcctgctggtcctcagactcgaggtctagggcccttcaggggaacaggctccccaccgtccattcccatctctcgtgcccagaaggactcctggccttggcctgtgcccagcaccgctgcatgcttctctgccccaggtggtgagaagtggggcggcctccactgtgctgggtgctgggcaccctcctctcaggggactgccctgtttctggggcagacggccacgtgaggtcagcgaggccaggacagccgcgaagcagcaagaggagggcaagcggggacagaggcctgggcagtgatggggtggggatgccgtcctgaggccgaggccggaaggagcctgggtgcgcctgaggtgcccagcggtgtgggccgcatcttccgccatgggtgagaggtggtcccgctcagctcagccagggtggtgagaccttggtcacagggtggcgctggctgctggggccaagggaagatgggagccaggcatgggcctgagaggggctgctgcgtgtttggggagagggctggatttgtgagggtctcagagccacagttggtgggattgggggcagtgagggaggagtgacttgggtttcgggtctgctcggccagttgggtggttggactgtcagctgagacttggaaggagatgtgggagccggaatgcaggggggctgagtctgggcagccgtggccggagggcagccagggttcggggcctgggccttgccggtgagtgtcaccctgctcctggccccctcctgagtcctagccaccagcctcaagtggcccccacctcgtggctgtccttgtttccaggtgacaccttgtttgtggctggctgcgggaagttctatgaagggactgcggatgagatgtgtaaagctctgctggaggtcttgggccggctccccccggacacagtaggcagcgcctccctgcgggccggggtgtggggggccttaaccagggcggggctgctctccctcctggcaccctctcaccggacaccccccgggggcatccaggtcccgtccctgaggactttcacaggtggtaacagccttccgagctcacctgtcacctctctcctcagagagtctactgtggccacgagtacaccatcaacaacctcaagtttgcacgccacgtggagcccggcaatgccgccatccgggagaagctggcctgggccaaggtgagtggggccgtcactgcgcagtgccttcctgtgggctgctcagggccgctgtgcacagcggggtcgccagagtgggtagacactcacactctgagcccagagagcaggcctgggattcaggccagtgtggcccagctcgccctgcacggcaaacccaggggttctatggagatccctctgcctcggagggtctggagtaggcctcagacgctgcgtgtgtaaaaagcgcccagcctgttcccacattctgagcagtagggtcaggctggcagcacgtggctctgctggctctccaggccacagaacgtggctctgtgtccaaaggactcttatctccacggtggccccacgtgagcctccatggcgtagcccaggccagctgggccaaagtctgccaggagcaggacggggttctccaggggtgtgtttccccgaattcactggaaacggtgtcacaagcacgcacgcctgggtggtctcaggcgtgggctccctctgctgagtggagtgagagtcgctgcctctgacagggttgttttaaataaatcacccggttttttgagcatctttttcaatttcttagagtagaggttaacattattttacagtatttactcatgcaaattccaactctaaatcagatgaatcataaatactcatcttttttttttttttaatttttttttgagacggagtctccctctgtcgcccaggctggagtacagtggcgtaatctcggctcactgcaaccagcacctcccgggttcaagaaattctccctgctggccgggcgtggtggctcacgcttgtaatcccaactactcaggaggctgaggcaggagaatcgcttgaactcaggaggcagaggttgcagtgagccaagatcgctccactgcgctccagcctggtgacagagcgagactccgtctcacaaaaaaaaaaaaaaaaaaaaaaaaattctccctgcctcagcctcttgagtagctgggattacaggcgccagccaacacgcccagctaatttttctacttttagtagagatagggttttgccatgttggccaggctcgtcttgaactcctgacttcaggtaatccgcctgccttggcctcccaaagtgctgagattacaggcgtgagccacgtcacctggcccgtgtgtctgtcttgagtggacagattgcagtttgaggaatgttgatgatgtttgcacttgtgtaatcccctccacagtccagatgtggaacttaccactaccccaaaggctcctgtgtccctcccatgtggcgtccccgccagctgttgctctgctgtgacctcaggtcactttctagtttcccatgaacagaatctcattgctccgtcatctctgtggcattctcggccccgctgatgttggtgagggtcagccacgctctttgcttctgagtagcccattgtgtggaaatgctacaatttgtttatgcatttgtctgtttccagttttttgctatttgaataaagctgctatggacatttgtgtacaagtcttttgtgaacatgtttttattgctcttggatactacctaagagtggaattgctgtgttgtgtggttaaaggtgtgaaccgttttccaaaaatggttgtactgttctacagtcccccaccaatgcttgagttccggggcctccatgctgtgccagcactgcttggtgttgtcggtctctccaatttttgccattctaacttgcctgtggtggcgtctcactgcctttaaaatgtggatttccccatgactagtggggttgaccatcttttcatgtgtgtcggcctttggatgccttctcatgaagtttatgttcaatcttttgtccattttaaatattgggtttggcctgttgggctgctcttgtaagagttccttatatcatctggaaacaagtctttgtgagatatatatatatatgtgtgtgtgtgtgtgtgtgtgtgtgtgtatatacatatatatatttatttgtttgttttttgagacaaagtcttgctctgtcgcccaggctggagtgcagtggtgtgatctcatctcactgcaagctctgcctcccgggttcaagccattctcctgcctcagcctcccaagtagctgggactacaggtgcccgtcaccacgcccagctaattttttgtatttttagtagagatgggtttcaccgtgttatccaggaaggtctcgatctcctgacctcgtgatccacccgcctcggcctcccaaagtgctgggattacaggcgtgacccaccacgcccagctgagatatatatttaaaagatgtttttctctcccagctcatggcttgccttttcattttcttaacattgtcttttggaaaatagtttatagttttggtgaagttccatttacttattttttgtttgtttcttttttttttttttgagacggagtttcactcttgttgcccaggctggagtgcagcggcgcgatctcagctcaccgcaacatccacctcctgggtttaagcgattctcctgcctcagcctcccgagtagctgggattacaggcatgcaccaccacacccggttaattttgtatttttagtagagatggggtttctccatgttgatcaggctggactcgaactcctgacctcaggtgatctgcccaccttgggctccaaaagtgctgggattacagatgtgagccactgcgcccggcctactcaatttttcttttatgtttcttgtgccctttctaagatatctttgcatacccttagctcacaaagactttctcctgtgtttcttcctagaagttttaaagtcttagcttttatatttacaaacaatttacagtgttccctttcaagatggtgtttgtgtgtggtgcgaggtgagggtagaggttcaccctctcgcagtgtgatcccgaggtgttcagggctgtctgtcgaaggactgtcctttcctccctggattgccttggcacctttctgaaaagaatgggccctctatgcccgagtctgcttctggtctctgctctgtttcgttggtctctatgacttgccacggtgtccgaggacagcaccttgatgactgtaactctgtgctgagtcttggcactggtatgtgtgaatcctccagtgttctttttcaaaatggttttagttgttttaagccttttacatttccgttttcagaatcatctcgtgaacttctatcagaaaagctagcctggctgctgattgggactgttgtgataactgatgtggcgagaattgcgatcttaacattgagtgtttctgtgagctttccatctatgaatgtctttagcttttctcagcagtgttttgaaatttgcgtgttcaaggtcttgcacgtgttactaaatggatccctaagcacttctggtcatgattatttgttgatactagttataaatacagtggatgcgtattaacttcctgggtgtcttagtctgtgtggtgttgctataaaggaatacttgaggccgggtgacttataaaaggaggtttatgtggctcatggttatgcaggctatataagcagcatggcctgggcgtctgcacctggtgaggcctcaggctgcttctgctcatggcagaaggcgaaaggagctggtgggtgtgaagcatgtggccagaggaaggagagagtgggggaggcaaaagtttcttttaaacaaccagatcctgtgggaactaacagcaaaaactcgcacttggagcagggcaccaagccgttcacaaaggattccccccatgatccaaacacctccattaattggggatcagatttgagcatgcgtttggagggatggacatcccagccgcagccccgtgtgaacacccaggagaagggagtggccgggctggatgggaggtgtgtttgacttttaaagaaactgccaaactccccttccccggtgcttgtggtgtttgctttcctgctgggaaggcgtgggcacaccagctggtccgtgtctttcggcacaccacacggtggagccagcccacgcggtggagccagccgtttgaaaggaggtgctggagcccagtccctggtgagaggccgcctcctgcagggcgcctcccattctgcggcctctggttttcttagcagtatcttttgagccaacatttttaattttaatgaagtccaatagatttttttatgcttcattcttttttgtctcccatctaagaaatctttgtttatcgcaaggtcaaaaaattttctcatgtattttatttttggaatttgtatagttttaaaacttagtatgaactcccaccccccaaatgtctgctggatctgtaatgatattcctgctttcattcctgattttgacaatttgtgtgtttttttttgttttttgtttttttttttttgagacagcgtttcgctcttgccgcccaggctggagtgcaatggcgcgatctcggctcaccgcaacccctgcctcccgggttcaagcgattctcatgcctcagcctcccaagtagctgggactacaggcatgtgccaccatgcctgggtaatttttatatttttagtagagatggggttttaccatgttggccaggctgatctcaaactcgtgacttcgtgatctgcccgcctcagcctcccaaagtgctgggattacaggcgtgagccactgtgcctggcctgtcattcttttttttttttttttttggttggggagagacagcgtcttgctctgccgcccaggctggagtgcagtggcacaatctcggctcactgcaacctccgcctcctgggttcaggcgattctgctgcctcagcctcccgtagctgggactacaggcctgtgccatcatgcctggttaatttttgtatttttggtagagagggggtttacagcatgttgcctaggctggtcttgaatttctgggctcaagtgatcctcctgccttggcctcccaaagtgctgggattacaggcatgtgccaaccacgcccggcctcattctttttgataggtgtaaaatatactattgcgtgggtgtcacccataaatcattttaccaatcccaataggagggacgttgagagttttcaactccttttgcaccctggagtccagaacccacacgaggtggagctcttctgagctgtgctgcaaggactgaccttatttttttatttttatttttttgaggcagagtctcactctgtcacccaagctggagtgcagtggtgcgatctcggctcactactgcagcctccgcctcccgggttcaagcgattctcctgcctcagcctcccaagtagctggaattacagacatgtgccaccacgtctggctaatttttgtatttttagtagagacggggtttcaccatgttggccaggccggtctcaaactcctgacctcaggtggatccacctgcctcggcctcccccagtgctgggattacaggtgtgagcaaccgcgcccggcctgttgttctttctttgggagacagtgtcttgctctgctgcccaggctggagtgcagtggcatggtcttggctggctgcagcctccacctcctgggttcaagtgattctcctgcctcagcttctccagtagctgggattacaggcgcccgccaccacacccggctgattttttctattttagtagagatggggtttcaccgtgttgcccaggctggtctcgaactcctgagttcaggcaatccacccacctcggcctcccaaagtgttaggattacaggcgtgagccactgcgctcggctgactgaccttatttttgtctttaaatgcttcgtactttgtaggaaaaatagctagaacattaaaactcgttttaataggtaacctaaaagcttatgacaatttgtacttcctctgttttaaaggtctccttagaagtgttaactttgcttccctcgtaggaggcagagggagatttcttaggattgagaatgttggtgggaacacagggaatattttaaaacattctcagattcttttcgccagaagggaagaacagattagtgagaaaccatcttggcatctaccagacccccgcttggtgcagctctaccagctgaagagtcactcaccgacaccactgcccatagcgggtggggaacctcgggggtgaggcgcggtggtcttgagcctgtgcgtgggcaccagcagcttctgtcagagctctgccctgaggccctcctggtgcggctgcggtagaagggccggggctgtgtggagaccccgctgttgccgccctgtgttttcctgctaactgttggccccgtggctgggtttgcattctcctccccccgcccccaccccatctgccctggtcagtgctggtcggaagggagaccatctccatctcgagaggaggtgaccagctgcctgcctgcaggggcttgggtggcctcccctgctgctggtccctgtgcccctcctccccgtgcttgctgtgagggtgcagctgtggcggtttcttttctgtgtctcctgcattgctgttacctccataatgtgaaatgtaaaccatgtgaatgaaaaggaagctccgtccctgtcgtcctctccaggccggtgcgggaaggcggatgtgtggctcatcccggacgctggcttctcttccctcttccatacgcgcacacccgccggggtctgctcaccttgccttctcagccttgtcagtcgggcagtgtgctaaggttaccaggaggtgttctgaagcatcttttttgagacgtgatgtcgctgtcacccaggctggagggcagtagcacagtcttggctcactgtagcctcgacctgtgctcaagagatcctcccacctcagccccctgagtagctgggaccacaggtgcctgccaccatgcctggctagttttttgtatttttagtagacacagggtctcgccatgttgtccaggctggtctcaaactccagggctcaagtgatccatctgccttagcctcccaaagtgctggtatcacagacgtgagcctccgtgcctggtctgccatcctgtgaagttcccgtgataaagtggcgcgtttctcttgcaggagaagtacagcatcggggagcccacagtgccatccaccctggcagaggagtttacctacaaccccttcatgagagtgaggtgaggcccagggcaggtggtgggtgcgggcccctcccctctggcagtcccactgctgcacacacagccggtacgtccgagaccccagatggctgaggctgccttggggagctgtcgcaggtgcagccgcagagcctgagcactcttcttgaggggggtccggcctttcctggcaccttggccggggtgtgagtccttctggaccctggagttcagaacctgtcagaaggggagtggctgccgcctccccgccctccgtgtcctctgagggcggggcttggccagcacgagtcgccttcctctgcagtggccctggctcctcgggtgggcgtggctcggcacagcctgcagcccggtgctggcctccgcagggagaagacggtgcagcagcacgcaggtgagacggacccggtgaccaccatgcgggccgtgcgcagggagaaggaccagttcaagatgccccgggactgaggccgccctgcaccttcagcggatttggggattaggctcttttaggtaactggctttcctgctggtccgtgcgggaaattcagtcttgatttaaccttaattttacagcccttggcttgtgttatcggacgttttaatgcatatttataagagaagtttaacaagtatttattcccataacttccccttgcagactgttttcttctggcctttaggcctctgcttgtcccctcgggcctccttcctcctccatgagccactgcagtccccccacccacgcttcaggtcaggcgtgagccggtgcctttgctgtggccttggctgggtgctgatgcgactgtcaggcccactgctgcggtcggtacctttgcagcctgtgcttgtggtctgatctgttcaggcccccggcagggagaggtggccgcgtcttcttcctggaggcggccagatcgcgcgacctccaggcagtgctcctgcttggcagcacccacctgcctctgcttgagaaagcacaaactgccctctggggaagcagccagctggggagtgctctcggcctgtgaccccgggagggctgggtaggtggccacatgtcctgccccggctctgggtgtggctggtggcagagggtctatgagggaagggcaggaaaaggcaacccctaaggctaatctgaaatttagggctggggcgtggtggctaagcctgtgatcccagcactttgggaggccgaggcgggtggatcacgaggtcaggagatcgagtccatcctggctaacatggtgaaaccccgtctctactaaaaatacaaaaaattagccaggtgtggtggcggacacctgtagtcccggctactcgggaggctaaggcaggagaatggtgtgaacccgggaggcggagcttgcagtgagccgagatagcgccactgcactccagcctgggagacagagcaagactctgtctcaaaaaaaaaaaaatatgaaatttaataataatatttttaaaaagttacctgggcagggtggtgtgcagctgtagtcctagctactcaggaggctgaggcaggaggatcgcttgagcccgggagtccaaggctgcagtgagcattgcttgtgccactgcattctggcttggggaacagggagaccctgtctcaaagaaattaattaatcatgcagttgagtggtatttagtccattcacaatgctgcagccacctctcgcgtgttctgaaacatttgacctattcactgactgactgactgctctctcagtgagctgtgaggggaggtgactctgtgtggggcccacaccctctgccacctggtcctatagacagactcttctgagtggaggggcagagcggccctgggacctaggagcaagcctggcccgaggcttgtggattgaagaggaaggctggcactgcacttctagaccacatgcatgccctccccccggaggggtcactggtctgttcgcatactcgcagacccctctgggatgccacggaagccaggcgtgtgtgaggaggcagggcagactgcttctccggctttcttctcccactacccccaccccagcgcaaagagtttgttctattgttcagcaaatattcttaggccagaatcttaaatgtttccattctataacaaacactgtgctcatttgtcaaccaataagtaattttaacagccctctttggatgcaacaaatgcctgaacatctgatcttttattttcttgagacaggatctcgctctgttgcccaggctggggtgccgtggtgcaatctcggctcactgcagcctctgcctcctgggctcaagtgattctcttgcctcagccgcctgagtagctgggattacaggtgtgcaccaccatgcccggctacatttttgtatttttagtagagatggggttttgccacgttggccaggctggtcttgaactcctgacctcaggtgatccacccacctctgcctcccaaagtgctgggattacaggtggaaggcactgcacctggccttgatgtctgatctgaatggtaggggtggtggggcaggcagtagttgtgggagttgacagtgcttagagggaaatttatagctttaaccacctatgtaataaaagggggtctcaaataaaaaatgttgggcagggtacggtggctcatgcctgta

SEQ ID NO: 16868 - DNA, 8176 bp, Human
actctagtgcaaggaaaagttctggcttgagctggtgttccagagctgttgacacgcagaccaaaggagttagcacagagggagagacctccccaggatcgcgccctgggctcctaaggctcacaggtcacagaggaaggacccatgagggaggaggacctccaggaggggcatagtggctcacgcctgtaatcccagcactttgggaaaccaaggtgggcagatcacttgaagtcaggagttcgagaccagcctggtcaacatggcgaaaccccgtctctactaaaaatacaaaaaaaaaaaaaaaaaaaattagctgggtgcggtggcacacctggaatcccagctactccagtggctgaggtaggagaatcacttgagcccctgaggcaaagcttgcagtgagccaagattgcgccactgcactccagcctgggtaacagagtgcgactgtaactcaaaaaataaataaataactaaagaaataaatgagtcgacagcagcatcagacttgcccttgggattggcacggagaggtcagtggcaaccttgagtttaggtggcggtgggagctgattctgccgggtcagagggagagagaggagggtgttgcaggcagagtttgctgctaaaggaagcagtaacgtaaggcagctggaggggaggtggggtcaacagtgtttggcttttaggagaaagtgcagcatgtctgggtgctgatgttagtgatgaagtagagaatgaatgacacagaggggaggtctgtggccaacaggtgagaggggttgtgatcggacgcacagtgtgatggacttggaacacagtgagtagcgcctctggcaacacctgctctgcccacctgtgcccagcaaggctgaagaatgagctccaggggggctgggccacgcagcaccatctgtgcacccggctcgtgtagcagggacctgggttgcttattatctgaagtacagggtggtaacagtctccgccactacacaggtcaagcgcttggcgctgtaaatgtcagtgcagacatctcagtgctctagacagaaacctaggagtcatctgaacttccagcctgctaggaacatgaggagagggaccttgttgcacccaaggctggggtctgtggaggggactcagcgggacacagggcagccaggcaccacccccacccgactcctagtctctgatgccgctccctgccctccattccagactaggcgccgcaagtacgctggggagacccaggagtagggagggcattgggagcaccaccacctggccacgggcaaggagcggagacaccgaaaccaacactcccagcggcgctggccacggtggctctgtcccctccctcaacaggtgctcctggggccaacgcctttcttcccaccagatcctccccgccagaggctagaagctgtgatagcagctagagcacagtggggggccatgagaaagaccccagttatccatctggtcttcttgggaccagggccagggagccggtcccctctcccgtgggttgggggaagatgctgcagcccgtggacctcctacccctttactccctcacccaagtgcccttcccagaggagcggactcctcctgtctgtcctcccggctctagcaaagtctgcgcccagcacccgagccccaccctgcccccggggacctggctggtgggttcctgaggatggtctccatctcgggaccggggcaggcaggtgagggtgggggatgggaggtgggcgcggcggagggagaggagggacccggccccgcgcgcatggacccagtggggggcgcgggcgcggccccgccccgtcccgcgcgtccccgccgcggccggcgcgcgctcccgggaggcggcagcggctgcagcgttggtagcatcagcatcagcatcagcggcagcggcagcggcctcgggcggggccggccggacggacaggcggacagaaggcgccaggggcgcgcgtcccgcccgggccggccatggagggcgcctccttcggcgcgggccgcgcaggggccgccctggaccccgtgagctttgcgcggcggccccagaccctgctccgggtcgcgtcctgggtgagtggtccctgcccgggcccccgctcccgcccctgcctcgcgaccttcaggcccctaccagccccctgccccctaccccctgccccctgcttctcgccccccgacctcactcactctcatcctcgccggcccctcccccgccggcctcaggttggggtgacgtcaccgggcagggcgcgcccacctgcgggcggaggaggggccggcggcgccggagagggaccttgagaggtcaccgccggtcgcctctacccctacctcctccccgggtctaatttcagtccctttccgcagcccttactccgtttttcctgttctcgtgacctggaagcagggacggggtggggacggaattctccgaggggcaggagggggctacgggaaccgagaagcgcctccccttcccccgcacacacaccctcgggtctccttggcagggagcctgtcccctggcccccagttccagctgtgagttgagggaggagaggctctgggctgggagggcttcctggcggcggtgtggaaggcaggtttgggagcagcctagcccactggggcgtccctgggagggccctgctgctccttccctccggcaggggaggtggcagttgggtgccgagctctgggttttgtccaggtggcaacctctgggccagccgcacctcggcgcctgtcttggaggagggcggtgcccacggtggggcaggggctttggcctcccctgcggagtggctctgaccagaccgggaggcaggacgctgcgttttggtccgagcgcacgtcccgacttgtggcccactcttggggacaagtgcatgtcccggcttcccccttggctccactctcggagctggagcgggaaaggagcgaagggatgaggttgaggctggaggtcgtttcttggaaacacagggctgccccgtgcagcgctggttaaaatgactgcggtccccctcatgcctgtctcccggaactggtgggcaggaggcattgaggtttgacggaacctcagaggtcaacggtgtcatcttttcagcccaaacacttacaggtgatattaataatcagtcacgtgggggctgtcatccctcgggtacccaccacgtgcaggaagctgggtggacatgtctgtcccagcactgcatgagctgtgcccgtcaccctatttgcatgctagaaaacaggccagacagttcccaaccgcgcaggaagcaacagctccgctgcctccataccctccctcccgccccgctctgcctgctgcactctcacctccccttcgccgttccggctccagcctgggaatcgcgggcccaggtgaaggctcctgttcccacactcttgagtgggctctgaggggactccacgggcccacgcggtgcagagtacctggcttgaatcaaccccggcttttgtcagccatgtgatcccggacaagtcacttcacctgttggggtcccaatgtcccccgcatttataaagagaataagaacaatggcgatcccacggggactttctgaggatttggtgaggggacgcatgtaaagtggctgtttaacacaatgtctgggcatagtagatgctcactaaacggcccgtgttgtcaataattactaaatacgcgagggttcgggaaagaaagaggtgacaccgccccccacccagatacgggcctgggaacgcagggacaggcccaggggcgtgggcgctcgaggcgggctcgcagaggtcgggtcgccgcagggccctgagcgccgcgccgcacgcaggtgttctccatcgccgtcttcgggcccatcgtcaacgagggctacgtgaacaccgacagcggccccgagctgcgctgcgtgttcaacgggaacgcgggcgcctgccgcttcggcgtcgcgctgggcctcggagccttcctcgcctgcgccgccttcctgctgctcgatgtgcgcttccagcaaatcagcagcgtccgcgaccgccggcgcgcggtgttgctggacctgggcttctcaggtgggcggggccggggcggtgagcgcggagagccttccgggtgggcggggagggggcggggcctgggcggggaacaccgctggagtttccagctgggcgtggccgtgacgaggggcggggactgaggcagggagtgtcaatgggcctcccgggtgggcggggagggggcggagcctggacggggagcgccgcgggactttctaggtaggcggggcccgggtctgggcggagcctgggcgcggaacgggtctggcgctcccgggtgggcggggtcagcgcaggagagggaggcgggacctcgcgccacgcggcgagcccaggcgaggcgccccaagcctcgggcccaccgacctttcctcctccgggcgaggccgccgtgggccaccgcgtggagcgtcgccctgacgcgccgcactgttcgcaggactctggtccttcctgtggttcgtgggcttctgcttcctcaccaatcagtggcagcgcacggcgccagggccggccacgacgcaggcgggggacgcggcgcgggccgccatcgccttcagcttcttctccatcctcagctgggtgagtgcggggcccgggagggcggggcgaaggggcgggcgctcggctgatcccggctgaccccgctgaccccgccccgcgcaggtggcgctcaccgtgaaggccctgcagcggttccgcctgggcaccgacatgtcactcttcgccaccgaacagctgagcaccggggcgagccaggcctaccccggctatccggtgggcagcggcgtggagggcaccgagacctaccagagcccgcccttcaccgagaccctggacaccagccccaaagggtaccaggtgcccgcctactagcggctggcaggcacagaccagggctccaaggccaccccaccaacgcaggccccagggtctccgggacctcccttgggtccttccagctcagtgccgcggacagagtaggtggccgctttgcgccatccggggccaagagggggtggacccgcgtgtctgggctgcccctgccaagttcccccagtccctcagcacctggccccaggactgaggtcctgagaaggggatagcactgcccaggacgtgtgtccctagcctggaatggactggcctggggaaggctttcccctcttgggccacacctgctcactctggggttgggggtccagctgccctctacgatcaggtgcaggggctgcccaggacaaagcgggggcaggggaaagacaccaccctcgccccaagactggggatcctggccactgttcccatcccatgtccctgtgggtagtgactgtctcgtttctgtcatggtggtgcgtcccgtccggagccactctccactttctctcacaggctgctagaacagcccagccctgtcagtgttgtgatcatggtccagtcttcgggtttcacctcctagtactccacaagctgctcctctctctgtggccccggcccctgcccaggtgtgggtggttctggccaggaaggcacaaggtagctgtgggccaagacaccagccctgtcctagcccttcagtaagaccttgccaggagaggagaaggatgcctgggtgccaggcaagacaagcccctcagcaggagagaggcccagaggctccagctggccaccgtgccccacaagatggcccctgtgtggttccctttaccttggcttcctggcccagtccctgcctctccacctgcaccctgcttcctggcccagtcccaggttggagtccctctgcatagctgactactcatgcattgctcaaagctggcttttcacattaagtcaacaccaaacgtggttgccacatttcatcagacagacacctccctctggagatgcagttgagtgacaaccttgttacattgtagcctagaccaattctgtgtggatatttaagtgaacatgtttacaatttttgtatatatcactctctccctctcctgaaagaccagagattgtgtattttcagtgtcccatgttccgactgcaccttctttacaataaagactgtaactgagctgactgtgacctggacgctcctggaatcatttctaccccttcccttctggtgccagggattggtatctgagaggcaccagggccccacaggaggggacggggaggtagaggccaggctgacccccaggctctgggggctccaggtccataggtccccaccaccacgtatcccactagtctggttctctgaaatgctgcgagaccccttgttttttttgtttgtttgtttttgtttttgtttttgagatggaggttcactctgtcgcccaagctggagtgcagtcgtgcaatctcggctcactgcaacctctgcctcccgggttcaagcaattctcctgcctcagcctccagagtagctgggattacaggtgcccgccaccacgcctggctaatttttgtatttttagtagagacagggttttgccatggtggccaggctggtctcaaactcctcacctcaagtgatccacccaccttggtgtctctcaaagtgctgggattataggcatgagccacagcgcccggcctgttttttttttgtttttttttttaagacggagtttcactcttattgcccaggctggagtgcaatggcgtgatcccggctaaccgcaacctctgcctcccaggttcaagtgattctcctgcctcagcctcccaagtagctgggattacaggcatgcaccaccatgcccggataattttgtatttttagtagagatgaggtttctccatgttggtcaggctggtctcaaactcccgacctcaggtgatccacccacctcggcctcccaaagcgctgggattacaggcgtgagccaccacaacgggcctagagtgaacctgtttttttttttgtttgtttttttgagggataaataaataaataaataaataaatgcctaggctagagtgcagtggcaaaatcttggcttactttaacctctggctggctgcaacatccacctcctgggctcatgtgatcctccctgctcagcctcctgagtagctgggaccacaggcatgtgccaccatgcccagctaattttaaagttttttgtagagatggagtctccttatattgcttgggctggtcttgaactcctgagctcaagtgatcctcccaccttggtctcctaaaatgctgggatttcaggcataagccaccgcgtccgaccctgatgatttcactcttatgttctagcattctataacgctgatgagagtgatgctaatggtaccatttgcattgtttgtaagtgatcttgttggtaatgatttgtagggttcttttctgtaaatccttgtctagataagaatttcttatcgttgatcctgtttggtccttgatggtttgttttctctcttggtgttggggtgagcagtcacggtttttcgcatgtcctcttctcgccaccttctattcctgggactcctgtaagatttgccgtgaagcctccagtaccaggtccctattccatggccttccatggccacacccttccccacttctcactgctaccttttgcagttacatcccccagcttgggtttacttttgaacccatctattggggtttttatctcaattactttttcattcctaggatttttgagacagagtctcactctgtcacccagactggagtgcagtggtgagatctcagctcactgcaacctccacctgccaggctcaagtaattcttgtgtctcagcctcccaagtagctgggattacaggcatgcaccactacacctggctcattttttgtatttttagtagagatggggtttcaccatgttggccaggctggtctcgaactcttgacctcaggttatccacctgcctcagcctcccaaagtgctaggattacaggcatgagcgactgcacccaacctcattcctaggatttctaactgttttttttttcataacttcctggttgaatgaagcacagctaagaaccatctctggagccaaaatgctggctttgcccctttctagctcag

SEQ ID NO: 16869 - DNA, 9057 bp, Human
tgccacctccacctcctgggttcaagcaattctccagattcagcctacccagtcgttggtactacaggcacgtgccaccacgccaggctaattttctgtatttttagtagggatggggtttcatcgtattagccaggatggtctctatctcctgacctcatgatccgaccgcctcggcctcccaaagtgctgggattacagacatgagccaccgtgcccggcctgcaggagagactcttaagggtctatccctgggcactgattctttagaagagaaggtgggggaggaagcagccttaggggggcagtagggccggccctgagtgatctagagcctggctgggggagggcgtgtttctggccagagtgactaaggctcctcctgcaccaccctctcaaccagggcccccaaaagaagcatctggagaaggaaacgccggagacctcgggagacttgtaggctgtgtggggtggatgaaccctgaagcgcaccgcactgtctgccccaatgtctaacaaaggccggaggcgactcttcctgcgaggtctcagagcgctgtgtaaccgcccaaggggttcaccttgcctgctgcctagacaaagccgattcattaagacaggggaattgcaatagagaaagagtaattcacacagagctggctgtgcgggagaccggagttttatgttttattattactcaaatcgatctctttgagcatttgcggagcagaggttttttttttttttttttttgagagagtcttgatcttgtcgcccaggctgctggagtgccggggagcagagtttttaaggataacttggcgggtggggagagccagtgagccaggagagccgattggtcagggaggaaatcacagggagtcagctgtcttcttgcgctgagtcagctcctgggtggtggccacaagatcagatgagccagtttatcaatctggttggtgccagcagatccatcaagttgcagggtcggcaaaatatctcaagcactgatcttaggggcagcttagggagggtcagaatcttgtagcctccagatgcacgactcctaaaccataattcccaatattgtggctaatgttagtcctaaaaatgcaatctagtccccaggcaaggaggtggtctgctttgggaaagggctgttactgtctttgttttaaactataaactggctgggcgcggtggctcacgcctgtaatcccagcactttgggaggccaagatgggcggatcacctgaggtcgggagttcaagaccagcctggccaacatcgagaaacctcgtctctattaaaaatacaaaattagctgggcgtggtggcgcatgattgtaatcccatctactcgggaggctgaggcaggagaattgcttgaaccagcgagttggaggttgcagtgagctgagatcgcgctactgcactccagcctggaaacagagtaagactccgtctcaaaagaaagaaagaaagaaagaaaaaaacaaaaaactataaactgagtttctcccaaagttatttcaacctaccagcagggatgaataaggacagcttggaggttagaagcaagatagagtcggctgagttagatctctttcactgtttcagtcatcattttgcaaaggcggtttcacctgggcgcggaaaggctgcatgacctccggcagctccgggcttagtaccagggactggactggggggacacgaccctacggattcgcgccgtcgcccacctggccaggccccatgtgcgcccctagccaccagggcgcgaggggcggcaggggcggggccttggggaagcggcctaggggtggtccctgggagtttccatgggcggggcctgctggggagatgcgattggactggcaccggggggcggggccttggggaagtggcccaggagtggtcccaaggagtcaacgtgggcggggccagctgggaagatcgtattggaccagccctgaggaggggcggggcctcccggaggcggaagccgggattcgccctccggggagcgattggtcctcgggaggggcggggaggtggacgcgggtaccggcggtcgtcgggtcggcagcctttggtcagttggcagcggcaagcgcgctgcggttccggtggcgccatgtcgttctgcagcttcttcgggggcgaggttttccagaatcactttgaacctggttggtcctgcggcctctcgctgggagggcagcgcggcggggggcgcgcattagcgggggcgccgccgtcgtccgggggtgatgtctctcccaagccgggaatgggggcgaatgtggctgccggggagaagcgaacaggggtcaaaaggactgcggaggagtggggagcctgggggcgaggagagtggggtacccgaggagagggggccttggggctcaccgtcctggagggggcaggcctcgagtgtgaacgtgccgtttcgggggtgggtctaagggatcgggatacgtgggggtggtaccccttccctaccccctacactccaaagtgatggcgctgggggaattcgggttagggtcggggcttcggagaggccaggttcttgtccagggccagctcctgtggccggggcgccccttcgcgggtcatcccgcaggtgttaccctggcccttcccattcccccgagtccgggatctctgggaggagtctggcaagcatagaatgtccccttcagatcctaatgtgccggcccaggtgcctccccacctgcccagggactccaaattggggaaccaggagtgccaccaggcacctgccaacagcccgtgaagtttgaccaggcaggcaggatggggtggtttggggcatggccagccctccacactggccctgatgaatcccttctgggctgggctcgcctggtagtggactaatttggtaaaaacacatccacaggcaagtctgagtgcactggtctccttgggcggatctgctgggtggcacccctgtagcgggttgggctgtgacacaggaccatcccggcaaagcctcccccagcaagactctctggctttagatcccagttgtcctcaggctgctctgccaagccagaaactccacttccacagcagctgctggcttctctttgcttttttctccagttcctggaaaaggctgggtagtttacagtctccaggggaggctgtccccaggtgatgggtgagaggtgactcagcacccctggaggttcctgttttcagtccttaaaacagttctgcaagtcagttttgcaactttcccaccccctccactccaaagggatcctttgtgggtaggctgaaatctgttgtccccagccctctttcttcctgggctcctgtgtggcctggaggccttttctctgggactgttctcttcctgcctggagagcagagcagtgcctgggtatccagcttagggcctcgttgggcagcagggaggaccacttgagaaaggagagggaccaggtggttgggccacatcagggcccctgccctctatgttcctgggggaactaggggggcgagggggagctccgtgtcctcattggactacccaggttccttcacgctgcacacacttgtagctgagtgtctgcatcaccaagcaaagatggaaatgttaggatatgccccgtcacggggctatgagaagaatcaaggagataattgtgaaaggtgactcccctggtctctggcacatctactaaacgtgagctcagcacagcgcctcccgtggcgggtgcctggggaaggagcacagcctaccctcggaacgggggcagcgctgtctttgcctgggttggtggatttgggagcttgaccccggaaaggcgggagctgatgactccacatttgcctctccttccaccacaggcgtttacgtgtgtgccaagtgtggctatgagctgttctccagccgctcgaagtatgcacactcgtctccatggccggcgttcaccgagaccattcacgccgacagcgtggccaagcgtccggagcacaatagatctgaagccttgaaggtgagaggccacaggggtgggggagggacgggggcggccagggagagcagagagccagtcccaccttcctccctctgcttgccccacagctccaggggcttagaggcgtctattccaggcctgttgcctctgccagggagctgccaccccaggctatcgggagagcctggccttctggtgcaaatgtgggaaacaggacaggtttcctgtacgggctccaggacaaaggtcaacctcttatgtcggcggtcagcttgggaaataggcgtgtgggaagaaacaccatctgccagccccagtaagggccttcactgtggctgtatcatggccagaagctcacccagctgccttgtgatctttccaggtgtcctgtggcaagtgtggcaatgggttgggccacgagttcctgaacgacggccccaagccggggcagtcccgattctgaatattcagcagctcgctgaagtttgtccctaaaggtgagcttgctttgcacagctggggccaggcctgttggcctttgagcccaggctggggggcccagtgtttgtgcttgtccacttaccatgacaaggtatggggccaccaagtcacgctgcctgggaactgtccaggatcccccagaaaggtggctgcagcgcaggggcaaaggagctggtgttccgcttcctcgcttggttgatcatgactgtcccaaaaaggggcttcagcgtgagaatgtggcaaatggttttcctcagaggcctggcctttcccagaggctagagtcaggggcggggcaggcagagcctgaggccccagtctgtgcggctgtgtctcccactggctaggactgtggccttgcttcttagccgctcagagcctgcctcctcctctgcagagtggcggtggtagcagggctgtgaggacagctgcgtgtcacgtgcacctgggcctggcacacaataatagcttgatgaatcctcatcctttttttttttttttctgagatggagtcttgctctgtcgtgcaggctggtgtgcagtggcgcgatctcagctcactgcaacctctgcctcctggttcaagcaattctcctgtcttggcctcccaagtagctgggattgcaggcacgcatcaccacgcccagctaatttttgtatttttagtagatacggggtttcaccatggtggccaggctggtcttaaactcctgacctcaggtgatctgcccaccttggcctctcaaagtgctcgaattataggcatgagccaccacgcccagcccacacctggttaatttttaattttttttttttttttggtgacagagtcttgttctgtcacccaggctggagtgcaatggccaatctcagctcaatgtagcctctgcttcccaggttcaagtgattcttctgcctcagcctcccgagtagctgggattacaggctcccactaccgcgcctggctaatttttgattttttagtagagacggggtttcaccatgttagccaggctggtctggaactcctgacctgaggtgatctgcctgtctcaacctcccaaagtgccgggattataggcgtgagctaccgcacccagccaatttttaaaatttttatagagatgggggtctcactatgtggcccaggctggtcttgaactcctctgggccttggcctcccaaggtgctgggattacaggcttgagccactgcctcgcctgaaatggggctgttaacagcacacgcttgtggccatcaccgtgctgtggggttgagcgagcagcctgtcaggatctggtgcgtggtaaacctgcgatgttttcgtccttttgttgttatttgtcctccgtgtgagtggagggagaagagattctgggttctcctgtggatgtcagaacaaaatggggtacacagactcccctgagtcgggcatctggtcttttcagctcccctgtggcctgcaggccagggcagagtgtgaaagcgcagggaacggcacctgaagctctgccttgcagtgacttgctttctgcccctaccctggctttccaccgcccccgcgcccggctttccgcccctgcttgctttctgtccccgcatactttccgccccctctcctctctttcaggcaaagaaacttctgcctcccagggtcactaggcgggcagcccacacccaccccagacggccaccacactgaggccacacgttggccattccaccttggagttggaaccctgggcgtcgagacaggaaggcagggcgcagtggttgaaacatcaggacactcccaaggccccggctctgaacaagaccttttcgtttcttggaaaagagactcatttgctgatggttcatgccttctgctgggacaggcctgggctgtgcagccacactgtcggctgacttagccccctgctcactctaggtgcctccaggaggtgagccctgggtgcagctggtctctgaatgacgttacaccctcaccttcttttcctggccctgtctctggactctcccctgtgaggcccaattccaagacagactctcgtcctcaccgaagcttaggcccacatctcccaggctgcttaggagacagaatggaaacggaggccgcccctgccagccgccctggccctggtcactgcatgatccgctctggtcaaacccttccaggccagccagagtggggatggtctgtgacctgctgggaaggcaggctgatggggcacacccttggcctctcgtccacgaggggagaaacctaaaccctgtttcacaatctgtgcggaagtagcttgcctcacttctgcttaggaaagcggctgttgctccataactctaaccagcacagggctgaggcctgcagtgcacacctgcagggaggcccttcccaaggtgtggtgactgtgccttactgtacatgctcggaggcctggccatataggagggtgggtgatgctgaaatcaccccccatcttaagtaattactttctggagtaatcaggtggaaatccatagacaaatgaaacattcagatgtactgtctttttttttgttttgagatggggtggggtcttgctctgacatccaggctggagtacagtggtgcagcgtggctcactgcagcactgacctcgcaggttcaagtgattctcccacctcagcctcccaagtagctgggaccacaggtgggcaccaccatgctggataatttttacatttttctgtagagatggggtctcactatgttgccgaggctggtcttgaactcctggactcaaatgatcctctcaccttggcctcccaaaatgctaggattacacatgtaagccaccttgccccggccctgctgtctttattaacaacatcagagatgccaggacatgagtgtcaggcctttatatagttaaaaaaggcaggcatggtggctcacgcctgtaatcctagcacttcgggaggccgaggcaggaggatcacctgaggtcaggggttcaaaaccagcctggccaacatgaggaaaccccgtctctacttaaaaaatatgaaaattagccaggcgtggtggcacacacctgtaatcctggctactcgggaggctgaggtgggagaatggcttgaacccaggaggcagaggttgcagtgacatgagatcctgccactgcattccagcctgggcaacagagactgtgcctccaaaaaaaaccccccaaaaacctttttttgcaaatatttactgagtatcctttcagtaaatatttgcaaaaaaaaatatggctgggggtgcagctgtgaacgagataggtgagaccccgcgctcaaggtctcacagcatagctggggagacctggtagtgaggtagtgtcagaagatgatagggctgggagcaactgcagcagagtaatgatgctaggatgtgtggaggaagctccaggggtcagggagggggactcaggagggcttagctcagcagtgatgggcacagcatgtgcacaggctcagcacacatggggcctgccccaggccctggagggcacggaacaaggctccacaagaaatgcaccattttcccaatttatacccacagaaatccggggagcatgtgggagtggattttaagggtggatgtttcaccctgcagaacccacagctggcatcgccccaaaagcggtggccaggagtgccccaaagggcacaggatggccccaaagcattgcaagatggggccagttgggatctgaactaaggaacgctaaacgccagggtgagcactccagagcatttattagggggacttacagaaggccgcagcgtatccttgcaacaaaagcgagagagaagaggtgccctcccttgatatctctgcagcaaggggacacggtgtggagtggatatggaagtttaagggatttggctcagggctgggccagtttctttcagtgttttagcccacaacctagatttttttttttttttttttttttggagacagagtcttggtctgtcatttaggctggagtgcagtggtgagatctcggctcactgcagcctccgtctcacgcctgggttcaagcaattcttgtgcctcagcctcttgagtagctgggattacaggcgctcgccagtatgcctggctaatttttgtatttttagtagagatagggtttcgccatgttggcgaggctgatctcgaacactgcacccagcctagaattttttaatttaatttttaaaaaattagagatagggccttaccatctcacccaggctggtcttgaattcctaggctcaaacaatcctcctgcctcagtcccccaaagtgctgggattacaggcgtgagccacatgcctggctgcactttgtgattcttggtcaggacacagaaagaaagcaggggaggccaggtgtggtggctcatgcccgtcatcccagcactttgggaggctgagatgggtggatcacctgaggtcgggagttcaagaccagcctggccaacacggtgaaaccctatctctactaaaaatacaaaaa

SEQ ID NO: 16870 - DNA, 13261 bp, Human
tttcaaactgcacaatttttttttagacggagttttgctcttcttccccaggatggagtgcagtggcgcgatcacggctcactgaaacctccgcctcccgggttcaagcaattctcgtctcagccccccgagtagctggaattacaggcgcccaccactatgaccggctaatttttggtatttttagtagagacggggtttcgccatgttggccaggctggtctcaaactcctgacctcaggtgatccacccgcctcggcctcccaaagtgctgggatgacaggcgtgagccaccgcacccagccaggatggactatattttattcatcagttgatgaacgttttagttgtttctaagtagaaaactttacaagtgcaaaaattcagcatttactcatgggcaaaacacaatgccaggcatgtgtgacaaagacacaaacacacataaaagataacgacctagcccatgtgcgatggctcatgcctgtaatcccagcactttgggaggccaaagcgggcagatcacctgaggtcagcagttcaagaccagcctggccaagatagtgaaactccatctctactaaaaatacaaaaattaaatgggtgtggtggcacgtgtctgtagtcccagctactcaggaggctgaggcaggagaaccacttgaaactgggaggcagaggtagcagcgagcagagattgtgccactgcactccagcctaggcaacagagcaagactcagtctcaaaaaaaaaataaaataaagaacctacttctcccaggaactcacatcttatcatgtaacacctggacatatccttacctgtgaagatgatgatactcaggcctcatctataagatgggctttctttcatcaacatctgaatagtaactcaagtgtgcctgaaccaggtcaccaagatcctgactttcgaagtctcctgaggaaggacatgtcggcctccaagtactggagacagcattcctgtgtagacagttgccagcaacccgtctcccacagaacctggtgcaagaccaaacccagccttctctgcatttccctctagcctagcaaagacacaggtagctcactcactctcagtatttccgcggtgatgataaactccgtctgtttaccctctgcagacctgggatttggcctcggtgttcccagtcccaacagaatcttaaacttctccttcaagcctgaatctttgcttgttggtttggccatggtggaccaggacgcaccagaaaacccctctgtgcaaacgaaacaggaatggggacatctgagcaacacctctgcccaccttccccactgcggacctccagccgtcaggaccctgggtctctggtgggcataacctttcctcccacactccctgggagaactcaactacagcccagctgaccagctcgcaaacaggcacctaggaaagcccgggagacaccaggcctggtctagagagctctctactcagacgctgccgcccgccccgcccgactcagtgcacgggttaggactgccgccgcgaagtcctgggagccccgacgtttgccgtctctcctctacccatgtgaagcaggagctgtcacggagccgcctgcagcagagacccgttcgcacccgccatgacttaaaactaagggatgctcggagctccggagtcgggttgcagtgggcgcgggtgagggcccgggacccggacactgcggggtccgcctctctaggccgctgccccgtggggaccgccacttgccccgtggggaccgccacttaccccgcgccgcgccaccgcgctccgggccgccccgacgcggagaaaggcgcacccccctggccccgggacgccgccggaagcgcgacccgcacttccggtagcggcattgcgcggagggccgccttgggagcttgctgggagttgtagttctgtgccgccctctggcggaaaggccggcgatccttgcatcacgtgacggggccgcatgggccgccgggatgtgtagtccgcaggagtccggcatgaccgccttgagcgcgaggatgctgacccggagccggagcctgggacccggggctgggccgcgggggtgtagggaggagcccgggcctctccggagaagagaggctgcagcaggtagcgccgcgccgtggctggagcgtgggaggaggcgggataggggctgcaggctggagtcccgggccgcctcctgcggctcccagctgcgcgggcaggggctgcaaacccggcagccgcgaacggttcccacgtgcggccctgcgttcccaccttgcgcctttttcccaaagattgcggtccgcaggggctgggtttcgggcgctccgctccgctgccccctttcgccccaagcaagaaaacgcttcctttcccaccactctgtccgggactctccactccaggctctgtgggtcccatccccgccctcctgcagtgaacttgctgtcctcggagaggctgggtgccaaggacacacgcagccagaagcctgctcccccagctcgggggagggtgcctctgagggaaaacaggaaagggcatggcacttattatatttatcctgcagccgttgaggacctgctgggggccaagcactgcagtgagcagtgagggacacggacagggcctctgcgctagtcccgctgggacttctgcagaattggccagagttggattcccataggcacccagggaccccaggggtagtccagactatggcaggaggaactggtgcagctgggagcaggcaggtggtgatgccagccagggtggcaggagctttgatgccaggatagagtttggagtttattatgacagtaaacggaagtcaattaggaggttttgttgtttgttttgagatcgggtcttgctctgtcacccaggctgtagtggagtgttgtgatctcagctcactgcaacctccgccccccaggttcaagcagttctcctgcctcagcctcccaagtagctgagactataggcccctgccaccacacccggctaacttttgtatttttagtagagatggggttttgccatattggccaggctggtcttgaactcctgacctcaagtgatccacccacctcggcctcccaaagtgctgggattacaggcttgatccaccgcgcccggccggccaggattttttaaaagggagtgacacaacctgatgtgggtgttagcagactgtctctggtgcagtatagaagatgtattgggggcaccttggtacaggctgttgctagagtcctcatgagctaacatggaccttgtcagggtcgctggcataaggagggcccacataccccagactgcagagggcagagcaccccaagtgtattagatgatggacagttgtggcatgaacgagtgaggggtgagctagcaggcgggatggcacccctaccctaccttcacctgtggccccaccagagggactgcgtggtgctttttgcagaagcgaggaaaagccacagccccgtgaagcgtccgcggaaagcacagagactgcgtgtggcctatgagggctcggacagtgagaaaggtgagggggctgagcccctcaaggtgccagtctgggagccccaggactggcagcaacagctggtcaacatccgtgccatgaggaacaaaaaggatgcacctgtggaccatctggggactgagcactgctatgactccagtgcccccccaaaggtaggcaggggccccatctgcccagatgaccccccatcttagcaaggtccttgttttctttctacccggtggcttttggctggcaccctcccctgcagacagcaccttgggaggatggacacccggtgccccagagcatcgcctgcatcactgtagccactcagcaggtcaggacaccagtggtttagggcctcgtgctcgaacttctgcccagtgcaggcgtgacctgggctttgtgtgatatcaggaaggaagagttccttttgcttcacggtcccagggcctgaaacccttagaccaagctgagttctaatccctattctgctaccaggtggcttggatacaggcctctctgagcctcagtttgcttgtctgtaaaatgggtagtatgggccaggcatggtggttcaggcctgtaatcccagcacttcgggaggccaaggcgggtggatcacctgaggtcaggagttcgagaccagcctggccaatgtggcgaaaccacgtctctactaaaaatacaaaaattagccaggtgtggtggcaggcacctgtaaccccagctacttaggagggcgaggcaggaaaatcgcttgaaccccggaggcggaggttgcagtgagccaagatggcaccaccacacttcagcctgggtgaaagagtgatactgcatctcaaaaaaaaaaatttgttttaaagggtagtgtgatgattcacgaagcaatcataatagtagtggccaatggctgttcagtagtgatgggccagatacgatcgtgttgggtttttttttgagaccaagtcttgctcttgttgcccaggctggagtgcagtggtgaaatcttagctcactgcaaccttcgcctccgaggttcaaattattctcctgcctcggcctcccgagtagctgggattacaggcatgcaccaccgcacccagctaatgtttgtatttttagtagagacggggtttcaccacgttgatcaggctggtctcaaactcctgacttcaggtgatccgcctgccttggcctcccgaagtgctgggatgacgggtgcgagccaccacgcccggccacatacgattctaagcactgagataattcatttaagcttcacattactccagtgagtcaggtactattattgtcctggtgttgtagatgaccaaacatacccaaaccagacctccccaccccacagggggaggctgatgcctcaagtgtggcccagggcaacaaaccagggtgtgtcgagggcggggggcggagcctggccagggaatcacccaggacccgccgccaccccggtccctgtcactgcacaagcaggtacgcaggtaccaggtgctgctgtcactgatgctctccagccaaaccaaagaccaggtgacggcgggcgccatgcagcgactgcgggcgcggggcctgacggtggacagcatcctgcagacagatgatgccacgctgggcaagctcatctaccccgtcggtttctggagggtgagccctgcctgtggcaacgggggccgggtggcagtggcctgagagagacctcagaaggctgaggggggtggcgacggtgcaggaagtgagggtcaagcatctcaggctcggggggtccccctgaagccccccccaggccgtggggccctgaggcctgacgcccagtcccagcagctccttggccttcctgttcgcatcctcccttccttcctctgcttccccgcctcgccgcctgcccacccttcctcaccgccaaggctgcctgcccacccgcctttccctttgtttactgctagcctctcccggtgtgtcaccccctcctgtccagagcccctcaccctccaggagccctggggaggctgctccccaaccccgccgagcactggatggtggtgggcggatctgttgaaagcagcttggtgggtggggccgcttccccttggcacccgcgtgggccgcagtttctcagatgggttttaaatagccctctccactcaggcacaggatgggaaccacccggcaggcctggcagctggtggggaagccccagctccagccctccttcctgaaggcgcaggtgcagccaagccccactcctgggagcggctggcctgcttggcctggcctgggtgctggcagggaatgacgggcaggggaaccccagccagagcctacacgtgcatcattggcccacacgggtgggaggagggggtcaggcctaccttgggcctccctgctgccctccgcttgttcccgcctcctggggggcgggggctgagcttgcacacgtcctcagcaggtgcaggtagctctggccacctgtgggtctcctgggggctgcatcctcccaggttgggctgtgcccttgcctccaaggctgaacccacccctgtctttcagagcaaggtgaaatacatcaagcagaccagcgccatcctgcagcagcactacggtggggacatcccagcctctgtggccgagctggtggcgctgccgggtgttgggcccaagatggcacacctggctatggctgtggcctggggcactgtgtcaggcattggtgagtagaggagggcggggctggctccagcccactggctgctcttgggattccccacatccttgtgacctgtgactccacttccagcatgctggtcctccacccagcccatagagtcagaaaggtgctcccagggtggagccaggccagccccactcagagacaggtgctggggcaggaggtcacatgggctgagcacctgctccgtgcagggctctgagagaggccccggagctggactccatctgcgttgtattcgggagaaatgtggagcgaggaattccccactcgtggagtggaaaccctgatggttgtgcagggtgctcttggggcctggcttgggcccagggcctctgggaaggcccccaaggtcatccttcacctgagagctgcagagcaaggtggggtgagccaggccaagaggaggaagtgtgttcccagcagaaggaacagcatctgtaaaaccatgatgcgagagagagggccaggagcaggaagttctggaatgagatgagggcagagtggggaggtaaggactgaggagggaggaggaagagtatcccctcagcaggtggggtggggagggaggtgctggggggagaaagggggagggtggggagggaggctctgcggggacaggaggggaatggtagggagggaggcgctgggggaatgggggaggagggtggggagggaggcgctgggaggatggggggagggtggagagggaggtgctgcggggagaagaggggagggttgagagggagaagaggggagggtggggatggaggcactggggggagggccctccttgaatccttttcccaggtcctggtgtctcttcctagcaccggaggcttcttggcagttgggtgcagacagacccctgggtttggggtggggctgcctcctcctcggctttgtccagaggatttggggctcctaaggccacacgcagccgggcccagccagtccagaaaccagggcttggccctgccctctgtgtgcccccatcccaggcccctttgggactcctgcagggggcctgtgccggaggcggggggcttgcagcactttctggtgggcaagagggccaccaagggccgggggcctctattctgagccggggccacctggtgaggctgaacagccacagcagccccaaagagccagagccaggccaggtgcgccggggcagggcctcctcccgactgagactcccagcgtcaccacctgccagcctctcagtggacacttgagcttatctgggcggctgtcctcagctgcccgtgtccctggggtgctgcatcgtggttgggcagggctgtgggggaaggtccctgcccgcagccaggcagggaacgggctttgggagcagcgggcacaagagacagccatgtggaaatacctccctctccaggtgtctgtgggcctgaccacctgcaaggagaccccagggctgcctcctaggggttccccgaaagagaaacgctctcagttaaaatgtcagagctggctgggtacaagggctcaagcctgtaatcccagcactttggaaggccgaggtatgtggatcacctgaggtcaggagttcaagatcagcctggccaacgtggtgaaacccgctctctactaaaaatacaaaaattagccgggtgtggccaggcgtggtggctcacgcctgtaatcccagcactttgggaggccgaggcaggcagatcacgaggtcaggagatcaagaccatccaggctaagatggtgaaaccccgtctctactaaaaaacacaaaaaattagccaggcattgtgtcaggcgcctgttgtcccagctactcgggaggctgaggcaggagaatagtgtgaacctgggaggtggggcttgcagtgagctgagatcgcgccagtgtactccagcctgggcgacaaagcgtgactccgtctcaccaaaaaaaaaaaaattagccgggcgtggtggcaggagcctgtaattccagctcctcgggaggctgaggcaggagaatcgcttgaaacccagaggcgaaagttgcagtgagtggagatcgcaccattgtctgtatccagcctgggtgacagagcaagactccgtttaaaaaaaaaaaaaaatgccacagccatagattgctggctccggtcccagctctgcacctcctggctgggtgactctgggccaggcccttggcttctctaagctctggccacaaagtgggtgaggcagtcctcgtcattcactgtccaggtgggcaggaggctcacacaacgtgacgtggcctgactcagccttgaagcatggccacttccgtgttacagaggaggaaactgaggctcagagccccaggggtgtgacccctcaggccttgtggtctccccacaccctcggacacctttttctaggcagcagcgaaggagctggtgcaggcctcggctttctctttgggaaacacgggaggaggaggcagggctggggctgcagctggccggggccaccgggtgggagaagggagccccagtgagcagacgcctggggtggccagctgaggggagcaggagccagaacccaggtggacagcagctgcggccggccagggcatgctcccgctgtgtccctgaccgctgcagtggcaggtgctaggtctgcaggcagtgacctcatgccggcctgccaggcagagctgttgccacccagcctggtgcccagagccagtgcttatgccgagaggagcctcaggccacaggagacagacagagggaagcctggatggacccttccggggacagggccacgttcctggggaggctgagggctgagaggtgcttcggagtcgggatcctgccgggcctcggtttcagcatccgtaggacctcatgaggactcactgagctggccaatctctctggcagggtctggcccccagcaagcgtttgtccaagcgagctgtcgctgttattgtggggaatagagctccaagcagagccgagtcatcacccccaggccctgcccaaagcagagaccccaccacccacacatccaactagcaccagtgttgggagtgggcagcccagaacagagccccccaggctggctcaggtgatgggagagaggcctgcaccccaacagagggctcagcccctgccccagcacctcaggggcagccaagatggtcacatgtaggcttgcagccagggctttgcggttccaatgtctaactggagggccacgggggtggtggcagactcgcctctgggcggggaggggcacgggctaggctggtggagtgtgcccctgttcaccccgcttggcctcccagcagcagtggacacgcatgtgcacagaatcgccaacaggctgaggtggaccaagaaggcaaccaagtccccagaggagacccgcgccgccctggaggagtggctgcctaggtatgagtatgtggggggcttcctagggagaagagctcaccccgcccgccctctgtcagcactgacccagcccccacccccacagggagctgtggcacgagatcaatggactcttggtgggcttcggccagcagacctgtctgcctgtgcaccctcgctgccacgcctgcctcaaccaagccctctgcccggccgcccagggtctctgatggccgcatggctctggccgaggtgccgctgtggccaccgtctgtgaagtggctttacgcttcaggaagccacgcctgttgaataaagctttggtgtgtttgcagatgggatctggctgatgtctgtccctgagggggcagagagcctgggaatcgcatacaaggatgtgttcgtacacacccgtgctcgcgtgtctggagcagggctgcctgggaggccggctggggacgtgacaatctttgctatgtactcagggagggggagggggtgtgcatgaacctgggagggaggaagtggggagagccagctgcagccagctgttggaagtccgctggggaagcaagcagcccccgggcagctggctggggaccctggcccctcatgctatccaccgccggccccccagcttcccagcccggacaccgccagctcctgaactttcatgccctcaaagcccagcctctgccagggtcccacccctgtttacagagctacccggccttgaaagggacactggggacccaggcagggcgccacagggtacaaagcttgacctgtgactgctagaggtcgcagggtgaattgggcaaagggtggcccgtgtgggtgttgtgtggggccggatggcttcacagggaaggtgaaggtgggaggctgagtctgccaaataagagagatgggcatgggcccaggatgtgccacacagcagggggtcccatgggggtcagcgggggagatggagcagggctgggagcagatggatgcagggcacgggctcaggaacgagaccgtttccagctgctgagactcggggagggggctccctgaaacagcctcatccctccacccctctcaccccacggggaggaggctcagaaaagacagaggcgtgtgggtcccaggcagggcctgtttatcctgagagcgcgcatgcgctatggcttacgaggcaacagcggtgccggtcgatcggtggtcggttcgggggtgcggggcccgggagggaagtgcaaagtcaacagggtgtccacgggggagcccgccaagcagggctgagccagaggccaggcgtccttcccgggtgccgctctcacacacctacgttccccaggcctgggagctgccgcgcggaatgaggggcctgtccagaggccgccctcctcggggacgtggggcctccatcctcaggcccctcggagagcccaggcccccagcagggcacaggcgcacagggtagctgggtggggagcagggtgtggcctagggacccccacaccagggcaggtgggcaggggcagctcctacggccacatcaggcctccctggccttacccaaggtccccacgaagaggctgggcgccccaacttggccactgggaagtcccagggactcccactcaggacggccgctgctgaggggagggggcggggaggaaatggtttgcagagaaaggtttgttttattgcaattatttagagcgcgtcccaagggggaggggaagggggaggggaaggggggggggtctctggtattaagtggaaacatgtgtggagctggagatctttttggaaaaaaagcaaaaacacaaattcctttcagtcagcaggccccggcagagcagcaaaggccctcgccccgcggctgccgcgcgctcgctcgctctctctctgtctctctctgtgtctctctctctctctctctgtctctgtctctgactctctctcacatctctgggtctctctccccctatcttgctgccacaggcccccagtacctggtgggcaggggcaggatgggggctcaccggggctggggctgatttctgggcaatggcaggaccaccctccagtccactgaggctgggggagctcggggcaggctgaggcccaaggtccgtgcgggaggggtcccagggtcccgagacaggcaggaaggggctcagaagttgctgaagatttcacgcttcctgttccagtccatctgtggcgcgcgcttgttgactcgcatggctcgagccttctccttggcctcggccgccgtggggctcaggtggaggccgctctcctggaagggatcttgcttccaggcactgccatcctggggtgagcacggtgggtggggtgtctggagtgagccctagtcccacaccccagacggtggcccctcctagggagcaaccaacagaggctgcctgctggggctggggctcacgaggacttcctgaacagagaccccactgcccgggctgacatctccacagacgcctaccccaaggcctctagcaaccccacgtgtgagctcaggagtggagaacatccatacctcagtgtccttgtcggaaccaggcaggtcacttcgggacgagcacgcagagccaccattgagctgggaaaccaagggcagattgtggtttcacagacacacacaacacctgcacacgcacacatgtgcacagaggcacacccccccccagtgtgtgctcctccactcggcagggggcctcgggcctctggtggactccagatgcggcggggcaggcaccgggcgcctggcagtgacaggcaggtggcctggccggctcatggtgcagagggggttcaggtgcaggaatggccggcgtgagcaacgcctggggtgaggccaccgccagctccctgaggaggcagagactggagggcaactccttaccaggtggtgcccaggagaggacagaaggcagtggccccgaccccaggggccccacgtggcttgtgtgtggcacgacccaggatgagacccacaggggcattaaagggaggtgacagggctaaaatcgggtgtcactagcacacctcgaggacggatctccagggagaagggggcctctgtcgggcctgggtacccccagaggcaccctgtgtctcatgggcaccccaccctcttacctgggcagggctggttccattggtgacgggtgacggcagaggacctgtggggacagcgtgtcagtggctgctcagccaccacaccgcacccaccctgtgccctgggccgtggcccaccttccacgtgctcctcggtgggtgtgacccgaagccgcttgaagtgttcatctgtctcggggtccacgaccagcagccgggcctcgtcctcccgtgccttgatgctggccaccacctcagcatggcgcagtccctccacattctgcccgttcacctgccgccaccagcatgtatcagccccgccatgggcccagacagcccccaacgccgcgtggccaggtgtggcatcaaatattcatcacagccaccgcccaccgaggcagcaggaggcgcaccagctcaggttcccagcgt

SEQ ID NO: 16871 - DNA, 6758 bp, Human
tttcacagtgggtgtgggctgacatcacaatagcattgtccagctcaagccagtcacaaccctggttcaggacccagagaccccgtacagcccagcccttgcccccttctctgaaggatcacaggtagccaggcgcggtggctcacacctgtaatcccagcagtttgggaggccaaggcaggaggatcacttgagcccaggagaccagcctgggcaactcagtgagaccccacctcttaaaaaaaaaaaaagccatacggctagctgcagtggctcatgcctgtaagcctaacactttgggaggccgaggcaggcagatcacttaaggtcaggagttcgaaccagcctggccaacatggtgaaaccccatcgctactaaaaatacaagaaaattagccaagtgtggtggcagttgcttgtagtcccagctacttgggaggctgaggcagaattgcttgaacccgggaggcggaagttgtagtaagctgagatggtgtcactgcactccagcctgggtgacagcgagactccgtctcaaaaaaataaataaaataaaataaaaataaaagagagcagctcttgacctgagataggtctatgaagcgcctggggcttgagagtggctgacagcgtttccccagaagcactgggtcagaaccaagcttcatggagctgtctcccccaggccagggcttcagtgggatcacagggattgccaccctcttctctccaatactgcggcccaggtggctggagatcctaaggcttaggggttttaggcattgactcactgggggtcttcacttaggatctgatactcaggtgctagctccacggcagtgacaactaaactcccgggtaacctgccgccccagagcagggggcccagcctcccaaaccaggtgtctgatccactccagcctagcaccacgggggcgctgagttcatctaggcctagttggtcaaatcctttagaatctcacctggtctcacaaggaagccactggaagcctctgagcttcccatccttgctagtgctctgctggctccacctggagccctttggaccaaggcattttacctgccagtgtagttcacttgagatgcgcatggccacaagactgttcgtagtctggctcctccacttaagaggcgtcggaccttacacatcacctgccaacctcccatatcctacccttgtgtccaaagccaggaaagaagaggaggcatctcgctagggttctccccgccacagcgtgaacatatgcacttgccaggctgataggcgagtcggggccccaagaacacccgcatgcagtgagttagacaaaacagctttatttgaaagacgtgggacagccaagttcccccaaccccgcggtcctggcgacgtcggtgtcaggcgtgggaggaccagtgtcctgcggagaaagaacaaggttaggggtctgcagtcggggtcaggagtcaggggccagacctcgcgagcgaccgcacccgggggggaggcggcagcgcctgtcggggcctgggtttcaccgccgcacatggggcagcgcgcggtgagctgaggcccccgggggctctgggcgccgaatctcacccgcggccacggccaaagccgggggcgattttcaaccaacgccggtctcgaagaccaccagcgagacgccagtggtcaacgcggcaggacctacctaagtgaagaggagagcgcaatggaggcgcggacgtttatagccactcttcgggtggattcccgagccgcggctggggacggaggcgccggcgtttatagtcgcttttcgggtgacgtagattcccgggccgcggctggggccggacgggcaagagcactcagagcccggtgaggacggggcaccgcggagccaatcacaggttgtcttataggagctcggcccgctcccgcttggggcggggctgcggagatctcgcggcgcttggcgtgctataaaagctgcttcccagtaggtctcgttcttcttttccgacaaaacacgtgagtcctgttggtcgctgcagcgggcctctgcgtgggcggcgggaatccgcggacatcgggtcgggtctaggctcccgagtccgcgctcctgggcgggagcccttgtctgggtctcgcggggggctgccagatgcgtaggccacactgactagttccttcttgtcgcttttcccagcaaatggcggatgacgccggtgcagcgggggggcccgggggccctggtggccctgggatggggaaccgcggtggcttccgcggaggtttcggcagtggcatccggggccggggtcgcggccgtggacggggccggggccgaggccgcggagctcgcggaggcaaggccgaggataaggaggtaggtatcagccacgctcggggtcgggcccctgggcggcgccggagagcggtcctggtcactggcgccttttctccctttagtggatgcccgtcaccaagttgggccgcttggtcaaggacatgaagatcaagtccctggaggagatctatctcttctccctgcccattaaggtacgcgtcggtcgttggggcgttgagcaagtgcgaccccggagtcatttgggctggggttggaggattagcatctgccattgactcgcattaaagggcccagcgtctcgcgtgagaggttgaggttgtgttgcgggctggctgaggagaggattccacttagaggttggatggatacctgagcgaagccagagccacaaaaggcatttcagcgcatcttcccacattcgcagcgaattcatttccaaagaactgaaagagaagcagcgcttggttcatgccatccgagaggatgatgaagttcaggttgtgggaggacactgtaagggttagcaaactgtcatagtccgcgtgtacgggacagctgtcatctgcatccagcgggtgcagtggggaaaggctaatggcatatttgtcatgtgagcgttcgccctagcaaggtacggtggtcatggctaggccaaagctggacaaagcaaaaggaaatctgagtggaaagccacatctcaccaaacaagagaaaaagggcaaataggaagaaacgattgagatgcagaaatagggtaaccttacatacaagcttccaaaaacgaaacgaaggggacagatcggggggaagccaggtgagggggttcatgacttcttcggttttttttgggcggggtgggcggttacacagtttcgccctatcgcctaggctggcgtgatctcggctcactgcaacctccacctcccaggttcaagcgattctcctgcctcagcctcctgaatagctggggttacaggcgcactccaccatgcccggctaattttttgtgtctttaatagaggtggggtttcaccatgtggccaggctggtatcggactcctgaccttgtgatccgcccacctcagtctcccaaagtgctgggattacaggcttgagccaccgcccccggccgtgactttggttcttgaatatcgtaatggtattaagtttttttttaatgctctccctacaattttcttgtttgtttcaggaatcagagatcattgatttcttcctgggggcctctctcaaggatgaggttttgaagattatgccagtgcagaagcagacccgtgccggccagcgcaccaggttcaaggtacccggctgtcctggagggggctgcgctgggcttgccgggactctctcggctctgcatagttgcacttggcttcacccgtgtgactttcgtaacggggagagagagaaaagatctcctcaggacctcggatgggccttactgtggcctctctttccttgaggggtgcaacaggccctgggcggtgggcagtgattgggtgtagggccaccagctgcctcacacacatcttttcgcaggcatttgttgctatcggggactacaatggccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtaggctggtggcaggtgatgggcctgccgtggggcaggctccctcgggcccccgtctcctgactccttccctcaccaggtgacaggccgctgcggctctgtgctggtacgcctcatccctgcacccaggggcactggcatcgtctccgcacctgtgcctaagaagctgctcatgatggctggtatcgatgactgctacacctcagcccggggctgcactgccaccctgggcaacttcggtaggtggtccacacatggggcatagccatggtctctcagctccgcttaaccacacgggtccagtgtgtgcttggcgtgttttcagggaggcagagaaaggctctcctaatgcacgacagacccgcccagaatggcctctctgttcctaggagtgcgacaatttttgggttgggggacttgcctcaagcacaccactgaccctcctggggttcttttgttttgcagccaaggccacctttgatgccatttctaagacctacagctacctgacccccgacctctggaaggagactgtattcaccaagtctccctatcaggagttcactgaccacctcgtcaagacccacaccagagtctccgtgcagcggactcaggctccagctgtggctacaacatagggtttttatacaagaaaaataaagtgaattaagcgtgttactgtttttttcccgtgtcctgcatggttagtggtggtttgaatctggggcgtggggccaatagatcacaccagacacacaggcaggttgcagggctttatatttcagcaacagtcatacagagccacacagcaggggcacccacagctgcctcaggaggtggcagcggcggcctcttttgcagcttttctctcttgcagcatcctctgcctctgtttggccaggcacttcctggcagaactgtaggcccccaggtcctgatctggggaagcaatggaaacaagctgggaaccgaggcctctgctacatgcaaagggggcaaagtcaagtgagcacaagggaggggagggaagatttgcaatggttctggcccccaggcctcaggaggatggtggggggttgggggtgggtggggcacgcacagcggtcctggtaggccttggccacctgggtgaactgctccacttccttgatacagttctgctggtagttctgtccttccctctgctgacaggctttgagccgatcctgcataatgttgataatttcttggtcgactttgctggtggagaaaaggagcaagagaggctaatcacaaggaatccttttcctgtaccctgtgagaacaattgaaagcaagagccctggggtctggctcctcccatgtcacccctaaaatctgggcatgccaccctgtggcatcccagggactagtgtcccagcagcacacggtgcagatctccacactcccagcatggctcacgtactagtccctcttccactgcatttcggcttcatacatgcacatgatgtcctcctccttgcactcagtgatgtctggcacgcggcggtactgccggtggtagtagtaatacctgttctttgcgtgctgccgctctataaattctgcaaagacaaagccacagactcaaacgcctcatcggtttggacaggcttttagctttcttatttctcataagccctttggaggggagagaggagaacttcctgagtgttccagcgtttagaaaacagcaattcgtctctctaagggatgtggccagccaggcaggcctgtgaaggcctaggctacagctgatggagagctcccgagtaccaggcatcatcctcagagttccacatgcattaccttactctgtcccccacacaagcctacaggcagctgcttctcacagatggcaaggactgggacgcagctctgccagtgcacctcccccagctgcacagggaccctgctgggtgcgcaaagaggctccaacagggagcctccagcaagcagaacttaccaccttacggcctcagcttcctcactgggaaatgaacgagctaaaaggagagctcgaacatccagacacataggacagacatgctctacaactgctacaaaagagagggagctgggtccgctgttgcacggtttccagatctttgggggtttgatttggagacttcaccctcttacggaagaaccaccagagcatgctatgcaccccaagtgttcaaaaagaactgaaccaggctggacacggtggctcaggcctgtaatcccagcacctgggggccaaggtgggaggatcacctgaggtcaggagttcgagaccagcctggccaacatggtgaaaccccgtgtctactaaaaatataaaaattagctgggcgtggtggtggtgcgcctgtaatcctagtactggggaggctgaggcaggagaatcgcttgaacccggggtggggcagaggttgcagtgagccgagatcgcgccactgcactccagcctgggcaacagagtgagactgtctcaggaaaaaaaaaaaacaacaaaaactgaactgggcattttcccggttcgttccagagatggtgaatttgggcatctcggccatcaccccgacacttggtcatctggcagagagacatttgagagaggcctgaggccagcggtgcagtggaggggtgcccggggcggcgggg

SEQ ID NO: 16872 - DNA, 37861 bp, Human
  misc_feature (1)...(37861): n = A,T,C or G
atacaaaaattaggcctggcgccatgactcatgcctgtaatcccagcactttgggaggccaaggcaggcggatcacaaggtcaggagattgagaccatcctggctaacacggtgaaaccccgggtctactaaaaatacaaaaaattagccgggcgtggtggcgggcgcctgtagtcccagctacttgggaggctgaggcaggagaatggcgtgaacccgggaggcggagcttgcagtgagccaagatcacgccattgcactccagcctgggcaacagagcgagactctgtctcaaaaaaaaccaaaaggaaacaaaaaaaagaaaaattagccaggtgtggtggcgggtgcctgtaatctcagctactcgggaggctgaggcagaagaatcatttgaacccaggaggcggaggttgcagtgatccaagatagcgccattgcactacagcttgggtgacaagagtgaaactccgtctcaaaaaaaaaaaaaaaaaagaaggaaaaagaaaaaagaaatgccaaccatggccgggcatggtggctcatacgaagagtcctagcaactcaggaggctgaggaaggaggatcccttgaacccaagaggtcaaggctgcagtgagctatgatcttgtcattgtacttcagcctgggtgacaaagtgagactgtgtctcaaaaataaaaaaataataataataatttaaaaaaaggccgggcaccgtgactcacgcctgtaatctcagcactttgggaggccgaggcgggtggatcacgaggtcaggagatcgagaccatcctggctaacacagtgaaaccccatctgtactaaaaatacaaaaaattagccggccatggtgacgggcgcctgtagtcccggctactcgggaggctgaggcatgaacccgggaggcagtgagccgagattgggccactgcactccaacctgggcgacagagtgagactccgtctcaataataaaaatatcgaccttttaaaaggaagaggatgaggcacaaaatataaagagtttactctagaggctaacgtggaaggatcacttgaggtcagaagtttgagaacagcctgggcaacacactgtgagctccacagcaaaaattagccgggtgtggtggtgcaggcctgtggtccctgttactccagaggctgaggcgggaggatggcttgagtccaggaggtcaaggctgcactgagctgtgaccgcaccaccgcactccagcctgggcgacagaaggagaccctgtctcaaaataaataaataaatgacccagaaggtggggacagggtgggggctgatgtaaagctgtcaagaattctctttggtttatggaaataccattgattagtgatgggctgtgccctggtgcgggtacagggtccgggcggctatttggctaattcacagctatctgcgtagtagccggcagtttccagaggcgaccctcctgtactgtctctggggcctgatcgttgaagaggactcgccttctgttcttttctcattaggcgggaggaccctctggggctgcctggaggaagcctccactccgaccctcgcccgagtgcctactgcgagggcggatgcatgcttcgggacttctaatttcatccttcacgtctttagccgccgcctatggcaaggaagggcctgccctcgcccctgcctccctcctcccttccccaccgcggctccgtcacgatcggcgcgggcgaccgggcctgggggagcccctccagccggctcctgccctcaggccccgggcgcttccctcgccccgactcccgggcccgaggtcccgggggcggccattcgcctcccaagcactcggcgctcagcccaacggggccgcctttgcagtcgcgtgggcagaacggggtcctcagggccgcggcgattctctagggcgggcggcgccacgacccgccgggagcgcggctcccaggagcccccgcgcgaccgggcctcggtggttgccgttgcaggtcacatggtcgccgtcgctcatcacgtggccccgtcgcgcgtcacgtggccgccggcgcgggtcacgagaacaaacacgggggcagccggcgcttcccggccggtgtcgctccgcggcgggccatggccaacgtctctaagaaggtgtcctggtccggccgggaccgggacgacgaggaggcggcgccgctgctgcggaggacggcgcggcccggcggggggacgccgctgctgaacggggctgggcctggggctgcgcgccaggtgaggccgggcagggcgcaggcggggaaactgagccctcgtgcgccccgcagcccgcgccctcgtgagccttctggcggcgccgcgtgtctcggtcctggaggcgaccgaggcgcggtggactcgggaacgcgccccggggctcctcggcggggccgggctggcgggggcgcctggggtctggagtcttcggaggccgcgccgggctcggtggccgggagggctgcgtgggcgaggcggagctcgccagaccccgcggaatgtggggcgctgaggggcgccggggcagccgtggcgcacgttcattccctccggtgtcccccagactggccctaaaggggtgcaagtggctttctgttcaggtgacttttaaaaattgtcatcctacacgagcaactaattttgtttgcgtttttgaccccctgggagatggaaacagttaagattgcagccgggtcactgtctttcagtgagaatgactgagcgcctttatctgccatctttctgtgtggggatcagtcccgactttcaggtgatcttgggagtgacgagtatttgtactcagtctcccttcgcaccgagttgaatttgcaatgtgcaggcaaacacaataagcagcaagtcagaggttggaatgcgttccgcatgtcaccctgcagcgtgcgtctgagcagtgttaaggtctggagaaccgttgcgggtacatttgtttccctgtctgtgtattgtcttaatatttttttttttttgagacggagtttcactgtagttgcccaggctggagtgcaatggcgcgatctcggctcactgcaacccccacctcccgagtttaagtgactctcctgcctcagcctcctgagtagctggaattacaggcgtgcgccaccgcgcccggctaattttgtatttttagtagagacggggttcctccgtgttggtcaggctggcctcgaactcccgacctcacgtgatcccccgcacctcagcctcccaaagtgctgggattacaggcgtgagccactgcgcctggccgtattgtgttacttttgagttaatggaccgttttgttgatgggtcttaatctgctttgcagttattctttacattttctcttgtctagtcctttaaacacttgtcttgtgcttaaagattaggaaggacggcagggcacggtggctcacatctgtaatcccagcactttgggaggccgaggcgggtggatcatgaggtcaggagattgagaccatcctggctaatatggtgaaaccccgtctctactaaaaatacaaaaaattagccaggcgtggtggcgggcgcctgtagtcccagctactcgggaggctgaggcaggagaatcaattgaacccgggaggcggagcttacagtgagcggagatggcgctactgcactccagcctgggcagagcgagactccgtctcaaaaaaaaaaaaaaaaaaaaaaaagtttaggaaggacacgaaaatcagcctgtttccatagaacctacatttaggttttcccaattccttagaaacgcaccagacaaagaaggtcatagtctgccttttgctgataagaagcagcagctcagctccctttgaagtgggccctcctgctctccgtgctgtagtctgcatgaaaagtgatctgaaggggttaatttgaagtgatggggccatgggtgattagttatttgtgtgtatgcctgtgtgtgtatgtgtatgcctctgtgtgtgtgtgtgtgtgtttctgttttaaaagaaaggccaggtgtggtggctcatgcctgtaatcctagcactttgggaggccaaggtaggggaggatcacttgagcccagaagttcaagaccagcctgggcaaaatagtgaaaccctgtctcaaaaaaaaaaaaacaaaattagccaggtgtggtgatatgcatctgtagtcccagctactggctcgggaggctgaggcagaagagtcgcatgagcccaggaggttgaagctgcagtgaggtgcttttttttttttttttccgaggtagtttgtcactcttttgcccaggctggagtttgagaacctatctcaaaaaatttaaaaaaaatttttttaattaaagaaatctgaagttcacaaggtagaaggaataaacccaactttaagggctgaaaggtaaagactaggaaccttgatggaggttgaatttgagtttctcttgggactgaatgtgcttggggtttcctgtctgtctttgcaaatagaagagttgatttttggggaaataatctgttgatctcttaaccttagaaagtattcccggctgtgcacggtggctcatgcctgtaatcccagcactttgggaggccgaggcaggtggatcacctgaggtcaggagttcgagaccagcctggccaacatggtgaaaccccatgtctactaaaaatacaaaaattagccgagtgtggtggtgagcgcctgtgatcctagctagtcaggaggctgaggcaggagaatcgcttgaacccaggaggcagaggttgcactgagccgagatcacgccattgcctgggcaacaagaacaaaactccatctcaaaaaaaaaaataaaaaaactattcccttaaaggtcattgtaagcttatttgtttgtttgcatttaataacagcggataccctgcttacaagcaatttaaaaaatagtttatcgtgcacttgctctgtggctgcctgggacgcaggcgcataaagctgcttccttcctgctggagacaggcccagtgccctgtgcggatggtctgcagggcccctggggcaggagcagtcacaaggcttgggcttgaagagcacaagatcttcaggcaggcggacggggggaaaggacagagggagtgtgtgtttgggatgcgctgtggagcctggaggtcagccctgctgcgcacatgaacaggctttgaatttggctcatctctaggggagcccatgggaagctaggaccccattcctgaagggccccagccttcccctgcagacagactggagaggcggagtctagaggccaagacaccacctcttaggccaggcgtttgtgctctgagcatcggactcgccgatggcctcctgcaaggcctgtagcctccctgttgcccagttttcccgtctgcgaaaaagttaacgcatgcatagcgctgagcacggtgcctgtcacaaactacgctctgaagaaacgtgagtcgtgcccggtcgtgttaaaaccagcaacacaagagggattcgtgttcgttgtgactttcctgtccaacttcctgagtagctactggatttcttggtgctgcttttctgggggagggtctgctctgactggtgggcacagctcacagttaggctcaggcgcaccccagtgtggccacagacggggtactgtaagctgcccttgggttcaaggcctccagagctgttttgagctaaaatatcaacccaggccatcccctgctgacgggactgttccagtgaacatgagaactggtcctagctgcctccaggctctttagggtttgttgcaggattttcaggttggctggtggtgtcgttgccacctcagcgtgggcacagctggccaaacactatgaggtggctgccctgggcagggcagactgtggagtggcttgttggaggctgggtgcccgctgaaagcccaggcccttcagagctgcctgnnnnnnnnnnnnnnnnnnnnttttaccttgtaagtgattggctaattaaaaccataattaataacattttacattcaatagattgaaaaattaaggaatacaacaataccaataaagatgatgtgcctcagtctttcacactgcagataggattttgaactgatagactctgagctcagaaagcaatttggcactatctcttagagttaagaattcacgtacactaaccattctacctctacataaatgccttagagaaattcttggatatgtgtacctcaagagtacacatgtgagaatgcttgtggcagccctgtttttaattactcaaatgtccattgacaacaaaaaacaaattacgggttttgtaattttattcagcagggagaatgacctacatacaacaacccagagtaatcttaaaaatgataaagcaagtctcagaagtctacatacagtatgctacagtttttataaagctataaaagaaacctaaactgtattatgtaggaatatgtatatttgtgataaaactttttcttttaaaggagtcataaaactcaggatagtggcaaggtgtaacacatgaatacataaaacaatattagtgatactttcgttcttgagtaatgggtttcttgatcttcatttcatttacttaatggcactaacataaattttgggtggggttgtctgttactaacaaactaccctcaaacttaattagcttaaaataacaaccatttcacttgcctcaatgctgtgagttgataggaatcagctgggtggttttgcgccacatgatggtgactttagctgcagttatctaggggctggattgggcttgaaacatctgagatactcatgcacatgattggcagttaatggtggctatcagctgggaattcagctgccacatctcagtttatgtggcttctccatgggacttggagttcttccagtcgtggtggctgggcttgctatcatttatggctgggatccaagaagcagcatcccaagtataagcatttcaagaagaggaaagtagaagctaagtccttttggggccttagcttggaaatcccagaacattattttcaccacattgtattggtcaaagtaatctacagggtcagcctagattaaagaaaaaaaaaaaaaacccctttttgatgggaaggggtcatgcatacacgagcaagaaagaaattgatggcagaaatctttggtagttacaatgtaccccctggtcatagtaatttgtgttcctgatggaaaattatttcactacctcctaggaaaccttaaagtctcatctcaatatgacatcaagttcaagctcaagacccagaatctcatgatctaaaccagtttcagtaacatatgaggcacctttactacagtttccctcaatccgaagatgtgtgaaactaaaggcaagttttctttcccatattcacccagcctacgatggtgagtcaggcaatatacactcttgtttaaaaaagaggaaaaatgagaggtacatagcagtgaatggttcatagcaattctgaactccaattgggcacgtctaattccttatgattctgggagcacagaatgtatgtcaattagggcctaattctacctgagagtggttctcaactcttggctcttccctgtaagatcttgactttgctctgagtcattcttttccatgacttttccattagaaaatccatactcatctcttcaagacaggcctgtctctaatttgaactcagaggatgttgaggaacagcacccttaactaccttagatactcattatcgagcaaagtaatctacaaaatgtgctcataagattcttagaagtctttttgtctagctaagaggtctatgaggcactggcttaaatatttctgaaaccttaaaggatattacagatgcaccgttgatcctaaattatcctaattctatggtttactaacaattcttgatttgatctttgccataaggtgatttcttccttgagaacctcttgctggctggaaaagatgttctacacactttaaatattctataaattttgctccaaaactgaacagtttcttagtttatttctctcttctcctgtttgatgataggcagctagaagtagtcaggtggcattttccatgtttgcctggaagtctccttggatagattcacaaatttattaggttatgttttccctttagcaattgccatgagcttattagttctacctttcacgttactgcaaatgaaagtgttgcctttctgttttctcattgatcttctagccaccactgtctgtatttcctgtttaattccaaagttgaggctacgtaagttttgggtttgaccaagtggcaccctatttctagataccagtttctattgcagttatcttttgctccacaacaaacaacctcaaaacttagtggcttaaagcaaccattttgttaactcatgactctttgtatagaaggaacttagctgactcagttgggtggccctgctccacgtgatgctgtgtggggtattcaattatctaaaggctgtgatatccaagacagttcatccacatggttgacagtttatctggttttccttcacgtgacttttccaaagagtttggcttcccacagcatggtgattgaattccaaaagggagtgttccaagattcagtgttcagagatgaaagatgtggaaactgttcatcctctcaaggcctggtcttctcagaagttccagaatgtcactctttgcattctactggtcaaagcaaacacagatccagtccagtttccacaggagaggaaaaagaagcccatatctcattggggaagtggcatatgcttgtagagagagaaagaattgatggcagtcattactggagatttgtaactacacatttttagtatatgtcaaaaaaagaagattgaaaatataatcatacctcagagatattgtgggctgggtcccagacaaccaaaactaagctaatatcataatcaagtcacaatttttttttgttttcccagtgcatataaaattatttttatactgtagtctagtaagtgcacaatagcagtatgtctaaataacaatgtatataccttaatttaaaaatactttgctgctaaaaataaaagtggcaatcctctgacctttcagccataatctttttgaccttcagtcataatcttcataaccttcagtcataatctttttgatggtggaaggtttttgtcttgatgttgatggctgttgactgattagggtggtggttgctgaaggttggggtggccatggcaatttcttgaaagacaatgacatttgccacatcaattgactcttcttttcatgaaagatttttctgtagcaggtgatgccatttgatagcattttacccacagtaaaactttcagaattggagtcagtcccctcaaaccctatggcttctttttcaactaagtttgtgtgacattctgaatcctttgttgtcatttcaacagtgttcacagcatctttgccaggagtaggttctatctccannnnnnnnnnnnnnnnnnnntcttggtgctgcttttctgggggtaggtctgctctgactggtgggcacagctcacagttaggctcaggcgcaccccagtgtggccacagtacggggtactgtaagctgcccttgggttcaaggcctccagagctgttttgagctaaaatatcaacccaggccatcccctgctgacgggactgttccagtgaacatgagaactggtcctagctgcctccaggctctttagggtttgttgcaggattttcaggttggctggtggtgtcgttgccacctcagcgtgggcacagctggccaaacactatgaggtggctgccctgggcagggcagactgtggagtggcttgttggaggctgggtgcccgctgaaagcccaggcccttcagagctgcctgtgggttgctgttcctgttctcaggccggtcttgctttgtgtggtgtagtggtgaattgaccaagccagtcactgctcatctggtggtgttgggacagggcgagggtgaggtcagccagccctggccgtgtgtgggcggcaggaagcagaactccttgagaactgagagggaaagcggctggagccagaaacacttgggtctcagggggcagtgaggggaggtgggtatttgcaggacatccctgggaactcatgttgggacactccacataagaccttggcagggcaggggtctgggttagtgtgggactgtgtcctgcctgggcacccggagccacagaccgcagcctgagaaagaactgtgggcgcagcaaggctgcgggggagggtctggggtcgtcgccagtggccccttgagctctgctgtacttgaggaagtgccccttggttcttttctggcctccaggaagtcctctgccagcctgggagggttcccctgctgtcccctgcccttccctgccctccagcattgctgttcagtgtctgtcttgctttaggtctctgccttaacgccatggggacactgcatggacagcaaaggcctctccttggtctctgtggcctttgtgtgtcaccttgtttcctttgactgtaacccccatccccccgcggggcagctgctgtatcctctgtgcctagcgtctagcctggtcctggcagaggcctgctgaatgttaggacgcaacacaggccgagcagaacagcaaatggtctttaatcctgctttaagttttaaaaaaaactgtggtaaagaacacataccataaatttaccattttgagccaggcatggtggtgcacgcctctcataccagctacttgagaggccaaggcggaaggatcatttgagcccaggacttagagaccagcctgggcaacatagcaagaccttgtttctaaaaaacattttgtttaatgaccgtttaatcatccgtgagtgcagacagtagggttgagcacgctcttagtgttacacaacccattccttgccaaactgaaactgcacccattcaacgctctcccttcctcctgctgcccagccccctcgttgccatctgcctcaggggacctgacggctccagggccctcttgcgagtggacctgcgggagctgtctttttctgactggcttatttcacggggcacagtgtcctccggcccgtcgtgctgcagcacgggtcggtggtcattcctctttatggctgaattattccattgcggggagaggctgcatttccttgactcactcatccatcggcacagcaggtgcttccgcattttggtcattgtgaacggtgctgctgtgaacatggcgtgcaagtgggactttcagacgctgcttttttatgtttgtttttggtttttggttttttgtttatttttgtttttgtttttgacggagtctccctctgtcgcccaggctgaagggcagtggtgtgatctcagcttaccacaacctctgcctattgggttcaagtgattctcctgcctcagcctcctgagtagctgggattacaggcgcccaccaccatgcccggctaatttttgtatttttaggagagttggggtttcgccacattggtcaggctggtcttgaactcctgacctcaagtgatcagcccgcctcagcctcccaaagtgctgggatgacagacgtgagccacctcccctgaccctgagtttttttatgtattctgaatattaatcccttatcagatattaattccttatcacatttgcaaatattttctcgtttcataggttaccttttgctctgttgttttctttgatgtgtagaagttttaaagtttgatgtagttcccctctatacattattttgacttttattttgttttattttatttatttatttgagacagggtcttgctctgttgcccaggctggaatacagtggcaggatctcggctcactgcaacctccacctcccgggttcaagcagttctcctgccttagcctcccgagtagctgggattacaggtgtgcaccaccatgcccggctaatttttttttttttttttcgttttttttaagtagagacggggttgcttcatgttggccaggctggtctcgaactcctgacctcgggtgatctgcccgccttggcctccgaaagcgctgggattacaggcgtgagccactgtgcccagcccttttttgacttttaaatcactctggattcacaggaagctgcaaaggtagcacagggggcttgtgtacccttcaccgagtttccccccaatgtttacctttccgtaacagcgcagccccaaaaccaagagagtgtcgctgcaatgcgtgtagatccgcgtaagcaccaggaagggggtgcaggctattttcagacccatctttctagtcccacccactcccaaccctgatgacctcgcctcccgtccggcccgagtctcgcctctcgggagtgttggctcacgtgttcctgagcctgtctgtttttagttagtgtccggcgcttgggaccgtgtaggttgccgtgtgtggcaggagtttgaggaacagcatctagtgtttaatttataagagcttgcatttaaaaaagaaagtaaccgcacggaatgcattgctgaacttgaagtaaacgtcgtgttcttccattacgaaagccaccttctcaaagtcctggcagagttaaggaaagagatgctgggaaggcaaggcgccggagccccatcctttcactccgggcaggggcagctgatgccctgctggggggcaacccctcacccctcacccctctcggatctgccaaggcggcggcggtgggggtggcccgctggtcacatactgcaccggcagccttcaccttggcctgaatgcatgtgcggctctgcctgctgctgtgggacagtgctgtcgtggtgtagacggtggccctcctcaaggcctcccaggcctggcgcccaggacatgtgactgtggctgttttcgttttgtttgggtttttttttttaattttagagatagggtcttgccgtgttgcccaggctggagcgcagtggtgcaaccatagctcactgtagcctcgacttcccaggctcaagcgatcctcttgcctcagcctcctgagtagtttgggccacaggtacacgccaccatgccttgctgattttgattttttgtagagacagggtctcactacgttgtccaggttggctttgaactcctgggctcaagcgatcctcctgcctgagcctcccaaagtgctgggattacaggcgtgagccaccacgtccggccagaatgatccgttatttccagcaaggaatagcctgagaagcacggcaggccttgagtggcgttagagagaagtgccgacatcttgagtgatggagagggtggccctctgggcagggtgtgtcccacagggtgcctgtttggacgtggggtccttcctcatggtgaaatgggtcttttgggttccgtggtctctgtttggggcatcggggcacctgtccacctgggaggtgggggtcagaggcccagcgctggtcccagggctgttttctggtggtgagacctggagtccaggggctttgatgtgagtgtgagcaagagggagtgggcagctggccaggccactgcttccatcatgcctggaccgtggcaccttcctcctcccaccgtcagcccgtgtggcaggagactcaagctgtgagtttcgcctgtgactgagggctcagggagagccactggcatgtggcaaggctgggggaagaggaggggcaggcgccctgtgactcagggttgtgtccagcaggacctgtgcactctagcccctcccacactctcccctgggcgtggagatgccacggcagacacctgcgagtctgtctgtctgtctgtctggcctctgctcctggcttttgatggggatggcctgagagtgctctttgcctggggagaggaggaggctctgactggtgtctgccaagggccagtggcacgtgcccaggttccttcccctgccagggccacttaccgggtcatcaacacggggggtgtacagcaagggcgacggtggctggtaacaggacgatggttggggaaggggtccctggagggcagtgggctggaaggtcaggttctttttttttttttttttttttttttttttttgagacagagtcttgctgttacctaggctggagtgcagtggtgcgatctcagctcactgcagactccacctcccggcttcaagcgattctcccgccttagcctcccaagtagcccgcctactttttgtatttttagtagagatggggtttcgccatgttggcccagctggtctcgaactcctggcctcaagtgatttgcccgcctcagcctccgaaagtgctgggattacaggcatgagccactgtaccccgccgggaaggtctggttctgaaggcagtttctgggatggcggtttggggagcccgtctccttcaggggtgagcactccagagaaagcaggacccccacccctggctcgcagtgacctcagatcccaaaccttccttctctgcttctgtgtccttgcctgtgtgtggtaatcgtgatccccgtggataggtggaggttgagggaaaactgggccccagtgcaggccgttcctgcacgtctccccgtccccacctcggccctgtgggctcctggcgccatcacctgccgttctatcaccaagaagcacttccaggccctgctgaaacctggtgcgggaggccgagcctgaggaaggtggagggagagatggggggatgaggaggggacggcgttgggggccgggagggctgctcccagggaaggcgggcggcagcctcgttggtcttcccacggccggtaccagccgctggactcctccgccaacactttcctgacaggcgcacgggctctctgatgcagatggcgggcgccctgcgcatgcggtccctccacctggaaggcagcccttcttcccttcatgtccccagatgttgctaaagattcaggagatagtggaaattggagtcgtctccaaaggatctctttggggaaaggaggctgaggtcttggctcctcctagcctggcctcagcgccttggctctagtaaggagccggagactggggtgggagctccgtaagtcacatctgcaccacgccacccagggcccgctgccctgcccctgccctgagctggggcggccgcaaagccttaggtggctgagaccccacccagctctgcctgacagctgggcgtcctgtggggagggcagcgtgaacactgtggagccgtttgtgtctcaagacccagagaggctgcagtggaggtgactctgtggaggtggcaggtggctgagcagggcctcgggagcagggttgggcaggatggcccagggtgctgtggcgggcactgcattgggggcggcgtgttgtccagcccttctttcctggtgggtggcaggtgcctcgctttcagtctagagcagggagcttgcgccctggactcgggctggacgtgtcgctgacaggccgaggggcagccggatcagttctgcttccagggcccagggaggcctgtcccagccctgctgcccccacccagcaggcaggcctggcctagcccattcctgagctcccgggcagggtcaggcgaggccagggtgcggcggcgggagtgagaatccacggagcagagcgtgcgacgcctgagcgccctcatgatttctcttctgcttttagtcaccacgttctgcgcttttccgagtcggacatatgagcagcgtggagctggatgatgaacttttggacccggtgagttgggggtgttccccgtcctcccgcagagctagctgcatcttagcagagggtgacagggatgggcacgggccgagcggcagggagatagtggggccccagagccggggttcagggaagatttccttggggggacatggtccctgacgccaagtgagcagaggcagctgggcagaagtgctctcagacggaggagtgcagggcgcaggaagccggtcaggacagcagtgacagcatgggcagcgagggggctggacctggctttgggacagggcaaggacagggatcttgggggggcagtgaggagccccaggagagtgagagggggccggatgcctctgacttcagagggcaggggtttagatgttcccgtgccagtggctgccctgggagtcctgagctcagcggcagcgtgctcgtcttccttcccctcgggggcatctcccgccggcctcggtttttcccccagccgctggtgaggccgggagtcctctgctgccgctggccgttcactcatcgtctctgggtagatgtctgtgcgggactcctgttgagatgatcctgatgttggcaacaccccgggcgtcctccttctccccatcaggccccacccggctctgccctgggccacgtcagaggctgaggcatctcacagtccacctgtccgggtgctcttcggccttgcgtccgtttgagctctgccgcagtcgctcccgaggccggcgccgtgctcagatgccgtcctgtacagccagcagcgcctcttccggggctgcccttctgatacgtttgtgctgcctctggagccacaaggccttcggaagatctgtttcgtggccgtgggcgccttcggcactgcctttttggacttcaaagcctttgctctggtgtcagctttgggaggggcaggagttgggagagaagggaaaaagccagcacgtgagattcagcaatcagtcctctcctgtctcaaccctggagcgggtgcctggccggccacacgcgtgttggttatgctcatttttaaactgggtttgttgtctttataattgagctgcaggagttctttatacatagatgcaaatctctcatccaatacatgatttatagaagttttctcccgttcagtgggttttctgttcactttctcagtggtgtcttttgttgctcaaatttatttaattaaaaaagttttggccaagggaggtgattcgtgcctgtaatcctagtactttgggaagcagatggattcattgagctcaggagttcaagatcagcctgatcaacatggtgaaaccctgtctctacaaaaaatataaatattagctgggcctggtgataggcaccagtagtcccagctacttgggaggctgaggttggaggatcacttgagcccaggaggtggaggtttcagtgagctgagatggtgccactgcacttcagcctgggtgacagagtgagatcctgcctcaaattttttttttttttttctgggcaggtgtggtggttcacacctgtaatcccaacactttgggaaaccaaggctgcagcccaggatttggagatcagcctagacaacacagtgagaccctgtctctacaaaaaacaaaaacaaaaacgaaaattagccaggtgtggtggtgtgcgcctgtggtcccagctactcaggacgctgaggcaggtggattgatcgaacccaggaggttgaggctgcagtgagccatgatcacaccattgtacttcagcctgcgtgacagacgggaccctgtctaaaaaaattaattattactattctttgagatgaggtctcactgtgtggcccaggctgaactccatctctcaggctcaagcaatcctcccgtttcagcttcctcctgaggagctgggaccacaggtgcatcacaccccgcacaggttgtattgctgaggttcagctaatctgttttttcttgtgttgcttgtacttttggtgtcaaatctaagaaaccattgcctcacccaagagtatgacgactgacccgttttttcctaagaattttacagttttaggtctttcatcccttttgagttaatttttggatgtggtgtgaggtaagggtccaacgtcataccctccctctctctctctctttttttgagacagggtctcactgtcacccaggctggagtgcagtggtgcaatcatggttcactgcagcctctgcctcctgtctgtctcccaagtagctgggactcaggcgcatgtcaccatactcagctaatattttgtagagatggagtcttactatgttgcccaggctgatcacaaactcctggcctcaagcagtccttctgcctctgcctcccagagtgctgggattatagctgtcagccattgcgcccggcccagcttcatttttgcatgtggaaatccagttgtaccagcaccatttgttgaaaacactacctttctctgttgaaatgttttgacactgttgtgggaaatcaattgatcgtacatgttttggatttctttctggactctctcaattctcttccattcttttgtggccatcttcatgccagtaccatgcctggttttttttttttttttttttttggcttttttttaagagttggggtctcactgtgttgcccaggctgggtggatcacttgaggccaagagtttgagaccagcctggccaacatggtgaaaccccgtctctactaaagatacaaaaattagccaggcgtggtggtgcacacctgtaatcccagctacttgggaggctgaggcaggagaatggctttaacctggaaggcggaggttgcagtgagttgagatcgcgtcactgcactctagcctgggcaaaaagagtgactgtatctcaaaaaaaaaaaaaaaaaaaaaaaaaaaaagacagatgagggttttactctgttgcccaggctggtcttgaactcctggcttcagttgatcctcttgcctctgcctcccagagtgctgggattacaggtgtgagccaccgcacccggcctcatggattgatttttggatgttaaactaacttgtattcctaggctgaattcaccttgctcctggcattgctggaatcactttgcttgtgtcttaccaaagatctttgcatccgtggttgtaggggtgttggtctgtagttctctttttttttttttctttgagacggagtcttgctctgtcacccaggctggagtgcaacggcgcaatctcggctcactgcaacctctgcatcccgggttcaagcgattctcctgcctcagcctcctgagtagctgggattacaggcgcccaccaccacgcccagctaatttttgtatttttagtagcgacagggtttcatcttgttgtccaggctggtctcgaactcctgaccgcagctggtccacttgcctcggcctcccaaagtgctgggattgtaggtgtcagccaccgcaccccatgtgcagttctcttgctgtgtccttgtccttggtgtcgggatgataacggcctcgtgtgtgagctgagaggggcctctctccttgtggccttgtcaactgtgcttctctctttgcctttttctgccacaggatatggaccctccacatcccttccccaaggagatcccacacaacgagaagctcctgtccctcaagtatgaggtgggcgtccttctgtccccctgaccctgagacccggcctctgccccctgcaagcccactcccggtcccctgtgcccgcacccagagcgtgggttcggtgctgagtgctgcccttgctgtcccggcctgcagagcttggactatgacaacagtgagaaccagctgttcctggaggaggagcggcggatcaatcacacggtgagctggacgccgctccctgcagggccccacggtgcggggcctggtgccggccgggcctggggctgctcttctgccggggtgaggtgacgcacctcctccctcctcctctgactccgcctctgaggcctgtggttcgtctggtttctagagacagtgggagggtcacggtcaccgtaaccaagaaggctgctcttacggccgccagatgcggtgcccagcataacaaccgctggctgtgaagttgttgggaattcacccacctccccgagtcaccctcgggccccgggtgcgcctcagatgttggccagaaactgtcctttgtgggactcagcgcaccgtgcacactgggcccttcataatcccggggcctgcaggcggtctgggcggtcctgctgctgccagagtgactgcgccagggccctgcctgaccctcgccctgaccgcgccctgcaggccttccggacggtggagatcaagcgctgggtcatctgcgccctcattgggatcctcacgggcctcgtggcctgcttcattgacatcgtggtggaaaacctggctggcctcaagtacagggtcatcaagggcagtatccttcccagtgcggccgctgcagcttgggaggggggcgtggcctgggccgagtcccgggcagaagtcctgagcccagcgtgttccagtgcaggtggaggcggcccggccaggctggctgtgtccctgtcatggttgggccgtgagacgtctctgggatgtccagtgaacatcatggctccacccagcagggtggcatctgccaggctggtctgtggggcagggctgaggtctgggctgggtggtcctgacggggaagcagccagccctccttgatgagccccagatatcgacaagttcacagagaagggcggactgtccttctccctgttgctgtgggccacgctgaacgccgccttcgtgctcgtgggctctgtgattgtggctttcatagaggtgggtggcaggatgccgcagctatggcggaccccatgaaggattgggggtcttggtgaatgggcgggaacccctgcagctcacccacccccaccatcacattggctgacaacccgggcacttttagaatcacgcggtccagactcacaacctcaggaggagcagacacaccagggcctcttcacccccagagccctggggtgctgctcctgacctaccagcacaggcctgggcaccctcaccccactccgcccctccttccatctcctcactctgccctcccctccttccatctccacctccgcctccaccacgtccttgatctgtgtctgggctgggaagagtgagagcagctaccccaacgacatgagacccttccctggggccccaacgtgtgtgctgctcttcccttccctgaggccccgacgtgtgtgctgagctccccttccctggggccccgaagtgtgtgctgctctccccttccctgaggccccgacgtgtgtgctgctctccccttccctgaggccccgacatgtgtgctgagctccccttccctggggccccgacgtgtgtgctgagctccccttccctgaggccccgacgtgtgtgctgctctccccttccctgatgccccgacgtgtgtgctgagctccccttccctggggccccgacgtgtgtgctgctctccccttccctggggccccgacgtgtgtgctgctcttcccttccctggggccccgacatttgtgtgctgagctccccttccctgaggccccgacgtgtctgctgctctccccttccctgaggccccgacgtgtctgctgctctcctcagctcctggggctcctggggctgaggggctgcatctgtctcagcctggccgtgacccactcagccgtgcttcccctctttcagccggtggctgctggcagcggaatcccccagatcaagtgcttcctcaacggggtgaagatcccccacgtggtgcggctcaaggtgagggtgcggtggccctggctgggcagggtgggcgcccgctctttgctggttcaggagcagctctcttggctgcctgccttccagaactggcctcagccaccctgtgtactggtggcactgtgtgcagatgggctggctgggtgtgaaggggtcacctttttttctgaaagtggtaacaactggtatttgcacatattaaattacgtaagaaatgagtagtcatacagaaatgcttgcgtggtgcatgtgtgacacagctgtgcgacgcgtctgtgactgtgggctgcgtggtggtgactgattcaccgtggaagctgtcgtggtagtgggcgtgtagcagtttcccgctttcagtttgcctcatggtcatttacacttggtgttatcagagcatctggttctggaggtgctgggagtcctgacccagttccgctgtggttgcttctgtctgtgccgccatcgttccttagcctgagacttgccgcagccccgtcccgtctgaggatgggtgggcagcatggccgctgccccctgggggtgcttccggggcctggtccctgtggccaaggagcgggaccagtgtgtcccctctggcgaaagctcccaggtgaccttggggtgcccctgccctgtggtgggagatcaggtttactggagcagctgggaatggcgacccgcctgtcacccgcgccaggctggcctgaaccttcttggatgttgctctataacttttgttggctgagggttgagtttgctcggcatctttaacatacagtcctcccccacacactcagcgcccttgtgtttagggtctgcgcccttgtgggttctgccctggggcagggaggctgataaacaccttacacaccttctcaggtggagaggatgaggcccctgggggcggggagcagccgaagggagagggggcatcgtggagccgcaggtgaccagccttccagtgccaggggtgtatgaggagccttgctaggcggggctagcgggaacacctcccctgtgctggccacgctggcggaggcaggttgtgcctgtaggatgcggtgggcggcccagctttgcctcaggaaggaaggaaacgaaagaaccccttgcctgctcagtgctgaggccacagagggcaggtcccccgagtgagtgcgggggacgcttggctgctgtttagctccactgtggccatggggagacccagcctgggggtgctggccccctcccggaggccccgtgtcccagccactctgcctgatgagggctgtgtgtgctgttttacggctcaggtccaaagacagcgcctgccttttcatcagaggccgtgcgtctccctgtgtttcagacgttggtgatcaaagtgtccggtgtgatcctgtccgtggtcgggggcctggccgtgggaaaggtaacaaagtgcacatggccactccagctggagcctgaggccgccgggcccgcgagggccgccacgcccatgtgtgtctctgagcaccggtccttctggtctccaggaagggccgcgtcacgcgtgtctctgagcaccggtccttctggtctccaggaagggccgcgtcacgcgtgtctctgagcaccggtccttctggtctccaggaagggccgcgtcacgcgtgtctctgagcatcggtccttctggtctccaggaagggccgcgtcacgcgtgtctctgagcatcggtccttctggtctccaggaagggccgcgtcacgcgtgtctctgagcaccggtccttctggtctccaggaagggccgatgatccactcaggttcagtgattgccgccgggatctctcagggaaggtcaacgtcactgaaacgagatttcaaggtgagttgaaatcttgcgtgggtgggctccagatgccatgggcacgggcacgggcaccactcagggagatgggcttccctcagcacccccaggccgagagccccagccccatctgaggacagcctggcgggtggctcccagagccagcgggcacagtccctgcccggcaaggcctccctacggcccgctgcttccctccttgggtcccctgccacacgtgcatcagtgtttcccgtgggagggtctgtggctccaagcggcttctcagaggagtgcagaacctgagaccaagtgtgcccacctgttgtttatttgtcaagacacactttggaacactttttccccaaaaaagtccccagcatgttgatggggattgagctgcatttgtgtgtgattgtattttttttttttttttgagatggagtctctctgttgcccaggctggagtgcagtggtacaatctcagctcactgcagcctccacctcccaggttcaagcaattctcctgcctcagcatcccgagtagctgggattataggtgcccgccaccacgcctggctaagttttttgtatttttagtagagatggggttttgccatgttggccgggctggtctcaaactcccgacctcaggtgatccgcctgcctcggcctcccaaagtgctgggatgacaggcgtgaggcaccgcgccggccatgtgtgaatttagaggcaggcagcgtcccgcaggacaaagaacagcaaggctgggtttccatccgtgcgcttttcgttagagggtagaggtttttggaatcttgcgtgcgctggaaagtggagctcctggctgggtgtttgcgtgtttccctgggctgccggtggtggtgctgaccctgctgtctcttgccgtggtctgcagcacggtgctcttcaggaatcagagctgctgactcggttgtcctgaaagccccttcccctgcacagcccctgtcctggcagttgctctccctttctgagagccgtgccctcaaggaacctgccccgaccctggtctgtccctgttgcagatcttcgagtacttccgcagagacacagagaagcgggacttcgtctccgcaggggctgcggccggagtgtcagcggcgtttggagcccccgtgggtgaggagggccgcaccgggtccaatgctttgccctcgccctgtgtgttggaaggaacggtctcctctctgtaggcccagtgcccgctgagggtggcagaggcttggagtcacggccggggcatttggaagcggccggcagtgtacttgggtccagccctcagacctccctcagggtccctctctgtgtggctggggcccaccccattagcttctttctgacgtggtctgggttccctggagcctgggggagggagttggtggtgggcatggtgccctgtgtccagctggcacccgagccggccgcctgccttccaggtggggtcctgttcagcttggaggagggtgcgtccttctggaaccagttcctgacctggaggatcgtaagttcctgctgatggctgcctcctgatcagggtgcatgctgcgctctcatttcccaccatggggtccaccttggggccacccatcgagctgcggctggagctggaccccctgtgggtctgtcaggccttggtcctgcccaaagcagcggtcctgcctttgctgcccagtttgcccttggtcctgggcaccattgccagccctgggtggctcccgggtaggggatcaaacagccgggaacccagccctgccccaccttcccctcttgctctccactggcaagtccagagagggctgggcccctccttgcccgcacagtgcgcccacccctggctccagccccttcccttctgccttgggcggggtctgcagactcctggccccggggctgacaggaggggcgatggtccctgctggtccgtgagccctgggctgggagcgtggctctgagggcgctggtttcctgccctctgccgcagttctttgcttccatgatctccacgttcaccctgaattttgttctgagcatttaccacgggaacatgtgggacctgtccagcccaggcctcatcaacttcggaaggtttgactcggaggtaacctgccccatcgcccacctcgcccacctcgtatcctggtccaggaccctgtttgcttaaggcccaggttgagaatttggtcctttagaaaactctggttgatagctgtggagctgagagctcttgtgtaagctccagggccccgaggggctgcaggaagacaccccaagctgcccctcaggtcagggcaccatgtgaccagcagggcacctgggatgtcacacagttgctgcgtgcatggggcctcccacggcctgggggcacgtgcagcagccgctctcggggcaggtgggctcaggcctagtttccagggtagcctggggcctgggctggggagactctccgtgccatcgatagggcggctctgtgcgcaggaaactgggggaccacgggctatgttcccagtgcttggggccctccccgccccgggtgctgagggtggcagggtctctgagagcctcgctggccaccccgccaggcaggggccaggcctgctcagaacacccagtgtgtttctcccctgtggacttccgcagcctgcgtggaagggcgggaaggctctctgtggggacagctctcttaagatggtggtccttgagtttcagcagaaaggagctgtgggccttttccctcacatcctctgccttctccctctctctgcacagaaaatggcctacacgatccacgagatcccggtcttcatcgccatgggcgtggtgggtaagggcttctcccagcaccgcagggacggcctgcgggcctggctcagctgtgacgtggccatagagacgaggactggaggctgtggctccctggagcctgccctcatcccagggccacccgggggcctccagattcttccatgggcagtacacgtggggagtggggagcccaaagcttcgcttctgtggcttcctgttgtttatctctgttggcaaaaaccacagggctgcagggatggatgggatttcctgtaagagatagaattgctcccaccagtatttattgctctgctggacacctttgccctggaaggaaggcagagcctttgagaaacagctcccccagccctcagggtgtgatgatgtggaggaagcatcttaccaggaccccccagccccctgccgtccccttccctctgcaaaccctccagcttctcctgccatctgggagccggcgggcggaggcccgcacttttcctccggtgtcgctgactggcctttcccctgttcgcaggcggtgtgcttggagcagtgttcaatgccttgaactactggctgaccatgtttcgaatcaggtgaggagaaaccgcattgcatatcgcgttggcaggcgtggccacacaggccctttgaaagcggacgtggtggaatggggtttacactcctaggccacagccgaaagaaaggctgtgtatgcagcgtccttcctgatggtttccccggtggagctggtcagagatgtgtcccggggcctggagggtgacggactagcccaaggctaggagtgcgagggctcctggaggacggcccctgggtaggaagtgaggccctgcgtgggatcgggcctgggcgaggcatgcccaaccttcaccgcctggctctgcctggtagcaaccgcagctgtcctgggacaccggggccccccggcttcttccttcttggtctgtgctgatttcaatactgtcgggtacagccggggcacgggtagcgccacttcccacacatctggagaagttgctgccgaggagtctttaccccagggaagaggacgaccccaggacatttgggtgcctgattgatgattaaacacaggcctggccgggcgcggtgcctcacgactataatcccagcactttgggaggccgaggcgggtggatcacctgaggtcgggagttctagaccagcttgaccaacatggagaaaccccgtctctactaaaaaattcaaaaaaaaattagccagatgtagagccgggcgcctgtaatcccagctactcgggaggctgaggcaagacaattgcttgaacctgggaggtggaggttgcagtgagccaagatcgcagcactgcactccagcctgggcaacaagagcaaaactccgtctcaaaaacaaaaacaaacaaacaaaaagcaccacgggcccagtgtcctccatcagggactcgagttgccatggggcctgcggaggggccgcgctgccgtcctgcctgccatgcagcctgattcttggttccaggtacatccaccggccctgcctgcaggtgattgaggccgtgctggtggccgccgtcacggccacagttgccttcgtgctgatctactcgtcgcgggattgccagcccctgcaggggggctccatgtcctacccgctgcaggtgggaggctgggcccgggcggggtccagcaggcagggcagccacagggcggcctccaggaggctcgcttaggctacgggaggagggctgcccaccccgccgagttccagaagcgcatgggctggcgtgtctcaaagagggttagtcctgtccacccagatctcagaggaggccaggtgtctgctgaggtgccaggggaatgggcggtggtatgggggccagaggctccccccagtcctcttcccagaatggcagcctgacggggcgagcctcaggcgccctatgggggcaccatagatgtggacccaggagaaatgcaaacctccgtccacaactggacctgtgcctggcgctcacggctcaccgccgtccgtgcgtccatctgcactgtgacacggttgccctggaaagcactacgctcagaggaaccacacgtgaggtcacgcgacgtagccccattaacatgaaacatccagaacagggagagcctagaggcccagcagaccagtgggtgccacggcgggagtgggcaggatgggacgggtcaggtgtgaaccgttagagacgtgggaggcccggggccatggggttgaccagccttgctacactctgctccagccccgtggataacaccccctgtgctgctggagcccaggaggctctgggcctgtggcaccggggcgccaacagcctcttctaggagctcatgtgagcgcctgggcccaccttccccggcaccagggatggacagcgtctcagcccatggtcctgctaacccaccccccagggctagacacggccccctgctgggcctaggccgtgtgtgtcctcctttccctccgtgaccatggcttgggccttgtgtgtcctccttgccctctgtgaccgtggccctgacccaatggcaggatcgtgtggtttcgcgcctgatgctggccaggcacagggtacacggcctctcacggcgacaccaggtttgtgcctgcagcccaccagctcatctcccctcccaacgtgtgctctctcccgaccccacagctcttttgtgcagatggcgagtacaactccatggctgcggccttcttcaacaccccggagaagagcgtggtgagcctcttccacgacccgccaggtgtgtgtgggcagtgccgctgggcaggccctgggatcagggcctgggtgatgccttctggctgagtgtcccctgtgggctgaggttgcagccctgggctggggggtcatccctagcatggatcatagcagggactcactcctgtaatcccagcacttggagagaccaaggcaggaggatcacttgagcctaggaggttaagaccagcctgggcaacttagcgagactctgtctttgcaaaaaagcaacattatctggctacggtagtacacccacagtcccaggtacttgggaggctgggccgggaggattgcttgagcccagaaggttgaggccacaatgagctgtgattacatcactgcataccagcctgggtgacacagcgagaccctctctcaaaaaacaaaagaaaacccagcctggtgactcccacaccaagaccacggcctggcctcgctcgaccacaagtgtttcacggaagcgcagaccgcgaccttggagtgccggcctttcacctctgcagttgtgtccctggcggtctcacccgccctgcacgcagtacagtgctgcctgctccaggaaaggaaccccaggctgtggggggcaccctcttcccggagccaggctgcgagctgcaccacggtgcacacccatggagtgtagacctggcgctgctagacccagctgggccgccccgctggacgcggctcctgcttctgctggcatcagggccccgcagagcctcttcccctgtggcctccccatgggatccttttagcctttctgcttcccagggaggctgagaacagggagccttctggggaccgctgggctcgggagctcaggttgctgggctcctggaaggtgactgtgaggcccgagactgggcagcggggcagggcagtcctgcggaggcgggagtcgtggaggccccgtcagcccctcttctctcctaggctcctacaaccccctgaccctcggcctgttcacgctggtctacttcttcctggcctgctggacctacgggctcacggtgtctgccggggtcttcatcccgtccctgctcatcggggctgcctggggccggctctttgggatctccctgtcctacctcacgggggcggcggtgagtggggccggaggggaggctgtggggccctgcagctgagccaggtcttgcggcatcgcgggccggagcagaagtcccagggcaggacaaaagtgtcgcacctcacgtggttcacgggccgtgggcgttgtcctcgcgtggttcacgggccgtgggcgttgtcctcgcgtggttcacgggccgtgggcgttgtcctgctgtggtggcagcgtgtactgtggcagcgcagcccatgtgtggagtctggaccaggcgaaggtagggggcggaggctcgtgtccttattcttgagaatgtgatgaaaagcagaggtgattgtgggctgctgcagagctgtttctagactccatggggtggatgtccggccagggctgctctctgtgaggccgggggccagagcggcatacactgccctccagacctcagcccccgcaggccttccttctctgcctgcctctgctgggactgggttctcttatgtgtcttctgtttctcatttcagtcgcttaaataagactgaaaacctgtaagaggccctggcaggaagcccccggccatgcttctcatccccggcaggaagcgcccactcctgctccccaggcccgtgtgctctgcccatctccctccgcacaagggtttggtttggtttttaaaattgaaacatgattcaaataccgtaaaactcatcgttttaaagagggcagttcagcggcgtttctcacgttcacgaggcagtgcggccgtcactaccacttctagaatgttccgtcatcccagaatggaaaccctgtgcccaccgaccctcgtgccccgctttctgcagcctccatgcctgggttctgtggcccagcctgatgttcccggggctctctgtgtcgtgtgtgccggggtttcactcctcatgctggacggtgctccctagttggcctgggctgctgcgtggtgactgtgccctctgcatcctccatgcctgccactcccctgttgctcgggtgctgagcgcctggttcaggccaaggatgcagcctccgcagcagggtgtactgtgctaggttgttctgtgtgtatgtacgcggccacgaggtttgttcctggctgtggggctgctgggcctgggcagggcctcctccgtctgtgtatcttggtgggtttgggcctgccaccacactgacacctcctccgtgtcacctcccacagatctgggcggaccccggcaaatacgccctgatgggagctgctgcccagctgggtatgtcccagctcttgcccgatgggtggggagctccacggggtctggagggggccatggctgtccttgcggggctagggtctgggagcaggtggatgggatgggtgctgcagagaaggcagtggccacgtgaccctgagccaggagggtggacgtgctggggttcatgatggctcccgcaggcgggattgtgcggatgacactgagcctgaccgtcatcatgatggaggccaccagcaacgtgacctacggcttccccatcatgctggtgctcatgaccgccaagatcgtgggcgacgtcttcattgaggtgcgccagggcctcgaagcctcaccctgagagcgtgggtgctgccataggggaggggcccctgtgagcctccaaacagccggtcccggggggtaggctcagggtttctgggggcggcctctgggctcccaggggtaggctcggggctccaggggtgggtgtggactcctcaagccctgtgttcccgccccgcccgcagggcctgtacgacatgcacattcagctgcagagtgtgcccttcctgcactgggaggccccggtcacctcacactcactcactgccaggtacagcgcccaggacacctgtgggtggggagggtgtccagcggcctcttgttgcacaggggcagggtgcacggcttgcgggctccaggcagccccgcgtttcctgtccagcggcttcacacctcaccagcccgcagaggtaactgtgggagttggtggcgtgtgacgggcatgtgtggccgggctcctccggcagggaggtgatgagcacaccagtgacctgcctgaggcggcgtgagaaggtcggcgtcattgtggacgtgctgagcgacacggcgtccaatcacaacggcttccccgtggtggagcatgccgatgacacccaggtaccgggcaccccatagacagggtcctgcctatgtgacctctgtcgagtccattggtgggaagcacacggcaaggtttgcaggatggggaagctgcacgtttgggtgcactggcagttccaggagtgccggaagctgagtgtgcagccatggagggctgtgtggacgctgaggctggtggggggggctgcggcctggcagggtcttggggttggcacccaggctgggctgagagccgtggcactgggggccgtgactttgtcaggaggccctgacaggacacacagctcggccactgctgtgtgtcttttagacgtggacactgggtgtttggaggttggtttttattgggacccagtggggctgcatctgccctgcagcaaagccaccatccctgggcccttggctctctgctgtgcgcggtcaggccccgctaccctgtcgccgatccttgggtcccgtggcattgtgcgtgtgggatgccatggcgaggctggtgtgagcaggtagccaccgacacggggcccatgcccagatgggaaatctggccggaacagggtcagagcggggcccgacacagcattccagcgcagcctcccaccctcgggcccgtggccctgaccgcgggcctgtcttgcagcctgcccggctccagggcctgatcctgcgctcccagctcatcgttctcctaaagcacaaggtgcgtgccaggctccgggccattgggcgggtgggggccccgggggtgctgcctgggtgcctgacacagggctctgccgcccgcaggtgtttgtggagcggtccaacctgggcctggtacagcggcgcctgaggctgaaggacttccgagacgcctacccgcgcttcccacccatccagtccatccacgtgtcccaggacgagcgggagtgcaccatggacctctccgagttcatgaacccctccccctacacggtgccccaggcatgtgcagggcatgggcatgggcgtggggcctgggactgaacagcagggggtggggtccagagcctcggggaggggcagccggggggggccacagcggagaggactcggtgactctgtctcctgtgaagggcctggcaggctttagagctgaagtcaaggggctgagggggctggccagacgggcgtgggggctcaggacgtgcctggacgccgtggtggggggtgcagggagccagcttgggtgagggtcccgcctgcctctgctgtgtgggcgggcactgacagctgtgcccctgctgcaggaggcgtcgctcccacgggtgttcaagctgttccgggccctgggcctgcggcacctggtggtggtggacaaccgcaatcaggtgagcgggggcggtgggggtgcaggcatgccgtgcagggctcccctctgcctcctgcccgtgcttactctcagctcccggcaggggacacggaagcacaggacccagcaccgagtcggcccatgccccatggctgcacccctccccagccccgtgctcagctcgggggctgtgctgaagcccccagggccccctgcctgtgctgccccagccacacacaaggcagggagctccacaggcaggcgggagccgacccgtgtgtcactgtggcctggacttgtcctgcaggttgtcgggttggtgaccaggaaggacctcgccaggtaccgcctgggaaagagaggcttggaggagctctcgctggcccagacgtgaggcccagccctgcccatagtgggcactggcgctggcaccccggcccttctgcatttcctcccggagtcactggtttctcggcccaaaccatgctccccagcagtggcaatggcgagcaccctgcagctgggcgggcaggcggcaggcgcggaactgaccctctcgcgggactgaccctgttgtgggcagtggtctccccccttggcgcctccttgcgcaggcccagcctccactctcctcgtctaggtttctttacctccagggatcagctgtgtgtgtgtgacctccctaccgggctatcggcctcttgggagccagcggcagggccggcacctgcgtgcctgtgcccgtgtgcgtgagacagagcccttgcccctgctgctgccccgagggctgccctgccctggaagggcccctctgcctccacaccagtggagtcttcgagacttgggagctgcttggcctcattttcagccatgagcagacggcctgtggtccctgggcctgaggcacggactcgtagcaccagggtttggaggctgcgaccgccccggagagcagcttcacactggcgccacagaggagccccacgtgcactccccggcctgcatccggcttgggtacacaggcccagaggactggggtgactcacgggccctgtgctgtgatgttgagagctgagaaaaacctccaaggccctgagccccatgcccagccctgccttggtcccccaacccccagagcttggagtctgggccccacacccagccctgccttggtccctgagcctcagagcgtggaattgctgccctgtggacactggctgggaaggcaggtcttcccctagcacatggggaccccggcctcgagggtgacctccctaccccgcccctgccagccaccaagcgcaggtgcagcgggggccagactcctgccggcctcagaggacacctggcccagcacaggcagctagaagggccggtgggcaccggggccgggaagcccccacctcaccacctgagggcccctgggaggctcctctggcctggctgggctgggtctggggccgccacaggcccctcacggggcggcagaggcaacttcagtgtccctgttagagcaacacgggtccctccgtggggggctgggtgcggccccctgccgtgtatttcctccccagggagtggggcctccccgggagctgacgccaccaccctgcttagccctcacagggccccaaggtgtccgagtgtgttgggtctgaacgcgaaataaagaaatcctctcagcccgcctttgccagcgtcgtccctcccaccccacccagaccacgtccaacagcctgggactttcgggaccctggggtcggggcaccgtgtggagtgagacaggcgtgaaagacagcggctgcggccacccagggcaccagccacatcctcttcctcgtccccgcccctcagcctccctcctctggctcctggctggtgggtctggggggcaaggcagaggcgctccaggtggaggggggcgggccggggtgcccacgctggggtgacgcaagaagaaaactcccgggcctcagagtcggcgccggaaacctaggtctgggtttccctcgtggtggttctgtactgaggacctggaagtgatcatattttggatatattcggttaaataaaatcagcggttaggattcacatcgctgcttcttgccttttaatggggctgctgagcaagatgggttcccgtggagcccggctgtgcccctcaccccgatggcgctgcccaggcctcgggctccgctcggacgtgggcctggctgtgtccggggtgtcctggggctctcggcctccctgctcccagcgtccctcccggcgtgcccaggcctcgtcagggcctccttcccctccctcggcagctgaagaagtcccctttgccagaggacacgtgtctgcgccctctcgggagtggggcccctcagatccatccagaagcaggcagttggggggccctgcgggagtgggagagctgagggctagagttccattggcagttgggctgtgaagccgtgaggttctggggagagaaggaaggttctggaacggccccgctgccccacacctgcctccctggggaccctgagaaggcagccagacgagggcagcagctcgtccctcaaggcccagagctctcacgggacttcctctggctcctgacccccctggcctgtgcccagctctgggcaacctcagaggccccaaggcccaagctacagccgagggcagggtggccggtgcagcccagcagccatgtcaggtgaccagagcggaggagcggggcccagggaggggcttgccacaggtgtgagggtggggaccgctctgcttctgaccccgggctccctccagctcgcttgttcctgccgcccagtgctgtgtgtcttcaggcagggccctggacttgtctgagccaagcccgtctggatcctgtgtgacccaaggagacgcgttgagctctgggtggtgggcgagggtcctgcgggggtttggggccttgttcccgtaagctccagtgggggccgggccccaaggggcaagctcccaagatgcctccttgtagagttggctgacagtggaccctcaggggcatcggccccttcccagctgagagccgtcaccctggaagacctggggctcctcctggcaggaggcctggccagccccgagcccttgagcctggaggagctctcggagaggtatgagtccagccatccgacatccacggcctctgtccccgagcaggacaccgccaagcactggaaccagctggagcagtggtgagccctgcagggggtgctggcgggggaggaccacgtcgccgccgcctccgcctccacggcgggcaccgccagactcgcccactctcgccccggccagggtggtggagctgcaggccgaggtggcctgcctgcgggagcacaagcagcgctgtgagcgcgccacgcggagcctgctgcgggagctgctccaggtgcgggcccgcgtgcagctgcagggctcagagctgaggcagttgcagcaggaggcgcggccggcagcccaggcccccgaaaaggaggcgccggaggtgagcggctcccccccccacaggtcgagctgcccctttcctgggtgttgggggcagctgcttctgggcctggagcccagctcacccctgctgcccaggcccagagctcccaggggccagtggtgccggagctgggtggactccaggggcaggtgccagacccgggcctaggtccagcccacagcctcctcttcctcctcgcagttctctggtctccagaaccagatgcaggccctggacaaaaggtaccccccacacacctaggggcacaggcccagggcggggaggtggtggcgagaaagcagcggcaggtgtggtggggggtccacatctcccgctgggtgtcgctggagtgggggatacacatccaggtccagctagaaaaggccgggtttgtacgtgcctgggcggccttcagaggcccaggaaagccatgggaggtggccacaggggccccttggccagacccccagcccgccgaggctgctcagcccgcctgggcctctcgggaatggcttgttgtgtcccaggctggtggaggtccgggaagccttgacccggctcaggaggagg

SEQ ID NO: 16873 - DNA, 35688 bp, Human
ctgaacactctggcctttgcttcccccatttcagttctaatctctcccggctatcgctgtctgctgtcaggtttgtctcccttatggaaagggaactcagaccgtgaaggcatgatctgccgctgtctgattcgcctgtggttcccagcattgcctagcactgacagtttatttcagtaaacgtgtggagaatgaatgacttatagagcagagaagggagagattaagaggcactcaaaggaggcggagcagagaaggaaaccttaaggcaatttacgaagagactgagtggtaccaagattctctcgcttctaggcctttgcagtgcttttgtttctttcttttagagacggggtttggctgttgcccaggctggtctctaactcctgggctcaggcgacccacctacctcggcctcccaaagtgctaggatcacaggcgtgagccactacccccagctcagtgccgtttctttaagcatctcctcctccaggaggatagagaaaccccaccccgcggcaagcccaggaccctgaacaccccttgctgtctccggaaaaccctctcctccgccccgcttggccagagcgcttcctccaaccgggctcagacctgtcgatacccttgagcaacttgcccacgttggctctcatctgctcaaacatcgccatgacttctgtcgccttccacaaccagggctggaggctaacactgacccggcacggcgtcctcaaggacgggaacaggaagaggtggtggaaacggaaacgacgtcgttgttgtcgctccagctccttgggtgcggtaaagggaaaggctctagcagcagccgccacgctttccggctgccacgtgacttcttcctcgcaggcgcaattggcgcgtgcgcattcgcgccactcaagctggacagacagcgtgagaaaaatcttactggatcccagtgcgcaggcgcctctcgtggcgagggggcggggctaagcttttcccgggcctcacagacccagttccagtgccggtagcgcgggagcgtgcgcgcgcgaactcaccgggaagcacccggagctctggcggcgtgcgcgcgcgttgtattgcgcgcggccatgaggccacggagctctgcgggaatgcacgcagcagccttacgtttaggccatggccaagttccgagggaggtgttctgaggtccctcttgccacaggcctgggcgcctggtgcaggatcctgagctctccagtttcaagtctcagcccttggtccccagctccaggaggagggtcccacaaagctactgtgctctgccgggcaggggctggggtgagggctcctggacttcgccggatcgcgccccgtctccattaggttccggtcttggagctgagggcgagcgtcccatttgtactgccatgaattatatattatgtataggttttgtacactgcaggcctacaaaatgcagttatgtgccatgcatgtggaggtatatgtcctgggtacatccacgtgtgtactgtgcacacaggtatccaggcagatgcacgtctacacgcctgcgcagtgcagaggaggtaacccaagtgcatgtatgtgacaggtgaacaggcatgtacactgcatagccatccctttgcagacctgccgccttcgggttgtggccaaaccttcaagcacccagcagaggtttagacactacctaggagacgggggcgggggttctaaggcacccccctccaacccagttacgattaagatcatttgcatcacatttacatccagccctgggccttggaggttgagggtggtcccttgggtcccaagacaagctgcccctcagaggctctcagagcccaggggacgggggggtggagcccgttgcacagtcgtgcagtgcagctggggcaggaagcgagagtgaggaggggggaggccacagcccgcggaggcaaggcgggtgcagggcttctggggacggagggaggtgccagaagttgagccctgaggccctgctggcccctgggcgcaggcccagctcaggcccccagggatggacgtcgtggaccctgacattttcaatagagacccccgggaccactatgacctgctacagcggctgggtggcggcacgtatggggaagtctttaaggtgaggaagcccctctgtccccaacaccctacaaccagtgacctttaaggcaagccctcggcagggaggaggctgcaagagggggtcccagttcttgaccttgactcagggatgctgtggagggactctggcaaatggagcctgcctgactgccaacttcccctttgcaaggctcgagacaaggtgtcaggggacctggtggcactgaagatggtgaagatggagcctggtgaggagggaacatggagctccttccccacatccccaccttcgcctcctgggacactgggatcacctcccctgtagctctctccccatgcgagctgccttttctctcccgccctcctcacagatgatgatgtctccacccttcagaaggaaatcctcatattgaaaacttgccggcacgccaacatcgtggcctaccatgggagttatctctggtgatgaacctcagacccaccctggcacccagcccagcccctaacccggagtccccatttcttgatgggggtaccctcagttctttttttttcttttctttttcttttttgagatggagtcttgttctgttgccaggctggagtgcagtggcatgatctcagctcactgcaacctctgcctcctgggttcaagcaattctctgcctcagactcccgagtagctgggattacaggcgctcaccaccctgcccggcaaatttttgtatttttagtagagatggggtttcaccatcttggccaggctggtcttgaactcctgaccttgtgatccactcgcctcggcctccgaaagtgctgggattacaggtgtgatccaccgcgcctggtcttggcaccctcagttctaaccttgaacttccatttctcaccataacccgacctcccatcctggacccccatttttgactgggctaaccctaccatgatcctcactcctaagtcccacttttctgaccagagcagcctctaatctaatctccaatctaaaattcccatttctgaccaagagtaccccaaattgatctcttcatagtaactgaatttgaaatcaactcccttgaaacgaagctctcaccattctgctctttggctcacccagtttcactctctgctcctttaatataaactcctaaattccctgatccccaaattaatattccagatgccccaataatgacctctgctccccagaacaggtgccctgggcccctctgtcccctccaaatctccacaacccgtgagatctctgccctgcctcctaggttggcgtgggacggcagtggggtcccgcccaaaggcctaggtttgagttgacttgccccggaactcacatttcctctctgagccttaacttccttgtctgtaaaatgggaatgaaacaacctcactctggtagacaaggagaggtggagtgatgagagctgttacgttaaagttcttattgaactagaacaagacagaagcaaaccaggggctttcctgcaaataataatgtatttactgctattattattcttactcttgaaccactgcaggttgcagaaactctggatctgcatggaattctgtggggctggttctctccaggacatctaccaaggttagagaaaggacaacgggacccaagcacccctcctatccccaccccccaaccccgacccaaattcacctcttccgtctctgtgtgtgtatctcacaggaactgtctttctgggccatatttcaaactcctgggctgagctgatcctcttgccttcagctgtcgaagtgctgaaactacgggcttgagccactgtgcctggctttttttttttttttttttaatataactgctgggcctggtgtggtggctcacgcctgtaatcccagcactttgggaagccgaggtgggcggatcacctgaggtcaggagttcaagaccagcttggccaacatggtgaaaccccgcctctactaaaaatacaaaaaattagccgggcgtggtggcagacgcctgtaatcccagctactcgggaggctgaggcaggagaatcgtttgattctgggaggcggaaaacctctgattccttccagccctagacctcaaatgttagaaaaggaaggacgtcattgagaagtcctcaggagggaaactgaggcccaaagagaggaagtgaatcccacagctggtctgtcagacctgatgtctgacggcctctctctgtctgtctgtctctctgtctctctgcctgtgtgttgttcttacctcgttaccctctgggtctctctctaaatctgtctgtctccccatattttggcctctgacctctgtctttgtcttctgtctcatttttttgtttttttcaatcctgttccttttgtatgtctcatgtatgatctgtctccgtttctctgtctctctctgtctctgtgcctttccttattttgcaaagtcacatgacgcccctgctcagagccctcctacagcttccatttctctcggaggagaagcccagactcctcatcagggtccaccccatgctggccaatctcacctcctcccactttcctcctccccctccactccaccccaccccctttgctgctttccagacccaccagggactatcccacctggggccctgcacttgctgtggctggtcccactcagagtgggagccctcatgtcttcacccactgtcaccttcagagagcagccctgactgaccacctctgtgaaatgtcatagctcctcctacgcgcacctttcttgctttatgtttcttcttgctgtctatcagcgtctgaggaactatatcatattctacttatttatcttgcttactttctttctttccttctttcctttttttttttttttttttttttttttgagacagagcctccttctattgcccaggctggagtgcagtggtacgatctcggctcattgcaacctccacctcctgggttcaaacgattctcctgcctcagcctcctgagtacttgggattacaggcatgcaccactatgcctggctaatttttgtattttttagtagagatggggtttcaccatgttggccaggctggtctcggactcctgacctcaagtgatccacccaccttggcctcccaaagtgctgggattataggcatgagccactgcgccaggcctattggcctcttttatttgcattgctgcctctttctgtcactgaccaccccaccatctccccctcccactggtcctatcctatttcccctctccctatggcaccctcttagctggtgtgggggggcaggactccccagcccaggttccctggctcccatccaatgcctggcctggccggggtgacctttgcagtgacaggctccctgtcagagctccagattagctatgtctgccgggaagtgctccaggtaaggagaggcctggggattctggggatgggaggggagggtggccccactccagcccccaaacactcactgtccccttgtccacccttctccccagggactggcctatttgcactcacagaagaagatacacagggacatcaaggtggtctgggggtgtaggggtgctgttggggggtggggcccaggagatgggagtggcatttcaggggctcagggatcagggtagtttgagctggcggagtgggctagcactgggctggggagagtctctgcagcctcccatatcccctctcattcccagggagctaacatcctcatcaatgatgctggggaggtcagattgggtgagtaaggctgggggttgagcaggggggctgactggggggccggaagcgcagtggaccccagatcactatgtctccctctgcttccagctgactttggcatctcggcccagattggggctacactggccagacgcctctctttcattgggacaccctactggtgagtggcgcccagcgggcagctaggggtggagtgggggtcagtggtttttcctaccctggttccccgggatcctctttcctggctccgttcccctgcctcgtcctttctccttggaagattctttcattctctctgggtgtcgcttgagttttccattttcctctctctttgtgcccttttctggccattgctctcggtgtttgtgttgatttttatcttgatttctctgtccctccatatccatttctgtctttttcctctagctcagtttgcagtgctctctgtctctttgtttctgtctctctcactctctgtctctgcctctctgtcttttcattttgttttgtttttagagacagggtctcactctgtggcccaggctggattgcagtggcatagtcacggctcactgcagcctagaactcctgggctcaggagatcctcccacctcagcctcccaagtagctgggaccacaggtgtgcaccatgacacctggctaatttttaaaatttgtgtagagatggtgttgtttttttttttttttctttttcgttctttttttttttcttgagacggagttttgctctgttgcccaggctggagtgcagtggcatggtctcagctcactgcaaccttcacctcccaggttcaagcaattctcctgcctcagccaccaagtagctgggattacagacgcctgccaccacgcccggctaatttttgtacttttagtagagacgggctttcaccatgttggtcaggctggtctcgaactcctcacctcaggtgatctgtccgccttgacctcccaaagtgctggaattacaggcaaaagccaccgtgcccagccgagatagggtcttgataagttgcccaggctggtctcaaactcctgggcctaagccattctccttgctcagcctcccaaagtgctgggattacaggcgtgagccatcgcgccccgtctgcatctctgtcttcatctgcctgtgtctgtctttactcctgtccctctgtctctccatctgactctctgtgtgctgcgtctcccctcaactccttctccttctctgcccctccttcccttcctgtccccatgccacctctggctctctgagcgtgtctgcccccaggatggctccggaagtggcagctgtggccctgaagggaggatacaatgagctgtgtgacatctggtccctgggcatcacggccatcgaactggccgagctacagccaccgctctttgatgtgcaccctctcaggtaggcaggcgtggggtccccaggcccagagatcctgtctagccctggcccaaagcccaccctcagcttccgccttccatcccaggaacctccaattcagggatcaccacttgagcctacctttgcacgtgctgcagctctattttttaaatttaatttaatattttattttattttattttttattttttaagacagagtcttgctctgttgcccaggctggagtgcagtggcacaatcttggctcactgcaacctccatctcctgggttcaagctattttcctgcctcagcctcccgagtagctgaggctgcaggtgtgcaccaccacgcccggctaatttttgtatttttagtagagacggggtttcaacatgttggccagggtagtctcgaactcctgacctcaggttatctgcccatcttggcttccggaggtgctgggattacaggcgtgaaccactgcacccagcctatttatttatttttatttttatttatttatttatttttgagatggagtcccactcttgttgcccaggctggagtgcagtggcaagatctcagctcactgcaacctctgcctccagggttcaagtgattctaccacctcaacctcccaagtgtgggattacaggtgcacgccaccatgcctggctaatttttgtatgttttggtagagacggggtttcactatgttgaccaggctggtcttgaactcctgacctcaagtgatccacttgccttggcctcccaaaatgctgggattaaaggtgtgagccaccacgcccagacattttttaaattaattaattaattcttattatttttagagacaggatctggctctgtcacccaggctggagtgcagcggcacgatcgtagttcacttcagccttgaatgccggggctcaaatgatcctcctgccttagcctctcacatagctggtcctacagacccatattgccacacccagctatttaaaaaaaaaattttttttttgtctcactatgttgccccagctggtctccaactcctgggctcaagctatcctcccgccttggcctcccaaagtgttgggattacgggcgtgaaccaccacacctggccttgccatagctctatcacttcataaatggcttcccttaggagaggcaccctggtgcactgtaaaacctgaacctcacttccatgctgtttctcactttgccctctgctgaccacaatgctactaggaacccctcaagccatgaggtctggcccccttgagggtctgaaccccatgtcctttccctactattctagagttctcttcctcatgaccaagagtggctaccagcctccccgactgaaggaaaaaggcaaatggtacgagagagtaacaggagggagggtgagagagggcagggctggggctgggtggcctgatgggagggtttctggtcccctcatccagaacctggcttcttcttcccaaggtcggctgccttccacaacttcatcaaagtcactctgactaagagtcccaagaaacgacccagcgccaccaagatgctcagtgtaaccctcccttccccaagatcctcagcctaggattccctggggccttccacaactcccgaggacatggataactttgttccatggagtccccgtggcctttccaaagtccctagtgcctcagaatttcccaggaccacccccgaccaccagagaccctccgggttataccccagacctttcccaaataccccgagttgccggaactgacaaattcccaaaggactcaagacttgtcctgagtgtcctcttgaatccccagggaaccacagtctcttccaagacaactctggaattctcctagccccgctctgagaaacctaaattcttctaattcctaaaaatgtcttagactcccaccggtcggctgggcatggtggctcacacctgtaatcccagcactttgggaggctgaggtagatggatcacttgaggtcaggagtttgagaccagcctggccaacatggtgaaaccccgtctctactaaaaatacaaaaattagctgagcatagtggcgcacgcctgtaatcccagctacttgggaggctgaggttggagaattgcttaaacccaggaggcggaggctatagtgagccaggatcgtgccactgcactccagtctgagtgacagggcgagaccctgtctcaaaaaaaaaaaaaaaaaaaaaaaaaaaaaaattagctgggcgtggtggcacgagcctgtaatcacagccactcgggaggctgaggcacgagaatcaattaagcccaggaggtggaggttgcagtgagcctggattgtgccactgcactccagcctgggtgacagagtgagactctgtcttaaaacaaacaaacaaaaaagaataccccaggcctctgagttccctggatttccccgccctctgccttcactggcaccttctccccagctagattcctttagtccagtccccaaggccctgtaccagtcctctctgtccacaccagccctctctgtccacaccatccctctggatacggacacctcttccctccgccagcatcaactggtatcccagcctgggctgaatcgaggcctgatcctggatcttcttgacaaactgaagaatcccgggaaaggaccctccattggggacattgaggatgaggagcccgaggtgagagccttggctgacaagagcactggggacctctcggtctttctcaggctgtgcctgctgccagcagtgccttcctgctgcctctcttagggggaaaacagggagggaggatggggagcttggtaaaaggctgtgtgcccagagggttacaggagagagcagatggaccccgggcagggtaggaggctgcttgggggtcttgagccctgacgtggctgcccctctgcccagctaccccctgctatccctcggcggatcagatccacccaccgctccagctctctggggatcccagatgcagactgctgtcgtgagtagagaatccttatgtttggggacacctgaccctataatagacctaagagaccaccttcccctaccatcaggcctccagagaccctcagcatcatctgatcctataagagaccccagacaatctcatcagcacctgaactacaaaatgaccgtagaggccaggcgtggtgactcatgcctgtaatcccagcactttgggaggccaaggtgggcagatcatctgaggtcaggatgtcaagacgagcctgggtaacatggtgaaaccctgtctctgctaaaaatacaaaaattagccgggtgtggtagtgcacgcctgtagtccaagctacttgggaggctgaggtaggaggattgcctgaacctgggaggtggaggttgcagtgaaccaagattgcgccactgcactccagtccaggtgacaagagcgagaccgtctcaaggacaaaacaaaacaaaacaaaaacaaaagcaaaatgaccatagagttcccagggagacctcagaaatctcatcagaacctcaatacccaaacggatcctgaaaacaccctgtaactacattgagcccccaacttcctgatcccaaaacttatttatttgtttatttttttgtgacaggatcttgctgtgtcacccaggctggagtgcagtggtgtgatcacagctcacttaagcctcaaacttcttgggctcaaggaatcctcccacctcagcctcctgagtagctgggactacaggcttattcaccacgcgtggctaatgttttttttttttttttttttttttttttttgagacggagtttcactctgtcgcccaggctggagtgcgatggtgcgatcttggctcaccaaaacctctgcctcctgggttcaagcgattctcctgcctcagcctccagagtaattgggattacaggcgcatactaccatgcccggctaatttttgtatttttttttagtagagacggggcttcaccatgttgaccaggctgatcatgaactcctgacctcaggtgatctgcctgcctcacctcccaaagtgctgggattacaggcgtgagccactgtgcccagtcacttggctaatttttaatcattttttgtagggatgggttcttgcccagttgtccaggcaggtctcaaactctgggttccagcgatctgcccacctcagccttccaaagtactgggattataggcgtgagccactgcacctggtcttgatcccaaacttgacccccaaatgaagtccctgtaatccaagacccctttccccaagggacagttccctgagatcatttgcagtccccaagatcctgactgcaacccccccgccaattctactctttctgttcttaaacccatctcgttaccccttgcccccagctcacagcaggttatcttcccccacccaccctagggcggcacatggagttcaggaagctccgaggaatggagaccagacccccagccaacaccgtgagatgctgtccccccactccccaccacaccgcctgcttccctgaggccactgctgacccttttcctaccccacaggctcgcctacagcctcctcgagacctcaggagcagcagccccaggtcagggaccccagggaggatggggagggggctggaatgtggacaaggcccccaaggctcatacctgtcacccttcaggaagcaactgtcagagtcgtctgacgatgactatgacgacgtggacatgtaagtgaggccctgcctgcagctccacaggccccacctcagcccccaccttcctacaatcccctgatgtggcctttcctccactcctgaccccgctgcacccctgcctttcttctagccccgagccctgagccctgattagaccctcaatgcagcccctctgcccagctacctaggccctgttccctaaccccacctcccttaacccttcacctccaacccctgacccccaacctgatcccagctccagctcccactttccttctttccttccaccttcttctttttttttttttttttttttgagatggagtctcactctgtggcccaggctggagtgcagtgacgtagtctcagctcactacaacctcggctccccgggttcaagcgattctcctgtctcagcctcctgagtagctgggattacaggcacctgccaccatgcccagctaattttttgtatttttagtagagatggggtttcaccatgttggccaggctggtttcaaactcctgacctcatgatccgcccatctcagcctcccaaagtgctgcgattacaggtgtgagccactgcacttggcctccttccatcttcttatacaatcttttgacttgaccctcagcgtcagccccccacctgctctccaccccagagctgaccccagttccttctagaatgtgctgctgctccaatctctgacttgaccccacctatcctccatgaccctgcaccctcagccacatcccagtctcaaactcctcccgaatgtcactctcaccccagacccaccctccagccttcagccccagccctcagcttttcctatctttttgcccgccctcaggctgaaccttggcacctggaaatctcccaaagaccagatactgagccccagatccagacccaacagtcagcccaggcccccatactccccagcccacaggccgagtcaggctccatccaggtgcgcgcactcacttcacccatcacgtgcgacagcctgtgtgtggcgccagcacagggagagcagggccacggcgctgatgtcacctgtgttactaggtggtgtaaaggtgcaaagccgtggtgcactgtcagcactccacctccaagagttgctgttactgttattagtcttttttttggaaacaggctaatcatttttttgtaggatggggtcttgccatgttgtccaggctggtctcaaactcatgatttgttttggcaccaaggctaagtgcaggagtgcaatgatggcttactgcagcctcaacctcccaggctcaagcaatcctcccacctcagcctcctgagtagctgcggtcacaggcgcacctgccacgcctggctaatttttaatttttttctggagacaaggtcttgctatgctgcccaggctagtctcgaattcctgggctcaagccatcctgccctggcctcccaaagcactgcgattacaggcatgagccactatgtccagcctggctattaatcctttaatcctctgctccaggcagaaccagtcatcccttaatcctcctcacctcagaccccagtcccgggcctccagcccagaaccatgccatcttccccgagtccttgttccccagccccccagctatttaacccatctttgtgtttcagccccacccctgcagaggacacacctcctccacttccccccaaggtaaggccctgggccagagctgggaggctggggcctcagggccactgggggccaggaggccaggtccttagatgctgggatactgggctctccagggcagggaattggggagaccaggatgatggctacattgggatctggaagtggcatccctcaacctcagggtcggattcaaaatatttagcctcttagacactggtcagtagctggtcctaggaagcccctgctatatatccagcattaacccattagtttctgaagtgtgttgatgtccaggctggggatgtcaggggaaggctggagggggcacaagatgttgtcgggggggtgggtcagagccacagctgttagttctggtggaggcagggacttgagttgcaaaagggtgccctctctgagatcatctgatgtatttccccacgctccattcccgtctccaaagcccaagttccgttctccatcagacgagggtcctgggagcatgggggatgatgggcagctgagcccgggggtgctggtccggtgtgccagtgggcccccaccaaacagcccccgtcctgggcctcccccatccaccagcagcccccacctcaccgcccattcaggtaatgggacaggctagggtggagggcgggagggttgggggttcttgggggctgattttctcctaacccctctcagaaccctcactctggaacccaccctcccgggagcttgacaagcccccacttctgccccccaagaaggaaaagatgaagagaaaggtgaggttcagctctgctgaggacttacacctctggacggggctggggatgcctggtggggtggggagggggtggcaggactgacagtaacaacaggtgacatttgttgagcgcttctctgtgccctacacttatctcctatcattacatggcataaagcttcacagagtgaagaagatatcacagagatgttatcccccatttcacaaatggggaaattgaagcacagagagggtaagtggcttacccaaggtcatataaatacctttgaggaggcaggctgaggcaggattgttgtttctgcttttttttttttttttttaaagacggagttttgcttgttgcccaggctagagtacagtggcgcgatcttagctcactacaacctccgcctccctagttcaagtgattctcctgcctcagcctccggagtagctgagattacaggcaatgcagcaccatgcccggctaattttgtatttttagtagaggtggggtttcaccatgttggttaggctcgtcttgaactcctgacctcaggtgatccacctgcctcggcctcccaaagtgctgggattacaggcatgagccaccgcgtctggcatgcttttttttttttgagacagagtctcactgtgtcacccaggctggagtgcagtggcgcgatctcggctcactgcaagctccgcctcccaggttcacaccattctcctgcctcagcctcccgagtagctgggactacaggtgcccgccaccaggcccggctaattttttgtatttttagtagagacggggtttcaccgtgttagccaggatggtctcgatctcctgaccttgtgatctgcccgcctcggcctcccaaagtgctgggattacagtcatgagccaccgcgcccagctactaaaaatttaaaaaattagctgggcgtggtggcacacacctatggtcccagctacttgggaagctgaggtgggaggattgcttgagtccagaagttagagtcttttgacaagatccatcaaaacctccatgagtcactaccacatatgcagttgcccaaagagccaagatctcaagaaattttacctctcataaatggagatgtacaaaaagaacatctctttattcaggaagtttcagtgtttttacgtacatgcataatgcctacacacgtagtcagtgttgtgataatgcacctttgtggcatcaaatttgccaacaaatgcataaaatgaattagaactctctaaagtccttttttttttttttttttttttttgagatagtatctcgctctgtcgcccaggctgctggagtgcagtggcgcgatcatggctcactgcagccttgacctcggagactcaagcaatccatgcacctcaccctccctagtagcgcttggctaattttttttttttttttctgagatggagtctcactctgtcgcccaggctggagtgcagtggtgctatcttggctcactgcaacctctgcctccccagtctaagtgatcctcctgcctcagcctcctaagtagccatgactacaggcgcccaccaccacgcccagctaatttttgtatttttagtagagacggagttttgccatgttggccaggctggtctcaaactcctgacctcaagttatctgccagcctcggcctcccaaagtgctggcattacaggcgtgagccaccgcgcccggcccagcttggctaatttttaaaaaaatgttttatagaggcagggtctcactatgttgcccaagctggtcctgaactcctgggcttaagtgatcctcccacctcggcctcccaaactggtgggattacagccgtgcctggttggctaccggctaaaagtatgtataatttatacctccagcactggaaatgattcaaagatgaaatgcatagcataattaatcatacatatatacatatacatatatacacacacatatacatgtatatgtgtgtatatatgtatacgtgtatatatatgtatatgcatatatatgtacatgtgtatatatgtatatgtgtgtatatatgtatatgtgtatatatgtatatgcgtatatatgtacatgtgtatatatgtatacatgtatgtgtgtgtatatatgtatatgtgtatatatgtacatgtgtatatatgtacatgtgtatatatgtacatgtgtatatatgtatatgtgtatatgtatatgcgtatatatgtacatgtgtatatatgtatacatgtatatgtgtgtatatatgtatatgtatatatgtatatgcgtatatatgtgcatgtgtatatgtgtgtatatatgtatgtgtatatatgtatatgcgtatatgtgtacatgtgtgtatatatgtacatgtgtatataagtatatatgtacatgtgtatatatgtatatgtgtatatatgtatatgcgtatatatgtacatgtgtatatatgtatatatgtatgtgtgtatatatgtatatgtgtatatatgtatatgcgtatatatgtacatgtgtatatatgtatacatgtatatgtgtgtatatatgtatacatgtatatgtgtgtatatatgtatatgcgtatatatgtacatgtgtatatatgtatatatgtataggtgtgtatatatatgtatatgtgtatatatatgtatatgcgtatatatgtacatgtgtatatatatgtatatatgtatatgtgtgtatatatatgtatatgtgtatatatgtatatgcgtatatatgtacacgtgtatatatgtatatatgtatatgtgtgtatatatgtatatgtgtgtatatatgtatgtgtgtgtgtatatatatgtgtgtgtgtgtgtgtgtgtctatatatatatgtatatgtgtatatatatatatgctggccaggcacagtggctcatgcctgtaatcccagcactttgggagaccaaggcagacgcatcacctgaggtcaggagttcgagaccagcctggccaacatggcgaaaccctgtctctactaaaatacaaaaattagccaggcgtggtgttgtgtgccagtaatcccagctattcaggaggctgaggcagaagaattgcttgagcccaggaggtggaggttgcagtgagctgagattgcatcactgcactccagcctgggcaacagagtgagactccatctccaaaaacaaaactgacagctgggagtggtgcctcacgcctgtaatctcagcactttgggaggctgaggcaggtgaatcacatgaggccaagagttcaagaccagcctgggcaacatggcaaaactccatctctactaaaaatacaaaaattagctgggtgtggtggcacacgcctttggtcccagctactcagaaggcttaggcatgagaatcagttgaacttgggaagcagaggttgtagtgagctgagatcatgtcattgcattccagcctgggcaaccgagtgagactctgtcttaaaaaaaacaaatgctgatgatttaggatagtggaggaaaaactaaaaaaagaaatatataacaacaacaaaaaaaaacaaaaacaaactgaaaagaaaactcaatgtatgaaaaagtgtattacagggatagattatgggaaattgcaccaaggtaagaggcaggatttgaaccttggcactctcgctccaaagtcgtaaccactgccccttcctgttccctgctctctttgccggatctgctgcctggccccgcggcgacctgcccagggatgtgcccttctcgtaaagttgttcaatggctgccccctccggatccacagcacggccgcctggacacatccctccaccaagggtgggcattctggagggtcaaggagatcctgtagggaatgggagagcaaaagtaggggtggggagaagcctaaggaaggcacaaaggcagggacggggaggagcttaatggagttggggtgtggccaggctgaaacaggggcggagcttgtccttacactcaggatttggtgatcaaagatgcatagagggcagccaggtgtggtggctcacacctgtaatcccagcactttgggaggctgaggcgggtgaatcatttgaggtcaggagttcaagaccagcctggccaacatggtgaaaccccgtctctactaaaaatacaaaagaagctaggtaggccgggcatggtggctcacgcctgtaatcccagcactttgggaggcggaggcgggcggatcatttgaggtcaggagtttgagaccagcctggccaacgtggtaaaacctcgtctctactaaaaacacaaaaattagccaggcgtggtagcacgtgcctataatcccagctactcaggaggctgaggcaggataattgcttgaatccagggggcggaagttgcagtgagctgagatcatgccactgcactccagcctgggcaacagagcaagactcagtctcaaaaaaaaaaaaaaaaaaaaaaaatgggtagagggatgagttggagagtgaaagtaggaatattggaattcaggggccaggagtgtcagaatataacaaaaaggttagagtttggagcacgagaaagatggacagctggaggttaatgatagggagactgggagcagcattttggggtgaggaattttagagattaggatgcagccagaaagggacagaatctagagatcaaagagatgaagacaaggtcagtgttaaaggaacaggtcacactggacagaaaaagtcctgtttgggggtgtctgagtttgaaggtcaatgttaggattggcattagggtatcagaactggggagaaagaggggaggaaatcagaggactattttgggggacaggtctaaggttggggtcagtttggttcagaagacagttgggcagagaagaaagaaccaccagaatatgggtagtcaaaaggagggagagtgagactggcttgcgggaccgtccgctctggctttgtttggggaaacagaggctgggagtattggtttggagaaagaatagagggtcagagctggggacagagtgtcagtgtttgaggtcagacaggtggggatctgggaggtccctgaggatgaagtcggtcccagcgtccttgtctgtgcctccagaccagcacctgctcctgggggcagaggaaggcatcttcatcctgaaccggaatgaccaggaggccacgctggaaatggtgaggaaccataccgggccagggcaagggcaagggccggagtcgggggttgctggggtgtcaccagagccatctctcccattccctgcagctctttcctagccggactacgtgggtgtactccatcaacaacgttctcatgtctctctcaggtctggctgtgggtagcaggtgggatggggtcggaagttaaggggtccaagggttcgggggctgggaagtagacgggcacagctgaaaaaaaacttagactgcttggtcacaaagtcctaggttcaaatcccagacactttttgactgtgctccccaagcctcaatttctccatttgtaaaatggggttcacaatagtcctcacctctcaagtcaattttgaggtagtttctacaataaattagtctttttttttctttttttgagacagagtctccctctgtcactcaggctggagcgcagtggtacaatctcagctcacggcaacctctgcctcccaggttcaagtgattctcatgcctcagcctcctgagtagctggaattacaggtgtgcaccaccacacctggctaaattttgtatttttagtagagacagagttttaccctgttggccaggctggtctcaaactcctgacctcaggtgatccaactgccttggcctcccaaaatgctgggattacaggcatgagccaccacacctggccttagattagcctttttttttttttttttttttgagaccgagtctcactcagttgcccaggctggagtgcaggggcgtgatcttggctaactgcaacctctacttcctgggttcaagcaattctcgtgcctcagcctcccgagtagctggtattacagatgtgagccatcatgactggctttttttttttttactttttttattttttatttttagtagagatggggttttaccatgttggccaggctggtcgcaaactcctgacctcaggtgatccacccgccttggcctcccaaagtgctgggattacaggtgtgggccaccgcacctggcctaaattagtcctttttttttttttttttttttttgagatagactctcactctgttgcccagactggagtgcagtggcgcagtctcggctcactgcaacctccgtttcccaggttcaagcgattctcctgcctcaccctcccaagtagctgggattacaggcacctgccaccacacgcggctaattttttgtgtttttagtagagacggggtttcgccatgttggccaggctggtctcgaactcctgacctggtgatccactcgtctcagccccccaaagtgctgggattacaggtgtaagccaccgtgcccagccctaagttagtctttaaatagctttcatgttcagatgacaatcagaacttattccatactttactaagatagagtgagcaagttatagatttcaaaatctggacggggtgcagtggctcatgcctgtgatcccagcactttgagaggccaaggcagtagtactgcttgagcccaggagttctagatcagcctgggcaacatagtgagacctcgtctctactaaaaattaaaaaaaaattagctgggtgtggtggcacacacctatggttccagctactcgggaggctgaggtgggaggatcacttgagcccagaagttagaggctgcagtgagtcatgatcacaccactgcactccagcctggaagacagaatgagaccctgtctatatataacaataaataggccgggtgcggtggttcacacctgtaatcccaacactttgggaggccgaggcgggtagatcacctgaggtcagtagttcgagaccagactggccaacatggtaaaaccccgtctctactaaaaatacaaaaattatccaggcatggtggcgcatacctctactcccagctacttgggaggctgaggcatgagaattgcttgaacctgggaggcagaggctgcagtgagccaagattataccactgcactccagcctgggtgacagagcgagactgtctaaaataataataataataataaataaatgaaataatttctagttttgggggaaacaccaagccaaatgggattcatgagttagtgaaagccacatctgtgatgacaaactagaagattttctagatgtgtttcttctaaaactttgtaagatgtgtaacttcatctgactggttatgtgtccagagtttctgatacggctacaaataccacgagggtagggaacatattttttatgctcatcactgttcaccagagccaagcacagcaggcctggcctacaatggacgttcaatctatgtggagtgagaaatgaatgaatgaatgacaagtacttgagacttgcaggcttgggagtttcagacaaagggatggggctgagggaagggatggaggaaaggaagtggtatatgggatcctataacttcctgcttccccctacatacacacaccctgcaggaaagaccccccacctgtattctcatagcatccttggcctgctggaacggaaagagaccagagcaggaaaccccatcgctcacattagcccccaccgcctactggcaaggtaccagctcccaatgaatggcaccacacagccttataattcctcccatgcccctctgcctcctgctgtcctaccccccttcacacctacctattctccaggaagaacatggtttccaccaagatccaggacaccaaaggctgccgggcgtgctgtgtgggtgagagagagcttcacgggtgtgcagagagtgggcggggccaggccagaggaggggcttgaactgcatccacctgagaaggttacagagttaaggcaatgtgtccagaacccagaagatgggtggtagtgtgggtggcgaggaggatagagggcattgatcttgactcatccttgcccatgccacagcggagggtgcgagctctgggggcccgttcctgtgcggtgcattggagacgtccgttgtcctgcttcagtggtaccagcccatgaacaaattcctgcttgtccgggtaaggggcttgggagggtgctgggaactctgaggagtgggtggctaaggccttgcaccctttgcgcttctatcaagagctccatgaagccccacctccgtcgaggccccgccccaatctcccgaggccccgcccacctgcggtctgcgcttggagcctcgtccttctgaagccatcctgatccttaagcgccgcccctcacacctgggcctaattattcctcaggctcaatgctgccactccctgggtgtcctagtagagcccatttagagcctgtctctttgagtgtctaagcaggttttgctatctttggggccctgcccgtctgccgccaaggtggcatgcccccacatggaagccacacccactcggaggtcacgacccccgttcccgcggaggcaccaggccttatcccctgacatttctagacggcatcccccaagacttagggccctggttcggaagtcccaggccagctacaagccacgccccctgaggccccgtcctgaaccaccccctagcccgcccctccctgtgcggcccgcagcaggtgctgttcccactgccgacgcctctgtccgtgttcgcgctgctgaccgggccaggctctgagctgcccgctgtgtgcatcggcgtgagccccgggcggccggggaagtcggtgctcttccacacggtgcgctttggcgcgctctcttgctggctgggcgagatgagcaccggtgagtggggcggagtcttgctgagggcggggcttatcagatccggaggggcggagctggaggcggggcttcgcttagcctgaggcactacgggactgagaaagggctggaagggcggagaagggagaatggcaggttttagttaactggggagattgatgatggggtgggaccgggatggtgggcggggtttagcccacttgcttgtgaactgaggcggtggctaaagcacaggtactggccttctgggggtggtgtggggaaaggggaatggggtggggtcaatccttaacccactccccccaaacagagcacaggggacccgtgcaggtgacccaggtagaggaagatatggtgatggtgttgatggatggtgagaaccctccttcctccccttcctccccacccctccagctgcagtccctagatctctgcctccgaacttgtgcttctcagaaccccctgagcccctctgggccttgcccctgtcctacatagctttcacactgaatttatggattggtcccttagtaaccctctaagccttgctcacagttcttaaaaccgtctatctccttccaggctctgtgaagctggtgaccccggaggggtccccagtccggggacttcgcacacctgagatccccatgaccgaagcggtggaggccgtgggtctgtgcagggacgggagagcccaggatcaggggtggaaactcaagtgatccccaagggtaacgggcattgctttctccccagctatggttggaggtcagcttcaggccttctggaagcatggagtgcaggtgtgggctctaggctcggatcaggtaagcccctccatccaaactccacatcactgccccccagcctccatcatgacattcatcagatgggctccgagaactcctgagtcagagtgtgaagtcctggaggggaaacatcttccaaatttcagttcagatagatccccttctttgccccaggatttattttttattttatttttatttatttatttatttaagacggagtttcactcttgttgcccaggctggagtgcagtggtgcgatcccggctcactgcaacctccacctcccgggttcacgcgattctcctgcctcggcctcccaagtagctgggattacaggcatgcgccaccacagctggctaatttttgtattttcagtagagacggggtttcaccatgttcatcaggctggatggtcttgaactcttgacctggggtgattcacccgccttggcctcccaaagtgctgggattacagctgtcagccaccacacccggcctattttatagatagatagatagatagatagatagatagatagataaaatttatttatttttggagatggattcttgctctgtcacccaggctggagtgtagtggcgcgatctcggctcactgcagcctctgcctcccaggttcaaagaattctcctgcctcagcctcctgagtagctgagactacaggtgcatgccgccatgcttagctaatttttttgtatttttagtagagacagggtttcaccatgttgcccaggctagtctcaaactcctgagctcagccaatctgccttccttggcctcacaaagtgctaggattacaggtgtgagccaccactcctggccatttttatatattttttgagacagagtctcgctctgtcacccagggcagagtgcagtggcatgatccgagctcactgcaacctctgcctcctgggtccaagtgattctcctgcctcagcctcccgagtagctgggattacaggtacactccatcatgcccaggtaatttttgtatttttagtagagacggggttttgtcatgttggccagactggtctcgaactcctgacctcaagtgatctgcccgcctcagcctccgaaagtgctgggagtacaggcgtgagctacttcacccggcctgtttgttttggagatagggtctctctctcttgtccaggctgaagtgcagtggtgcaaccatagctagctgtagccttgactttctgggctcaagcaatcctccctcctcagcctctcaagtggcttggattacaggtgtgagccactgcacctggctgctcttggatttcttgagtcccaatctcatcctgggccactactgtgaccttgggctggcaacgttgcttctctttaagcttctgttccccaactgtaaaatggggaccactatagagatatatggatagttaagacaagactgtctgggttggaattcagctgagtggccttgggcaaatgacttaaccttcctgtgcctcactgtcctcatttggaaaatggtgtttatctcacagaatactgtgtcagactttgcccttacactttagtatttttatttatttatttttgctcactcagttccttccctctttttgaaatggagtctcgctctgttccccagactggagtgttagtggcacaatcttggctcattgcaacctctgccacccaggttcaagcgattctcgtgcctcaccctcacaagtagctgggactacaggcatgcgccaccacagctggctaatttttgtattttcagtagaaatacaaaaattatctcagctggagatctcggctccagtggcacgcccagtggcgcaatctcagctcaatgcaatttctgcctcccgggttcaagtgattcttctgcctcagatcctgagtagctgggactataggcgcgcaccaccatgcctagctaatttttgtatttttagtagagacgaggttttgccatgttggccaggctggtctcgaactcctgacctcaggtgatccacccacttcggcctcccaaagtgctgggattacaggcgtgagccaccgtgcccagctccttgctgtctttaagggagccatgttcgtagtgacagtggaggtatcttccaggcactgagacacacactttttttccctagctgctacaggagctgagagaccctaccctcactttccgtctgcttggctcccccaggtatgttgtggggtggggtgcagaaggacctgggagggggcttctgatgtgaagagagcattctgaggtgtccccagcaaggtatctctagcctggacagtgtctcacctggtcaccctgcttccatccctgctccctagagtctgttctctgcactgcagccacgggggcgttctctctttttgttttgtttctcactgtactcaaaggctggagtgcaatggcacgaccacggctcactgcagccttgacctcccaggctcaagtgatccacccacctcagcttcctgagtatctggaactaccggcatgtgccaccatgcccagcaattcttttatttatttatttatttatttatttattgagatggagttttgcttttgttgcccaggctggagtgcaatggtgtgatcttggttcactgcaacctctgcctcccaggttcaagcgattctcttgcctcagcctcccaagtagctgggattacaggcatgtgccaccacacccggctaatactatattttttagtagagatggcatttcaccatgttggccaggctggtctcgaactcctgacctcggtgatccacctgcctcggcctcccaaagtgctgggattataggcatgagccactgcacctggccaatccttttattttttaattttaattcttttatttataaaatttttttaaaatttatttttgacacagagtctcgctgtgttgcccaggctggagtgcagtggcacaatctcagctcactgcaacctctgcctcccaggttcaagtgattctcatgcttcagcctcccaagtagctgggtttacaggtgtgtaccaccacatttggctattttttgtatttttagtagagacggggtttcgccttgttagccaggctggtctcaaactactgacctcaggtgatccagctgccttggcctcccaaagttctgggattacaggagtgagccactgcacctggccttaattttatttcatttttgagacaaggtctcattctgttgcgcaggctgaagtgcagtgttacacacacagctcactgcagtcttgaccttctgagctcaactgatcctcccacctcagcctcccaagtagctaggtccacaggcatacaccaccacaactggctaatttttaaaatttttttgtagagacggggtcttgccatgttgccctggctgtccttgaactgctggcctcaagcaatcttcctaccttggcctcccaaaatgttaggattactggcatgagccaccacacctggctgcattttttttttttttttgagacggattcttgctctgttgcccagcctggaatgcggtggcgtgatttcagctcaccacaacctccacccactgggttcacgcgattctcctgcctcagcctcccgagtaactgggattacaggcatgtgccactgtgcccggctaatttttgtatttttagtagagacaggctttcgccatgttgtccaggctgctcttgaacccctgatctcaggtgatctgcccgcctcggcctcccaaagtgctgggactacaggcatgagccaccgtgcccagccctggctgcatttttattttagatttttatcttattaaaaatttttaactattaaaaataactattttaactattttgacataatttaaaactcacactcccagagaagttgcaaaaatcccttttatccagattaaccagatctttttttttttttttttttgagatggagtcttgctgtgtggcccaggctggagtgcagtggatctccactcactgcaacctctgcctcccgggttcaggcaagtctcctgtctcaacctcctgagtagctgggactacagttgcacaccaccacgcccagctaatttttttgtttttttagtagatgtgggctttcatcatggtggttaggctggtctcgaactcttgacctcaggtgatccacccacctctgcctcccaaagtgctgggattacaggcgtgagccactgtacctggccagatgttaatctttttaaccgcatttgccttattattcttttttttttcttttcttgagacagagtttcgctcttgttgcccaggctggagtgcaatggcataatctcagctcaccacaacctcccactcctgggttcaagcactcctcctgcctcagcctcccgagtagctgggattacaggcatgtgccaccatgcccggcctcttctctttcttatgcgcacacaccacacatacaagtatatgtgtgtgtgtgtgtgtgtgtgtgtgtgtgtgtgtgattttttaatgaatatttgggaatgaattgcagacgtgatgcccatttacccctaaaatacttcagtgtatgtttcctgaatcaaagcaaggacataatgttacaaaccacagcacagctgtcaaaatcaagaaaacaacactgaaacatcacaaccttctaattcatacccctactcaatttcaccagttggccaggtgtggtggctcacgcctgtcatcccagcactttgggaggctgaagtgggcagattacctgaggtcaggagttggagatgggcctggccaacatggagaaaccccacctctagtaaaaatacaaaaattagctgggtgtggtggcacgtgcctgtaatcccagctgggaggctgaggcaggagaatcacttgaatcggagaggtggaggttgcagtgagccgagattacgccactgcactccagcctgggtgacagagcgagactctgtctcagaaaacaacaacaacaacaacaaaaaatttcacccgttgtcctagtgacgcccgtgattatatatatatatatatatatatatatatatatatatatatattttttttttttttttttttttctggtccaagatcataggttgcacttaggagtcatgtttctttattatttagcctggaacaattatttagacttcttttgtctttaatgagctttgacctttttcaagagtaaaggaaagttgttttctagaatgttccttgactgtgtttgaggtttccacgttctgcattttgggcaggaatactgcagaaagatgtctttctcagtgcatcatttcaggaagtacacaatgctagtttgtcccattactggtgatattaacttcggtcatttggttaaggtagaatcagccagttctctccactgtgaagttgcttttttctccctttttctttttttttaaagatagattctctctctgtcaccctggctggagtgcagtgacgcgatcatggctcactgcagcctcgacctcctgggttcaatcagtcctcccacctcaacctcccgggtagctgggatgacaggcgcgtaccactacacctggcttattttcgtattttttgtacagacagggtttcgccatgttacttagcctggtctggaactcctggactcaagagattcacctgtgtaggcttcccaaagtgctgggcttataggcaggggtcaccgcacccagcctctgtttttctttgtaataagaagtatcccaccggtcgggcgcggtggctcacgcctgtaatcccagcactttgggaggccgaggcaggtggatcacctgaggtcgggagtttgagaccagcctgaccaatgtggagaaaccctgtctctactaaaaatacaaaattagccgggcatggtgttgcatgcctgtaatcccagctactcgggaggctgaggcaggagaagcgcttgaacccgggaggcggaggttgcagtgagccgagatcgcgccattgcactccagcctgggcaacaagaagtgaaactctgtctcaaaaaaaaaaaaagaagtatcttttggggagattcactgagacgaggtaaatagtctgtaaatacgttgtttctcatcagattttcacccactagttttattgttttttgtttgtcttttgttgttgttttgagtcagagtctcactctgtcccccaggctggagtgcagtggcacgatctcgcctcactgcaacctcctcctcccaggttcaagcaattctcctgcctcagcctcccgagtagctgggattacaggtttgagccaacgcacctggcctgcccactagttttagaatcaattgatttttccctgaatctattattgttaggtggctactaacaataaatggtgattttctgattctatgtttccttctgcgtgtgttagttggcattctactctaaagaagagctgtgtcttctccattcttctttctttataccagcatggtctcatggatttttattctgtgggttatagtctattactgtcattatttatttatttatttatgagatggagtctcgctctgtcacccaggctggagtgcagtggtgtgatctcagctcactgcaacctctgcctcccaggttcaatcgatcctcctgcctcagcctcccgaatagctgggattacaggcgtgcaccaccatgcctggataaatttttttttttttttttgagacagaggctcgctctgtcgcccaggctggagtgcactggcgctatctcggctcactgcaagctctggctcccaggttcacgccattctcctgcctcagcctcccgagtagctgggactatagtgcctgccaccacacctggctaatttttttttgtatttttagtagagatggggtttcaccgtgttagccaggatggacctggataatttttgtagttttagtagagatgggattcaccatattggccaggctggtcttgaactcctgacctcaagtgatctgccccccttggcctcccaaagtgctgggattacaagcatgagccaccatgcccggccttgtcattatttattttgaggcacaaatggtcttaaatttagccagtgggaaccactttaagtagcccctgtgtccttttgacatgccagaagggtcactttaaatccaaatctgatcgtgtcactgtctccctgcttaaaatcctcccatggcctcaagataaagactcaatcctggccacagcccacaaggccatgacatctccagccaagtcccagcctttctcccacctcaaatcctttgcacaggctgttctccccagccagaacactcttccttgccctttcaccaagttccctcctaaccccccttcaggctgcaccatccattctctggggagtctgggctgacctcctgggttaggtttccctgccagacatgccatgcttttttgcactcatgtaattcactgattcatgttgatctccttctctagaatgcaagcttcctaagggcagggaccgtgtctgcccattcactgctatagttcagcatggggctggcacagtctctattaactactttgtgaattaatgaatcaatgaacatatgaatgaataaatgaactgacttatctcttccttccacaggcctgtagtggtggagacacgcccagtggatgatcctactgctcccagcaacctctacatccaggaatgagtccctaggggggtgtcaggaactagtccttgcaccccctcccccatagacacactagtggtcatggcatgtcctcatctcccaataaacatgactttagcctctgctgtcatcttgtttttcttgggggaaacaattcctggatgtccactcctccaaaatttcagcaggccaacacagtgatgctggggggcgtagcacagatttattttccagtactaggtcacctctcccccagctgccttagggggaggggcttggggactaaggggcttgctgtgagaataaggcacttgaggtgggggtggagggccagctgggggtgtgtcagctaagctggtcctcatactgcttacggaaacaatcaccagctgggaagaaatcccaacatctctcttggtacatcttccagacataagactcctaggattggggatagaaagagttcattggtcacatcttcaaacccttgagacatatatatatatatatttttagacagggtgttgctctgttgcccaggctggagtgcagtggcgacaatcacagctcactacagcctcctggctcaagcgattctccacctcagtctccagagtagctgggactacaggtgcacaccaccacccctggctaattttttaatagagaaagggtctcgctgtgttcctaggctgtcttgaacttctggtctcaagcaattctcccgctgtggcctcccgaagtgctaggattgcaggcgtgagccaggacgcccagcccaaacccattttttttgagatggagtatcgctctgtcacctaggctggagtacagtggcatgatcttggctcactgcaacttctgcctcctgggttcaagcgattctcccacctcagctttccaagtagctgggattacaggcatgcacaaccacgccctgctaatctttgcatttttagtagagactgaatttcaccatgctggccaggctggtcttgaactcctgacctcaagtaatccacccgccttggcctcccaaagtgttgggattacaggcgtgagccgccgtgcccagcccccagccctaacccttgatattgataggagctttttactgccacctactgactggccttatgttaaagggctccacgtcctgcccactgtcctcccattaacacccccttacctgacccgtgtgttctgtctcatccttgtttatcaaatacatcaggaaaaacctgagggtgagaggaccacaggagacaagtcagaaccacccttaccttattttatttttcatttatagtagagaggaagtcttgctatgttgcccaagctggtctcgaactcctggcctcaagtaatcctccccacttggcctcccaaagtgctgggcttacaggtgtgaaccatcttgcggggccccacccttaccttctgattggctggcagggaatctgcccacatggacactacaccccctttcctaactggccaaagctaagtaccccactgctggctattggcagccatgccccccaccctcctgactggccagtgtgtctgctcacatgtaattggccaggttgtgctcctccagcgtgtgagtctcgaagccatgcggtgtcgtatcaaagtagtcactgccgattccacagatgaagcacttggtctgtgagtggcaagagacatcagagtggaggcccacttgaccccctgaatcccgtaatccctctgggtcacccccagacatgacctacctccatatcctccttcacttgctcttgttggtctcggagctcaccaaaagcgtcgatgatcagacctggggtggcaggacacaagtcagtgcccgacctctgacctggttcagactcccccctctccagctacctacctccagggcttgccctccatcccccatttccctaatctcacccctaatctcgcttcctaagaagatagtattaggcctttattggccgggtgcggtggctcacgcctgtaatcccagtactttgggaggctgaggtgggcggatcatctgaggtgaggagttcaagagcagcctggccaacatggtgaaaccccctcactactaacaataaaaaaataaaaaaaattagctgggtgtggtagcatgtgcctgtagtcccagctaatcaggaggctgaggcagaagaatcgcttgaacctgggaggtagaggttgcagtgagccaagattgcaccactgaactctggcccgggcaacagagcgagactccctctcaaaaaaaaaattatacatatatatatatagacacacacacatatatataaatatatataaacacatatataaatatatataaacacatatatatataaataaacatatatatatatatatatctcaggcctttattgagcactcatatgagccagacaccgagcgcctatgaactgacttaatcctgatcacaacctatgaggttagtaccattgacaccctcgttttgcagatggagaaacggaggccccgagaggtgacttgcccaaggtctcacagtagcgagaggtagagatggggtatgaatgcaggccgactggatcctgggcctgcattcttagccatggagctagcctgcctccgggccctgagcgcccactcccagcactgaccctggatgatggccaacaggatgacgatgacgaagaagaagaaggtgatgtcgaagaccaccctgtagagctcgtattcgtcacccgcggggtcctcgatctcgtccccaatgcctccgccagcccggacacccacgtacatgtgaaacaggtaacactgagggaggggagcacactggtcactcattcattcgacattcactgagtaccagccaaggccccgggataggcagggctgaagacatggtaacgactgagacagccctgggccctgccctcaaagggctcacagatacggcatcagacagggaccaacagccagaaatggtcagggctgtgacaggaacagcacgggcaggggggtgagggccaggttgggtgtggggcgcaggcagaggggtcagggccaggatggggggcacaggcagaggggtcagggccaggataaggggggcacaggcagaggggtcagggctgggatggggggcactggcaggggaatcagggccaggataaggggggcacaggcagaggggtcagggccaggataggggggcacagggagaggggtcagggctagcatgggggggcacaggcagaggggtcagggctggaatggggggtacaggcagaagggtcagggccaggttgggtggggggcacaggcagaggggtcagggccaggatggagggtacaggctgagaggttagggccaggatagtggggcacaggcagaggggtcagggccgggatggatggggggcacagacggagggatgagggccgggatgggtgggggggggcacaggtgtagggatcagggccaggataggggggcacaggcagaagggtgagggcgaggatgggaggggcacaggcagagggtcgaggctggggtggggaggcacagtgtgaccagggatgagctaggggaagcactggaagctttaacagcccgctggaggcatctgatccagcctaggtgatcag

SEQ ID NO: 16874 - DNA, 31867 bp, Human
agaagttcgagaccagcctggccaacatggtgaaactccatctctacaaaaaatacaaaaattagctgggcgtggtggcgggtggtgcctgtaatcccagctactcaggaggctgaggcaggagaattgcttgaatccaggaggtggaggttgcagtgagctgagatcacagcattgcactccagcctgggcaacaggtgaaactctgtctcaaaataaaataaaataaagaaagaagaggcctataccttcttccaagccttgacggctcagcacatacttctctgttttcatgctcaagcctaggtttagtaggcctgagtggcagtgggagattcaagtgctgggggagacctttggcctcacattcagattccaccttgagtcccatgatctcattgcaaggttagacttccattgtttaaggtaaataccattttgataactcagttacggcttttcatgtattattatgctaggagggaggctgaagagtgggagtggccctggctcctgaacacactattctctttcctgcctgaaggcctccgcatgtgccattcctgattcttggaatgtttgtcccttggcctttatcatccttcagagttcattatcaaagccacccctcacaaagcccttcctccgccaccccattcaaaagatctcttgttattttccatcccagcccctgattccttttctgtatagcactgtcaaagtgttttcaggccaggtgtggtggttcacgcctgtaatacaacacttttggaaggatgagacaggaggatcccttgaagccaggagtttgagaccagcctgggcaacatagcaagtcccctgtctccacaaaaaatttaaaaattagctggatgtggtggctcacatctgtagtcccagctacttgggaggctgaggtgggaggatcccttgagcccaggaggtcaaggctgcagtgagccaagatcactccattgcactccagcctgggcaacaagagcaaaacttccatctcaaaaaaaaaaaaaaaagaaataatctaaaagtgttttcaataataatgcatttatgttgattaccttgttggctatcctctactcgtgtgcctgccccactccattcccctttctagagtctgttcacgtaactcctcttccaggaagccctctttgactcccaggcttggtcaggtgtcttctctgggtttccccaggggcttccttcctctcaattctgatgctgcctgtgctaagtatttgtctccatatctgtcctgagaaccttggagccagggctcggggctgtttttgcatgggcctatcacctcctccaggaagccctccttggccctctctcaggctggatgggaaagctgtctgggctcccatcatgccctggttttctagcgacccagcctctgatccctaagcttggccttccccatcacagctttcatcactttgtgctaagcttccgctatcactactctgggccgttcctgtttggtgactcagggaccagtctggcatggccaccgctgggtccccagcattaagccctggagcatgagcccagtgaactttgaaattcaggaaggaattcacaggaaagctgcggcgaggcgggcagaaaaccacaggcttccaagaaacgcgtgtctgccgccccctcctcccaccctgaggccagtcctagagcgaaggccctcctccgacgtcgtcaccaagcccaagggaagggtggcaggtgctcagcgggcagacgccccgccccgccccgccaggttctgttgggggcgaggcccgcgcaagccccgcctcttccccggcaccaggggcgggcccaggtgcgcccagggccggggagcggccgcgcaggtgcctgccctttgcgcctgcgcccagctcgccctgcctagccaggtgcgccccgccccctgcctgcccggccaccttcgggagccgcttccaataggcgttcgccattggctctggcgacctccgcgcgttgggaggtgtagcgcggctctgaacgcgctgagggccgttgagtgtcgcaggcggcgagggcgcgagtgaggagcagacccaggcatcgcgcgccgagaaggccgggcgtccccacactgaaggtccggaaaggcgacttccgggggctttggcacctggcggaccctcccggagcgtcggcacctgaacgcgaggcgctccattgcgcgtgcgcgttgaggggcttcccgcacctgatcgcgagaccccaacggctggtggcgtcgcctgcgcgtctcggctgagctggccatggcgcagctgtgcgggctgaggcggagccgggcgtttctcgccctgctgggatcgctgctcctctctggggtcctggcggccgaccgagaacgcagcatccacggtgagggccgggcgggtaggctggaggcggggcgcagggggcagaggctcgggggtcaacgggggtctgagcagggagaactggcgggggaggaaactgggggctacttgatggcgttcagcgggtgtggtggaaccagccctggaggattgagccttgaaatgaggtttgggagccttcgacagcgaagacgggcggaggagcgagggttaggagagtttccttcgggtggaggaagagtcaaggggtattgaccaagaaggcgtggcactgccccttcctgtggcaagaacggggtgaggagccgaattgaagaccagccttctcctggcggtggaaagttccatggccaaagctcagggagaggccaggcctgtgagatggtgggggttgggttgggtgacctggtggccgttttagactcggaagaagcccatctcacccctgcctctttggagattggacaagagcctcccctgaagtttttgtagttgagttgcagtaaagtaggtgcccgagaaggagggagcaagaaaggaaacaagctttggggaagaggaagctctgctaaggctcgagagagtattggcgttgagcagctggtgttggggtctttggattggcccttagaagtcggtggtgaataaggtgatttaaacttctacactcttaaggaagtgtggtctgaaaggtctctttgaacaagtgttgttataaccttaactgcttcagacaagcaccagcgtgttttgaaaagagctctcttgaaagcaagaattcattgattcagcaaaacttactgaggccctgctacgtgtcaggcactggcgctggttataacagttaactcagactagctgggttcctgcattcacagagctaatattccagtgggagaggcagagctagtgaaggtttaaaaagcacttgccatgagattaagttactgagaattaaatgaaccaggtgaagtacaccaacagggtgacgtaagatgttgggggcggctttagctcaggtggtcgggggacgtctccgtgaggagggtgacatctgagctctaacatgaagaatgaggcagtagccacacggagacctgggggaccagtgtccagttgcaggcaatagagtacaaaggccttgaagctggaacaagcttggttgggttcagggaaaagacagagccagcctggctggagcaggcgtgaaggaggggaggactggaggaggatgggaggtgggagaggttggctgcagccagatggcctagggctttatagacaggtgctggtgcttgaacccgggaggcggatgttgcagtgagccaagatcgcgccactgcattccagcttgggcaacaagagtgaaactcccatctcaaaaaaaaaaaaagaaggccgggtgatgtggctcatgcctgtaatcctagaactttgggaggccaaggcgggcagatcactggaggccaggagttcaacaccaccctaggcaacatgatgaaaccccgtctctaccaaaaatacaaaaattagctgggcatggtggtgcacacctgtagtcccggctactcgggaggctgaggcaggagaatcgcttgaagcccagaggcggaggctgtagtgagctgagatcaagccactgcacagcagcctgggcgacacagcaagactcagtctcaaaaaaaaaaaaagagcaggctaggtgtgtaccaagtcatcacctgtggtaacttctggggactggttaatttctctgtgccctaggcaggagaaaaaagtgaattggtggggagaggctcagctgtaggtgactgggagtcaggaatgcagacgttgatcattcttgcaattcgaaccagaatttggcagctctgctggactttttcagtttaagtaattacgttaggatgtacctcccagttacctggcctcttgctacctctggtgcttactctgagctgggacatggcctcttgctacctctggtgcttactctgagctgggatgtgccatttaacctttgaaacagccgggtgcggtggtgaagttacttgccttgcccgaggtcactcggtagtagtaattgacaaagccaggtctcactgcagaggccttctctgttcagagtggcctacctgactgctgctgccgactggacctactgacctttcagaagtactagtgtctgactgggtgaactcatgccctcactcatcgtaagttctgtttgtttgaaagcttgaacagcttaatcggaggcagaaggcagttttgacttttttttcctcgctccttcctgattgcttctgttttctccggaagcgagtcatccactgggagtgtggtgttgctgaagctccatgcagtggctcaggtgctgctggatgagtgtggtggtgagggaggagtgaacagagaatgtgtgagggagggaggatgggggttggtcaaggaatttattctgtatgaaaacatgagggggcggagggccgaggtagatggtagggccagcagattgttggagttgaggttctgaagggaatgaaccagacagataggatgcagtgggtagtgagtgagatgcatgagagggaggttctgaagaggtggcagttactgagacaggtctaggtgtgaccctgagaggaagcgggggggcgagggtgggaggagatcaggtggaggtcttgggacctagaggtcagaggaccatctacctggatatagaaatctccaagaatgatcataagagcagcgggagaggtggcaggcccggagctaaagttgggaaggaagaagtagttgtctgggttggcagataacgtgccaggcggggtagtgaatgatttactctaataatggaagtctcccagctggggattttggggagggtggagggagaacagtccagaagcagctcccaggagcaaggagacctccccacttggaagggccccaggaggtgtgccctcaggggagattccaattaggtaagagggtggcaacaatgttcagaggagattgaggacatggaagatttgctcaagaccagtcctgagtaccagagggcccaggagttgggggaggggagatggggacaaagcaggccccaccgtgtgagagtgagggttaactcaggggtcggggcttcttgtgagaagcatcatgtggtctatgattgatgtgttggtgacgctctgagtagtgagggcaggtgggaagggacaggtggacgggccggacaaagagtgtcctgactccaacctctgcagacagaggtggggggaaagctgagcttatgccaggtgagaaagctcccctatctagcgttagggacagttaccgtctggagtggaaagcacgcagagattataaactgtccactcccaggaagcttcacacagcctttatgtgacttgtactttttccagaattgggattttttaaacgtaaaaatgtagtttttggctttgcctgaaagacatgaagatgtaatggaaccaaaccagaacacaggcctgttttcctgcccagcagtccctggcaggagccgagtacctctttcaggcaggagatatgccattccctagcctgtagatcttactcagcttgcctcatctcagctactgcttgccctctgtctctgtaggcctttggcttgtgacccctaccttaaacatatgctccatttagtaaatggtaacacgtaacagttctttataaattgcacattacagtgtgagacagagagagagcatgcgcgcgcgcgtgtgtgtgtgtgtgtgtgtgtgttacggctggctgttggggaaatccttatatcaggtagctgcagatatgcaggatttttttcttttccttttccccacccaggtggtaaatcctggtatttggagggtcctgaaatgtgtaatgttgctcaacaccaggccagatcatatatttcctcagcagaatagaaacttgaaaggtcctttaggagtggccagttaggtgtagttcttgctgccaataactttgtgcctggccctgggcatcagaacttgtgttaatggttacttggcttaaggtcttttgtttttgtttttgtttgtttttgtttttttgggtttttttttgagacggagtctctctcatcgcccagtctggagtgcagtagcgcgatctcagctcactgcaatctccacctcccgggttcacatcattctcctgcttcagcctcctgagtagctgggactacaggcgcccgccaccacgcccggctaattttttgtatttttagtagagacagggtctcaccaccgtgttagccaggatggttcaaggtcctttgttgattcttcttgggaatttccactggaggcaagcagggcaacacttatttgagaacctctcctgcaccttttttttttttttttttttttgagacagagtcttgctgtgtcactcagactggagtgcagtggcgccatcttggctcattgcagcctctgcctcctgggttcaagtgattctcctgcctcatccgcctgagtagctggggttacaggtgtgcaccaccacacccagctaatttttgtatttttagttgagatgggatttcttttctttttttttttttttttttgagacggagtgtctcgctctgtcgcccaggccggagtgcagtggcgcgttctcggctcactgcaagctccgcctcctgggttcacaccattctcctgcctcagcctcccgagtactgggactacaggcacctgccgccacgcccggctaattttttgtatttttagtagagacggggtttcaccgtgttagccaggatggtcttgatctcctgaccttgtgatctgcccgcctcggcctcccaaagtgctgggattacaggcgtgagccaccgcgcccggcctgagatgggatttcaacatgtgggccaggctggtctcgaactcccgacctcaggtgatctgcccacctcagcctctcaaagtgctgggattacaggctcgagccacgtggcccagccctctcctgcacttccaagggattttcgaaatgcatggacctctcaggttaattatagtgtctgtagaaccttaactgctgtaagctttccagcagactccacagacgtgttattagttgccaccctttctttactttcctcctcacccccatggatagtcgtgaccctggtggtcagagataagatgacagaagagctaaagtaaagctggtgttggcgatcagctgggaattctctaaaacagcttctcacattattcttatcctccatagaaggagtgcttgtcctacttgcaggcaaggcagtttggttccagggtagttcgaaatcttattcactgatatagtcagcaaatgtttattgagcacccaccaattgccaggcactgactcactcaaattagagcactgaacaaaatagaccccctcccccatccgtggcagacgtgtcataatgagaggaagacagtacaataaatgaacagatgaatgtatgtctggtgatgagtgtcagggttggtgtgcttagcactgaaaatgggggcttctgaggttcaaatggttgcagttcctaaagaaggttgagggccttgccttcaggtcaccgcgggagactggcccctttccactggaaacattgctttgcccagtcagtatttgagagctcagcctgcaatggagaaatcacacttctcctctttcaccctgctccccaccctgtttctcattttacccatccccagccatttgcagaatgcatgcagagcttctgtttgccatgtctggaggctacaggggaggctgaataaggggtgataagcctgtggctcatgtgaggcgggagagagcccagcaggagtcacactgaaatgactccattagccccaggaggccttggcccaccggccatgactaatgtggacattagagtgtggattccgatgtcctgcaagatcctcctcacaagtgtcatttcatggtttttttctggcaacatctttttgaaaactccctgtaaagaagtgctgatgttgatgctgaggcccaggaactttggagtttatttacttttttttgttgttttattttccttggcaggtgaagtaggagctagagtttacttattttgaagtttatttgaaatatgctttttatgattagaagccattttagaaatgagggcgaggccgggcgcggtggctcatgcctgtaaccccagcactttgggaggccgaggcaggcgggtcacgagatcaggagatcgagaccatcctggctaacacggtgaaaacccgtttctactaaaaatacaaaaaaattagcctcgcgtggtggcgggcgcctatagtcccagctatctgggaggctaaggcaggagaatggcgtgaacccaggaagtggagcttgcagtgagctgagatcatgccactgcactccagcctgggcaacagagcaagactctctcaaaaaaaaaaaaaatgttatgctaagtgagaggagccacttacaagagaccaccacatgtttggccgggtacagtggctcatgcctgtaatcccagcactttgggaggccgaggtgggtggatcacgagatcaggagttcaagaccagcctggccaagatgttgaaaccccatctctactaaaaatacaaaaaaaaattagccgggtgcagtggcaggcgcctggaggctgaggcaggagaatcgcttgaactcggagggtggaggttgcagtgagccgagatcacgccactgcagtccagcctgggagacagagtgagactccatctcagaaaaaaaagagggcaagaattcacatgttgttttactcacacgtgttggagatggagctcagggtgattcctgactgggcccagggtccatggcctcagaagtcccttaatctgaagtccttcacttttatgtgatactgctgggcacaatggctcacgcttgtaatcccagcactttggggggctgaggcaggtggattgcttgactgaggagtttcaacatggtgaaacaaaaaatacaaaaaactagtcagcctgtagtcccagctatgtgggaggctgaggtgggagaattgcttgagcccaggaagtggaggttgcagtgagccgagatcgcaccattgcactccagcctgggcgacagagcgagaccccatctcaaaacaattttatatgtgatagtttgtccatgtgtatgccagggtctgtcatttagagtgtatggcatgttcttaaaggggtgggggaacaaaaagatactataatagtttgtgaccttttgaagggccgctctacatgaatagatatatagtatgtctgtggtgttaaaattttgtggggcgattaggaaaaacatttccaaaaagtcttagggggaaggtagtaatgaaaaaaggttgagaaacaccattccagagagagggtccaagagctttcctcagttctgaaaatggtccatgatttgcacaaggtaaagaatggctgaatgcgaattaacagcagacagtttcttagaagatttgaaactattgtttccttcccagctattcagatggactgctcgggttcttgttatggattgaggcgagggtagacttaatagtcttgtttcagagtggaatatggagtgatggtaggcatgagtagtgatgagttgcattgtgctgataggttatgaaatgtaaattttttattttttgatatggagtctctgtcgcccagactctggagtgcagtggtgcgatctcggctcactgcaacctccaccttctgggttcaagcgattctcctgcctcagcctcctgagtaactgggattacaagcatgcaccaccacgcccggctcatttttttgtatttttagtagagacggggtttcaccatgttggccaggctggtgttgaactcctgacctcaggtgatccacctgcctcagcctcccagagtgctggggttacaggcgtgagccaccgtgcccggcctgaaatgtaaacttttatatctaaatattttatatagaaaataccaagattttatatctgaaacaccaagattttatgagcctcataacttaagtaggatttgtaattgtaaatgttctttcctcataaatacctgaggtttttttttgaaaggttctgaattgtctcaataatgaaaacttccagacacccaagcctagaggagatgggtagttggtagctttctgtactggaaacagaaacactcaaatatatagaacctagccagctaaccaaagtaggtagatttatagatcatcttaaaataaggctgattacacagtaaatgtcacctttggaatctggcttggtagaattgaaataggcttcagtacctcctgtcattcagtacctgttttcttgaactcctgacttcaggtgatctgcctcggcctcccagagtgctgggcttacaggcatgagccactgtgcccggcctcagtacctctttttaagatgctctcattcattccctggtgaaaagatgcttgaagtgcaagtgcaagtaggtgtggaaagcatggagggtttgtgttgcttcatttgttttggtatttgttttttccaccagtccctccctctggctttctgcctcccagcccagcatatcctgatcttgtagccatgcaggactttgacccgtgtggtggtttgccattgtcttcctccaggtgaagataagacatcattggtttggcttgaggttgtacttttggccttccctgtatatcctcttcctccttatcctctccgtcagcatgcttggttggactctgtagtgaaatgtgtcattctctttattctgactgtccctatattagtcctgtcttcataaaaaatacaatcgtaaagatacaatatctactatttgttaaaagttttgtgctaggccaggtgcggtggctcacgcctgtaatcccagcacttcaggaggccgaggcgggtggatcatttgagcccaggacttcaatactagtctgggcaacatggtgaaacctcgtttctacaaaaaatgcaaaaattaaccgggtatggtggcacacgcctatagtcccagctacttggaggctgaggtgggtgggtcactgagcacaggtcaaggctactgtgagccaagattgtaccactgtactccagcctgggtgacagggcaagtccctgtctcaaaaaaaaaaaagaaagctgtgtgctaaatactattttaagcaattataatggattaaaaactcctttaatcttcacaacaatgttttttctttctttttttttgagatggagttctttgaaactcttggattaaatgactcttcagagctttctttgctttttgatactaaggagtggcatgtctggggatttttatagcaaataacttctccttggctactatccttagaattccaagtgtttttaatgaaaagaggagacttgtttttagtgatgttagttgtttttaggaaaggtgttctgcagtgtttttcgctaaggtggctcacgcctgtaatcccagcactttgggaggccgaggtaggcagatcacttgaggttaggagtttgaggccagcctggccagcacagcaaaaccctatctactgaaaatacacaaagtagccaggtgtggtagtacactcctggagtcctagctactcaggaggctgaggcaggagatgacttgaacccgggaggcagaggttgcagtgagcctagatcgcactattgcattccagcctggacgacagagtgagactgtcttaaaaaaaaaaaaaaacataaaatggagaggtagaccagcttacgggaggtgttgcacttccctctgccactggagagactctggatctgcagccagggagcttgtgaaggcttcttgtccacggaaatgagggcggcagttgtgactttctggatggtggcccagaggaagcaacactggcagagcctcttctgtgaagcagctctgagagcaattttgtgacattgaaagagcaaaggataaaacgttgaaagctgatccagatctagaaaagtgtttggcaattgctggaaaaggtgtagaaatgatgcttgctctgtatcgtaagttatatggtgagaagaccacaagcacggttcaaactccccttagaaattcttttgcacagaaattaacactttaatcctaaatgtttccaatgttttaacttacagtatgctaaataaacattctttctgtttgtttgttttgttttgttttgttactctgtgcatttatagccaatagagtttttctttccttatttttttgacacagggtcttgctctgtcgcccaggctagagtgcagtggtgcgatctcagctcactgcaacctccgcctcctgagttcaagtgattgtcccgcctcagcctcccgagtagctgggactacaggcgcgcgccactgtgccgggctaagttttatatttttagtagagatggggtttcgccatgatagccagggtggtcttgaaatcctgaccacaggtgtgagccactgtatctggccaaaaaaatttttttattttttgtagagacagggtctcactatgttgcccaggctggtcttgaactcgtgacctcaaatgatcctcctgcctcggcctcccaaagtgctgggattataggtatgagccaccatgcccagcttgacaaaaaaatttttttttttttttgagagatgaagtttcactcttgttgcccaggctggagtgcaatggatcagctcactgcaacctgtgcctcctgggttcaaacgattctcctgcctcagcctccagaatagctgggattacaggcatgcaccaccacgcccggctaattttgtatttttagtacagacggggtttctccatattggtcaggctggtctcgaactcctgacctcaagtgatccacctgcctcggcctcccaaagtgctgggattacaggtgtgagccaccacgcccagctgacaaaaatttttaaatgtcattgagcagtatcatttttcccactgattatgagattgctttgtgtgatcacacactgacgggcaggccaattgctgcttgtattcagtatttggccccttatagaaaacatttgcagacccttgttctagaaaaaacagatgggtgggaggaggaggaggagaagcatttcaggagtggctttgggctttcctgtcctgcacgtggtgaggcaagaagctcttgtgcctcagctcatagcactcatgggagtctgtcaataactagaaccctaggagttatttttgcttgttttaaaaataagcttgttttggggccaggcgtggtggctcacgcctgtaatcccagcacttcgggaggccgaggcgggtggacttacaaggtcaggagatcgaaaccactgtggctaacatggtgaaaccctgtctctactaaaaatacaaaaatcagccgcgtgtggtggcgggcgcctgtagtcccagctactcgggaggctgaggcaggggaatggcgtgaacccaggaggcggagctttcagtgagccaagatcgcaccactgcactccagcctgggcgacagagcgagactccatctcaaaaaaacaaacaaacaaagcttattttaatggatataaaaacatgaatgaaataagacaccaagttcaaggtggtagggggttaatttggaagaggcagagcaaatgtgattgaatgaggggtatgcaaagggtttctgctctatccatatgttttatttattaatttatttttggagaacaaagtctcgctttgttgcccaggctggagtgcagtggcgtgatctcggctcactgcaacctccacctcttgggttcaagcgattctcctgcctcagcctcccgaggagctgagactacaggcacgtgctaccacacccggctaatttttgtatttttcagtagagatggggtttcaccatattggccaggctggtctcgaactcctaaccccaggtgatctgcccagcaggcctactctatgttttagtccttgagaatgttagaatttgatgacactgagatgtggatataccagacatggggtattttctgtactcatcagcatatttgaaatatttcattaaagttcttactttgcaaagtagacacagctgcaattatgcatttttggaaaatgattaggtactatctcatctgttttgtttttttgtttttttgtttttgagatgaggtctctgtcacccaggcctgagtgcagtggcgcaatctcagctcactgcatcctctgcctcccggtacaggtgatcctcctaccttagcctctcaagtagctgggactgcaggtgcacaccaccacacccggctcattttttttgtatttttgagctcaagcaatttgctcgtctcagcctcccaaagtgctgggattacagatgtgagccactggcccagtactatcttgctaagcctataaaattagattagattggtagtacttgggacccctcagaattctataatgtccttcttagaaggtgacagcagatctatccagcagactgtagattgttgtcttagtcaccggctgattgtcttggttaaagctctagtgacttcagaaccagagaaacttgttttccaacacattcaaagaccagtttgctttgcaattttgcaatagctgacattcagaatgcctgcgaggattttgtaagtgaggttcatatttcggataatgtgtgacttttgccatttctgatgcttttccaaaagaaagttactcttccctaaaggcaggaattctacttttgcttagatattctgaagcttatgagttcatccaaatttggttcctttcagcattttcctgttggtccgtctccgttttgaaaacatacagaatgtacttaattttgccctaccatttgtgagcatacaaaatagcacttgagtcatatttttcatgattgcttcccaatactattctaagaccaacatagcattttgtcatttcataataatagaattcctcattaaggaataactttctaaaaatgtgtccagcccatttcccccccagccctggccgtttcctttggtatgttggtgtccgtgaccctgtcattgagtgtgactgaaaacagaggcctggcagagggcctggcctttgtgagccctcagattgtgataaagaccctgaggaatgttttggcttttaggcaacctcagttctgttttcctgctgcctgttgatgcagtggctttttcttcccatcagtctgaagggtcgtgttagtgcctgggctctcatcagaccacagggaactcatcctggcactgctggctgcctcactttaaccacctcaagtctcagcattctcgtttgtaaagcggagatattattacgtgattcacagttttattgtgaccattagaggtagggcacatgatatgccaggcatcatgcttggcgaaggcaataagtaatgcagccaggtgctgtggctcatgcctatgatcccagcactttcagaggcggaggcagcaggatcacttgagaccagcctgggcaacatggtgagaaccccatctttacaaaaaattaaagttagccaggcgtggtggtgggtgcctgtagttccagctactcaggaggctgagatggaaggattgcttgagctcaggaggtcgaggctgcagtgagctgtgatcatgccactgtactccagcctgggtgacagagtaagactgagtctcaaaataaataaatacaaggtttttgcagaacagtgaatgagaaaatgcactgttgttatttgtggtggaagtgaatactatatggcctgtgtttcctgaaggaacactgcctccattaaaacaaatgagcaaacaaaatcccttttcatgacttcagttctctcaggcctgagagtaaagtttacatcatagatgcttaaaaacaattcagttagtgaaagcatgtgacaagatgagacgatttgtcttcaacgaggagcttccttccatactcacaaaaagatgtgtgtcttaacatagtaaggacatggttaaatttagtcttatttggacctaacttcagccaattaatctgctacttagaactcttttactcaaatgaaatttgagtaaaaaaaaaaaaaattttttttttggccaggtgcggtggctcgtgcctgtaaacccagcactttgggaacccgaggcaggtggatcacctgaggtcaggagttcgagaccagcctcaccaacattgagaaaccgcgtctctcctaaaaatacgaaattagctggtgtgatggcgcagtcctataatcccagctactcaggaggctgaggcaggagaatcacttgaacctgggaggtggaggttgcagtgagccgagatcgcaccattgcattccagcctgggcaacaagagcaaaactccatcttaaaaaaaaattattataataattttcaagtatatacaaagcagtgacacattttgtaaacccccatgcaccatcacacagcttcaacaactaccaacatctgtctttcagacatgtttttagtccaagttttctcttaataaagagactttttctttttcttttttgtttgtttgagactgagcgttgctctgtcgcccaggctggagtgcgatggcaagatcttggctcactgcaacctccgccttgcgggctcaagtgattctcctgcctcagcttcctgagtagctgggactacaggtgcccaccaccatgcccagctaatttttgtatttttagtagagatggggtttcgccatgttggccaggctggtctcgaactcctgacctcaggtgatccgcccacctcaccctcccaaagtgctgggattacaggcgtgagccaccatgcctgaccataaagacatgtttctaaattctcctgggacaacagtgaagttctacctttccttcctactttaccgaaggaacctgaaaataaggctgctttctgaaacttaaactactaagtcagtgatatttagagcagatgtaagcagctgtctagacacagaatggcttcccaggctcgcaagacttgtcatgaagcccccagcacgtcaacagaaagcatccaagctagaagaggcactggctcacagcagcaccccagaaaggaagcgtctcagggacagatcgtgaccgtgctccggaagagctgtcctcagccgctactgtgagcatttggcctgcctgacagattctgttggtgagaatgttcttaggaatcatacagtaaactaactttattctgacttcaagcatcgtgttccattgatgcttgctttccaaggtgttttgctgattcacatcagcatgcaacctgcttgacagaatacagtgatgttctcactgtaaattcatcacctgctgctgtggtctcatgtatcatcccgtgcgctgttagctgaggccagtgctcctgtgtctcctcagcacgagggcactggcaagagtgcatgtctgggcctataaagatgttggccaggttctaggcagggttgaattcaccaaggtaactgccatccatccctcaataggcattttttctcctacacaccctcaggcacatgccacgtgtacctggcacccttacttacgaagttaccgaattcctgccatgatactgtgggtcaccctgcttcattctcaggtgtggtgtcgggtggttcctgcctgggcgccgggtgttgttgggccctccctcaggttattggtttttgttttgagatgtaattcacatgccatatgattcacccatttaaggtgtacaatattcccctgaagtttattgtggaaaaaggctgtgtctgacactgcttaggaagctaagacacaaagcagccagaggggctgccagggctcactgtggcagggcggcggagaggctgctggcgcctctgtagctgttgggtgctcttgccttgatgctgttttcagctttggattgtaattgggtcccacgtgggtcctcttcatctcgtcttgttggtggcagtgttgctcccagcgttggggtgggcagagtcacacaccagaggacctcctcctgctgttttctctggaccttgttgattatgtgttttgtgacctttggcatattgtacctgttccaggtgtacagccagctggttttggttgatgtgtaatggacaaaaggtgcccctatttaaaaaaaaaattttttttctgcttgtagtcccagctactcaggaggctgaggtgggaggatcacttgagcctaggaggcaaggcttcagtgagccatggtcctgccactgcactccagcttaggtgacagaggaagaccctatctcaaaaacaattatataggccgggcgcggtggctcatacctgtaatcccaacactttgggaggctgagatgggcggatcacctgaggtcagaagttcgagaccagcctggccaacatggtgacaccccatctctactaaaaatacaaaattagccaggtgtggtggtgcatgcctgtaatcccagctacttgggaggctgaggcaggagaacagcttgaacctgggaggtggaggttgcagttagcggagatcacgcctctgcactccagcctgggcaacaagagtgaaactctgtctcaaaaaaaaaaaaattatcataaaatcactcgttttaagtatatcatccaaggattttagcaccttctacagagctgtgcagctattgccacaatccaattttagaacattttcatcatcccctaaagatccttttacccatcactccccattcccacccccagtaccaagcagccactcatctacttcctgtgtctattgatttgccttttatggacatactgtacactttcattcatatgaagtgtctagataaggtaccctctaacgggtgacttttcatggttagcttttttcaaatgatagggaatttcctgcttcagaagatgctttttctgctgtgctacttacctgtgatctattgtgtgggtgggatttccttggaggcatgtatgtgtttgtttgttttgcagagtagcaaccttttttgtccgttgattagtgttctgtggaacatctggtttcatgcccatcactgtgacatatttggggagacacaacagaagatatatccctagtgggtgaaacaaacctaacaaacatgaaaacaactagcgaggagtcaatgacaacatctaagcaagcgtttggctgtgggatgcttttattggagacatgtttatcaagcatcctgtgccaggccctgtgcaggttggaatgcccttgtgctgagcaggcagaggtgggtgaaggccagggttagggaggggtgataaccgtgatacaggagcagacatggagccacacagccaggctgttttcttttcaggtcgccttcaatccttccagtggaaaggcttattttggtgcaggtgttgcttctagcaattgtttctctctccctttcaagagagcgtaccgaccttttgcaagaagtgtttctggctggaattttataacattggcttttgtttcccttttactaaagtagggccagatttgagggtgccttgaaacccaggcccatcttggtgtgcccaaataggagctgtaacaagccgtggtgcaggggtaggacctgtgttgtctttggagccatgggctgggctgcaggcactcgagttaagaagcttccttctgaggctcttccagtaatttgagtgtcctgtggcctgcctgggcagagagtggacaggaaagatcaggaaaagcacgtgtgaggactaccgagggtgctgatagcgcctctccttcccaacttcacttctctggctctgacctttcagccctaagctccccttggccctgtgggatggggcagcatccagaagggtcttggagtcaggttttgttttgtttttttttttttaagtcatgtttccattgggcgtagtggctcgtgcctgtgatcccagcactttgggaggccgaggcaggcggattgcttgatctcaggagttgaagaccctcctgggcaacatggtgaaactccatctgtactaaaagttcagaaaaaaaaagcccagcatggtggcgcacgcctgtagttccagttgcttaggagggtgaggcaaaagaatcgtttgaacctgggaggcagaggttgcagtgagctgagatcgagtcaccacactccagcctggcgatggagtgagactctctctccaaaataaataaataaagttatgtttctacactggatgtgcatgtcttcaataatggggacaggggacaaaacacacaactgaaatacagttcagtgggtgggttgctgtctttattgttgggtgatgtgtttatacaaggaaggaagcactgagtgggcctgttgacgatctgggcttgggaaacagctcacaggggaactgctggaactcaaggctctggttctcctgggggatccatgtacaggtctgtgcgtgtcctttgttgccaggattgccctgccaagctaaccgggttgtgcttcgcgtttcagacttctgcctggtgtcgaaggtggtgggcagatgccgggcctccatgcctaggtggtggtacaatgtcactgacggatcctgccagctgtttgtgtatgggggctgtgacggaaacagcaataattacctgaccaaggaggagtgcctcaagaaatgtgccactgtcacaggtgagatggcagtagttggagcttttgtttttttccttttttttttttttttttttttttttgagacggagtcttgctctgtcgcccaggctggagtgcagtggcgcgatcttggctcactgcaagctccgcctcccgggttcacgccattctcctgcttcagcctcctgagtagctgggactacgggcacccaccatcacgcccaactaattttttgtgtttttagtagagacatggtttcaccttgttagccaggatggtctcgatctcctgatcttgtgatctgcctgcctcagcctcccaaagtgctgggattacaggcatgagccactgcgcccagcccctgctttttttttagacagggtctcactgcagcctccacctcctgggctcaagcagaacctcccacctcagcctcctgagtagttgggactacaggcacatgccaccacaccttgctcattttgaaattttttatagaggcgggggtctccctatgttacccaggctggtcttggactcttggcctcaagtgatcctcccacctgggccttccaaagggctgagattacaggcgtgagccactgtgcccagccagattttgctctttagagacaatttattaactggaatgtggatactttcctctctttattagttcttgacagtggaatctgggtgacgttttaaaaagcagaagaaacaggcaccgtgtgaatgtcctggtggccgtacagtggtttcacagcagaccctcactcctcctcttcccagaaagggagcaaaacaacagggcagagctggggccagcgtgacccagcttcctttctcccactttactaagtgcaagtttcagagcagaccaaagaggaagtagccttgccttcttgagcagaggctttttgatccactccgacagggctgcccctcttgttccctgggtatttgggttattttattttattttgagacagagtcttgctctgtcgcccaagttggagtgcagtagagcaatctcggttcactgcaacctcagcctcctgagtagctgggattccaggtgtccaccactacgcctggctaatttttgtatttttagtagagatggggtttcgctatgttggccaagctggtcttgaacttctggcctcaggtgatctgcctgccttaacctcgcaaagtgctgggattacaggtgtaagccaccgcacctggccgctatttgggttatttttaattgtgggacaagtgacttgaatagctcacccagccaagttaccgatcaagttaaaacaaacatacgtcctggaatccatcctctttgcggccctcacctgcgaggagttctgtggaatcaaggtaattttgaccctgataacctcacagtttaaattaaaacctaaacctcccagcagcgtgccctggctcttagctgagtgagaaggacttcctgagagctggtggtgatgagacattggccctttggggctgctccatcccgagtgttccagagacccgagggtttggccatccaaatcctatgttaaagattttcacttttttctttttttctcgcttagtcgcctaccaggctggagtgcagtgatgtgatcttggctcactgcaacctccacctcctgggttcaagtgattctcgtgcctcagcctctcaagtagctgggactacaggcgtgcacctccacacctggctaatttttgtgtatttggtgaagatggagtttcaccatgttacccaggctggtctcaaacgcttgagctcaagcaatctgcctgcctcccaaagtgctaggattacaggcgtgagccactgtgcccagctaaacatttcactttaactgaaaaaacaaacaattacactggcctttaagtaaaaaataaataaaaatattttcagcggcactccccctaacatgtttttttgatgacttggtgttgtctctgtgagccaccgttgacccagttactgtatttctatcgtcagctgtgattcattatgaaggaggacttgggagaactatcttttgctaccttttctgagctatcccagtcaagagttgcctttagcaaatgtatctgtccatcctggctgtttgttacctcctcaggaagggagctgaagtgttgagaactcaggcagtagacagtgaacatagccaggggacatgagtggctgtgtgttcctgggagcaggcaggttagctgtctccctagagtccggccccgccttgcaggtccagaaagcacatattggcatctgactggctgcaatgtgtgtctctcgaggcgctcccatgtgagtctgtaaagagctaaacactgccagggctgctagtgcctggggtcctttgccggcatattctctcccaggcaggcaggctctgtgggaaggcaagtgagaatgagactgccagtgtattaattcatcatgagaaccaggaccgccccggggagcaggcactcgtgtccccgggcccacgcctttagtccgcataggcaagtctctagtccagttgccagaagactgcttgatgaagagagaggcagaacgcggggagctggtttgcaaggtgaccgtttaatagcatcaggctaggccaggcccgaggatgcggaggagccagggttccctccatcttggacgaggtgtgggagataagcgctgtgtaaaatgtatcatgtgggccgggtgcggcggctcacgcctgtaatccagcactttgggaggccgaggtgggcagaccaagaggtcaggagatcgagaccatcctggctaacacggtgaaactccgtctctactcaaaatacaaaaaaaaattagccgggcctggtggcgggcgcctgtggtcccagctactccagaggctgaggcaggagaatggtgtgaacccgggaggtggagcttgcagtgagctgagatcgcgccagagcactccagcctgggcgacagagcgagactccgtttcaaaacgaaaaatttgtcatgttaacctttaaaaaaagtgtcgtgttttgttttgtttttctccccccaaagagattaggtctttttatgttgcccaagctggtctcaaactcctggcctcaagtgatgccccccacccttcacccagtgtaagcactggtattacagttgaattagttagatgagttgatacagttaagcaattatttggccctggaagtcactgtgttttgattgtttgtttctttctttgagacggagtttcactcttgttgcccaggttggagtgcaatggtcaatggtgtgatctcggctcactacaacctctgcctcccaggttcaggcgattctcctgcctcagccacccgagtagctgggattacaggcatctgccatcacgcctggctaactttttgggtttttttgtttgttttttgagacggagtctcactctgttgcccaggctgagtgcagtggtgcgatttcggctcactgcaacctccgcctcccgagttcaagcaattctcctgcctcagcctccggagtagctgggactacaggcgcgtgccaccacacccggctaattttttgtatttttagtagagatgggttttcgcagtgtcggccaggatggtctcgatccctgacctcgcgatctgcccaccctggcctcccaaagtgctgggattacaggcgtaagccaccgcacccggccctaacttttgtatttttaataggttttgccatgttggccaggctggtctcaaactcctgacctcaggtgatccacctgccttggcctcccaaagtactggaattacagccatgagccaccacacccggccaagtcactgtctttttaaggtcactttgcacatctctgctctgattccctgcaagttaatcttaagtttcctcttcgggaggcaatcttggttccttatttccaagttgtggtctggcatgcacattgaaggtcccatgtaaaggagaagtggatgctgtggtgagaggcgcacagggccagctcattctttgtccctggcagtctctcgaaagctctttcactgtgctgtttctttgtccccttgcagagaatgccacgggtgacctggccaccagcaggaatgcagcggattcctctgtcccaagtggtaggttcttaaagagacccgcgatggagtgaggccaccggatgggtcattgtgaaaggacacttgtcatttgggaactgtcacaggcttccctctcatggttctgtttactcaaaattggcaaaccgggggctctgcctgggctgccggcttctggctccagcatccttatgggggagtttatactgtccagctgacacaggggccggggatcctgcagcacttcctggctggcccccatctcctcctggaggatgggatggaggtggctgctgcccatgaggctcaggcccctccttgctgtgcgggcctccagctgctctgctgaccccactccccgcccaccctcctgtctgcctgttctgtctcctctgcttcctttgctccctgttgccatcgctgtcccctgccccgtgggcatcctctgtcctctgccacccccgcctccccgccactgcagcttgtgatctcaagatgtgtgttagcttgctttgtagtgctggcggctgctgccccattcctcctttatggtttaaggactctgcatcgggcgcctggggtgagtggtcccgatgcactaccaggtagcaaatgcaccctcggggcagacctcaggccatggactctgggaggctgctgtggagggggtactgcaccgcacccctgctggaggatgggactcccccggcagctgctacccaccgagtgcactgtagctcagcagctgttgggccggctggcttgcagagtgctggggcgttagggtggtcactttccagctttgctaggcctggagtcctgtgcctgtcctggctttgctctgcctggctccctgtttatcctctgctagcccccccacacaccagctctggtttccatcttgttggagaggaacatgtccccctcactgtattagaaagtgtgaacaagaccgtgttccctataatattaggagctgtggcaggcttggtttctataggaaccctgaggtggcggcagggccaccacatccagcactctcagtgtgtgcgtagagcccattagggctggggtgacgtggcagagccggccatggaaggggctacacaccccttcttaaaggcgtgtccacactcctcagtgggcccttccagacccagacccagctaggcctgtgtcctgtgtccggcccagcctccctaacacagatgtttgtgtttcagctcccagaaggcaggattctgaagaccactccagcgatatgttcaactatgaaggtaaaactccaaagaggccaggtgcggtggctcacacctgtaatcccagcgctttgggaggctgaggtgggcggatcacgaggtcaggatatcaagaccatcctaacatggtgaaaccctgtctctactaaaaatacgaaaaattagctggacgtagtggcatgcacctgtagtcccagctactcaggagactgaggcaggagaattgctcaaagcctgggaggcggagggtgcaatgagccaagattgcgccactgcactccagcctgggcaacagagtgagactctgtctcaaaaaaaaaaaaaaaaaaaaaaaaaaaaactccgaagaaacttatatatggggcaaaacatgtattcttagttgggtattgagagacacttgcggattttcactgaggaagttgtagagcagggctctcccctccccaggtggtggcagccccctgaggttggggtcaaggtgacaggccccacgtggatgccgccagcagtgggaaggaggctgcgcctgtggagatgtgcgttagaggcgtagcctggcacgtggctctgcaatttacattgtccctgaacctctcgccagcggcttggctgtgggcaagtgactgttgccccgcctcagagttcccatgtataaaatgaagggtcccagataggtctcatagagactcagccactgcatgtaaaaggcctagaacagggcttggcagagagcagccttcaaagctccgaagccgtcacctggacccaaggagcagcgcgtcagagccgctgcactggtcttgggtgtaatttacaggcttctttaccagagagatgtttctccgtctgctggagccgcaagcctcctcaggcactttctggcttgcttcccctccttgcgggccctactaatttgtattccctgggctgtcttactcctagaatactgcaccgccaacgcagtcactgggccttgccgtgcatccttcccacgctggtactttgacgtggagaggaactcctgcaataacttcatctatggaggctgccggggcaataagaacagctaccgctctgaggaggcctgcatgctccgctgcttccgtaagtctgcagcccctcagcccaggaagccctgcccttgaggaccccggtccatctccccatccctaaaatatgaaggccttggaaatgctgttcttgggcccaccagggcagcaaggcctctaagccccagaaaagctggaagaaagcccctcagaaagagctccccatggaggccctggctgaggggatcccctgcggcagctctgtggaatgggggctgtgagctgacctcaggctgtgtgttctcttccaggccagcaggagaatcctcccctgccccttggctcaaagggtaagtggccccttaccctcctcctgccatcagcctgcctcctcccttccttgactgagctcagccctgcccagctgtggtttacattatccttcactgtgaacatcatcttggcagaaagtcatgtttctgcgtgagaatggcgaggtggtggtttgtcccaccgttcagtgtacacagttggggctggagtgagtcagtcacaaggcaggccctgcccaggcggcgtgggtgactggggatgaggtcttcctgttgagcatttgaggactgctgcacacgggcctgaggctggcctgaggtgtggagggagcgctgctatgtggggcataagagttggtcacgggtgacaggacggaggaccacgggccagggtgtttcccaacacagtctggtctgagcgggaggccaggcctctggcctgtgtttctgagcttgagttgcaggtgataatgttggcacaaaagacctgccatgccagtctggcctctttctccacctgtttcccggtgaaggagccaggacctggcctgcgagtctgtcctgttctagcagtgaagcctggtttgccaggcacggggctgggaagcaagcagtctgggtctggagggtggccccaaaaaggccaactctgcagctccacagccacatgggggaggctgccacaggtcacactccttagccggatcccctcctgaagaaaagcatctgagctgaccagcgagactgcagtggggcagacactattaaatttgctggcacagctctgagtaccccctcgcttccaccctgacttcatcccgcagtagctctcagccctcccagcccctgcagggccacgtctttctctattgccggtcagcgtgtgtgtgcacaaagcccctaaggtttcatgtgtacacaccggtgctaagtgttttttacacccttgtgcatctctcggcctggggctcctgtgcaggttgccctgagagttgggtttttagttcaaaaagaaggaacacagatgactactctgctggcgacacggccactctgctggcacgcacatagcatggcgcctccttttttgggggactctccttggtggcatctctggcaggctgtgtcctctccagctgcagttctggaccctgtctgggttggggaggggcatttggtcctcaggctgagcccacctggattccccaggcccttggtgagcgccactctggctgcaactccccttgcctggcccgtcctgaggcccctctctcgtcctcagtggtggttctggcggggctgttcgtgatggtgttgatcctcttcctgggagcctccatggtctacctgatccgggtggcacggaggaaccaggagcgtgccctgcgcaccgtctggagctccggagatgacaaggagcagctggtgaagaacacatatgtcctgtgaccgccctgtcgccaagaggactggggaagggaggggagactatgtgtgagctttttttaaatagagggattgactcggatttgagtgatcattagggctgaggtctgtttctctgggaggtaggacggctgcttcctggtctggcagggatgggtttgctttggaaatcctctaggaggctcctcctcgcatggcctgcagtctggcagcagccccgagttgtttcctcgctgatcgatttctttcctccaggtagagttttctttgcttatgttgaattccattgcctcttttctcatcacagaagtgatgttggaatcgtttcttttgtttgtctgatttatggtttttttaagtataaacaaaagttttttattagcattctgaaagaaggaaagtaaaatgtacaagtttaataaaaaggggccttcccctttagaataaatttcagcatgtgctttctttatgggagtcctaatttcaaccctaccaaaatgatcacaagacactatctgaggtgtcccattctagaaatagacccctcaaaatagcgtctttcagatctttttgaatgaatccacaagatgaaataaatgtcctattactgagtgcccgtgaactttcgccaaaccacacttagcctcaccacctgtgaacactgatattttattactctatttcactttttaaaacttctggctacaaccctctgaactgatcttgatgtcccactatagactgtagcccacaccttgaagcactgccctcgagggcgcaggaggggcgcatgctgtccagggaggaccaagaccttccggggttggaggggcttaaccgagtccttgtggcgtccatgacgcttctcctctcgtggttctgtgctctctgcatcttgaaggggtggtgggagggcgctctaggtcaggccttgcaccgcctgccctgggcttttctgtcaagtctccaacacacccctgtgtgggaacggggacagagaactgcccggctgaatttggccttcaggcccaatcctgctgcctcctgtgggtgttcctttcctgacactagactctagaagcccctttcctccctcctctattccaacaaggaggtcctggggtacaggcatctgggcgccccatgaggtccggcaagcagctggactctacctgcctcagagacacaggaggagtggccaggtgcagtgccacaggccagactgctttcgactgcttggaaccaaagaacttccatgtctttcccttggcccttcctagaaatcccttagggcttaaaactctcttccagaagcaagttgggcaaatagctcatctgctcctgccccgcctccctcacagcagatgccgcaaagggatcctggtgtcctcccagctgatccccgcatgcctcagcccactctccagtggtcattgcagctggctcggggttggtgaacaagtggaatctacttaccacgtcccagacaaatcagacacacaggggtctgggcgagcctgtggtccagggaaagagggcctgggagttgggcagagcctctccacctgcagcgctctgtgtgtggcagtgggcgcggcccctaacccctgcaagcctgcagagtctgcacatgcacctctgcccagcaggagtctttctccaccaactccaatatggactgtctcctatctcagtcatgttgaaaaaaaaaaaattgtgcctttggacttttttaaaaacttgagaattggccgggcacagtggctcatgcctgtaatcccagcactttgggaggctgaggtgggcggatcacctgaggtcaggagttccagaccagcctggccaacatggtgaaaccccctctctactaaaaatacaaaaaattagccgggcgtggtggcgggtgcctgtaatcccagctactcgggaggctgaggcaggagaatcgcttgaacctgggaggcagaggttgcagtgagccgagatcacgccattgcactccagcctgggtgacagagcgagactcctttcaaaacaaaaaagcaacaaaaaaacttgagaatcacttaattctaccataataggaagttagatgaagggaattctctgaagcccagttgagcttctgtaggtttctaatacaatgagcctttatatgtttctagtgcagaagctgctgctctgtgacccacttctcctgcctaaacctgccccttctcacggcaagggaggcctcagcccctccgctcctggcagctcaactccatccgggcctctggactctttccagggcgactggtgggcctcaccacagcagacactcttcaggctgctgccgccgtggcccttgaagctcagctgtgtcatgtgttcaattcttggggcattttacggcctgacaaaggccctctttttgttggaaaggccacccaacagtgggtcagtggcctaggcatt

SEQ ID NO: 16875 - DNA, 14255 bp, Human
taacaatagcactataacacccctaaactggaaaatatccagtctgaggtatagggcatagtcataaaatggaaaccatccagaatgaaaatgaaagaactatttctacacacggtatgcatgaatctcacaaaaacaacattaactaaaagaaaccaaacacagtacacagagtactggtctagagagaaggagaattcaaaacaaacaaaagtaacccagctgttacaagtcagggcgagtccagccaggcacagtggctcatgtctgtaatcccagcactttggaaggctgaagtgggaggatcatctgagtccaggagttcgtgaccagcctgggcaacacagcgaaaccctatctctacaaaaaacattttaaaattagcaaggcgtggtggcacacgcctgtagttccaggtgcttgggaagctgaggtataggattgcttgagtctgggaggttgaacctggagtgagtagtgatctcaccactgcactccagcctgggcaacagagcaagaatctctttcaaaagatatatttttaaaggctacatggggtgggtcatgcctgtaatcccagtgctttcagaggctgaggagagaggatagcttgaggccagcagttggagactctagtgagctatgatcgtgccactgcactccagcctgggcgacagagactctagctcttaaaaaaaaaagaaaaaaacagatgaatgataacctttagaagggatcgggaggccggatgtggtggctcacgcctataatcccagcactttgggaggccaaggcaggcagatcacttgaggtcaggagtttgtgaccggcctggccaacatggtgaaaccctgtctctactaaaaatacaaatattagcctgggcaacagagtgagactccgtctcggggcggggagtggaggggggagaagaagggatgggggaaaggggagcacatgaggcttctactgtttggttttgcgatctggattcaggttgtatgggcatgttcactttgtgtaattttgtcgagctgtaatgatttgtgctcttctctttatttaacttcaataaaaggtttacttaacaaaaattgtagctggtgtgaagggtagcagtgtttccctggggccaagagtacaggctttggggacagacagacctgggtcccaatctatgctttgtcccttcggcacattgttgactgtggctggtggcttcgtggctctgagcttgtctccttctctataaatgaggaaacataatacttgcgacgatgatgcctgtaaagcttaagcgcaggacctggcatagatctgtaaggcggaaacctgggatacagaactaaggtctatggatctcctgtgctacccaacttctgggcactcgctgcctccttttccccagcccagacgcgtgggttctactcgattggttgctcactgcgggctcggggctcctcaatcccggggtaaagcccagtatgaaatgtcaccttcaggggcagctcggatcttcccacgcccgcgcggcgcacaatctttggatcagcgccacgtggagaccttacccgcccgtacgatcaatcccttctgtggaacccagctcaaggaccctccagcccagacactagaaagcgaagagcagttggccgccagactgtccgtgccagagctctgcgaacttactccgttgaaagagcaacggggctgcgccacctcccggagagaacccccagccctccacggcagggcgagatggcgccaccgcgtgatactgcgcacgcccacagctcccgtcccgccctcgcgcctgcgggtacggacagcgcatgagcttatgttgagggcggagcccagaccagcccttcgtcctatcctgcccttccagcacctctcagccgtaacttaaactacacttcccagaagcctcctcagccagggacttccgttgtcgtcagcggaagcggtgacagatcatcccaggccacacagaggccggcttggtcactatggaggagataggcatcttggtggagaaggctcaggtacagtggggacttgggctttttagtccgggccgggctcgcggggagagggtgaagccagacctgagtggggggaggaatggcttccaggaccccggcccaggttggggttattttagaggcctcggtggagagctttgtgccattcgaaggcctgtctgggtggccgagtgatggtaggaggtaaggctcagaaagcggggctgggggagtgagtgacgttagtgggtctttgagacggattgatttcgaaccctggccggtagtgcttagtgaggtcggtggcccggcgttgggattgggtcaggcggtgagtgatatatgggatcccgccgtgcggccgagtgatccccgggtctgggctgcggggctgactgatgttcagggctttgctgatgggggtaatggggcgggtagttaagtattatctgtggcttgcctgagtgatatttaggtctaaggtgagttaggagactgtgacataagggatctttgaggggaaactggggaatgttgggactcgttgaaggcgcagtcactttaacagcctatctaggagagccatgtgacattaggaacctcttgaaggggattgggtggcatttgggtctgataaggagttgatgtgacgtttagatcctagttgggggttgtgtgacactggggacatgttatgagtggtatatgataacataagatctgtttgaggggcaagttgacataaagagcttgtttaggtggccaaaaggtttccaggatctatttagagggtcttaagatatcaggggtctgttaggggctaagtgacatcagggtgaagtggggaggggaacaaacattagtgaagttgggaagctttcatgagaggactgtcttcttccaatgtgagttatcccctttcgtctaggatgagatcccagcactgtccgtgtcccggccccagaccggcctgtccttcctgggccctgagcctgaggacctggaggacctgtacagccgctacaaggtacattcgacccccaacccagaccttgcacaggacctgacatctcatactcttccccactttccaccactctctggatcagcaagtctggagccatccccttctgtcccctctctgctcgcagaagctgcagcaagagctggagttcctggaggtgcaggaggaatacatcaaagatgagcaaaagaacctgaaaaaggaatttctccatgcccaggaggaggtgaagcgaatccaaagcatcccgctggtcatcggacaatttctggaggctgtggatcagaatacagccatcgtgggctctaccacaggtgtgctaaggacacctcattcattcatctgtccacttaacaactatttcctaccatgtgctaggcagcagcaaacaaggcagggcagtgcagtgcaatgttcttcagagtattttgactgatcgaaaggtagaaatacatacatatatatatatatacacatatatatatgtatatctatgttttttttgtttgtttgttttttgttttgagacagagttttgctcttgtccaggctggagtgcaatggcatgatctcggctcactgcaacctccacctcccaggttcacacgattctcctgtctcagcctcccaagtagctgggattacaggcatggaccaccaagtctggctaatttttgtattattagtagagacagggtttcaccatgttggccagtctggtcttgaactcctgacctcaggcgatccacccgcctcaccctccgaaagtgttgggattacaggcctgagccccactgcacctggccagaaatgtattttacattgtgattatctgtatctgtctcttactttttagatagatgtgtaaaacataagtttcaccatgaaatatttagccttactaggtgtggtatatgctgatgttttctatcctattctagtctgttttgctttaaacacagttctggtcatgaccttccaaattgatttcacaactactactggtttggggcctgcagtttgaaacgatgagtaggagtgttaagagattgggctctgaggccaggcatggtgcctcacacgtataatcccagtactttgggagactcaggtgggcagatcacttgaggccagaagtttgagaccaggctgggcaacatggcaaaaccccgtctctactgaaaatataaaaattagctgggtgtggtggcacacacttgccatcccagctacgcaggtggttgaggcacaggatctgttgaacccaggaggtggaggttgcagtgagccgagatcgtgacactgtactacagcctgggtgacagagcaacactctgtctaaaaaaaaaaaaaaaaaaaaaatactgggccctgatagggactcagagtccttatcagagtatattgtagctgctgctgtttatataggtctaggccttgccctcttgatagtcattgtcactggcatcttatctgttttttcttgtttctgggctctgctcctctggaccaagccatgttcttgtaaaggttttggagaaaggtgtgcgattgtgcctggaattggactggtgggctatgaggaagtgaggagagggtggtatccaggatgaggcctttctctttgacctgtgggagttgggatagtgtggctttccctgagatggcaccatgggtagaggagtaggtttgtgggaagacagggagggcagtccagagcacatgggaggtgtccaggaggctgctggtcagccaggtctgacaatcaggagagagactgagcctggaaacagaagtgtgcctcactagtatgagatgcagggggaggcctgctggacagccagggctggatgtcaagagagaatcagggcggtagacaaggagttcgtgtgaatactggggacggacagcaggagggaaggctggaggccgagaggggacccctcagggtctgaaccagagatgttggggtgtggagattaggagggaggaagggggaaggggcagtttccaggctgacacttctcgttttcctctctcccttctcgcaggctccaactattatgtgcgcatcctgagcaccatcgatcgggagctgctcaagcccaacgcctcagtggccctccacaagcacagcaatgcactggtggacgtgctgccccccgaagccgacagcagcatcatgatgctcacctcaggtaaagggggagcctgcagctgggagggccccatggggaccttgaggacctggccaggagccccagctctgctctcccaccagaccagaagccagatgtgatgtacgcggacatcggaggcatggacatccagaagcaggaggtgcgggaggccgtggagctcccgctcacgcatttcgagctctacaagcaggtgaggcggtgcaggtggcagggaagggagaggccccattgggtctggggttggaggtggaacccctgactcccacttctcttccttcctctgggtttcagatcggcatcgatcccccccgaggcgtcctcatgtatggcccacctggctgtgggaagaccatgttggcaaaggcggtggcacatcacacaacaggtgagccctttcgcccctgccccgagctctcatcttctggcctcttcgccttgctccctgctcgctcactggcactgcacagtaattagaaacagactctggggtcatagcccacgtgtgcatgttactggctgtgctgacttcacctccttgggcctctcctagtagttgaagactcatttcacccggtgatagtgagcagttaatgaaataatgcagtgttttcctacaatgggttgtgacctattagtaattatgaatttcaatttgtgggttgcagccagtattttgaaacatgaaatagaacagaaagcgccagagaacatccacatggtatttataccatggtacaagtatatatggtgcaagttcatctgtttcgtgaaacttgtttcatacagatgtgcacactcatgtatacttgtggttcttcaaaaatatatatatatattttaattcttaaatttttttgtagagatagggtctcactctgttgcccaggctggtcttgaactcctgggctcaagggatcctcccacagtgctgggattacaggcgtgagccatgtgcctggccccaaaaatgtatttcttattgtaggtgccagacaaaaatgtctgaaagtcactcactctataacttttttttttttaaagccctaaaatcttaagcatatgttcagatcttaacacatgtgagccagggagcagtaggaggtagtagttaagcagtatgttttctggggctagactgcctggctttgaaatcttactcccccagcaacttcttatgtgatcctgggtaaattaacctctctgtgactcagtttcctcacctgtcagatggaaacaatcatagtacctatttttctagggtgggtgttcagaagagcaaattgatacaaagcatctggaatgggcaataaatgttagctgttgtcattgttactcatttgcttggtactttattgaacttttactctgtaccaagccttgtgctggaatgcaaagatgacaatcagagatgtcccttgccttgactgggaaaaaagaaaaagacacctagaactcagtcattcagtgactgtttattgaacacccactatgtgccaggatgtgttgtagatgctagagacatgggccaggcgcggtggctcacgcctgtaatcccagcactttgggaggccgaggtgggaggatcacgagatcaggagatcgagaccacagtgaaaccccgtctctattaaaaatacaaaaaaattagccaggtgtggtggcggtcgcctgtagtcccagctacttgggaggctgaggcaggagaatggtgtgaacccaggaggcggagcttgcagtgagcccagatcacgccactgtactccagcctgggcgacaaagcaagactccatctccaaaaaaaatatatatatatatatatatatatattaattagctgggcgtggtggccagcgcctgtagtcccagctactcagcgtgaacccgggaggcggagcttgcagtgagccgagatggcgccactgcacttcagcctgggtgacagagtgagactccgtctcaaaaaaaaaaaaaaaaaaaaaagaatagagacgtggcagtaaacagaacacctccttatggaggtgatgtcttagttggaaatgtggcccgacacagattcgtaaagtttcttttttttttttttgagatggagtcttgctctgtcatccaggctggagtgcagtggtgcgatctcggcttactgcacgctctgcctcccaggttcacaccattctcctgcctcagcctcctgagtagctgagactacaggcacccgccaccacgcccggctaattttttgtattttttagtagagacggggtttcaccgtgttagccaggatggtctagatctcctgacctcatgatccgcccgcctgggccttccaaagtgctgtgattacaggcgtgagccaccgcacccagcccgtaaaccttcttaaaacatgagattttttgtgtgtgatttttttttttttttttttttgagacagagtctcactctgtagcccaggctggagtgcagtggtgctatcttggttcactgcaacctctgccttctgggttcaagcgattctcctacctcagcctcccgagtggctggaattacaggtacatgccaccacatctggctaattttttttgtacttttggtagaaatggggttgcaccatgttggccaggcaggtctcgaactcctggcctcaggtgatccacccaccttggcctcccaaaattctgggattacaggcgtgagccactgcacccggctgtgatttttttttttaagctcatcacctatcattagtgttagtgtattttatgtgtggcccaagacagatcttccagtgtggccctgtgtacccttcacccagattccctaatgttactatcttatgtaaccatagtataattaggaaaaccaggaaattaacagtggtacaatacaatgaactaaagtttagacctccttcaaagtttaccagcttttcccactagagaccctcacttcaggttctgtcgtttttctgagtgaattggggtggtttgtcactggcagagggagggaagagagaaggtgtagaagggatgtagaaatgggaaaagctgctgactggggttgagttttgttttgttttctagagacagggtcatgtctggcaaggcgcggtggctcacggctataatctcagcacttcaggaggccgaggtgggcagatcacgaggtcaggagttcgagaccagcctggcaaacatagtgaaaccccatctctactaaaaatacaaaaaaattagccaggcatggtggtgggcgcctgtaatcccagctactcgggaggctgaggcaggagaattgcttgaacccaggaggccaaggttgcagtgagcgaagatcgcaccattgcactccagcccggccaatagtgcgagattctgtttccaaaaaaaaaaagagagatagggtcttgttctgtcacccaggctggagtgcagtggtgtgatcatagcccactgcaaccttaatctcctgggctcaagcaatcctccccacctgtctctcctaagtaggtgggactacaggcgtgtgccaccatgcccaactaatttttgtatcttcattttcagtagagacagggtcttgctatgttgcccaggctggtcttgaactcctgggctcaagccatcctcctgcctcagctccccaaagtgttgggatcacaggtgtgagcctttttttcctcttgtttttcggggggaattcatctatttgttccggtgacagcacagcttactaagagtgagtaactgaagcaggagcccattccaggataggtggaaggagtagtagagcccagggggagctgagagattgggaggacagggaaggttggggtaggaaggggactgtagtgattgagtaggaaaggctgacggacaggctcggtcagataaggcaattccagggatgggggtttcatgtggaactggttggacatttgcagaacagccaagtaaatggccaaagtcaggtggtcaaggtgtgttttctgtttagagcagaaaaagtcagaaatcttgaggttaggatgctgaatgagcccccagctgatgcaagtatcaagaaagagggaccccttgagccaggtgtaaagtctggatcttagggagtgaacagggcagggctgaagccttgaacagttcctagcttatgacataaaaccactcagtctatctatggactgcatgtctcccttctctggtggctggaaggagagtcctgggggtatgcttcatacaacacaaagcatctgatccttaagaaacaagtgtaactttaagaaacaaggccagggtcaagcatggggtggctcatgtctataatcccagcactttggaaggctaagccaggaggatcgcttgaggccaggagtttgagaccagcctgagcaatatagcaagaccccatctcctcaaaaattttaaaaagctaggtgtggggacatgcctatagtcctagctactcgggaggctgaagagggaggattgcttgagcccaggagattgaggctgcagtaagctatgatgataccactgtactccaagtccaaagggagggcccagaacaaatctgtcttcaaccccattgccaattgtcagttatatcagaacatgcccgtggtccctgatctttttcaggaaattaaaaagctggtccttatagcaaacaggaactcagagctcttggcgaggcagtatgatgtcttagtgtatgggcagcatgcctgttttcttgctgattttgcaagtgctccagaaatgtagactggtttttttctttcttattttagtatttcatatcctgatttttaaatgttgggccaaaaaaatgacacatctggctggacatggtggctcatgcctgtaatcccagaactttgggaggctaaggcgggcagatcacttgaggtcaagagttcaagaccagcttggccaacatggtgaaacctcgtctctactaaaaatacaaaaattagcttggcatggcagtgcacgcctgtaattccagctactcgggaggctgaagcaggagaatcacttgaaccctgaaggcagaagttgtggtgagccgagattgtgctactgcactccagcctgggcgacagagcaagactctgtctccaaaaaaaaaaaaaaagtgacacatttgtaaggatgattcatgatttaggccactgggtcactgtggggtacaagtagatggctattcctcagggctggatgtggggctcacccttgggcatgagggaatgacacaactactaggtatgggtatccaaggaaaaggatgtcttcaaggaattcgcagtttctgttaaagcagaatgggcccctcaggaggctcattcccgcctaactgttgtcatcctgtcatcagctgcattcatccgggtcgtgggctcggagtttgtacagaagtatctgggtgagggcccccgcatggtccgggatgtgttccgcctggccaaggagaatgcacctgccatcatcttcatagacgagattgatgccatcgccaccaagagattcgatgctcagacagggggtaagtgatgctgaaacaaggcccggggtcttggacaggcttgtcgcatgggatgcctgggactgactgtgctgtgcactctcagccgacagggaggttcagaggatcctgctggagctgctgaatcagatggatggatttgatcagaatgtcaatgtcaaggtttggggtttgggatggacaaggggaggtgtggtgtaggaactggggaaagttgggggctggcacctaaggggtggttatcgtgacaggaaggaggtaggagtgcagagatctgagctggcctgccccccaatgtcaggtaatcatggccacaaacagagcagacaccctggatccggccctgctacggccaggacggctggaccgtaaaattgaatttccacttcctgaccgccgccagaagagattgattttctccactatcactagcaagatgaacctctctgaggaggttgacttggaagactgtatcctgctccagaagtcagggaggggccctagttgggaacggggattagatcttcagctcaacttctgccagcaccacagcccagactgtgcaggtgggaccaaggtccagggaggaggggaggtgacagagatggccaaagatgacttccagccccaggcatttaccccatcacacagggaatagtttccttaactcgctgcagatgtggcccggccagataagatttcaggagctgatattaactccatctgtcaggaggtaagtggtggtttctctctggatccaggcagcgggtgtgtgaggacccttcttctctgaaccactctgctgcagtcctgtcccctcatggctgccctgggtcgtgggcgccatctctctcttcctctaccatcactaggggtggatagtacaggggtagtgtttttgtgttttgctttgagacagggactcactctgtcgcccaggctggagtgcagtggggcaatcatgactcactgcagtgatcctcccacctcagcctcccaagtagctgggattacaggcgcccaccaccagtctggctaatttttgtattttttgtagagacagggtttcaccatgttgcccaggctggtctcgaactcttgggctcaagtgatctgtatacctcagcctcccaaagtgtcgggattacaggtgtgagccactgtgccctgccacaggaagtagattttaactctcatccttcaacagagtggaatgttggctgtccgtgaaaaccgctacattgtcctggccaaggacttcgagaaagcatacaagactgtcatcaagaaggacgagcaggagcatgagttttacaagtgacccttcccttccctccaccacaccactcaggggctggggcttctctcgcacccccagcacctctgtcccaaaacctcattcccttttttctttacccaggattggtttcttcaataaatagataagatcgaatccatttaatttcttcttagaagtttaactcctttggagaatgtgggccttgaataggatcctctgggtccctcttaatctgacagatgagcagacgaggtgcatggcctgggttgcagcttgagagaaccaaaatattcaaaccagatgacttccaaaatgtggggaaagggatggaaaatgaacctgagatggagtccttaatcacgggataaagccctgtgcatctccctcatttcctacaggtaaaagacagtaaagaaattcaggtcacaggccttgggagttcataggaaggagatgtccagtgctgtccagtagaactttgcacaatgatggatatgttctgtgttctccagtatggtagctgctcgccacatgtggctaataagtacctgaaatatggctagcatgactgagaaactgaactttttttttttttttttttttttttttttttgagatggagtcttgctctgtcacccaggctggagtgcagtggtgagatcttggctcactgcagcctctgcctcccaggttcaagtgattctcctgcctcagcctcccgagtagctgggaccacaggcatctgccaccacacccggctaaattttgtatttctagtagagacagggtttcactatattggctaggctggtctcgaactcctgacctcaaatgatctgcctgccttggcctccctaagttgttgggattacaggcgtgagccactgtgcctggtcaagaaatggaactcttacacactgctggtgggaatgtgaaatggtaagccacttcggaaaacagtttgacaatttcttatgctaaaaatacacctatcagatgatttagccacttctaggtatttacttaagaaaaaataaggcatacatccatatgaagacttgtaaataaatgttctcattatttttatttgaaatagctaaaactggaaacaacccaaatatccatcagcaagtgaatggataaacaaattgtaatatttgtatgcaatataacaccactcagtaatatgaaaatgaactactgatgtatgcaaaaacgtgaaattcaaaataattatgctgagtgacagaatccagacaacaaataatacataatgtattattctatttacataaagttttagaaaatccaaactaatctaagtaacaaagcataccaatggtatatggggcttggggcaggtgagacggattatagagaaaaaagtaggaggtgatagacatgtttagtttttttgcttgtttgtttttactgtggtaatggtttttcaagtgtgtatgtcaaaacttatcaaattgtacctaatttattgtagttttattgatacctcaataaaattaatagttacatacataaatgtacttgaagttccacctagcacaataaggtaagaaaaaaaattaaggcgtgggactggaaaagaaatgaaactcttcattattcacaaatgtcatgattgcatatatggaaaatctaagtctacacaaaacctattaaaattaaatagtgaatttagcaatgtggctaaacaaaggtcaatataaaatattaaatataagccaggcatggtgacatgcatccacagtcccagctactcaggaggctgaggcaggagaattgcttgagcccgggagttcaagtccagcctgggcaacacagcaagacccactgtctctgaaaaaaaatcaaatacatatatcagcaataaataaataggaaattaaattttaaattataacatttatcaaataaattcttaagtgccaagaataaatttaaaatatgagatataaatagttaaaattacagaatattgacagaaatcaaagaagacaaataaatgttgggatacaacatgttaatgtattggaagattacgagtaaaaatattaattctccacaaattgatctataaacaacgcagcgccaatcagaatcccagcagttttgtcctgctggaaactgacaaactgattctgaaa

SEQ ID NO: 16876 - DNA, 10733 bp, Human
gaggtgactgagcaaacccaccttgctgtatagagtgttagaacatcgctggaggaacaagaaaaacagaacacaaaatagaaagagtgctctgtaacaagaagcatggttgctgggttccaaactgtgattaaattttttaaaaattttaactgtattatgacctttatttttaaaatgtttatacaaatcatttaagtaatataataccttcttgtgggtaaaattcaaacattacagatttataccttgacctcatttcttctaaacccagtgtccccccctacaaggaatgccttcttttgacattttctagtgcatttatgaatgtttgtgtgtacttatgagatcaattttatttttttgtcgttaaaataattggtctcgtattatgcatgttttcttcatgccttttcatactacagcatttcttgaagatatagccatgccagtactgataattttgtttttcttttatatatagtctatgtactggctacttaattaaaaactgtactgtaaaaaatttcaaatgtttgcaaaaggagagaactgtcatccccagattattttagagcaaatcccagatattatataatttcatacacaaaacctaaagtttttcgggggaacagtgtgtgcttggaaagatgtagttgaaaagaaagactgaaagcaagtcgtagggcataatggatttctgaagaaatagttgcaaccagcagaagtatgggctattgtgcagaggatatggaagttaaagaagatcaatctctctgcatcactgaaaggattgctggaatgcctgagaagtaaataacatcaacatctttatccacagcttactaggtggccagacgccctgaactgatatttcttccccagttcagatgaatagctgggatattactcaaaattctattgcatatctgttgcaaggaaaagcagttcctctttcccttctgtggtaatttcttacaagctacagtactgggcagggtgtgagggtggttgcctagaacggggtttccaaagctccttaattgtggcctctgacccttttcattgcttccatgtccatacccagagtcaaaacccaaggaatgcagtgggatgacattacaaattaatcttaaggaaatacgttatataccaaaagaactgtgtgattgtgctgatttatatgagcagaatcttggagtgcatgcttggaaatgaattgtcaaggttttagatcagggaaagtggaatttattgtcgggtcaagcacaactaatattaatgctaatgcatcctcatcgcttagctcccacttatgagtgagaaatctcacctttctccaagaatctgcaggagaacgacagcctcagattttgattcacatgaaaagaaatagggaaataagagggcgtacctaaagcccaggtgtctgagagacagagtgggagtggctctcacctggcagagccaagggatctgagggtgggtaaagaagacacaagtgttttctctacttctgtccccaggtcctgcgaatgatcaagatctatgctctcccagaaccactggagaaggaggaggaggattttctttcaaagccaagtgccttgcccccaggatctccagctttttaccattgcacaggttaggagaatgcacaccttcctggtagattctgcacagtggagaaaaggcttcatgagaagcatggaggctggaactcacaccactcatcctcactccatcgtctttatctgtgcatttccctggtgaccccttcctcctccagtacctccctcactgtcgtttctgctgcatcacaggcacaggcctccaaacaggtgtggttgtgactgagtctgtttctgacaccccaccccttctcactgtgtgaggaaaccttcctgggaggggcttggaatcaggaataaagccagaggcagggctgataggggccatttaaattctgcagctcagagattcacacagaagtctggacacaattcagaagagccacccagaaggagacaacaatgtccctgctacccgtgagttaaaaaggcacagccttcaataatctcaggtcacacagaaaagggaagagggagattttatgggatgaaaatatgaaaatttctactgtgaatgctttactgagagttgtgggtgtgtggaagagagaccctagggctatggtatctgagatgctcctggggtaggggggtagggggtgtggatgctggaacattgtgaccctctgtgagcatgtgatggtatctgatgagagtaaactctgctaaaaatgatgtgactttagacgggatgtgtatggccctccaggatatgggtgggtgtgtaagtgattgtaatcaggtgactgtgttttgtcttcatgactgtgatgtgagtgtgtgtgtgagcacagccggaccagtgcatgagcatctttatatgcacagtgagcaggtgtgtgtgactcagtgagtggcacggctctgtgtgactgtgagtgtgtgtgctggaatgtgactgggtgttgaactgggaacatgcatgtggccttctgtgcatgtgaaggttcctccccacatagcagtactctgtctaacttcccttgtgcatcactgtggatccccggtgacagaacttgtgggatcttggggcccttgagttaccgaggacttatctctgagcatttatgagagcagaatgcatgaattctcaggtgccttttcccaagcagaatgggggtgagaaacagatgatggggctgatggttccttaggtggaatctgcacacagtgaccactggctcctgcctccagcctcaggtctctccctgtctcctaccctagcctggccttcccattgagtgccaggatgctagagaaggacattgagggacttgatttaagagactgaatcacccaaaaccaggaaggtacaaggcagagcttacagtggatattcatcaagatgtttgctgaggcctgtagtctcagcactttgggtggccgaattgaaaggcccatgtcaggccaggactggtagaccagcctgggagacatagcaagatttcatctttccaaaaatttaaaaatttattgaatgtggtgttgcataccgtagttccagctgctggggggcatatgcaagaggttcactgaagcccaggccttcaaacctgcagtaattttttttttttttttgagacagagtctcactctgtttcccaggctggagtgcagtggtgcaatctcagctcactgcaacctccacctcccgggttcaagcgattctcatacctcagcttcccgagtagctgggattacaggcttgtgccaccactcctggctaatttttgtattttcagtagagatggggtttctccatgttggccaggctggtctcgaactcctgacctcaagtgatgcgcccaccttggcctcccaaagtgctgagattacaggcgtgagccaccacgcccggcctgcagtgagttttgatggtgccactgcattccagcctgggtgacagtgtgaccctgtttcaaaaaagaaaaataccatccatttatagattctagccaataacttccctgacccacaatcttcatttgtgcaagtactgcggttgtgctctcagcaatgtgtgccccttctgggaaagatgtccattgcccatgatgattgtgatgtatgtgcctcccacgcacaggggtttcctgttctttcctgttcgtttccctctctctttcaacaagtgttgtttctttctttttttttttttttggtggttaaaatgataataaaaaataaaactcacaatctcaagttagaaaagatgcagagtacctgaaacagtcaaacgatgcttggagggatgtaaaatgatacagctacattggaaaatcgtttggtattcccataaaattaaacataaaatcaccaaacaaacagaaacactttactcaccagattttagccaagtaaacactttagtttatggaaaatcctatacagaaatgtttatagtgtcattatgtgtagctgttctcaaattgaaactaacccaaagttgttgtttcttactggagtgaatctctctactgttacatcctcacatcttgttttcacagtttcagagttgaagatgatcgcaggtcagtgttccacaaggaccctccttgttcagatagaggacccccaacaggccctatacgtgccagggtttaggctaaagggtttacatctattaactactgtataactgaaaacatgatacaaagtaggtatttcggattatcatctttgtattgggaaaactgaggcagggagagtttaagcaatagatctaaggtccccttgctggttgggcaaagtggctcacccctgtaatctaggagtttgggaggctgagacaagaggatcccttgagcctagatgctccagaccagcctgggcaacatcgtgaaaccccaactctccaaatacatataaaattagctgggtgtggaccaatagtctcagctactcaagaaactgaattgagaggatggcttgagcctgggaggttgaggttgaagtgggctgtgattgtgccagttcactacagcctgggtgattcaattagaccctgtctaaaaaaaaggttcaaaacatgttaacatctcactgctagtagtcagcacaataaaggatctaattgaggtagctcagtttctgaagctctgctcttaaccatgggccccattgttttgaaaaatacggggtcctgactgaggtagggtgggagcagggaggcctgagtctactgcttgatctctaactggctgcaccatgggaatctgttacaggaggggaggccacacctggccctgcctctctcacccactctcaatcccctggcaggtgccatacacagaggctgcctctttgtctactggttctactgtgacaatcaaagggcgaccacttgcctgtttcttgtgagtactccatggtgcaaagatgggaggtggagaagaggaagaatattttctaagggggtgacctcatgtgtgaatcatgtggaaagtctagttggcaggatggaagtgccatgaatgtgcaggtcctggagaccctccagcaccaggaacaaaacctacagcagctgcactgggggctagtcatgggtctaggagtaaaggacactcaaggcttggggctgtgacactttatctattaaaaggcatagaatattcagaaaatgggcaattcatatgaccaagtcagtgactatggctcagtttccatctgtggatgagggctggagcatctctttccacccatggagaacacaaggagctgaagcagccccacaatgacaaggcctagaataccaacaagtctttgctcgaccacggaaggggcaaagagacttgtgtgtgtgtcttgtgtgtgccccacaagaatgggacctgctcaacactgtgtgctctgccctcaggaatgaaccatatctgcaggtggatttccacactgagatgaaggaggaatcagacattgtcttccatttccaagtgtgctttggtcgtcgtgtggtcatgaacagccgtgagtatggggcctggaagcagcaggtggaatccaagaatatgccctttcaggatggccaagaatttgaactgagcatctcagtgctgccagataagtaccaggtgagcaccccaggagctccccgcacccggcttccatgggatctcagagcaggaggcagctcttcatgccctaactccagataactccctctgtccccggcttttcatcacccacaactccccttatcccaggcttttcatcacccataactccccctgtcccaggctttttatcacacacacaggggttccctttacttttatcatttccctctctcattcaacaggtgttgttgcttgctctgccatcacctctccttgcactgccatcctcagctcttttcccatacctgaccagggtcaatgtcggttcacttgccattttccccaaatggagaatatcctctatcttccccttatgatgttatttaaattttcatgtagctaaatggataagatatacacatgaataaaattgttttagtcagtccaatatgaagacttctcactcctcaatcccaatcctcagaacaatattactagcttctctactcttcttccatagtctatccttatagaagcatatacatacacccatatatacacttttatttgtttttaaacaaatgctggtatcaatgtccctacacattacactttaggaatgacagttgagttgtactcaaagaatatatattggagaaataatctatccatggtgctgcctcatttttttaaggattacataatattcccctagaaggatttcctcaacttgctgtacttgaccctttacaagagcactgagttggtttccaatgttttgctctcacaaatgttactgtattaagctttctaatcaacccttttttcattgccaacttttccctatttatattggaacatgattataaagaaaaggaataactggttcaaagttgtatggattttaaatttgagaatgaaacctaaaatatgactccctgtgtagcctcagtaataaagaatgtgatcaaagtttctgacatttcaaatgggtaggccaaaacattcacattttattcagattaaagtcagaggtgtttttctatgtttatacgctgttaaagataatatcctcatagtggttttgatttgcatttctctgatggccagtgatgatgagcattttttcatgtgttttttggctgcataaatgtcttcttttgagaagtgtctgttcatgtcgttcgcccactttttgatggggttgtttgtttttttcttgtacatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttggacatgaagtccttgcccatgcctatgtcctgaatggtaatgcctaggttttcttctagggtttttatggttttaggtctaacgtttaccgtctcacaccagttagaatggcaatcattaaaaagtcaggaaacaacaggtgctggagaggatgtggagaaacaggaacacttttacactgttggtgggactgtaaactagttcaaccattgtggaagtcagtgtggcgattcctcagggatctagaactagaaataccatttgacccagccatcccattactgggtatatacccaaacgactataaatcatgctgctataaagacacatgcacacgtatgtttattgcggcattattcacagtagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaaccaaacactgcatattctcactcataggtgggaattgaacaatgagatcacatggacacaggaaggggaatatcacactctggggactgttgtggggtggggggaggggggagggatagcattgggagatatacctaatgctagatgacgagttagtgggtgcagcgcaccagcacggcacatgtatacatatgtaactaacctgcacaatgtgcacatgtaccctaaaacttaaagtataataaaaaaaataaataaataaagaatttaataaccataaaaaaaataaataaagataatatcctatgttttgtaacattaatccagccccacctctctaagaacacttgagttacattccttgccgccactagctcaaatatgagcaattccagagagaaactgggtcatcagcagcaaatagcagtcataatttatgtagctgaaatgtgtgcattcagtggacattgttgagcacttaccctgtggctggccctgtgcaagatgcagggattcaagtttatgaaacacagtccctggccttggagatcttccaggatagaggggaggctgagcaaatatggcccatgtgacacagagtgacagagcctcactggagaaatgagaggaaacattgaaaatacagtgagcaactgtctcagatagttacaacaggtagtctgtaaaaaagaagtgtgtctactgggttcagatatataatgaggcattttctggttggatgtttcaggtactatgacaccatagagagcaggctgaaagcttgtttggtgaaatactgtctttctgatgtatttttttccttctgtaggtaatggtcaatggccaatcctcttacacctttgaccatagaatcaagcctgaggctgtgaagatggtgcaagtgtggagagatatctccctgaccaaatttaatgtcagctatttaaagagataaccagacttcatgttgccaaggaatccctgtctctacgtgaacttgggattccaaagccagctaacagcatgatcttttctcacttcaatccttactcctgctcattaaaacttaatcaaacttcacagaatttggttcttgctttcatggggagaaaaagtggtcatcatcaagagggcttgggggattttatagatggtgtgaacaagtcaaggaggataaatcttcctgagacacaaaaagtaagtgaaaaggccactgaaatgtctgagaaggcattagcaaccacatccttctatagcatcgactatatgtcagacactctgaaccaaccctacccaatttcatatgagtcactgaggtgtaagcaatgggactgggggcttgaataactgatccatgacagggtgggtggggctgggtctgagctgagcagaactgagtaggaacctcactctttacactgaaaacagaggagtaagaacacttgggggctcccattaccctacctgaactccaaatctcatatgtcccttcactttactaggaaaaatgccaagaagaaaatctccagagaaagaaactcatatgctcgtcccctcagttcaggaacaaggggtatacaacaccatttctcgaaaggtagagcccagatgcagaaatctgatttgttcatttaaagaatgctcatgggtgaccatgcccttctcccatcctctttgcaaaccgagaaaggaaaaagtcactcacagagaagaagctgtaggctcaaacagtgaaaaggggagatactactttacagagtgtaaatcttggtcatagacggatagaaggcaaaccctttgatcagggcacacaatgacagctctcactgatggtctctcctgtaggcctcattcatctccacccacacacacaaggttaggacacctccatttccactgcctcccctcacccagtaaatcctaaccattgatctcagaaaacccctccggatgccccagccttatcgagagtaaatgttctccctggagtgtctcatttggggagaattctgggccagccccctccatctgaaatgctttaaagactttaatcctcagagtgtcttgatccctgtcttcccagtaggtctctgtgttattttggacaatttatttctattcaccagtcagaaaggcagacactttcttgacatttcagggattcaattggctttttggccactctccttgaaataagaaattatcggcacgaggagatcaggataattttgcagagaaggcaatgtttcaatagcctcaagctagaagtcattcaatatctatcaagagtaaactgctgagtatgtcttggccaatttataaaactccagagtggagataagtgaaaaggaaggatctatagctccacacggcaacatagatgaatcctaaaaacagaaatgttttagaaaagatgcatgacccaataaaaaaaatccaagataaacacctacaggcaaaattaaacaaagtaataaaatgaaagcaaagcaaaaaagaaaggcaggagcatggttgccagtaggggcaagaaggtcacgtgataaggaagggacacataggagtccatgtgtgttagcaacaagccacgagtacaattgtggtggctaaatgagtgctagtttaatcatgaatttatcataatatacattttttgttaacttggatgaagttttcaaaaatagtttaaattcacagtcaataaaactgaagagtaaaataaaaagaaaggagggagggagagggatttgaattcatttcttctttaaattcctatacagattttaaggatgttttctgttataacaaaaagagaacttgaggaggggtcctgagtcctccaccccaagtgaagactgcgttgtagctgaagtctgatcacctgcacctgtccctgtcttcatgcaggttttgagctaagtagcacacaaatcaagcgctagacttaggaatctcacctttctcccagaatctgagtctctgagattttattgcacatggacacccagagaaaaatgagagagtgtggatggagcccaggtgtgtgagagatggagtatgaatggccctcacctggcaaaggcaac

SEQ ID NO: 16877 - DNA, 15923 bp, Human
gagcaagctagcaggcaaagtatctcagaagcaggagatggtgccaggattccaagaaatagggctggaatcccctaaatctgcactgcactctgagtacttttgtcctttagaagaaaaatattaattagaaggcaaatagtaaaatccatgtgaaataggtaacattatccggaattggacccactggaatcattgcacatctagaaatccagaatagactcaactatttcatctcatagtttttaaaaagttttttttgtttggtttttgtttttgttttgggacaggggtgtcgctctgtgacccaggctggagtgtagtggtgcagtcatggctcatttcagcctagacctactgggctcaaaggatcctcctgcctcagcctcttgagtagctgggactacaggtgcaagcaaccatacccagctaattttttattttttgtaaagataaggtctcactctgtagcccaggctggccttaagctcctgggctcaagcgatcctcctgcctcggcctcccaaagtgcctggattacaggtgtgagccactgccccgaccggttctgaaaagtttaagcagattttccatcataatatctaaacaatctttcaggaatgtttctgtgcaaattggtggcattccacagctggaacactgtacacagagaactcacaacggtatgaggccatccattcattcaacaaacatttactgggcacccagagggctgtcctaggcctagagtgatagagcagtgaatggaacagagtcaacatctaggctctggactggtaggttcttctggattttttcggtaacttctcataacagcagttgtcttgctttgcagaatgaatatagggatggatactgatattacacaattacaaagcccaaaattcttaatacttaagcagaatctgttgacccctgacgccgctctctgcccccactctgatctgtctatccttttcttctgattcacggcagcagccagtccttggttttcctgctttcaccctcactcctgcagtctgcttcccacatgcagccagagggacctgtgtcagatcacattccttctctgcttggaacccttccatggttccatcttactgcctaagtcctcactatgtcccacaaagctccgcacaatctgcccttgttagctacccgcccttatctcctcttactctccaccttgctcactttgccccacccaccctcctcattgtctctccaacttcccatatctttccttcctcagggcctctgcatctgcagatcttttccctgcatgcaactctcttcccctagataggtgcatgcctcactcctcacttccttcagccctttagctcaaaagtctcctgatgcattccttgaccaccgtgccaaaaaaacaaaaatcatttgccctccaaaatctctatcccctttccctgctgttattttctccaaagcacttatcgctttcaaacattcaacatgtttggtgtctatttcctccattaaaaagatgaactccaggagagtggagatttttatgtctcgtacaccgctgtattcccagctcctagaacagcacctggtacacacgaggtgcactgtaaatgtttttcggatgtttgaatggaagcccagagtcggtcactgttcttggggctggaaatgtattggggaagcctttttgggtgtacaggggccagagggatttagctaggaatacaaaagagggcacagcccgtgcgaaggctatgagccctgattattggggtgctcgcattggggaagaggaaaccggaagcgagtttagggcgaccgctgcacaggcaaaggctgggaaggcagagagcgagggcagcgggttgcgtgtcgacaggctcgagaatccaggctcactgcgcgtgcgccgagctccgggcggggaaggggcccgggggcgggactacggggtggcgtcacgcagcgcacgtcgccgcgcgcctgcgctcttttccacgtgcgaaagccccggactcgtggagttgtgaacgccgcggactccggagccgcacaaaccagggctcgccatgaagccaggtcaggctggggtgagggtccggggtcagggacggaggccgggcgggaatccgggtgccaggccagaatcggaggggtggggccttggcctgggggcaggggttctgagcacgggttccagtctcctgtgggaagggggattctgattccagcaggtctaggggtttgtgactggcttcagaggtcacggtcgtgagtcgaagaaggccgtgggcctggcattgggggtgttgacgtggggttcgtctcattgaggccgtctaatagggattttggatattgggcaggaggcggcactcaagggtcttgggctagagtttggattcaggcatctggagtcttggatcgctgggcgtgttttgggaatcaggcttgggtcggagatggagagttcctgaccttgggtcctggagctgtgtgtgggaagcccccatttgccttccctgtcgctgccaccaccaccatccccttatcccgcatcccagcttttccgagtgggccggagtggatgaggactccccggttggccgtgtgcggcgctctccggctcactttcccgccttctgcacttacagtggggcggatccccggggatggagtggagatttggggattaagatttccacctccgggacgagacttaacaagctcggcattagtctggggtggtggggcgggtggttgtcacaggaggtaagtagttttattcttaagattttccactagattctgctgaaaccactcccttcatggtggaatgatgagggggtcctggctttgacagcagaagggcctcagttcagtgtgtcagctcttgctcagcttcttagcctgctgtgtgaacttgggcaagtggctttacctctctgagcctctgttttctcatcaataaaatggcgccagttaggattaagcgacgttaaaaaaaatagcacagtgcttgacatataatagtattagctctaattgttacctttatctttctcaaagagaacaacattagaatccttctcggtggtgcctgagcacttcctccatctggcctgcccaacccgcactcatctgtgtgagaacttgcttcattgagtttggagaatttccaccatggcccaaagggtctcttttcctagtacaggctttctttttcttttgtgtgtgtgtttgtgtggagagatgggggtcacctggcaggagatttgtggatctgtgcccttctcccaagttccctttctcttccgtgtttggggatctcttgatgaagtggggtgggggattgtaggccaggtatgctgagatcctggcttgcctgcaggcattctggtctgtgattccctcataaatggaggatacccgttcttccaaccttcctccatgtgtggtagaatgtgaagttgtaaaagttgtcaggtgttagctctttagtaaggattttagcctgagtgagaaaagaaccctttgggagatttttgagcaggggcgtggtgcagtctgacatttttaaaagggattctttttgcttcgatgtgtgaaagacctcagggtggcaaaagtggaagcaggcacattggtgggaagcttgttgctgtaatctaggagatggtgtggtggaccaggatgggagcagtggacatgctgacagttttacatgcttttgaagacagaaccaacagattgtatgtgggtgtgtgatcggagtcaaggataaccaagggtttgggggtgtgtaactggaaggatggaattgccatttttgagatggagaaggctgtggaaggagagcagattttaaatcagggggtttatggacccccctccccccaaaaaaagaacttactggaaaagtttgtgtgaacatgtgttttttctgaggactgggtacttttggtacattttcccccaaaagctccaggacctgaaacggattgagatgttttgagtatctgggattgaaagtttacactcatgcccactccgccccaagcacatgccagtacttcctttctgttaggcctgggttgagactttcataagcctagctgtggcatctcccctaaatgaaggtcttggctttggaaaactgttggagggcttgggcaagaaaattgagatctgagttgctgtttcaaaaacagcacttattagttgctgtgtggaaagtggactgtagggggagtagaacattaaaaagtgaacaactcttagttatgttctagagttttgaaaaggaaacttcattttaaaagatcaaattaggagtagctattaaaagttacattttcatctttaatagaaagatgaaaaaagaactaactggaaaagtttgtgtgaacatgtgttttttctgaggaatgggtacttttggtacatgaggagggaagaggagacgcgtacccctgagtttgaatgatgatgttcaaagtaggtgccagatagtatatatgtgatgtgctctgtgggtacaagtcatttaatctttacaaccctataggatgagcactgcattttttttatttttatttttttgatacagaatctctctctgtcacccaggctggagtgcagtggcaccatctcagctcactgcaacctccgcctgtgttcaattgatgcttgtgcctcagccttttgagtagctgggattacaggcatgcgccaccacgcccagctaattttttgtatttttagtagagacagggtttcactatgttggccaggctggtcttgaactcctggcctcaaactgtccgcctgcctgggtctcccaaagtgctgggattacaggcatgagctatggcgcgtggcctggcactgtattgtctccatgtcttacagatgaagttttcaagacccctatgaaccttccttactagggtcgagagtggcagcaacattgcctatctctccatatgcgatacttgaggggagtgaccggcacttccctggtcaccatctgatggattgtgtgctttctgaacaaatagagggtgctttctccttgaggcagggcccagggtttaagagtcatcagctcagtgctcatttaacatttattgagcccatactttgtgccagatgttgtgcagggttttggggatgcggtggtgaccaaaacagttaaaaatccctgcccatttggagcttgatcttagtgggggaggcaggtggtaataatattaaaaatgccatgtgtgataattgatttgaagggaaataaagcagggtaagggtactgtggccaaagtaggcccttctggggaactaacattttatcagagaccagaatgcagtgaaggagcgagtgagccatgcacatgtctgcaggagccaggcagtgggaacagcacgtggtaaagatttagaagctggactgtgtatgcttggtggggaagagcatggggcccagcataaagagaatgaagtcagggaagtcagcacaggccagatccttaggatgatgatactcaatgtgggctgcaccttggagtcacctggagagctttaggggaagaccttgcgcccagaacaatgaaatcagaatttaaagcctaaagattttaggctttgatttcaggctttgtaagccagggaaaggactttttatttcattttggatgtggtggaaaaccattggagggatttgggcaagggcatgatgagatcttacttgctgttttaaaaatagcatgtattagctgctgtgtgaaaagtggactgtagagggagtagaagattaaaagtaaacaacttttggttgtttgggagttttgaaaatgaaaccgttcatttttaaagattaaattaggaatggctgttaaaagacacattttttatctttaataccattaaggtgcatgaagggttcgtaggacaagatcataatgtatctttacaaaaaacatgagcaaggctgggcgcgctggctcacgcctgtaatcccagcactttgggaggctgaggcgggcggatcaagaggtcaggagattgagaccatcctggctaacacggtgaaaccccttctctactaaaaatacaaaaaaattagccgggcatggtggtgggcgcctgtagtcccagctactggggaggctgaggcaggagaaaggcgtgaacctgggaggtggagcttgcagtgagccgagatcgtgtcactgcactccagcctgggtgacagagtgagactccgtctcaaaaaaaaaaaaaaagcaagcttatgattgaatagattacatcatgtgagaatgtgagataattttaaaccactagttttccaactattttttttaacttgtgtgatttagtacttctgagtttttgaaaccaaatcagagaaaatattgaatctgttagcaccagagttctgttttaaacgttgttttgtgctaatggtgtttgttgtcctgaactggtaagaataaagcctgtctgagtctgttatttcttaaacatttcgatcttactgacaagtcgcaaactacttgtaaagtgcagcctatccttaaatgacagtttgttctgctttttcttgtttttcccctgagctgagagggacttctttaagcttggaagcagggagatgagttagggctgacatcatcctgtattcccctctgttttggggctggggttgacacttttcttccagctccaaggtcaggagtgggagagtatgaagacgtttgcagagtctagggggccctgttgtcacagcatgtgctcgtatgcagggctcactcttcacagtaattaatattgacatggaatgaattctgtgaatctgctatgcaaccaaggaaaccaggatattaacagtaacctacatctattcatgtactcctcccctatcccaaccccatattaatatctccttcccattcaccaatatcatgagttttacatttctcattcccttgctccttttcttgggcagtatgattgtggctgggtgtggtgcctgacacctgtaatcccagcacttcaggaggccaaggcaggaggatcacttgagccaggagctggagactagcctgggcaacatagtgagacccccatctctacactatgggagtagtggcacacacctgtaatctagctacttcagagaccgaggcaggagaattgcttgagcccaggagttcgaggctgcggtgagctgtgattgtgccattgctctccaacctgggcggcacagcaagaccctgtctcaaaaaaaaagcactaagcaaaaaaaattattatgattttaacatttattagtctgttgtgtataactgaaggtcattttcatgatcttgattgtgaatgtcttctattttatttgcccattctattgatggacatttgggttagtcttcacttttcttttgctgtggacattcttggaaatgtgtcctgctgtacacgggcacatgtatttcaggtttctcacctgagaggtattgctgggtacaaggtggtttaaccttttaagcttcattgccctgactcctgttttgtttcccccacaggattcagtccccgtgggggtggctttggcggccgagggggctttggtgaccgtggtggtcgtggaggccgagggggctttggcgggggccgaggtcgaggcggaggctttagaggtcgtggacgaggaggaggtggaggcggcggcggcggtggaggaggaggaagaggtggtaagattggctaggggttacagaggaggccttcctgaggtggggagtggggagggcggagattcaggatctttctctcctgttgtacctctcctttataggtggaggcttccattctggtggcaaccggggtcgtggtcggggaggaaaaagaggaaaccagtcggggaagaatgtgatggtggagccgcatcggcatgagggtgagtgaggaaggcagggagccggctgagcttcggggcagggagaggctgggggtcctcacccctgctctgatcccctcacccaggtgtcttcatttgtcgaggaaaggaagatgcactggtcaccaagaacctggtccctggggaatcagtttatggagagaagagagtctcgatttcggtgagaactgggcccctgtccaagccaccagggtcgcagctgagggtgtagccagtagtctgtgtctgccctcaccatgtgtcctgcacgtgacagctggaggattgtcataatatgtaaaccacactgtctgctccctcatccgccttctgtgactccccacggccttccagttagactcctgagtcttcactcaggcctccaagaccctgtgcattccagttccccctccctgccccctggctttgtctccttcactaactctctgaccaagtgtcctccagccaccctggccttgctgttcccactcccagctctgtgggaggctgcgtccttatcatctgcttctccaggctgcgtcacaccactctgcgggtcaaggcatccctcaccgccctcccctgtcctgttatcctgtgtcattttctttgaggccagggtgtgcctgccttggggccttcctaatcgctctccctctcgtgggaatgtccttcctcagataacttgaatggccccttgcctccttcaggtctgatttggaatctgcctttcagcccctccctggccccttttcccattttcacctgctccttgccctgcttcccaaactccgtatcttctctcctggctttgtcttctctccttaacacctgtcaccatctcatatgccatgttgtatttagttagttcggtgaatacttacaccttctgggcagggatccttgttttgtatccccagcgcctagagcagggtctggcacacagtaggtgctggcacagtgcatgtttgttgaacaagtgctggttttactgttactgtttgtgtttattctcttttgctgccctttgggtcagtcacctccatgagagggcagcgactgcatgtgcatggtcactgctctttactcatgttgagttcttgtgcagtgataggacagcccagttcctttcaaggctcctagggttaaaggcagtgaggtcctgcagaagagcctagcactgacttctgtccccatctctcatctaggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggtgagtgagtagatggagagtcaggcaggaggtaaaggctgcctcccttctgccaacctggaatatcagggtttgactgcttgcctgcgctgtgtgacttagggccaggcccttttctgtcactgtgcctgtgagtaaaaggagtggcttgaaccagataatgtcattcaacctcactcctgggttcttggcctcaagggaagagacgtgggtgtggggtgaccaaccttagagagacaacggggagtatagataccagactatttgatttgatgggcctctttaaaattttatgctgctaaaacctgctcttctggtttctttagaaagaaccaggagatcttcatggtttctgagcctgtataggcttcccatttagagggcccctggcacccacgtgtcccactctgttaccctttgttactttatgtgtttataagctgttaagtgtagtgccttaaaacctcaggctttggccagacgaggtggctcatgcctttaatctcaacactttgggaggccgaggcaggtggatcacctgaggtcaggagttcgagaccagcctgaccaatatggtaaaaccccatctctactaaaaatacaaaaattagctgggtgtggtgacgtgtgcctgtagtcccacctacttgggaggctgagacaggagaattgcttgaacccaggaggcggacgttgcactaagctgagatcgcacaactgcactccatcctgggcaacagagtgagactcaaaaaaaaaaaaaaaaaaaacctcaggctttaatcaggcaagttacctaacccatccaagcctcagtttacctgtctggaacatagacttgtgaagattaaatgagttaatttctgaaaggtgcttagagcagtggttggcccattgttacatcatctctgtgccttggcttcctggttttaagcctctgttgggaacctgggctctcaggcagatgggattgggtacttttgctacttgctgaataactcttggccagtgactttatgtctggacctcagtttattcatgtgaaaaatggacatgataacaatagtcattagatggtagggttttgatttgggggttggaagagatgctgtgtatagtgtatgggcctaaagtaggcactccatgcatgagaactagcatcactgttcattaatttttaatttattttaggatggtctagtctatgcagtcgagttctcccaccgctctggccgtgacctcattaacttggccaagaagaggaccaacatcattcctgtgatcgaggatgctcgacacccacacaaataccgcatgctcatcggtgaggggtctgggggtggccccggtggggtaggacaggccaccgcaggcttctggaagaagccagtggatctctgattcggatggagttggagtggatgagcagacctcttgagtctgcaggaatagaaaggggtaaggggagctaggtgaggttgtggaggtggcagcttggcttcagagtcttggaagccacccttggagggccaacctcttctccttcagtctcctccccatctcctaggtctcctgtacttcctgcctcttgtatttattacactacccctccataaaaagcctccttttgggggtcctaatcattgtctggtgagagcatatcccagaaaactaagcatggcttgatctggaggggcccactgtgaatattaattactttgtttaaaaaaacattcaaagatataatataaaagttgaaaagccttataaaccaccgccagaagtaactgatgagaacaatttgatgtctgcttttcccaggttttaaataatcagttttcattataccaccttttcattttttgaaaagtcacactggcttaaaaacattatttttcattctgctcctttttctttctgtgttttatttttcccatgcactcataccatcccctttgttctgcaacttgttttcatttcacagtcctgcggacactcttgcctataagtgctcactcactcttacttgtctttttgatgacgtgtctgtctccccaccagacctgggagcgtctcgagggcagggtccgggtctgactcgtctctatgtcccccacgcccggcccagggctggccacagagtaggtggcaaccatggtttacaagaagagtggatgaatgatgtgactgtgggttttggactcatcttgggacactggagggagggggaccagtggaggtggggagtgaaactggaggcagggagaatctcccaggaacctgctggtgatgggcataggccccatgggaggatctggggtgatccctgtgactccaacttttaactgctgctcctttctccctagcaatggtggatgtgatctttgctgatgtggcccagccagaccagacccggattgtggccctgaatgcccacaccttcctgcgtaatggaggacactttgtgatttccattaaggtgcggggtttggaagagtctaagatggggtggcagtgttctagggaggtatcttctctatctgtatctgtcaaatagccacccaaaacagaggggccaagtctgcaaaactatagctttggatttaaagaggcaggagagtgcagcggtcaagtgcaaaattgagtctgaccatctgagtttaatcccagcctgctgtgtgactgagcaagttacttaacctatatgcctcagtttcctcacttatgaaatagaaatattgtctagtctttttcagggtagatgacaggatcaaattagtcaatataatatgaagtgtttagaaaagatcctggcatagaatagatactagataaaagctaggtgcatctttcacagcatttttatttggaaataatggagaactctcccatgcacccttcacaaggttcaccatttgttagccttttgctacatttgttttattattctcaactgcattattactattattaaagaagaggaagtagaaataagccaaacaattcctgggtataaaatttaagcactggcttttagataaataggactgtttaaggcttcctgcttcaaatccaaaacaaaactaaaaactttttttttttttaatttgagacagagtctcactctgtcaccaaggctggcgtgaagtggtgcaatctcagctcactgcaacctctgcctcccaggttcaagcaattcttctgcctcagcctcctaagtagctgggactacaggcgtgtgccaccacacctggctaacttttatatttttagtggagacggggttttgccatgttgctcaggctgctctggagctcctgagctcaggcaatctgcctgtctcaggctcccaaagtgctaggattacaggcacgagccactgcacccagccaaaaactttcattaagccttttatcacatttcctaaacccgagtgtcttagcccattttatgcagctatcacagaatgctatagactgggtaatttatttatttttatttttatttttatttttttgagatggagtcttactctgtcaccaggttggagtgcagtggtacgatctcggctcactgcaacctccagttcctgggttcaagcgattctcctgcgtcagcttcccgagtaggtgggactacaggtgtgcgccaccacacccgactaatttttgtatttttagtagagatagggtttcaccgtgttggccaggatggtctcaatctcctgatttcgtgattgagccacctcggcctcccaaagtgctgggattacaggcgtgagccaccacgcccagccttagactgggtaatttataatgaatggaaatttatttggctcccagttccaaaggctggaaagtccaagattggaggtctgaatctggcgagggccttcttgctgtcatccattggcagaagggtgagagcaagatagaaagggggcataatcatccttttaatcagcaacccactcttgtgataatagcattactctgttcaggaaggcagaggcctcatgacctgaatcatctctcaaaggtcccacctctcaactcttgcatttaagggttacgtttccaacacatgaactttgggggacacactagaaccatagcactgagttttacttgaattaataatgaaaacatctggtttaaagagcacacaagagaaaaacagcccaaagccctgttgtagacattagtcctttctcctctttaggccaactgcattgactccacagcctcagccgaggccgtgtttgcctccgaagtgaaaaagatgcaacaggagaacatgaagccgcaggagcagttgacccttgagccatatgaaagagaccatgccgtggtcgtgggagtgtacaggtgagcaggggcccagcaatacaccaagacagacatctctgtcccttgcaccccgagtgccatgatcctggggaccctccttcatcacctatcttcctctcacaggccaccccccaaggtgaagaactgaagttcagcgctgtcaggattgcgagagatgtgtgttgatactgttgcacgtgtgtttttctattaaaagactcatccgtctcccatgtctgctgctcattcctccccttgacctgctgacacagggagcacgcacccttggtcaattttgcggggttgggtgaattctcactcggtcacagagcgcatgctccgtttctagctgcctttgcgcagcggcagcctggatttcggttcttgggtgggattggtagctcgctgcgcatgcgtgcaggtaagcggccatctcgcgcaggcggagtgtcagtgtgggtcacgtgaggggagcggagagggagggatgggggcggagtccagggcgtgggggggccggtttgttgtggtcgccattttgctggttgcattactgggtaatcggggccctggcttgccgcgtccgccggataccctcagccagtgggcaggtctgagctcgggctccccgagcagtttgagtccccttgcccgctccttcaggtaacggcgcggggacgggtggggcggcaagcggtcgcagggaggtgggcaggacgggatccgccctgctcccgtcgccgtgagacttagcacgaggccaagggaggagaggaggggggtggcaggcaggtgcgggccctgcctggctattcatagttgaattcctggaaccggccaagcccgaggaagcagttgcaggagggaggctgggagggggtagccgggccccactcccgccctttgtttgggctcagctccgcgggccgcttcttcgtcgcctagcaacagctgccctaggctgtgattggctgagctcttggcaccagcgaccaatggtacagttgttgccatggcaggtgccgattgccaagctcagtcgggccccgccttccggtctcagcaggcccaggagggcctcctgggtggggggcgggacgccgggtccctaggggctggtggtcactcagggtggggcgtgtcgcccctcccccgtccacctgctctactcttcccccgcgtgccctgggctgacccttgtcccctcctctccccgcccccggtggcagtggcggctgctgttgtcacccaccgggcctcctgtcccgcttgccctccccgccgcggggccggccgggccagagacaggcggtcgccttttcagcgccgccaccgccgccatgctggccgctcgcccaccccactgggggccccaccgcgccccagccccccgtgggccccgcgccagccctgacccgggtagggggtgggggctgggagagatgatcctggtgtgggagggccccggagaagaggtggttttttgggggaagctccaagggtggaggagtcgtggagtggcaaggcatggaataggagaaagggatttgacatgggggagagagtggcccatggggagaagatttttgctgtagctgacaactctgggaggagagaaccctatgtgataacttggggatttgactttgaggccctctaggagtggacacagttgtggaatgaccctggtataaagaggggtgcctggagaaaggtctgtggtaggaatattagggtgtgtgtgtgtgtgtaggggggcaaggaagcagtgtaggggagaaaaggatgatcactctaaactgtgggaagagacacctcctccttctcccatcaggaggagtgggccttgattgggatgggatattggagtaatatggggaagaaccctgttgtggtagggggaattgggatatggtacagggagactacctggaaggctggttcctaatatggaggacctgaaatagggaagcggtcttggcatgatatggagagggtcccctaggaaaatcgtgccctggtggatgagaatgctgtagagataggactctgttctatagaggttctcagataactttggtgtggttgggaggtccccaaggacgctgatgtggttttagggctgcagaggactctgctgtggtttgggaggggaagactcatgtggtttgggaatcctagagttctctgggttgagggaatctactgagaaggatagatcttaaagta

SEQ ID NO: 16878 - DNA, 6560 bp, Human
gtcccagctgctcgggaggctgaggcaggagaatgcgtgaacccgggaggtggagcttgcagtgagccgacatcgcgccattgcactccagcctgggcgaaagagcgcgactccgtctcaaaaaaaaaaaaggaaaatgtagtctgaaggcacaccccactataagagacccatccagccatcaactgaggatgaccttttttttttttttgaaagcttttttcaatcaatgcaaccatcagttatagtgaaagacctccaccttgccaatcttgagttttctcagagggcaaacctcgacataatttcagaccctagtatgaggcctgtgccatttgctagctcgaactaggagagtaactttatttttccccctgagagggagtctcgctctgtggcccaggctggagtgcagtcgcctgatctcggctcattgcaacctctgcctcctgggttcaagcgactctcccaccccagcctgctccctccccgcccccgagtagcgggaccacagggtgtgcgccaccacactcagctaatttttgcatttttgtagaaatggggattcgccgtgttgcccaggctagtctcagactccgagctctagtgatccgcctgccttgggcgcccaaagtgctaggactacaggtgtgagccgggcaggagagtaacttcactttggtttcctcctgccttaaatgggcataccacctggcattaggattaatgtgcgtaaagtacttagaactcagcccaggtgagttctccttaactcagcctagaagagatcatccgcccgagggtgagggggctagagccgccctgtgaattgggaaaggaggccccttttcagccttgccaggtatcctggaccccacccaacccactcactcacccacccaaccccagcaagtggggagagggagagcagtccaggtctccttatctgtctgggctgtttaggagtgagaccacacaaggcaggcagttctcagagaattcccctccaaggcctgctggctctttcttggcactttgctctgcagatttctttccgtaagtgcttatttctcacagtctttctcctttttgtccagtttctttttctttttaatttttttaaatagtattttttgtagacatgggatctcactgttgcccaggctgatcttgaactcctgatctcaggtaatccacctgcctcatcctctgaaagtactgggattggccgggcttggtggctcacacctgtaattccagctctttgggaggcggaggtgggaggatcgcttgagccccggagctggagattagcctgggcaacatagggaaaccccgtctttcaaaaaaaaaaaaagaagaagaaaaaggaaagaaaaacacaaaaagtgctgggatcacaggtgtgagccactgcgctcagcccctttctgtttctttttgtgatcctcccaaccctcttctccctctgaatctgtctctgggactgtctctgtctccccgtcttccctcccttcctcaccctgtctatctctctctgtatgtctcttggtgtgtgtgtctctctcgatgtttttctctctgcctgtctgcctgtctgtacccctctgcgtctctccccgcccccatccgtctgtgtcgcacgcgcacccccatcgggcttctgctcttgtcaattgcccctggggccctgcccccacctccgccccagtttccttctacaagcctcagtctccagctttgaaaactgggcaggcgtccccccatccgcacccccaccccttccccacgcattccccgctcggtcacggctgtccaccggccaagctcaggcgcgtcctggcccagggccgggcggaagggaaccagtccagggccagccaggctgcgccgggggcgcgcgtccgggaagcgcccctcctgccccgcccccggccccggccccggccccgccccgtgcttgcagtttcctataagtagccggctctcggtgccagcctcagcctgacttcagcgctcccactctcggccgacacccctcatggccaaccgttacaccatggatctgactgccatctacgaggtgagtccccgccgcacggcatccccggtacctgcatgcctgagtccgagtccccacctctctagcgccgcaaactccagcccgggacgcttgcctcccttctccaactggggctccctagcgccgcgccctccagcctggggcccctgcctcccgctcagaccagcttggtgatttggaggtgaaaatggaacccgcgacacccggctcttcgctcaaacatgggtggggcggcccatgcaagtggaaagtcggagaacttttctcagaccgaggctgcctggaggcggaagtggcccccatacctggctcacccctagtcgttgctgagggcgtggttttgcgcggaggcgtctctggggctgaagtctcagggtggggggatccgacttctgtctctccagtccctgaccgtagagacagagaaccctaaaaccgaagcaatccggacttccaggtcaactttgcccggtttctccagttgtgaaactggagatcccgacgcgtgggtcatatccggggaggacaagagacccaaaattgggaaacagtggtgcgccctgacttcggggtccccctcttggtccagccggggaagccgggattcctgggtccctcgggataaggcctcggtggtgggtaaactcagaacctccaactctgggttcctggcatccggaacccaggggtttctgcgggcgggtggggctcaggcggggagcccacaaaccggcctggcaagctctagttccctgcagctggggtggggcgtcgccctgcattttcaggtgccttaaccgacccatttccgcagagcctcctgtcgctgagccctgacgtgcccgtgccatccgaccatggagggactgagtccagcccaggctggggctcctcgggaccctggagcctgagcccctccgactccagcccgtctggggtcacctcccgcctgcctggccgctccaccagcctagtggagggccgcagctgtggctgggtgcccccaccccctggcttcgcaccgctggctccccgcctgggccctgagctgtcaccctcacccacttcgcccactgcaacctccaccaccccctcgcgctacaagactgagctatgtcggaccttctcagagagtgggcgctgccgctacggggccaagtgccagtttgcccatggcctgggcgagctgcgccaggccaatcgccaccccaaatacaagacggaactctgtcacaagttctacctccagggccgctgcccctacggctctcgctgccacttcatccacaaccctagcgaagacctggcggccccgggccaccctcctgtgcttcgccagagcatcagcttctccggcctgccctctggccgccggacctcaccaccaccaccaggcctggccggcccttccctgtcctccagctccttctcgccctccagctccccaccaccacctggggaccttccactgtcaccctctgccttctctgctgcccctggcacccccctggctcgaagagaccccaccccagtctgttgcccctcctgccgaagggccactcctatcagcgtctgggggcccttgggtggcctggttcggaccccctctgtacagtccctgggatccgaccctgatgaatatgccagcagcggcagcagcctggggggctctgactctcccgtcttcgaggcgggagtttttgcaccaccccagcccgtggcagccccccggcgactccccatcttcaatcgcatctctgtttctgagtgacaaagtgactgcccggtcagatcagctggatctcagcggggagccacgtctcttgcactgtggtctctgcatggaccccagggctgtggggacttgggggacagtaatcaagtaatccccttttccagaatgcattaacccactcccctgacctcacgctggggcaggtccccaagtgtgcaagctcagtattcatgatggtgggggatggagtgtcttccgaggttcttgggggaaaaaaaattgtagcatatttaagggaggcaatgaaccctctcccccacctcttccctgcccaaatctgtctcctagaatcttatgtgctgtgaataataggccttcactgcccctccagtttttatagacctgaggttccagtgtctcctggtaactggaacctctcctgagggggaatcctggtgctcaaattaccctccaaaagcaagtagccaaagccgttgccaaaccccacccataaatcaatgggccctttatttatgacgactttatttattctaatatgattttatagtatttatatatattgggtcgtctgcttcccttgtatttttcttcctttttttgtaatattgaaaacgacgatataattattataagtagactataatatatttagtaatatatattattaccttaaaagtctatttttgtgttttgggcatttttaaataaacaatctgagtgtaagctgggatcctggcttcttcgcggtctagagacaggaatggagagggagggggtgactttttggaagctgggtgcagttaactcttcctctccgagccccgcggcgcttacctggcaggaagtgacgtcaccgggcctggccgttcacctgaaagggtgggaccaggtgaggtcaccagatgggaaccgggggagccagttcccgggcgtcgggggcgccgcgctcccgtcctgctgggctccttgacccagcttcgggcgggtgcggtcggggacgggatgtttccgtccccacggggccgcgggaggcgggaggggccgggtggggaggacggaatgtgctggggcgcgcgcccagagcgagcgggggcgggcgcggggcggggcagcctggggtagcggaacccgtttcgggactagaggttccgggggggcttcgacaccttctggatgttggggaagcgggtttagggtctcaagaggctaggatctcaacatttgggagtcacaggttgcatcccctagcgctttagactctagacccctggtggctcggagttgcagatttctggccacccgggaccctggagcccgggaattaccgggtcttggcatttccgaaccttggaagtccgaggcttcgcacaccgaccagggtcggccccgcgaggccagggcgtgtgggtaggggccgcgcgtctaggaggggccccgggggagccgcgtcttcagaccatacaaggccagcgtcgtcgggaccaaccccggggccccgcgcccggaagccgccctgcgtcagcgcctgcggctcggccctgccgcccagccttcgccccctgcgacccctcttttttctccttgccccgcactcctccctcctccctctcacttccctcttctctcctttccctaccctcacccttcctcctctttttcacttcctcctctgcacccttctgccccgccctacaccctttgccttctgttcttctctccccctccaatttgtcccctccctcattactcctctcccacttccagcctccccatcctgccgtctcttaccccctttctcctccttcccgtctcccttctctccctttttccgtccttctttccctctccaccctttccttgccctcccactccccattgtcctcttcccctcctccccctagccttactccttctcctcttctctctccctctgaagcccctttccctcctctcccttctctctaccctcctcaagcctccctcctgctctcaggcctccttggcccactccccttgctcactgacatttggtctcctcttccaggaaactgcttcccttgtgggaaagggctcaggccctaataagtagaagaggatcaggcgagagggagtcagaacccctgagatgcaaaggcagcagaggggcagagaccaagagcaagcagtgaagagacatttgcagaaacagtcttggagactgaaagaacaacatctctggtccttcctttagccagatctgattctctgccccttccccaaaaaatccctcatataagaaaacggcacttctcaccatctaccagggcttaagccagacacccaggagtatcccttgacaccttgttctcaaatccacaccccagtccaacagcaatcctgtctgatccacctgcaaaatagatccactatccacctgcccccaccatgacccccaccctggtcctagccaacatcgtctgccatttgcatcttcatagcagccccagccccagtctctgctctagcccctgccttcagtctctcctttctccactcccccacgagacaaccaaaggaagcctgttatgagacctgagtcaggtcacataaaagtcaaagtccgaagtcctccccacagcccacacaatctggcacccatcgcttaccctcccccttggccactctgctccagccacactggcctcctagctgctctaccaagtctggtctgcttcatccata

SEQ ID NO: 16879 - DNA, 6711 bp, Human
tgtctccctgtctccaccctctttggcaaggtgcaccacgacgcccttttgaaccctggatcccagaccctgtactgccagagaaactgaggcaactgtgggctccctctagctctgagagaggaacctcttcgctggggagactcttgatggggtgagacgcagggacatctgccggggaaccagaggacaacccaatcctggggttcctcaggtggggttggggggctggggatggagaattctgtggggaggaggcttaagtggagggtgatttgggggagaggaaaaagatgactgggagattctggagaaagagattctaggggctgggcgcggtggctcacgcctgtaatcccagcactttgggaggctgagatgagtggatcatttgatgtcaggagttcgagaccagtctggccaatatggtgaaaccccgtctctactacaaatacaaaaattagccgggcgtggtggtgcatgcctgtaatctcagctactcaagaggctgaggcaggagaatcgctttaaccggggaggcagaggttgcagtgagcagagatcatgccactgcactccagcctgggcgacagagcaggactctgtctcaaaaaaaagaaaaaaaaaaaacaaaaaacagagagattcggccgggcgtggtggctcacgcctgtaatcccaggactctgggaggctgaggcggatcacatcacctgaggtcaggagttcgagaccagcctggccaacgtggtgaaaccccatttctactaaaaatacaaaaaacgaccagggcgtggtggtagacgcctgtaattccagctactcgggagcctaaggcaggagaatctcttgaacccgggaggcggaggttgcagtgagacgagatcgcaccactgcactctagccagggcaacgagcgaaactccgtctcaaaaaaaagagagagattctagggtggggacggggaagaggttaattcttgggggagggtctcttaggagagggggattctaacggagggaaaactccagggaaggcagttgctgggaagaggagtctcggaagggaaataaactcaggagaaaggtagattttgagggacgggtctctgagagaaaagtttttgtggatttgcggggcggggtgttctgggaaagggggatttgccgggaaagggggatttgccgggaaagggagattctggaggagggagattccaggggtactgggtcctgacaagagaaagattctgggaagggtgactgaggggacgaggaccgaatggagggagattcagggaaaaggggggtctaagttgagcactcttaagagggacatttggggttggccatctgagagaaggatgggaaacattctgggaagaggaaactgaaaggaaggacattctggtgaaagggagattctgaggggaaggggctctgaggggaaaaggattctgggagaggatccccaaggagggggattctagggaggataggattctggaagtccttaatctgagaatccagccagatttcttgcagtagattccaaaggaagattctgatgcgggggattcggggaggagggagtccagaggggagaaagattacaggtgttgggagggtgggaactgatttaaagaaagggcgaagggagattattaaagagccagaatgcaaagaagagctgcggtagtcgactacagaggacgcgaagcacactcccgcagccttcccttcagtccgcacacgacactcccaggccccgccccttccgcccacagagcccgccacttccgcctcacagggcccgcccgctctgagcgcctaagggccttcccgccgctgaccagacgccccgcccgttagccgcaacagaagccgtaaagctctctcccgtcgcgacgcagtgctcaaggcgcctgcgcagaccctgaaaagcggccagggtggcccctagctttccttttccggttgcggcgccgcgcggtgaggttgtctagtccacgctcggagccatgccgtccaagggcccgctgcagtctgtgcaggtcttcggacgcaaggtgagccagacgccggatgggaaggggaggggaaggagaaggccagggtctgggagaggtcggtgggcaggaatctagggggtaacatgggagctggagccggagctcacggggcccctgtttctcttgtatcttacagaagacagcgacagctgtggcgcactgcaaacgcggcaatggtctcatcaaggtgaacgggcggcccctggagatgattgagccgcgcacgctacagtacaaggtgctgggatccggcaccggcgttgagtggatggaggactcttggagacagagatgttgtagctcttgaaagctgggggggctggcatcagcaacgggatgtttagaagttgtgttgggtgtagaacagtggggtatttggcaatagagctgggcttggggttcagaagatgtaaaagctgagatggggttgttgaagattaagggtttgctttgagaactgggatgttaggaagctcacctcactggggcggggggacccaaagggtgaagggacaccgactattttttattttatttatttgttttgagagggagtctcgctgtgtcgcccaggctggagtgtagtggcgcgatctcggatcactgcaaccttcgcctcccgggttaaagcgattctcctgcctcagcctcttgagtagctgagattacaggcatgcaccaccacgcccggctaatttttgtatttttagtagagacggggtttcgccatattggccagagtggtctcgaactcattacctcaggtgatccaccagcctcggcctcccgaagtgctgggattgcaggcgtcagccaccgtgtgcggccgaatttgggtctgtttaaatgcttgcttgtaaaaggggttcctctgttccctttttgggactctcaatttctttggctcagaatggaaagaaaccagagtctgatttctgccccttctgaactctactacttttaaaagaaagaatatctacattgcagggtcagttaaaaaaaatttttttgagttataaggttgttttttaaaaacagtatcttgctgtcacctaccctggagtgcagtagcacaatcctaatgaactgcagccttaaactcctgagttggagatcctcccacctcagcctttcggttgccaagactacaggcacatcaccacgcctggctcatttgagaaatatttttctgtagacgtggggtctcactttattgcccaggctggtccttggtctcatgtgatccttctgcctggactgggattacaggtgtgatcaccatgcctggcctagaatttaataaaaattctgagatttcctttgtgtagcagatgttgaatgttactgttattggctgtcactgtatttgaaggatttgtatgtgtaccctctgttgagttttggggacatagcagtgatccagatgacttaaggtcttgccttcatggacctgccagcctagttggggagaaggactgggcccaataccagaagctgatccaaagtggtcagaactggggaaggagacctgtgagctgaaagcaggtaaaggaagtatccagacagaggcactggtaaaagacctggagctgggaagggtctagggaccagggacaggttgtactgtaattctggaaacctgtgaggctcaaagaaagggcagagagctcaggtgggaaatagaaaaggcacctgaacagtccagggatggctttcgactacttgaaacagccttgggagtttcagaagctattggaatgctccttactgttcagccttctaagaaccagtcttagaggtagggtgtctgaggtccagtgagggacacaagtaggagggagcccagatcttgttccctttaccttgcctatatttcttaacaccacttcagcagtctcatatctggcttttttgactttcctcttctctgggtctgtagagggccttggagtgacaccctgacccccatccactagtacttgaaggccagtggtggcagaagccacagaaacaagaagcccagtgagatggctaagctgcccagcatgtaacttaaatccctgttcattccccattcctttagctgctggagccagttctgcttctcggcaaggagcgatttgctggtgtagacatccgtgtccgtgtaaagggtggtggtcacgtggcccagatttatggtgagtcccaggaactgggcgcatggaggaggtggctctgggagggaggccttcacagcgctcctgtaccctttaattgtgtgtctttctcacagctatccgtcagtccatctccaaagccctggtggcctattaccagaaatgtgagtgagcatgggtccttcccatgaggtaggtgggtgtgtggggatcaagtcaaggactctgtgtgattatctaaatcctcgtccctgctcttcttgccagatgtggatgaggcttccaagaaggagatcaaagacatcctcatccagtatgaccggaccctgctggtagctgaccctcgtcgctgcgagtccaaaaagtttggaggccctggtgcccgcgctcgctaccagaaatcctaccgataagcccatcgtgactcaaaactcacttgtataataaacagtttttgagggattttaaagtttcaagaactgtgtgtggccttatgtgttggtattggatgtttaaccagacagaaatcagtaaacatcctggacctattgccagtctggattttgaccctccccagaagtggtcgcgctgggcttggtgtgggtgagtggaagcagaaggcagggggtctctgtctctacacctccagtagagtccagtgtgcaggcaaagctgagatggcagtcgtttggggccattagtggctgcagaccttggcggatatatggctcatccttgtggatgtctatttttttcaagcccagcctcccaaatagcttggattacaggtacccaccaccacgccatgctaattttgtatttttagtatcgatgggtttcactgtgttggtcaggctggtctcaaactcctgacctcaagtgatccgccttcccgggcctcccaaagtgctgggattacaggcgagagccaccacccccagctgaatttttgtttttgtagagacaggtctcactatgttgcccaggcgtggtctcctgacctcaggcaatcctcctgcctcatcttcccaatgtgtccaggttacaggtgtgagctaccatgcctagccaataatctttaatacaaagaaaacaaggagagtcgggcacggtggctcacgactgtaatcccatcactctgagaggccaaggctggtggattacaaggtcaggagttaaagatcagcctggccaagatggtgaaacctcatctctattaaaagtacaaaaattaggtatggtggcaggcgcctgtaatccagctacttgggaggctgaaggaaagaattgcttgaacaggcgcctgccacacccagctaatttttttttttttaagtagagacagggtttcaacatgttggcaaggttggtcttgaaatcctgacctcaagtgatcacccgactctgcctcctaaagcgctgggattataggcgtgagccactgcacccagcctaatttttgtatttttagtagagatggggtttcaccatgttggcaaggctggtcttgaactcctaacctcaagtgatcctcctgccacagcctcccaaagtgctgggattacaggcatgagccaccatgccgagcccaaagtggcattttggacaggtaaccgggctgtggaagaccccaggttctttttttttctttttcttttttttgagacagagttttgctcttgtatccctggctggagtgcaatggcgtgatctcggctcaccgcaacctccgcctcccgggttcaagcaattctcctgtctcagcctcccgagtagctgggattacaggcgcctgccaccttgcccagctaattgttctatttttagtagagacggtttcaccacgttggccaggctggtctggaactcctgacctcaggtaatctacccgccatggcctcccaaagtgctgggattacaagtgtgagccgccacacctgcccccccccccccgccttttttttttttggagacggagtcttgctctgtcacccaggctggagtgtagctgcacaatctcagctcactgcaacctccgccttccgggttcaagcaattctgcctcagcctcctgagtagctgggactacaggcaagtgccaccacacctgactgatttttgtatttttagtagagacgtgggtttcactatgttatccaggctgatcttgaactcctgacctcaggtagatccccctgccttggcctctcgaagtgctgggattaacaggcgtgagccaccgcgcccgacctagagcccaggttcttgactactagtttaggttgtcacagatctgctcaagaggccccatctctaccctgtggcccctcaacatgaggagctaaggagtcagggtggccgcttgtgggaaaagcacaagaggctgtgggactcaagcggtgcctgacagcctggaggagtcaggtggactccttgggggagaggacatgggaaccagggtctgctggccggtaggaagag

SEQ ID NO: 16880 - DNA, 11181 bp, Human
acaagagggagagagaggacagctgcagagatgtaggtgaaggggtagagtccagtgtagggtccggggtttgcccaccatggagggaagtgggccagtcacagttggcctaggaccctgtggaaattgtcttttgtttgcttttatcttctcactgaaatacatatggtttttgtgtgaactacattccttttatttcttctttatatgacagtcaggacattatattgatttttttttgaatttatgtgtgtaagtaggttatattatctaggaattttatttcgggatgggaaaagggggcagtgcaaaaatactcaataaaaaaaatagccgggcatggtggctcacagtggctcacacctggaatcccagcactttcggaggctgaggcaggtggatcatttgaggtcaggagttcgagaccaacatggccaacatggtgaaaccccatctctactaaaaatacaaaaattagccgggcgtagtggcacgtgcctgtagtcccagctacttgggaggctgaggccggagaatggcttgaacctgggaggcggaggttgcagtgagctgagatcgcaccactgcactccagcctgggcgacagagtgagaccctgtctcaaaaaaaaaaaattgggtaccggtctgacgggattgaactcccttgttgtagggcctcataggtcattgcaaggctagtgaggttggaaaagtgcaggaaaaaagtcaccattacccaggcactgtggggttgcccctctggtccccattttgccattgacataatgggcgtcagtctgaccagcaaaagactaaactccccttttccagccctgcaattcaaatatcccagatgggggtaaatctaggaaggccacctggaggaggggaggagcaaaatagttcgtttttagtacctattgtgtctgccatgctggcagctatgtgaagctatttatttatttatttttatttatttgtatttttattgcctgggatagagtgcaatgatgtgatcttggctcactgcaacctctgctgctcggattcaagcaattcttgtgcctcagactcccgagtagctgggatcacaggcgtgcaccaccatgccaggctaatattttgtatttttagtagagatggggttttgccatgttggtcaggctggtctccaactcctgacctcaggtgatccgcccgcctcggcctcccaaagtgctggcattacaggtgtgagccaccatgcccggccgatgtgaagctatttatatcctcaccacaatctcaaatcagaggggtgaagttacttagctagggtcacacagcaaggaagctttcgaaccctggtctgagcgatttcctgacaggtcctggcagatgaggggaaggaaggagggggaggagccctctgtgacagttgtcccagaaagggcataaacaggatgtggtgttggatgaaaccttcctcctactgcacagcccgcccccctacagccccggtccccacgcctagaagacagcggaactaagaaaagaagaggcctgtggacagaacaatcatggtcaggggccaggggttctatgggaagagctggggctggggttggggctggggcttggaggacacctgggcgaaggtcaggctatgggatggaggtcacgggccgggaagggggcccaactgtggtgaacagcccggctggaagaacagagagacagtggctctgggtttaggctcaggaagtggatctctgcacctccttgagtgtcccccaagagtccccgtggagaaggcgggaacccagcctctgctccgccccccaagctgagtgccctggtgaggggtatctactctgtgggaagggtgccttttctcaatgttcacaaaggcatcagatgggccggcgcgatgctcctcttcattagtggatggagaaacaggtttggggaaggggtgagggctgaggccaggccatttcagctcttcctgggtccctccggcagtctgactccctggtggtgtgcgaggtagacccagagctaacagaaaagctgaggaaattccgcttccgaaaagagacagacaatgcagccatcataagtgagtgacatcttcccccacagaaggatgggagggcggtggtgagggcagatagggagggctgggcttgtgtcccccatggatcagggggagtgtctaatccctgtgtgccacccctccccagtgaaggtggacaaagaccggcagatggtggtgctggaggaagaatttcaggtgatgggctggggtgattgggactgggaggtacagggtgagactgggagaaccaagtggttggaactgatatgaagagcctggcatgggggtagaaagacctggagattggccgagcacagtggctcatgcctgtaatcccagcactttgggaggccgaggcaggtggatcacctgaggttgggagttcaagaccagcctggcaaacatggtgaaaccccatctgtactaaaaatataaaaagttagctaggcatggtggtgggcacctgtaatcacagctacttgggaggccgaggcaggagaatcgctggaacccgggagatggaggctgtagtgagccgagattgtgccactacacttcagtctgaaccacagagcaagactctgtctcaaaaacaaaaacaaaaaacaaaaaaacaaaaaaccctggagatcaagttctagctcactcatgacccccagcaagagactttgcctgtttgtgtctctatttcctcatctgtgaaatggggagaatagtacttatctcataggcttgtttttacatccagtgatttaattcttgtaatgggtttagaacaaggcctggcacttagtatgtgctcaataaggtgatgatgatcttaataatgatgataataatgctttattggcatttaaatgaaagagtttccatataagttaaaaagctagccaggcatggtggctcatgcctgtaatcccagcgctttgggaggctgaggcaggaggatcacttgagcccaggagtttaagaccagcctgggcaacatggtaacaccctaactctactaaaaatacaaaaattagccaagcacagtggtgtgcacctgtgatctcagctacacaggaggctgaggtgggagggttgcttgaggctgggagttttgagaccaacctgggcaacaaagcaagaccccatctcggctgggtgccgtggctcacgcctgtaatctcagcactttgggaggctgaggcgggcggatcacaaggtcaggagatcgagaccatcctggctaacatggtgaaaccccgtctctactaaaaattcaaaaaattagctgggtgtggtggcgggtgcctgtagtcccagctactcgggaggctgaggcaggagaatggcgtgaaccccggaggcggagcttgcagtgagccaagatcgtgccactgcactccagcctgggcgacagactctgtctcaaaaaaaaaaaaaaaaaaaaaaagactccatctctacaaaaaaaaaaaagggggtagacctcacccccctggtggcctcactgtctttatcaataacaagaatgataataaggcttatttctctagtgttgcgataaggatttataagggaatccatggagactgggggctggggctctctcaggccctctgaaaggcagtatagtgaagcagttatgattcgaacccagattcaaatctcaactctgctgctttctatctgtgcaatcttgggcaaatgccttaacacctctgggcctcagttttctcagctgtatagtgggcataatgatgggacctaccccacagacttacgggatagttgcatgaattaatccatgtgtgtttcatagaacgatgccttggcacatggtaagtgctcacctaaaggtggtcattcttttttttttttttttttttgagacggagtttcgatcttttttgctcaggctggagtgctatggcacaatcttgattcactgcaacctccgcctcccgggttcaagcaattctcctgcctcagcctcctgaacacgcctggctaatttttttgttggaaatggagtctcactctgtctcccaggctggagtgcagtggcgcgatctcggctcactgcaacctctgcatcccggattcaagcaattctcctgcctcagcctctcgagtagctgggactacaggtgcatgccaccatgcctggctaattttctgtatttttagtagagacgggtttcaccctgttagccaggatggtctgaatgatttcctgaccttgtgatccgcctgcctcggcctcccaaagtgctgggattacaggtgtgagccactgcgccctgcctcattctttgtcttttcttctgttttcttgcctcagaacatttccccagaggagctcaaaatggagttgccggagagacagcccaggtatcctgggggaagaaagggttggatcaggccatgaggggaggggtgatgttggaggtataggctaagggactgctggagttccagccctattcatggactttgaatctctgtgtttggccgagtgaggtggctcatccctgtaatcccagcactttgggaggtcaaggagggtggatcacttgaggtcaggagttcaagactagcctgaccaacatggtgaaatcccgtctctactaaaaatacaaaaattaactgggcgtggtggcatgtgactgtaatcccagctacttgggaggctgaggcacgagaatcgcttgaacctggcaggcagaggctgcagtgagctgagatcacaccactgcactccagcctgggtgacacagcgagactctatctcaaaaaaaaaaaaaaaaaaaagaatctctgtgtttgaggccaagagttcatactctagaactttttgtttgtatagcaatattttattgcagaattttataccgattatttatgataccggtttaagagtcttttttttttttttgtacaaactttgttgagtttttgtttcaacattacgctggcatcattttttaaaaatgaaattttggccaggtactatgactcccacctgtaatctcagccctttgggagcctgaggcgggaggatcacctgaggccaggagttcgagactagcctgggcaacatagcaagaccttgtctctattttttttttttttttgttagagacagagtctcgctctgttgcccaggttggagtgcagtggcgcgatcttgactcactgcaacctccgcctcctgggttcaagcgattctctggcctcagcctcctgagtagctgggattacaggggcccaccaccatgtctggataatttttgtatttttagtagagacatgttggccaggctggtctcgaactcctaacctcaggtgatccctgcttcggcctcccaaagtgctgggattacaggcgtgagccaccgcgcctggtggaggaccttgtctctattaaaaaaaaaaaaaattagccaggcatggtggcatgtgcctgtggttccagctacttgggaggctgatgtcgggggtcagttgagttcaggaagctgaggctgcaagtgagccaagatagcacccctgtactccagcctgggtgacagagcaagaccctgtctcaaaaaaacaaaaaaagaaattttccttctttttcaatgtttgggaacactttaggtagcaaacaaattaattattattattgttattttattaaaaaaatttttagagacagggtctcactgtgtcacccaggctattgggcagtgctgtgatcctggctcactgtagcctctaactcctgggctcaagccatcctcctgcctcagcctcccaagtaactgggactacaggcactgccactgcaccctgctaaaggaatgactcgacttttaactatcaggtagaatcctgggcgaagtcacatgagcctggtgctttttttggtggaagagctctttgactatttctgtgaaaactggtctgctaagatttttcatcttgactgaattcattttgggtctctaggattagaggctgtaggactcaacaaggaccagcttcatgggcatatgataattgcacagggccccgcacccaggagggggcctcacacatgggggttaacggtcaccttctttatagttttatctttgaatttctgttttgtatgaagtcagatgggacaatggacttcacacaaatgtgctggggtttggagctaggttcacaggcagtccaccacctggctgcctccctgaacaggttctcagccacccactctctgcacccacccagtgaccgctgctgtccttgggtttcctgctggtgtagggagggtcagggtccagaaggcaccccttgcctgacaagttacagggtgttcctgtgagcatctgcactctgcctgcgcatatcctcatgcccgagggagcacgactttaaatagcaaactaaaaaagacaggctgagcgcagtggctcacacctgtaatctcagcactttgggagtctgaggtgggagtactgcttgtggccaggagttcaagaccagcctgggcaacataacaagacccccatttctactaaaattttttaaaaaaaggccaggcgcagtggctcatgcctgtaatcccagcactttgggaggctgaggtggacagatcacttgagctcaggagttcgagaccagcctgggcaacatggtgaaactctgtctctgcaaaaaacacaaaaaacattagctggatgtggtggcacgcccctgtaatctcagctacttggggggctgaggcaggaggatcacctgaacctgggaggtcgaggctgcaatgagctgagaccacgtccctgtactccaacctgggtgacaaagtgagaccctgtctcaaaaaaaaaaaaaaaaaaattagctgggcatggtggtgtgcacctatactcccagctactctggaggctgagataggaggattgcttgagcccaggagttcaagactgcagtgagctaggatcgcaccattgcactccagcctgggcaacagagtgaggccctgtctctaataacagtaaaaaaaaaagacgatgatcagtctagagagagactacaaaagaaaggaaaacaattttcctgcttcttgaacaagatgccccacattttcattttataccgggcttggatgattctgtagccatcactggtcacagtgcacctggggttcaagtgcactggacagaattgcatagggggtgagaacttacacgctggcattcactttcccaggttcaaatctctcccctatctgtagaaccttaggcaagtgactttgggcctcagttttctcatctgtacgatggggatattaatagcacctatattataaagtaattgtgagtcaaatgagcactatcattattattattatttgagatggagttccacttttgtcacccacgctggagtgcaatggcgtgatcttggctcactgcaacctctgcctcctgagttcaagcgattctcctgcctcagcctcctgactagctgggattacaggcgcccaccactactccaggctaatttttgtatttttagtagagacgaggtttcaccatgttggccaggctggtctcgaactcctgatctcaggtgatccacccgcctcggcctcccaaagtgctgggattataggtgtgagtcctgcgcccggccctatgattattttttaatcatttgttgtgtttgaggtcagtaccctgagtcccagacatcaaccctgggttctcagactcagccaacatttcaaggctgtggactcaggtaatggctgttaagcctgggctgcaggccagagtcctgattttcaattccctttcacggtaggttcgtggtttacagctacaagtacgtgcatgacgatggccgagtgtcctaccctttgtgtttcatcttctccagccctgtgggtgagacacagctctactgtcctcaggagagggtcttcgattctgtgtgtgtgtgtttgtgtgtaaatgcgaatgtgtgcaggcacttgtgtaagagtgtgagcatgtgacagcctgtgtgtgactgggtgaggatgtgtgtgtgtcgcacgcatgatgtgggagggcagtgaagtggaggtgggggctcagattcaccaagagcccacccgttctcagtcctggggcctaagccaacccaccttttcctttcacctagaaatccccgtctggcccctaaatcatctccagagaccctcagaataacttgaagcccccaagccaacctagaaactgagtacagtgcagggacctccttagaagagctcctaggacccttggcaagctgcagggccttcaggacattactagagctttagagaacacgcctgggtccccactgatgtgcctttctcctcttttccacgcaggctgcaagccggaacaacagatgatgtatgcagggagtaaaaacaggctggtgcagacagcagagctcacaaaggttcagactgggatggggctccagagtgttagggagaggtggtgtgggtcctgggtctgagggaagagggactagagtcctcactgtctcagtggtttttgtttttgttttttgtttttttaaagaactgggtctcgctctgtcatccaggctggagtgcagtggcacaacctcggctcactgcaacctcctcctcctgggttcaagcaattctcctgcctcagcctcccaagtagtgggacgacaggcacacgccaccacacctggctactttttgtatttttagtagagtcagggtttcaccatattggccaggctggtctcgaactcctgaccttaagtgatccacccacctcagcctcccaaagtgctctcttacaggtgagccaccgtgcccagccactgtctcagtgtttgagtagatcataatgccgagacctctctctgcccaggtgttcgaaatccgcaccactgatgacctcactgaggcctggctccaagaaaagttgtctttctttcgttgatctctgggctggggactgaattcctgatgtctgagtcctcaaggtgactggggacttggaacccctaggacctgaacaaccaagactttaaataaattttaaaatgcaaaaactcggagatcctcagtttggactcagtttctgcctcttctgggctctagccgacggttcctgcagtacgaggcttgggccagcagggggcgggctgacctagaggaatgcgagctgggtcccgggagggaaggaggatacctctttcttagaaagaaagggaagggcctgaaggatttccttggggggtgggggacggatgggcgaggcctgggtctcctggaggtattggggaaatatctggatctacagagcggtcactcccaaggggaacaaggacccctgagaataaaggaggcaaagtgcccgtttcctcccccactccccacctctggggggtaggaggcatcaccgaatgcgacttttctcagctgagcccttagataggaagaatttaaaggccgaagaggtttgaacgtaattgcttcaggatctcaggagctgctggggggtggatggtttgtacggtcaggtaggcctgaacacccagggctggggaagctgaagtcgatcctgggccctcggtggactcccaggggtgtgagattgaggagacagggaagggacacttgcccccatctgaagattcttcttttcttttttctggcatctctggacatcgaactttctcaggctttctgcgtctgtctctgagggacattgattaagtacccacaatgtaccgggctctgagaattccgagatgggcaggtcttcacagagatgaatcacaccctttctgtctctctgcttctcttccatgtttctaattgttcccctctctgtccccggtttcagggacgtgggaactccctccccccaccccttttcaggttcccggtagagaggtggctgttgccatggtaacaaagacatagtgaccttgggcctgggctgcccgttcccccaaccttggtgtttccggggatagggtccaaaaagcccagctccaagccctcccagccttaacacaccatccccttaccaccccactctaccctatctcttgcccgctcacccccaatcagggcaagtcctttgcatgagggattcgggatagaatcactctacactggtccatagagaaaattcaccctgccctaaattctctggagggttaggttgagctcctctgccctccactagtgctgttttcctgtccctatctctctgtccctccctctgatcacaggcccagtccctgaaggcaggagatggaggaggaggaggactggagacaagaggggtcattcaattaaatggacaaggaactcctggcctgcagaggtcagagaggcagagggactcatccaaggtcatgcacttacatgatcaaatgaatactaatagctgaccctcctcttgagggcttcctatgtaccaggtacttctataagcagtttataggcattagcttatttaattattgcaatacctcgtgaaaaaggtactattattctctccaacttaaagacgataaaaatctgaggcatagaagccaaaggcacctgtggtctgtacagttagaactctttaaccccaggctatcttgggggtcaatggccacactctctcttaggcaagagacttagggaacctcctcctcctccccgctcccctccccctcccctccccttccctctccccctccccctcccccccctcctcctcgtcctccttggtggtactcccaccctccatagtggaacttctgtttcatccaggcttgtgattacaaacggtccaatcagaaagagccatgcacaaggacttgcccgatcaggagcaaagcatgggaaagcaggggccaatcagaaagggtggctcacaggcgcagtccaatgcagagggagtacagctagggattgtggaaggaccaatcagagaggccagaacagactgcactatccaatgaggagtcagcacaatgggacgtgtcttcgggtttggggagattccctggagaggcagtacaaactggggaccgcctcctctagttccaccaacc

SEQ ID NO: 16881 - DNA, 5502 bp, Human
ccgcctgccccagcctcccaaagtgctgtgattacaggcgtgagccactgcgcctggccacctagcacctttaatatacttatttatttgtattgtctgccttccccaattagatcaaccatgaagacaagagttttcatttgttgggttctctgggcctagaggcatgtctggcatatagtaagcattcagtaaatatctgttgagtgaacgtatgaataaagaagtgagttcctcccagcaggcactgagaacattgggagtacagggttgcagctctctctgcagcaggagaatgtagctgcaataaagggaagtcaagaagccagagtccagccaggtgcagtggctcatgcctgtaatcccagcactttgggaggctgaggtgggtggatcacaaggtcaagagatagagaccatcctggccaacatggcgaaaccccatctgtactaaaaatacaaaaattagctgggcgtggtggtgggcgcctgtagtcccagctactcaggaggctgaggtaggagaattgcttgaacccaggaggcagtggttgcagtgagccgagattgcaccattgcactcccgcctgggcgacagagcaagactccgactcaaaaaaaaaaaaaaaagcagcagcagcagccagaggccactccagcatctcccctacctggcttgggtcagggagagggcagtgagaagtgaaaactcccagctacagaaaaggaaatatgttggggggaagggagaaggaaaggtgtcttcatcaatgccggggcagggtagatggagccctgggcagggagtttggaccaggaaatctcaatgagggaaatgtgctgtcctcacctctccaagaagcgactggccaaacagagtgacagaggggataaaggttatgcctagggaggcatgtgtcagaggctatcatccactctgttgaacccacagtgaccagcaccaccatcacacaaacatgcctgcatgtgtgcacgcacgcgcagtgtgcaaacctgatgtcagcctcactccctggctcttctgtccacaaacgctgtttctttaagtaccactttcagttcctccaaagaatctacttaaactcttaaattcctgatctctatagattttactaaagatttcaaaggagataagatgagagggttacgttgcacattctaaagcaaacaaattaaaatgttttgttagacatttccatatttttaagggcctccttggagctgccaggctgggagtgaggtttctctccctttctaaaccctgtgcccatcttgtcaccctcctggagctgccagcagacttcagattcttctccgatctacagagcagaaaaattcagccagcccttccttgtcttcctatccacagctgcctgcccagactcatgaaacctgacaaaatgcaaggtcttatcattacctgaaccttggacctgttcaaaaatactagttcctgagaataaatatccctggtgtcttcctgcccttcctgcacacctccagtggcttatcaaaatatttgtttcatgcgcacactgggctctcatttaagaggaatttgggagaatgttattttctaatctgcatttcacaccaggctccccctccttcctgggtctagtgcacagacctgatgggaagtagtctgggagcagaggaggaaggaatgagggaaaggggaagtttggaggaaggcttctgagaagactggtgggagagaaggagagcctgcagacagaggcctccagcttggtctgtctccccacctctaccagcatctgctgagctatgagccaaaccagggatttacagggtagggagggtgggataggcagcagcattagatcggaggaatgagatggacagacctgggctgtgggctaggagggcagtcagctggcctagggtagcccgggctggtgtcagggtaaggagaggaagggagggatgagggctgattaatttttttcaccccacaggaggaaaagctttcggactgctgaaggcccagcaggaagagaggctggatgagatcaacaaggtagaaggaagaactaagggggcagagccagggggatggggcgtggatggggagggcctaccctggctcttattttcccctccatagcaattcctagacgatcccaaatatagcagtgatgaggatctgccctccaaactggaaggcttcaaaggtgagggggaaactgtaggcggtggagacagggctgggggtaggagggttaggatttccacaagaacaaggcaggaacagcagagataaaaagtttacttttgtggtagcaaaaggggaacctgcctttattgccctcctgccacactgcggtccctttcccgggcctgcctctctcagcatcccctctagctccttacaccctagcggggcccctcaactccccaaccccacttcctctgcctgcccctcctcctccttccacgttgtctcctccacctagcagttggttggcaaccccttcctcagtcccctgctgaaaaccctccagtcagcgcttatcccttctgctctctcccctcacccagagaaatacatggagtttgaccttaatggaaatggcgatattggtgagaaacgggtgatttgcgggggcagggtggtgtgcaggcctaagaagacagaggtctctcctacatgctccattcctcatgatttgggagggggcccacctaccacagtgggaggaaggagaatggggatgcggaagtgggagaggagagagagggtctccccaccttctccccatccccatcctctgcccccagatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgtgagtgtcaatttccaacctcccctgtacttacctgttttctcctcccccatccctacccttgtccacaggctcaacatttctacacgttgcccatcatcccttcttccatccttagagggacccttccaaggtcccgaccccatccctatccatagtcctggtccccagaaactccaacccctgcccttcctcttcccccttccaccctcacatccccatccccttctagcctttcctagcaccctatgatttattcccttgagaggagtgttccctgatccctgtgcctcttcccatctcaaccaggatcctgatgtatgaggaaaaagcgagagaaaaggaaaagccaacaggccccccagccaagaaagctatctctgagttgccctgatttgaagggaaaagggatgatgggattgaaggggcttctaatgacccagatatggaaacagaagacaaaattgtaagccagagtcaacaaattaaataaattaccccctcctccagatcaagtcagcttagtttttatttgggtgatttttttcctgggtttgggaaggagagacaggtcttgagggaaaggtggcaaggatttggccatatgaacaatccatcaacaacgctatagtgtgtccactacagcagatggtttcacgcaccaagggggattccagctgtgtaagacagccttaacctcaaagaatgcaggcaggacaaaaacacatgtccaaacaaggtactcaggcccatgacagatttcatgaagagcaaggaataccatgaaccaacattctccaccactataagctttgtcactttgacaaatcactcagcctctgtgaggcttttttctaaaaatggggataaagtgacctatgctattgtgcctgacatatcataagccctcaataatgtttaaaacttgaatgagccggggccgatggcttatgcctgtaatcccagcactttgggaggatggggtgggcagatcacctgaggtcaggagttcgagaccagcctgacgaacatgaagaaaccccgtctctactaaaaatacaaaattagcctggtgtggtggcgcatgcctgtaatcccagctacttgggaagctgaggcaggagaatctcttgaacccaggaggtggaggttgtggtgatccgagatcgcatcattgcactccagcctgggcaactaaaaagcgaactccgtctcaaaaaaaaaaaaaccgaacatacaaacaaacaaaaaacacttgaatgggtagatgaatgaaagaactggtgctattaaataaagcaaagaatttacagctgggcgtggtggctcacgcctgtaatcccagcacttcaggaggccgaagcgggcagattacctgaaatcaggagttggagaccagcctggccaacatggtgaaaccccatctctactaaaatacaaaaaattagctgggcatggtggcaggtgcctgtaatcccagctactcgggagactgaggcaggagaatcgcttgaacccgggaggtggaggttgcggtgagccgagatcacgccatggcactccagcctgggtgacaagagtgagactctgtctcaaaaaaaaaaaaaaaaaaaaaaaaagactggaaggagaaactcattggagacaatgactatggacatcccttttaagaattttgctgcaaagggtaacaaaacggtatgtgtggtagccggccggggagaagggagaagagaatcattttggaagtttgaaaacagaagtcatcttaaatcttactgagcctctgactaaaattctcatctgatttctgcaaacttttctgccttcacttttcataatgaataagccgcctcctttatttagccatatcagcctaggcacaggcccccaaactcatgcctccactaatctgttctctgcacctgagatgtacaccttcttctgaaacttgggtaagttctaactcgttcttcatatctatttatttatatatttttgacagatatctactccgatcattcttcatatcatttttttttttttttcctgagatggagtctcatgttggccaggctggtctccaactcctgacctcaggtgacccacccaccttggcctctcaaagtgctgggattacaggcgtgagccactgctcccgctcccggccctttttttcttctttttcttttttttttttttttgagacgtagtctcactctgtcgctaggctggagtgcagtggcgtgatctcagctcactgcaacctccgtctcccaggttcaagcgattctcctgcctcagcctcccaagtagctgagactacaggcacgcgccaccagtccagctaatttttgtatttttagtagagacggggttttgccatgttggccaggatggtctccatttcttgaccttgtgatctgcccgcctcagcctcccaaagtgccaggactacaggcataagccaccacgcccggcctcatatctcttaataagagtttttctagaaacat

SEQ ID NO: 16882 - DNA, 5502 bp, Human; identical to SEQ ID NO: 16881

SEQ ID NO: 16883 - DNA, 15202 bp, Human
agcagaaacagacaagggtccaggcatatgaggggaaagatcctgaaacaaagcctagaagaaaggccctctcagaaaccacccccatcccacagaaatatcccaacaccaaagagatcaacacagtcccctttccccttagacctaacatgcaacttcatcctaaaacagaccgtaatatccccaccacctcaccatccatgaccataaaactctaccctccaccacaaatgttaatcatactccacatagatgttatactttacacagactgtggcattccgcccacaagctctatgtggccttcaaaactcccagactctcctacatatcatcacaaagtttcaccaatgttgtggtccctgccagggtcccctcagcctcagccctctgccaccatattttcttgttgagtcacccttacacacctcactagatgcacccaccaacttgcagtggggtctcatcccgactctgcctcaactcaccgcctgctgcttgctctggaattcgtgctctcgctctctgcggtattgctccacctccatctgtgcctcctcctttgcctgcttcagtcgccgggccttccctggaggcagaagaaaggacagtgagtggggatggacccacacacacacaatgtaatagcaggagtcagtcccttccagaaagttatacagccttctctcagccaaccaggtgccagattctaatatccatccatttcttccctcctaaccagcctccagaccctagctgtcttcccgccagccttgggttttcccaaaatgtttgctgtcccccacccccaattttctttccaaactcctaagggaggaaagaggagactcactctttctggcatctgccaccttctcagctgcccgcttctcagcttgcagaagctgctggataccttgggactgactggccatttctgttgttatggccgatgctgttttgaatgctgtcaaagtaccagatggctcccaccccccaccgcttacttctcctcctccagctcgttgctgcagtcctccactacccctgggtcttagtgctcccctgctcactcagcctcctgcaccgagtgtctctcccaatctcatcctcctattgatgactggtcctcctctccagcacttcttgctcaggcagtacccaaaggggccgcctgggagcagcagagaccaggcccaaagctgcgggcttacaacaggttagccatcccagtcggaaaggtctagggatgaggcaggggcggagacgggggagtactgaggtgagagaaggagaacttgattggtggtaacagaggaagcataaagggttgtgaatgcggtgaaaaggtaaggatgtcatcatgcaacctgtgttgggaaaagagcattctgggcttaattctaaactaactctctacctttctctctctctccaccatcccgccccctcccctgcctcccgttgttaacatctccatctttttctacatatttctcaagtccaaatttttgcatctcacttgccccatcctacgatagtcttcttccgtcttttgtctgtattttttcttttttttgatctgtccctgttgttgtcccactgtggtttttgtttttgttttccatgtttaatgtgatttttatcctgtctttatctcctctattttctctgtcttctcatcttttcgtccatcactgaaccatctcctctctctgccaagttagaggaggcgggaaaaaacctccaaataactctcttttctccctcccctcccctcgcctccttttcctcgcctccagtccagtcttctggtttcagacggcccctttaatttaagttccctagtttcccctgggagatctggccaagaactacccggtcggggcggaacgacatccggtaacgcccctcacagttcacttccgtcctccacctgcgtctctgcttgcgccatttcctccagcctggagtgtctccgcccttcccgcctcccgtctccgagcttcttaaacacaggccttgggcctacggctctgggggtacttgggggggcgggggcaggtctgatgagtaacccctccccccaggttccagaggaagaagcctccacatctgtctgccgggtacatgatattcaatttctagatcattattggagattatctgtgactttttaaaactcagatttctgctgataaaaattttccccatccggccctgttgggtttttttaaagttctttgttaaaaattaaaaatttacctgggctcctgagccttaaaccaattatttacccttttctcgaattttacattaaaaaaattaaacctctgatcctatcacccccctcaaaaaaaattttttttcaaatctatcatctgataaaggatcagggttaggttaggcctcatctcttgctgaagatattaaaaaaagacggaaccaaagggagaaacaacaggggatgtcagagatggagggagaaggaccagccaaggctgaagtcctgactgctgccttttttccttccccagcccaagagttccatggcctccacttcccgccgccaacgccgagaacgtcgctttcgtcgttacttgtctgcaggacggctggtccgggcccaggccctcctccagcgacacccaggcctcgatgtagatgctgggcagcccccaccactgcaccgggcctgtgcccgccacgatgcccctgccctgtgcctgctgcttcggctcggggctgaccctgcccaccaggaccgccatggggacacggcactgcatgctgctgcccgccagggcccagatggtgagtctgctcagtggggaacaaggtcataagcagctgaccagacctgaaatgaaagccaaccaatagttgagaaataagctggttatttggtcatcaggacctagggaaggagttaaccaagttggcatgtggctgtcatttgtccctttacattactgagctaccattgtctgaagaacccaacattccccaaagatcaactggtcttcaaatttcacatctgtttagattagtagctactttgtttcttgacagattgtttgctcgtagccaaaaagtagcatagaaggtaggctctggagttagattgcctggattcaaaccccagctccaaatcccagctccacacttcatagctacgtattcttggacaggttacttgaggcttagtttgcccatgtgtaaaaattaaaataataacaacctttgctatgtgccagacatttcttataaagtaacacatttaatcctcacaacaatcttaggaggtgagtactgatattatcccccatttcccagctgaggaaacagggcatagagaagtcatttgccagagttacagttattcactggtagagcagagattataacccagatggactagatagagtgtccatgcttttaacagctacattgtcctgtgttatacattatagcattgtacattgattgtgcccatgttcagagtacccatgttgtgccatatatgttttgagaatcaactgacatagtacataattagagtacctggcacacacgataagcacttggtatatgctggcgattgttgttcctgtttctctgttttttgtttttgtttttgttttttatgaagtttcactcttcttgcccaggctggaatgcaatggtgcgatcctggctcactgcaacctctacctcccaggttcaagtgattctcatgcgtcagcctcccaagtagctaggattacaggcgcatgccaccacgcccagctaatttttatatttttagaagagatgggttttcgccatgttggacaagctgatctcgaatgcctgacctcaggtgatccaccaacctcagcctctcaaagtgctgggattacaggtgtgagccaccacacctggccttgttcctgtttttgttatcaacaggtccatactcccttaaccacaattctaaactcaaaaacactctgagaaccaacatttttcatcaggctgccaccaaaattcatttggtgacagaaacctaatctgaactaaagtaagactattatttattttcatcctactgatgtcaatattcatacatttccctgcagaaacactcatgtgtttggttcttgggctgcctaggccctcctgggctacctaatatagagtgagtgtacttttaggtcagccctatcaagtcccaaaaacatttgaattctgcaaaacctttggcactgaaggattcaaatggggaacctggtgatattataatagtggtggaggccaggtgcggtgggtcatgcctgtaatcccagcactttgggaggccaaggcagtcagatcacgaggtcaggagttcgagaccagcctgaccaacatagtgaaacccccatctgtactaaaaatacaaaaattagccaggcatggtggcacacacctgtagtctcagctacttgggaggctgaggcaggagaatcacttgaacccggaagacagaggttgtggtgagccgagattgcactactgcattccaacctgggcaacacagcaagactccgtctcaaaaaaaaaaaaaagagtggtggaagcagctctttataggtagagccctgcttactagaataaaagctgaaaccttctttccccatctagagatttccttctggagtaagaacattacaggaaaacctctagatccagatgaacaaccctaacatcccccagctcaagtatagacagaaggcccctcccccaaaactcccccaaatggtcaaaaaaccccctatttaaaaatttcctttaacgtacctgagataggctagcatattcagatttgtttcttgttgtttttacttaaaacagagtaggtttactgagtgcaggcatctaacttgacagctcatattgtaagaggcaggaccctggaaggcaaaagagcggattaccccgaagcagacctgcatccagaccccagctctgccatcaacagggacatgcagcttacctctgtgagcccaatttgcctcgcaaaaatgggagttttgttttttgttttgttttgtttttttgagatggagtttccctgttgttgcccaggctagagtgcaatggcgcgatttcagcccacctcaacctctgcctcctgggttcaagagattctcctgcctcagcctcccaagtagctgggattacaggcatgcaccatcacgcccggctaattttgtatttttggtagagacggtttctccgtgttggtcaggctggtctcaaactcccgacctcaggtgacctgccagcctagcctcccaaagtgctgggattacaggcgtgagccaccgcgctcagccaaaatgcccctgatagtgtggtagggatttcctttattgtttgtttgcttgtttgttttgagacagggtctcattctgtctcccagcctggagtgcagtggtgcaatcatggctcactgcagcctctacctcgtgggctcaagcagtcctcccacctcagcctccctagtagctgggactacaagcacacaccaccatgcccagctaattgtttgtatttttggtagagactgttttgctatgttatccaggctgttctgcatctcctgagttcaaacagtctgcccacctcggcttcccaaagtgccgggactagaggcgtgagccaccacacccaactccattgtattgaattttaagaagctggtgagactgatattatcccatttacagatgaggaaagcagggcccaaaaggttcgggaacttgtctgaaatctcacagctctcaggtcattgtcttccaaagggggacccaagctcagtgccttcactcccagaccctggtgtcctctctggccttatttactcctggtcctctgccagccctgccaccagatggccttctaactccttggttgaaaggcccatctcattcagcttccagcttcctttttcttttccttttgagacggagtcttgctttgtcgcccaggctggagtgcagtggcatgatctcggctcactataacttctgcttcctgggttcaagcgattctcctgcttcagcctcccaagtagctgagattacaggcacacaccaccatgcccagctaatttttttatttttatttattaatttttaaatttttatttgtttatttatttttgagacggagtctccctctgttccccaggctggagtgcagtggcagtatcttgactcactgccacctccgcctcctgggttcaagtgattctccttcctcagcctcctgagtagccgggactacaggagcctgccaccatgcccgactaacttttgtatttttaatagagatggggtttcaccatgttggccagactgctctcgaactcctgaccttagatgatccacctgcctcggcctcccaaagtgctgggattacaggcatgagccaccatgcccgacctaatttttgtgtttttagtagagatggggtttcaacatgttggccaggctggtctcaaactcctgacctcaagtgatccacccacctcagcctcccaaaatgttgggattataggcatgagccaccgtgcccatcccacagaatgtcttttggttttgtttttgttttctgttttgttttgttttgttttgtttgaaaaggagtctcattctgtcgcccaggctggagtgcagtggcacaatctcggctcactgcaacctccacctcccaggttcaagagattctcctgcctcagcctcccaagtagctgggactataggcgtagggactgtaggcgtatgccaccacgcctggctaattttttgtatttttagtagacacggggtttcaccatgttagccaggatggtctcgatctcttgaccttgtgatctgctcacctcagcctcccaaagtgttgggattacaggcgtgagccacagcgcctggccaaaatgtttttatgtttatttttcttagtatgaaactccagcgtattaaagagcattgagaacggttgatctggtaaatcgctataaaggcggcatttctttttttttttttttttttttttttttggcgaagtgggggatggagtctcattctgtcgcccaagctggagtgcagtagtgtgatctcggctcactgcaagctccgcttcccaggttcaagccattctcctgcctcagcctcccaagtagctgggattacaggcgcccgccaccacgcccagctaattttttgtatttttagtagagacagggtttcactgtgttggccaggctggtctcgaactcctgacctcatgatccgcccgcctcggcctcccaaaatgctgggattagaggcgtgagccaccgcgccaggcctaaagggggcatttctaatactggagaaaggtgaactttttttttttttttttccgagacagagtctcgctgtgtcacccaggctggagtgcaatggcgcaatctcagcttgctacaacctccgcctcccgggttcaagcaattctcctgcctcagcctcctgagtagctgggcacctgccatcatgcccagctaatttttgtatttttgtagagatgggggtttcaccgtgttggccaggctggtcttaaactcctgtcctgacctgaggtgatccacccacctcagcttcccaaagtgctgggattacaggcatgagccactgtgcctgaccaggtgaactattttataaataatattggaacatttggctcatctagggaaaaacaagagtcccacctcacacctaatcaaaaagtaaattccagcagattaaatacctgaatatgacaggaaggtacacaccaaattcatgggacagatggcctggggaggaatgaaacttggaaggcggtatcacggtaaactacctttatctgtgatgattttatttccttaaaataaattatactacaaacatgacagtacattaacaaaccctgtggtaggaatggggttgtgtattgtattatactttgtatttttgagagttttttaatttcttttttgttgttgttgagacagagtctcactctgtcacccaggctggagtccagtcgcgcaatcttggctcactgcaacctctgcctcccgggttcaagcagttctctgcctcagcctcccaagtagctgggattacaggcatccgccaccacgtcaggctaatttttgtatttttagtggagacggggtttcaccatcttggccagactggtcttgaactcctgacctcatgatccacccaccttgggctcccagagtgctgggattacaggcatgagccaccgcgcctggccgagttttttaatttctaaaaataaaaatgagtatacatctaaagtagtagaagaaaatgcagagaatgttttataatcttaaaatagagccttcctaagagtgaagtgaaataaaaagtcagaaaataatatattgatatagatttaactacatgaaaattttaggccgggtgcgatagctcacacctgtaatcccacactttgggatgccaaggtaggcagatcacttgagccaggagttcaagaccagcctgaacaacacagtgagacctggtctgtacaaaaaatacaaaattagccaggcgtggtggtacgtggctgtcgtcctgtagtcccagttactcaggaggctgaggtgggaggatcgcttgagcccaggtggggcagagtttgcagtgagcaagatcatgccaccgcactgcagcctgggcaacagggtgagaccttgtctcaaaaagaaaaaaaaagcttttttaaagatagatagaagaaaatgtttgcaatatgtataacacatacagtatatagaaccctcatatcaatatatataatttccaaagaaaaagtggataaagaatatgagcaattcattcacaaaaaatacaaatagccaaaagacatgaaaaagaaaaaaacattgttaataaaataattttttaatctatccaactggcaaaattaaaagggttgatgatattcaattttggtaaaggaagacataggcacacttgtatattggcacaaacttattgagagcagtttgaccaaattgcgcatgtcctttgactcagaaattccacttatgaaaatctacccccacagaaagactgtaagatactcatgaggctgaacattttttgaaacaaagtctatcgatattggggtaaggagatttgttttgtacacacagtggaacactaattataaagtcgtcaaaaagtatgaggtagactgtatatattcctgtggaaaaatataaatgagatgttaaatgaaagaagcaagttgccaagcaatatttgtagtatggttacatatctccaaataaatgtgtcatatgtatgcttttaggtacaccaaggtgggactggaagggatcacagtacactgttaatagttatcaaatttgttcgtccttctttaaaaagaaaatttcaacttaattatatccctttcacattaaaatgtcaaataaaattgggggaaaagccacctacagccccaccacccataggctagaatttttacatattttttgccagtctattttttttctttttttttttttttttttgagatgggagtctccctctgttgcccaggctggagtgcactggcatgatctcagctcactgcaacctctgccttccaggttcaagtgattctcctgactcagcctcccaagtagctgggattacaggcacatgctaccacgcctggctaatttttgtatttttagtagagacagggtttcaccatgttggccaggctggtctcgaactcctgacctcaggtgatccacccgcctcagcctcccaaagtgctgggattacaggccatgagccaccacgcccggcctctttttttccaaccataggatttggtctcttgttttagacagttattatctgatcctctctctctctctcttttttttttttttttttttttttgagatagagtctcaccctgtcacccaggctggaatgcagaggcgcgatctcggctcactgcaacctccgcctcccaggttcaagcagttctctgcctcaacctcccaagtagctgggattacaggcgtcagccaccacgcctggctaattttatatataatataaaatataattatatatatattttgtttgtttgttttagtaaagacgggttttcaccatcttggccaggctggtattgaactcctgaccttgtgatccattgtccccccccccagcctcccaaagtgctgggattacaggcgtgagccaccgtgcctggccacatctgatcctctctacagttttgtagccagcttttttcaaacacatgcctcagttgtagtggctgtttaatattatgtttttatagttggaggccctactccttaaaacctatgaatgtaaacctcccatgcaagcctgagcactcaccatgctcaccacctgagctcaggtggggaacaagcgaatgagagacaggaccaggtactttctgggtgggacaagttgagagggtctgtgacaggtcacagcagcactagggagaagtgcccccccccaccaaccctgatgtgatttgggtagggatggtgggccttcgccagccacacctgggccattctgtcttcttgccttcctggccttgccttcccctattccagctttctgccaggtaaacagtactttccagcactaccaaataaagatttaaggactgctagcccatttcctcttaccccggggaaagaaagtaggtccacaggaaggaaggctgcctccctccccttcttctatcccccaagtgaaagaggtggttggtggccacagcaggtgggcctggccaggatgcctgggttggcagtgaaggaagtagcatggcactcagctaaccttgggccagatgcagcaaggttgggactgaagaaaaggggagttcaggaacgtcggttcctctcctgttttctctcagcccatgggtgagaccctctgtcacactccactccctttcccctgccctaggtcagcagtcatttggaaagagcttgctctgccgccggccatagttgttgccggttcacctccccacccctctcccatcatcccctggtaaggctggctgagagaaattcccctgaaaacatttattttactcagtttattgataagtgataataaaagataagtattacatatttgtgtatttattaatggcccagagtagagcattcagatattttcccagtctgatatatggtttcaggtgagaaaataagggatttatatagtgacaatatttttaagtgaaaagtggaatacatagtcaaagaatttgggcactgccttggtggctggaggcaggtcagaaaatgtcagttggcatggtagaacttctaggatgctgaaatagtttgtggagacacaagtaagaattttttttttttttttttgagacggagtcttgctctgtcacctaggctggagtgcagtggcacgatctcggcttactacaagctccacctcccgggttcacatcattctcctgcctcagcctgccgagtagctgggactgcaggcgcccgccaccaggcctggctaattttttgtattttttagtagagatgggatttcaccatgttagccaggatggtcttgatctcctgacctcgtgatccgcccgcctcggactcccaaagtgctgggattacaggcgtgagccaccgcgcctggccgagaatattttaaactaccacacttaccatgcatgtggtaaactatcagtctgtatttatcagtgatggttatttcctaatacccaggaggcatccatgtgagccacccttccattgctttaagaccaagggagcgagtgaccagcaggattcaagatggcagctctgccgaggagtgggagtcccagctaacttctgctccctgctctcccaccaacagcctacaccgatttcttcctcccgctgctaagccgctgtccctccgccatgggaataaagaataaggatggggagacccctggccaaattttgggctggggacccccctgggattctgctgaagaggaggaagaagatgatgcctccaaggagcgggaatggagacagaagctccagggtgagctggaggacgagtggcaggaagtcatggggaggtttgaaggtgagaagtccactgctatccacagctgcccttccccactggctgctttccatctgcatgaatgcgtcacactaggctcctctgccccctcctctgtgcttccctgcttcttggggcccatcaccttctcacagcctctctccaactacccccatcccaccctcccaaacaggtgatgcctcccatgaaacccaggaacctgagtccttctcagcctggtcagatcgcctggcccgggaacatgcccagaagtgccagcagcagcagcgagaagcagagggatcctgtcgacccccacgtgctgagggctccagccagagctggcgacagcaggaggaggagcagcggctcttcagggagcgagcccgggccaaggaggaagagctgcgtgagagccgagccaggagggcgcaggaggctctaggggaccgagaacccaagccaaccagggccgggcccagggaagagcaccccagaggagcggggaggggcagcctctggcgatttggtgatgtgccctggccctgccctgggggaggggacccagaggccatggctgcagccctggtggccaggggcccccctttggaggaacagggggctctgaggaggtacttgagggtccagcaggtccgctggcaccctgaccgcttcctgcagcgattccgaagccagattgagacctgggagctgggccgtgtgatgggagcagtgacagccctttctcaggccctgaatcgccatgcagaggccctcaagtgaccctagggaagaagcaagaaacttcggggctgcagcctcaggatgaggcagaaggaagggtaagggaaaggatggggaccacaaggaagagccaggtgctgctcagcagaggatatgggtgggagcgaaagttgtaacaagtgggggtggggggtgcgggccgccaccactgctccttgactctgccgtttcctaataagacctggttccacatctcactcccagtgtctcctctgtctttttccattgctgtggttttcatcacccatgacatctcctttcccgccccgcctgctgaaacccacagctcccacacacctgcaacacacacgcacacgctaacacgggctctgagctggaggcaagaagcctctgcatgccccctcagttcagccctaagaaggcccagtttgccatccagtctcactccactccctacactggggtcttgtccaccctgcaatctgtggctggagaaatagatgcgaacagaggcaaaaaggggaacaaaaccagtttccctcccctccctggctccccaagctgaaccacatcctcctccccacttaacacccccttcccccaacacagggctttccctttgctgagtcactgaatgagcgagttgggggtagccggcgctggggggccatgaggaggctgggggaggatggggaatacaagcagaatggctggaggaagagccctgtgggggagtggaatttcagttgctaaaattaggagcaggggaaggaggtggaaagagcaaaattatgtaacatgggttgtctgttcttgggcaactggagctccacacccaaagccagccaggctgctggctccatccatctctgccctctagcttgtcagttgtatctctcttcctccagggccccaatcctcatctccgccattcagctgctgccccatcctaaacctgagttcatctctgggcagcccaggcatggccttccctataaacatttccttttccaagaaccagtagttgaagtcctgagaggtggagggagagtctgggattcccacggaggagagaggggggctccctggaaactaagataggtagaccccactaccatcgcccaggacacaactgggaacttggcaaaaagaaaggacagggctgcaaggagagtacagacatgtgctggtgagtgcactgtctgcatagttacaccagagcatcttatcaatcagaaacttatctttcaggttttgagcccagttctctacaggagaatcccaggagtggaagtggaaggcagtagaagacagggagggcacgcctctgggaacacgggaacatgggtgggcatgagatccttgaataagacagcctgaagttcggaagagaccaaggcctctgaaggaccaggcagatgttcagggtgcaggagggggaagggctggtgagaaagatcctgtgagaggaagctgctgtgattcagagaagagacttcaagctgtgtgtgaccctggcgtccggttcctctcacaggctggagcttttcggaagtggcatgcaaagagtccaggtttggccttggggggagttggggttaggatccctaagctggaggttgagaagtaaattacagaaaactctggtgaccaaatttgctcctccacccaggagatttctcactggtttttaagcacatcatttccccttctgcaagagttacataaaaccaaagcaaaataagccctgaaacctgggcccaccggaccacagtcttttcaacgtcccttcctggtgtctggcccccagccctggtgggggttcccctgagataagggctgttcactttctctgaccacatggtttccgcttctgtgtctcttgtttcctaggctgataaaaatactgagccctagaggccctggcttcctctgaccccttggggcaggcagcaggcatcctgtccagcatggtgggggcagggacaggggccagggattcccaaggggtgactcagtgcctgccatgaaacagtgggtaggtggaagtgtatctctgctctctagagctggcaccaggagttgagtctcagtggaggatgcattgggattcaattggaggaacaggcctggaaaagaataatgagattgaagagggtcagtttgaggactcaggttggggcaggtttggattaagttaggaaaaggatctgggagggactctgttcagtgtaggt

SEQ ID NO: 16884 - DNA, 5868 bp, Human
tgcaatggcatgatttcggctcactgcaacttccgcctcctgggttcaagtgattctcctgcctcagcctcccaagtagctggaattaaaggtgcctaccaccacgccccgctaatttttatatttttagtagagatggggtttcaccatgttgatcaggctgctctcgagctccttacctcagatgatccaccttccttggcctcccaaagtgctggtattataggcaagagccactgcgcccagccccagtattcagtttttaaactgtcttgttatcaaggctctggagccagatgcctgggttcaaattctggttctgccactgactctgtgagctccataagtttcttaacctctctgtacctcagtttcctcttagggtttttgtcaggattataattattggctgggcatgatggctcatgcttgtaatcccagcactttaggaggccaacacgggcagatcacgtgagtccaggagtttgagcccagcctgggcaatgtggcaaaaatccatctctacaaaaaatgcaaaaattagctgggcatggtggcatgtgcctatagtcccagctattcaggaggctgaggtaggtgaatccatagatcctgggaggtcaaggctgcagtgagccatgatcctgccattgcattccagtctgggtgacatagcgagaccctgtctcaaaaaaaaaaattattaaagtgtgtaaatcagtggcataaacatgttaagtgcattttgtgggtcagctatattattattagtattacggaaacacatagagatgttaccaagaaggggagatgattggagccacttccagcttccttggacctggtctttcttcccttgactctttttttttttttttttttttttttgagagagagagtctcagcctgttgcccaggctggagtgcaatggtgcaatcttggctcactgcaacctctgcctcccaggtttaagtgattctcctgcctcagcctcctgtgtagctggaattacaggcgcgtgccaccacgcccggctaactttttgtatctttagtagagacagggtttcaccatgttggccaggctggtctcgaactcctgacctcaagtgatccacctgcctcagcctcccaaagtgttgggattacaggtgtaagccactaccccggctactcccttgactcttaaccactcatgctgcctacatctaccattcatgtggtccttgctgctttgttttggttattcctgcatttatttgtccttttattcatttatgtataaacatttagtaagcacctactaatggatagggctcattgtagacttggaagctctctgagggtgggagtatgcctcgtccatctgtctttactttttgtagcaagggaggtaaagctccatttccatccctccttagtgagtcagtagtcagtggtgaggctaaggcttacctctccctttctcactcagcacagggggctggagatgagcaagggaacgggaggaggtcagcccagtatgggaatcagttcttctcagggaacccagacatccatccctcaagattccagtccttgtcctagtccggcccttgacctcagagacgggatcagctcttcctccagcacctaccttgagggtatagaagaatgcaaaccacattggaaacctggagatctgtgttctcatttcagctctgctgactggcttcctgcaagctaccttccctccctgggcctcagtttctctctctgctgagccagaagatgtctaaagacccctttggttccaccctgagagcctgtctccctaacctcaacttcttccccagttcagagaacccaggcatccagctgccccaccccagctctgggtaaacaggaagctgggtgaggggagcaggggtgtgcggaaagtcccagccaggtgtgcaggtctacagggagggggtgggcccgtccctgaggtatgaaagccccctgctctggctctggttcagtctcaatgggggcactggggctggagggcaggggtgggaggctccaggggaggggttccctcctgctagctgtggcaggagccacttctctggtgaccttgttgctggcggtgcctatcactgtcctggctgtgctggccttagtgccccaggatcagggaggactggtgagtggctgcaacaggccctggtggagagttgtatcttgcggatgcttggctccctctggttgtgcctgtggtcttttgccccctctggctcagctggctcggctgtccctggtggggatgtcttgtctctttgctgactctctttccatgttcctgtgatgttgtgcttgtgtcccgacataagccccttgtgtctcctctcctcttcccgaggtacatctgtttctccgcccaagtacctatgccttgcttgttctcccttctaaggaggtgtgtgttggggatggtgctggtaggagaaaccccaggcctgcagcttgggtccactttcagaggggtaggggtgacatgagctgaatctgaactctgggcactgtgaccccacccaaccaggtaacggagacggccgaccccggggcacaggcccagcaaggactgggtaagagcagactgtctctccttccccgcttcagaccctcaggggctcccagctccctgctgcgtccccagatacctcttcctctaggaatccaggctccccatccctgcgccctgttctctcaagggtagcctgcatgggtggctgccctgcccccaatcgtggactctttgccccttccagggtttcagaagctgccagaggaggagccagaaacagatctcagccccgggctcccagctgcccacctcataggtaaggacctccaagacctgaataagagtgtaaataatccgaaggttccagttctgctcgcccagagtccttcggctccatgattccagtgctcggtttcccacccgcttcacgaccttttgtcgctcgtgcccactcttacgctcgtccccgcagtgtagtttcttcttccctccggtgcaagcaaaagccggcctggaggtccccactacagcgttctgcaccccacatccgtgttccctcggcccccaactcgcactcatcccagaaacagcaccatccctcctcccccggcccggctcggctcccgcaggggctaaaagccgccacttccccagaagtcccaagcctttaggatcgcattcccaagagcgcgtcggcccgtgtctccgcaggcgctccgctgaaggggcaggggctaggctgggagacgacgaaggaacaggcgtttctgacgagcgggacgcagttctcggacgccgaggggctggcgctcccgcaggacggcctctattacctctactgtctcgtcggctaccggggccgggcgccccctggcggcggggacccccagggccgctcggtcacgctgcgcagctctctgtaccgggcggggggcgcctacgggccgggcactcccgagctgctgctcgagggcgccgagacggtgactccagtgctggacccggccaggagacaagggtacgggcctctctggtacacgagcgtggggttcggcggcctggtgcagctccggaggggcgagagggtgtacgtcaacatcagtcaccccgatatggtggacttcgcgagagggaagaccttctttggggccgtgatggtggggtgagggaatatgagtgcgtggtgcgagtgcgtgaatattgggggcccggacgcccaggaccccatggcagtgggaaaaatgtaggagactgtttggaaattgattttgaacctgatgaaaataaagaatggaaagcttcagtgctgccgataaagatgctgagttgcgacacacgtcttaattcagggtgggtgcacgggtgcgggttaaatattctcagtactcttctggttgcttgaaacaattcatcacaacacagtgtatggcctttgctcctagggatgatggtctgcctgtcccaccccctccctgcctctgaatggccaggccccaccattagcccagttggagggtgggaggaagggggacttctcaaactccgaagcttctctaggcatcctgattttcagggccacatggtcccaaccagactctgcaccatactcttttctcttgggtaccccccaacagtgagaggggtcattacagagcccagcaagcaccactcagaaaggcccagcagcagagtaagcccctatcatgacagaggaatgaagcctggaggggccccgcacttctccccctagagctgcctgaaggcctctctgtctcctacccgacagtcaactcttctcctccaaggagcttaattcaaggctcatggggtctgaagggaggaggctgaaggagaaagaaggggagaatattagagagagatggggatggcaggaaggagcctgtggtgcctgaaaacaccaggaagttctggggaggaggaaaaaccgatgccccacttagggtgtcccatttagggtgagacggaaaatcctcacctttttttcacactttaggtcccccttcccaaaagtgagtaagtgtgggtgcttctgggatgagtaacagtgtcccccattacttcatggctgactttcagccacaggctggaggaggcagagggtgacccaaggccctatctaggtcaccccaatgggtcaccctaccccctcagcctaccacatggttttctcctgcctggcaccccagggctggaggtaaagcctaatttccgaactcagtgggggctcccagtctaggggggctcaatttccgtctccatatttgtttttggaattattatttttttgagacagggtctcgttctgtcacccagacgggggtacagtggcatgatcatagcttactgtaacctcaaactcctgggcttgagtgatcctcctgcctcagcctcctgaggagctaggattacaggcatgcaccactacacctgactaatctttaattttttttctagaaacaaggtcttgctatgttgcacaggctggtcttgaactagtgggctcaagtggtcctcccacctcagcctcccaaagtgttgggataacaggcatgagccactgcgccccacccttatttgtctttgactctctccagaagagccttcatccagggagggggtgcttttctctttccggattacccacctctcacctctcccctccttcaccacaaagaccagtgggaccaagccggcatgtgagtccttcacccacatcttattcctatgtttcattcttttttaaaaaatagagacaggatctcactatgttgcccaggttgctctggaactcctgggttcaagcgatcctctcaccttggccttgcaaagtggtaggattacaggtgcatgccaccacgtccggcagttcggttccttgttctttattgtcctcagtctcttcgatttcacccactgagagaatggaaggggatagaacagctggaaactggttgaaggaagccagaattcactaagtgcccactgtgccaagggctgagtgaggtcctctgatggaggtcaggccttctctcacatgccctatgtgtggtggacattcctatccccattggatagataggttaagtggctggttcaggttgcagagttaggacagggtgatttgaagcctagacacccgaatctctggaagtcccttggctgtgtgattcaggtacctgagaatgcggctcctctccagctctctccggactgctggccagctgcaacagccggaaatctcacctgagctgcaggattttcccagcaaggattggaattcccagagttggaaattc

SEQ ID NO: 16885 - DNA, 9928 bp, Human
tgccagccagccaaagtcaatattgatatcaaggcagctgtagctataaagctgtaggagagaaaagagaggccgggagaggctgccaaacctgtttgatcttcaagctggccccatttacctaaggcttctcttggacacagaccagttggaacaggagaggaccctgagaagtagagttgttttgatcccctcccctcaatgggaaggggtcctgtgtgcagattttgagggtcaccatgagggaattcacacccacacagaggcatggaatcatacccttacaggatgttacagttcaagggaacgaacaccaaagatagcctttctgtcgggaggagagaaaaaggccctcccacaagcaggagaaaacccacagaagaggaagcacaagaggaaaccaccaactgctggtttccagcagcacatcacgtcactccaccccactcctcccccaagtctctccctttctttaagtttcaagctctgttttagttctgtgttcttgcactccaccatggttttctggaactgtaggtcttttgttggacagagggtgatgaggaggatagagaagggatggttggacaggagagaaattcaggatatggaggctggaattctgggtttattttttcagcaggtcataaaggtttaatagaaatcaaggttactggagagagagctgctcctcctatgtcctccctgcttatttatttaggtgtccccaaggactctactcccactattctgtctgatctttctttatccccatgacaggaccagctaacaacacccctaccccaccccctatacacatacttcaggatcgggccatgataatcccacccctctgccccatctccaaggcaacctgtcagtgagacgaggacaaagggcacaggaaggggccccaataggaaacataagtggaagcacaaagctgaccaagctacaggaacagacccctccctgcaacaaagccccttgcctcggctttatgtttccttcgcaaaagacttcgtcatctcccttcccatccctaactctactttctttttcttttcttcttcttcttttttttttttttttttgagatggagtttcgctcttattgcccaggctggagtgcaatggcaccatctcagctcactgcaaccttcacctcccgggttcaattgattctcctgcctcagcctcccaagtagctgggattacaggtgcccaccaccccgcctggcaaatttttgtatttttagtagagacagggtttcaccatgttggccagtctggtcttgactccctgacctcaggtgatccaccccccttggcctcctaaagtgttgggattacaggcgtgagccacctcacccggcccctaactctatttcctatgcccaatcccaagtgtaggccacaaggactgcaagtcctagtgctgagctgggcccggagacagtagactgcggggggcacaggacctactgagacaccagtctgggcagctcagggagtgctggcgtcaccccttccctaatcccaggctgcatggctaacggttcctatctgcagtcccagccttccacttccgagttcttctctcagaccacagtcccagcaacccagaatttggattggagtctggaagaaatgcagaatgattaaacgaccacctttccatttgaagtccccatccctgaatcttcacgggtgtgcccaagctgttagtgtcaagttttttatatgagggtcagtcgggttgtactcagattaatgaagcagggaaactgaggcagaaaagagtcctgtgttcaggagaggtcggagaaacaaggaggttttcaggactcctccttaacacccccatccccatcctgtgggagatccgaggattccccttccggactcactccctacatcgtcgagtcccgcccccctccagtcccctccccaggttcagggcggggccggtcggtgagtcagcggctctctgatccagcccgggagaggaccgagctggaggagctgggtgtggggtgcgttgggctggtggggaggcctagtttgggtgcaagtaggtctgattgagcttgtgttgtgctgaagggacagccctgggtctaggggagagagtccctgagtgtgagacccgccttccccggtcccagcccctcccagttcccccagggacggccacttcctggtccccgacgcaaccatggctgaagaacaaccgcaggtcgaattgttcgtgaaggtaagaacacttctctcctcagccacccaaattcctggaagccaactctcacctttcccccggtccagccttaactccccaatcccttccctccttgactcccacccccaatcccacgtgcactctttggttgaggggtggttttgagaggggaagacattaacttgttagcaagtaatgagaattctaggatcaaccctgaaaagtttgtaaaagtgcaagtttctagcagactaaaggaagggaagtggagaaaaaggagaattcccaaaagtgagactggggtggggttagagggcgagctggtgaagggacagtgggggcccagcagggtttagaagggacagaggggaacctcagttaggacatgtgtccctacaagatctgagggtgagtagtgcagtaggagaggtgtgtgtgtgtgtgtgtgtgtgtgtgtgtgtgtgtgtgtgtgtgtggatggagacgcttcagggaagacggtgtgttgagggaggcctgagagtgagagcaagtaaattgggaagctttggaggggcggaacaaaacaggagactgggatcggagtttgaaaagcagagctggagaggtgatcgggtggcattgaatatccccaggactggggaaagggacagaaggggaggtggcaagaagacgtgagtttaacgtagctaccacaaggatgggtgggagagagatcagacggaggagaagagctcggttagggcattttgggatttgggggttggagaagtagaagacttgccccaactctctcctctctctgcgggtgtgggtaaggagagatggtcctatggcatttgggtagcaaaactgcaggcagcaggcttctcggtgtcacccagcccccctctgattgcagcggccgctcccctccctaccgctgctgcattcatttcccagtcttgggacctcctggctgtgcccctccctcccttccttaacagtgtcctcttctccccgctccgtttgtgtctctccgttggcacgcacgtctccccactctccactttcctgccgcctttctttccccttccccccttttgtttctctcatctttgtgtgtctctgcctgtgtctccctctcccttctgcttgggtttctcgggcagccattccctctccctgggcccagggaagtcggagcctgcttgggtccgcccccttaggtgtggtccccacctcactctcacattcgcctccggggctatttttactcgtgggtgaggctgtgccgcagagattccggccctgtgtcctgtgagaggatggttattgcagtcagaggacttgtgctgggagaccctggcagcaggttaggggtagccttagctgcccaggcctcatcctcactgtcccttcccccacatccttgacaggaaggaagccggagacagagagatgaatcaccctcagcttagggggaggtgtcccttgggccaatgaggtcaccacttgctaattagagggcagcccctctctgtagggccctccacatctctagcgcgaggcccagggccccttgactagactccccacccaaagacaccttggattggaggtgtagagaaccaaaactctggctcccaaaccccacccacctctcctgtcttcagactctactcccttcaggaacccagaaatccaggcttctagcctacaactctggcctcactgaagttccacacccttccctctctaggattcagatcctcccaagttctccaggacctcctccctctacctacctcccacctgtcctcagtgtctggggaaccagaagcctgcctttgcaaaacagtttcccattgatctgccttaggtttgacccaggcccaagggcaaagagcccatagtgaggggacagtgtatgtgtcatgactaggcagaaaacagctggtctgggagtgggaatgcagggactggcctagggatgggtggggtgcatcaggcataaccttgggttggggttacttttcaggctggcagtgatggggccaagattgggaactgcccattctcccagagactgttcatggtactgtggctcaagggagtcaccttcaatgttaccaccgttgacaccaaaaggtaggcctgcttatgttccttgaaacacccctggtgtacacatgtgtgcaaacacacacccacccgagtccttctgtcatgaacatttttgccctccccctggagtccctttcttatcccacgtcctccattccccctttctggttcttcctgacccccatttccagtcctgattcctgatcctttctccaggcggaccgagacagtgcagaagctgtgcccaggggggcagctcccattcctgctgtatggcactgaagtgcacacagacaccaacaagattgaggaatttctggaggcagtgctgtgccctcccaggtataggggcactcagaaagtggagaggtggagcagggagattctgggaaacagacagtttgcagaaatggaaaacagagatggtggtggggctggggcaggagagctagctgaggttcctcccaggaagacatcttacctcatttttcccattggctttcaggtaccccaagctggcagctctgaaccctgagtccaacacagctgggctggacatatttgccaaattttctgcctacatcaagaattcaaacccagcactcaatgacagtgagtcttgtgggtcagaggcctgggtcctgggaggaatagagaggacccagcgggtaggagacattaggggcacctggacgttcagatatcagggagatgaagcagatgttcgtaaatttcccccagcttcccatttttgctttacctctatatttccctgcattttcattggccaagacttttaagcttttctcatttgttccctagcctcttctgccccactgaggacgttagttggctgctggcctgttttctggcagaatagggtcatgcttaagaacagtcatcactctagatccagactacctgagtacaaatccaactagccgtataattttgagcaatcatttcacctctctgtaagtccatttccagatccacaaaattaggatgacaatacctatttcatgggttgatataaatttttttttttctttttttttgagatggagtctcgttctgtcgcccaggctggagtgcagtggtgcaatcagctcactgcaacctctgcctgccgggttcaagcaattctcctgcctcagcctcctgagtagctgggattacagacgtgcatcaccacgcccagctaatttttgtatttttagtagagacagggtttcaccatgttggccaggctggtcttgaactcccgacctcaggtgatccacctgcctcggcctcccaaagtgctgggattacaggagtgagccactgcacccggcgatataaatgagtttgtaaaatgtaaagtgttcactttgggaggccgaggctagcgcaccacctgaggttaggagttggagaccagcctggccaacatgactggtctctactgaaaaaaatacaaaaattagccagttgtggtggcaggcacctgtaatcccagctactcaggaggctgaggcaggagaatcatttgaatctaggaggcagaggttgcagtgagccgggatcatgccactgcactccagcctgggcaacggagcaagactccgtctaacataaaataaaatgtaaagtgcttagaataacacatagaaaagtaactacatgagtgttagctattattattttggactcaccattagtatccacccccaacgggccttttcggactatgtcaatcttttcctgaagttctaatcagttccctctcttgcacagatctggagaagggactcctgaaagccctgaaggttttagacaattacttaacatcccccctcccagaagaagtggatgaaaccagtgctgaagatgaaggtgtctctcagaggaagtttttggatggcaacgagctcaccctggctgactgcaacctgttgccaaagttacacatagtacaggtgtgtggttattgcgggaggagaggatgaccactggagtggccctttaaggagctcccacatgggcttcccctgacaaccactctaaagacgatttctttcttagggtggttttcataaattgctaccaatggcagaccccaccccagtcctttgcagcagtcattgctaacaagaccactgcttgagataattatattccatgatgtaagtcatgggtgcaaacagactagcaaagaggaatacatcccagtattacttttgaagaatgctcttcctgtctcggtatcactgccaaattcccagattagacagagcaggcttttcctaaagtcaaagctttaactttctttataacttcagtcttcacttcctcttgtggaagatcaaaactgctggttcccatgtttttgtcatagtctcaaagctatggtttagtttgtgcaacatgggcctgacatcagtctgccacacaactatgtagtgaacatctgtgtactaagcattgaaagatacacaagtgtatggtgactgggccttgctctcaaagggttgaaatctgagacaataaaatattcacatgaaagttaagaatatatgatgaaaagtcagatgggccgggcgtggtggctcacgcctataatcccaacactttgggcggccaaggctggtggaccacctgaggttaggagttcgagaccagcctggccaacatggtgaaaccccatctctactaaaattacaaaaattagccgcacatggtggtgggcacctgtaatcacagctatttgggaggctgaggcaggagaatcacttgaacccgggaggcggaggttgcagtgagccaagatcgcgccattgcactccagcctgggtgacagcaagactccatctcaaaaaaaaaaaagtctgatgaaaaatatagagacaaaagtcacctgtgtcagtgcctgaagtggtatagggggaaaaagtcactgtggaaattcaagaggagaattttataagtaaattatatctcaagttttaaaaactcaggaaaaatggctggttattaaaagccaggatttcagtaagtgagaaggaaggctaacgacagtacaagacagtgaggagttgagctggttttatcatgtcggcctggggagaagggaaagccaaggtggcttccctgggtctaacatgttggtccctctcctctccccatcctcaggtggtgtgtaagaagtaccggggattcaccatccccgaggccttccggggagtgcatcggtacttgagcaatgcctacgcccgggaagaattcgcttccacctgtccagatgatgaggagatcgagctcgcctatgagcaagtggcaaaggccctcaaataagcccctcctgggactccctcaaccccctccattttctccacaaaggccctggtggtttccacattgctacccaatggacacactccaaaatggccagtgggcagggaatcctggagcacttgttccgggatggtgtggtggaagaggggatgagggaaagaaatggggggcctgggtcagatttttattgtggggtgggatgagtaggacaacatatttcagtaataaaatacagaataaaaatcaagtgtttttacgcaatgggggtttaaagtgtgggcgacatggaatgaggggtgggtcagtgatcttgagctcagggcagaagccaggaattaagaagggaaatgtttgtggtggggctgctatgtttcgtgccggtccgccggtccgccgttgcgctgttctgaggtctacgaagcgtttgcagccccgtcgccagggccggccagatctgggtgggcctgggcagcgctcgctgggcggtgccgatttctggcaaggggggcgcagtctggatgtaatgggcgcggcttagcagggcggaatgggcgtggcccgaagaagccccgccccgtcccgcttagacaatgccccggagccgccagaccgtcgcgcccctgccccatcgtagtatatgagctcgcctacacaaggacccccgctaaaagccagagctcccagtccccgaggcttgaagacggggactcccttctccaccaactctgtcctcggggggtggggccccagccgagatcacagcgcgacaggagtgggggtggccgctggaggtgagtcttgcgtggggggccctgaaccgtgtgggggccggagtttgggggtgccgggcccatgcctgcaccagacagagagtatggggagccggtatttgggcgcggagctaggcggggtggactttgggacatagacggggaaccgggtcctggagccgggagtagtgccagcgccccggaaccacgccccctgttaccccgcccctcgcatttcgttttagacctctcccagtccttcgggactcggtctggtttatactaggtcgtgctaggggcagcgtgaccagccagggcggagagaggatgcttaactccttaggctcgaactcctcccttcctacccacctctctcccttctcgttcgggtattcaggacttccattccccagcccctgcctctccagctttctccttctgtcccataacccctgcgggtcccgggctggacttccagtccctgcggtagcgagcagctgagggttaagggggcggggctgctgcatttttggggagtgagcgcatcctagtggctgccaagaggggcgcccgacagggacctcacaagcccccaagcaggggcaacaggtgttttggagattagagaccctagccttgttcctcaggctcctcttaaagaatctgacccctgagggtgctgggtagagtgaggtcgacaggagcggaaggtctggagtgggtggggcggagtgggagggacgcctagagatggcaggaggaagacctgggcgctcttaaccacccccaacgcccttgtctgcatgtctttttctctgtctcctccttttctgtttcttctcccagacaggtgaagaaacaagaaaactaagaaatccgagcggttggagggggagtctgtgtggatgggatggggacgccgggggaggggctgggccgctgctcccatgccctgatccggggagtcccagagagcctggcgtcgggggaaggtgcgggggctggccttcccgctctggatctggccaaagctcaaagggagcacggggtgctgggaggtaaactgaggcaacgactggggctacagctgctagaactgccacctgaggagtcattgccgctgggaccgctgcttggcgacacggccgtgatccaaggggacacggccctaatcacgcggccctggagccccgctcgtaggccagaggtgagcgccgtggcgcgggtgtggtatggggaaaggcagaaggaactggatgtcggggctttggggaagaattgaggatgggggtgtcacagctccgtgccctcttctcctatcctaaggtcgatggagtccgcaaagccctgcaagacctggggctccgaattgtggaaataggagacgagaacgcgacgctggatggcactgacgttctcttcaccggtgaggctggggggaggcataggtcttggcacagggaagtagagtttggga

SEQ ID NO: 16886 - DNA, 7953 bp, Human
caccctggctgactgcaacctgttgccaaagttacacatagtacaggtgtgtggttattgcgggaggagaggatgaccactggagtggccctttaaggagctcccacatgggcttcccctgacaaccactctaaagacgatttctttcttagggtggttttcataaattgctaccaatggcagaccccaccccagtcctttgcagcagtcattgctaacaagaccactgcttgagataattatattccatgatgtaagtcatgggtgcaaacagactagcaaagaggaatacatcccagtattacttttgaagaatgctcttcctgtctcggtatcactgccaaattcccagattagacagagcaggcttttcctaaagtcaaagctttaactttctttataacttcagtcttcacttcctcttgtggaagatcaaaactgctggttcccatgtttttgtcatagtctcaaagctatggtttagtttgtgcaacatgggcctgacatcagtctgccacacaactatgtagtgaacatctgtgtactaagcattgaaagatacacaagtgtatggtgactgggccttgctctcaaagggttgaaatctgagacaataaaatattcacatgaaagttaagaatatatgatgaaaagtcagatgggccgggcgtggtggctcacgcctataatcccaacactttgggcggccaaggctggtggaccacctgaggttaggagttcgagaccagcctggccaacatggtgaaaccccatctctactaaaattacaaaaattagccgcacatggtggtgggcacctgtaatcacagctatttgggaggctgaggcaggagaatcacttgaacccgggaggcggaggttgcagtgagccaagatcgcgccattgcactccagcctgggtgacagcaagactccatctcaaaaaaaaaaaagtctgatgaaaaatatagagacaaaagtcacctgtgtcagtgcctgaagtggtatagggggaaaaagtcactgtggaaattcaagaggagaattttataagtaaattatatctcaagttttaaaaactcaggaaaaatggctggttattaaaagccaggatttcagtaagtgagaaggaaggctaacgacagtacaagacagtgaggagttgagctggttttatcatgtcggcctggggagaagggaaagccaaggtggcttccctgggtctaacatgttggtccctctcctctccccatcctcaggtggtgtgtaagaagtaccggggattcaccatccccgaggccttccggggagtgcatcggtacttgagcaatgcctacgcccgggaagaattcgcttccacctgtccagatgatgaggagatcgagctcgcctatgagcaagtggcaaaggccctcaaataagcccctcctgggactccctcaaccccctccattttctccacaaaggccctggtggtttccacattgctacccaatggacacactccaaaatggccagtgggcagggaatcctggagcacttgttccgggatggtgtggtggaagaggggatgagggaaagaaatggggggcctgggtcagatttttattgtggggtgggatgagtaggacaacatatttcagtaataaaatacagaataaaaatcaagtgtttttacgcaatgggggtttaaagtgtgggcgacatggaatgaggggtgggtcagtgatcttgagctcagggcagaagccaggaattaagaagggaaatgtttgtggtggggctgctatgtttcgtgccggtccgccggtccgccgttgcgctgttctgaggtctacgaagcgtttgcagccccgtcgccagggccggccagatctgggtgggcctgggcagcgctcgctgggcggtgccgatttctggcaaggggggcgcagtctggatgtaatgggcgcggcttagcagggcggaatgggcgtggcccgaagaagccccgccccgtcccgcttagacaatgccccggagccgccagaccgtcgcgcccctgccccatcgtagtatatgagctcgcctacacaaggacccccgctaaaagccagagctcccagtccccgaggcttgaagacggggactcccttctccaccaactctgtcctcggggggtggggccccagccgagatcacagcgcgacaggagtgggggtggccgctggaggtgagtcttgcgtggggggccctgaaccgtgtgggggccggagtttgggggtgccgggcccatgcctgcaccagacagagagtatggggagccggtatttgggcgcggagctaggcggggtggactttgggacatagacggggaaccgggtcctggagccgggagtagtgccagcgccccggaaccacgccccctgttaccccgcccctcgcatttcgttttagacctctcccagtccttcgggactcggtctggtttatactaggtcgtgctaggggcagcgtgaccagccagggcggagagaggatgcttaactccttaggctcgaactcctcccttcctacccacctctctcccttctcgttcgggtattcaggacttccattccccagcccctgcctctccagctttctccttctgtcccataacccctgcgggtcccgggctggacttccagtccctgcggtagcgagcagctgagggttaagggggcggggctgctgcatttttggggagtgagcgcatcctagtggctgccaagaggggcgcccgacagggacctcacaagcccccaagcaggggcaacaggtgttttggagattagagaccctagccttgttcctcaggctcctcttaaagaatctgacccctgagggtgctgggtagagtgaggtcgacaggagcggaaggtctggagtgggtggggcggagtgggagggacgcctagagatggcaggaggaagacctgggcgctcttaaccacccccaacgcccttgtctgcatgtctttttctctgtctcctccttttctgtttcttctcccagacaggtgaagaaacaagaaaactaagaaatccgagcggttggagggggagtctgtgtggatgggatggggacgccgggggaggggctgggccgctgctcccatgccctgatccggggagtcccagagagcctggcgtcgggggaaggtgcgggggctggccttcccgctctggatctggccaaagctcaaagggagcacggggtgctgggaggtaaactgaggcaacgactggggctacagctgctagaactgccacctgaggagtcattgccgctgggaccgctgcttggcgacacggccgtgatccaaggggacacggccctaatcacgcggccctggagccccgctcgtaggccagaggtgagcgccgtggcgcgggtgtggtatggggaaaggcagaaggaactggatgtcggggctttggggaagaattgaggatgggggtgtcacagctccgtgccctcttctcctatcctaaggtcgatggagtccgcaaagccctgcaagacctggggctccgaattgtggaaataggagacgagaacgcgacgctggatggcactgacgttctcttcaccggtgaggctggggggaggcataggtcttggcacagggaagtagagtttgggagactcggccgtctggagccttgtttctaactcactcccgccctcaaacctccgcggcctcccggactcaggccgggagtttttcgtaggcctctccaaatggaccaatcaccgaggagctgagatcgtggcggacacgttccgggtgcggagcgggaccagcctagggagggagggggtgcaggtgggggtcggaagggcctgggcgcccgctgaggaaatgagaggcagagagcagcctatgtttgaagataccccatcacccctcccgcgcccctgaatacctcccttcgctctccctaggacttcgccgtctccactgtgccagtctcgggtccctcccacctgcgcggtctctgcggcatggggggacctcgcactgttgtggcaggcagcagcgacgctgcccaaaaggctgtccgggtgaggagggggcggggccaacgaaagtgggcgcagttctgggcccgggaggccgggagctgggaggcttaggaaattagccctaacccctgccctcaatgggctgtccatcttacatgaaagaacacaggagaaaataagaagttacaacagcaggactgggaacaggggtgattaatttgctcttccggagtttcaggaaaccccaaaggtggcacctaaactgtgactctaaggatgggtaggacagataggaggggctggggaaggtagggggttgaaaataactgcatgtgattccaaggtggaaattagcaaaggtaactaaagtacttagtgtctgacatatcgtaagctctatgtgcttgctgtcattattttccacaaatgtcagtccgtccccagcccttagtggtggttgagcaggcagacacagctgtggagaggttctgagactcgaacacttcctctttcctctaggcaatggcagtgctgacagatcacccatatgcctccctgaccctcccagatgacgcagctgctgactgtctctttcttcgtcctgggttgcctggtgtgccccctttcctcctgcaccgtggaggtggggatctgcccaacagccaggaggtgagagagggcaggaactccaacaccaagcaccatcagagaaaagagtttcaggctttcctagtgggaggaaggaagggtaccttctctagaagcctgggtggggccactctgagctggctggaagagtggcctggctcagcctgaggtctcactcccctctccccactccatgtcttccctgtgcaggcactgcagaagctctctgatgtcaccctggtacctgtgtcctgctcagaactggagaaggctggcgccgggctcagctccctctgcttggtgctcagcacacgcccccacagctgagggcctggccttggggtactgctggccaggggtaggatagtataggaagtagaaggggaaggagggttagatagagaatgctgaataggcagtagttgggagagagcctcaatattgggggaggggagagtgtagggaaaaggatccactgggtgaatcctccctctcagaaccaataaaatagaattgaccttttagactgggctgtgactggtgtcttactggggcaaagggatagggcagggctgaaacctgagtttggggtcagtgcagggaagaaggcctcttattcaaaaatcttgttaggtacttatcaactcattgcccaaccatgtcataggtacttgagcacaagatgaacaagacagaatttctatcatgggaagtgtgtccagggcagagaaaagagtgtatgggtggattgctcactgaatttatctaaatgttagatgattcagagactggtagattaccagtccacccctatttgataaagaaaaagaaatgacacttccagggacattcattttcattcattcatttaatgaggcttagcaatgatatcaaaagggtcagtctcctgacgttggggagctcacagtacatgcaaatttcttacaaattgaaatacaggttgtcatggaacaatttacagaaggctgtttctatgagggaaataaagggggtgtgccctagggcatcaaagtatatgcaaggggtggccaaggagggtcaccttcccagaaaaggccatacttgaactaaggataaataagaattagccaggcagatagtgtgaaggagggaaaggggtaatacaggaagaaggaattgcactgggcaaagacattttggggctagggagaattctctaaggctggcattttctaagatgtgcatgtggaatgacacaggtaagcctggagagtggacaaagtgctgtagtaccttgtatccaaagccaaggcacgtgggcacagagctgaagctaaggagagtacttcagttctgtaataagggctgtcaggagcagttatctcttgagtaggatctctctgacttcagggaggaaagcaagggtaggaggatgaggtggggctatgggtaatccaggaaggaagtgagcagagtacattcacgtggcagcgctgggcatggaatacagtgtgggtttgacagtgatgttaagatagaaagactggacttcatggctcattgtgtgggagtaagagagaaaggaggtctgcgtgactcccagtttctgggttgggcaactgggttgttaaagagaatacagaggagaattaagtgagcagcttcagagatgacaatgagttgggtttgacattcagagtgcgaaatgcctgaggtcagtcaggcagaatgtctaagtggaagtttgttaatcccaaatctgagatctgagccagagagagttctgagtgtcatttgcagaggagggggctgaggactgactgttgatgagagtgtcccagaagaagagaaagggacaaacctagaatggtgggaaatactgtagggatatggagcaaggaagaggagtccaaaaagaaaacaccagcaacaaagaaaaacagcttaaagaatcaggccgggcgcggtggctcacacctgtaatcctagcactttgggaggccggggcgggtggatcacgaggttagcagatcaagaccatcctggctaacacagtgaaaccccgtctctactaaaaatacaaaaaattagctgggcgtggtggcgggcgcctgtagtcccagctactcaggagcctgaggcaggagaatggtgtgaacccggcaggcggagcttgcagtgagggagatggtgtcactgcactccagcctgggcaacagagcgagactccgtctcaaaaaaaaaaaaaaaaggagctagggcttgattgggtatagagaggacactggtggtgagggagacatggaggttataggagagatgggagtaagtttagaagtaagaccagtggcagagacagcctggaacccaggtctcccaactcccagtctagcacttatttctataccatggtgccttcctcttccaggtgaggaaccaaggaggggagagggattatggggagctgggatcccctagcttgggaggtttggagtaagggcttcccttcaaactacaactgcatagatggtggaggcatcagcagggtccgctgtggacagccggcggggcctgctgagggctagatggtccagatccgcatagagcaggctctggaggaggaaggggaggaagacaagatggtctccacagtcttccttggggttcaggcctttttttttttggtccattttcctcagagattctggctatccccttcccatccccatgcccttaccggttcctggtccaggtcccctggaatcttgggctcttcctcctttactggcctctggggctcggttttcacaagtggagctatgtgggggggacagagctgaaggatggagagaaggtgaccaacgtgtctgctcccagcaagggctcagactcaggaattgaggggtggggagtgggcatgtaggagaaagaaaatggggtggaattagtctcaccaaatctagggagtggtcgaatcggttgcgggggcaggcgcctgtaagggacatatgagtctttgagaaccaccagtcttgtctcactggttctcctgggactcgccacgccaaggacagcccagcaacttgaaggctcagaccggaaacaacttagactctaccccaccgacagtccagcccaggctctaactctgctgcacttccagctcatctgctctggtggggctctactcaccagccagcggcctcgctcccacctttgacctctcccattcttcgccaagccaggaccagagctctaggtctagctctttc

SEQ ID NO: 16887 - DNA, 28596 bp, Human
gttccagaaaaccatggtggagtgcaagaacacagaactaaaacagagcttgaaacttaaagaaagggagagacttgggggaggagtggggtggagtgacgtgatgtgctgctggaaaccagcagttggtggtttcctcttgtgcttcctcttctgtgggttttctcctgcttgtgggagggcctttttctctcctcccgacagaaaggctatctttggtgttcgttcccttgaactgtaacatcctgtaagggtatgattccatgcctctgtgtgggtgtgaattccctcatggtgaccctcaaaatctgcacacaggaccccttcccattgaggggaggggatcaaaacaactctacttctcagggtcctctcctgttccaactggtctgtgtccaagagaagccttaggtaaatggggccagcttgaagatcaaacaggtttggcagcctctcccggcctctcttttctctcctacagctttatagctacagctgccttgatatcaatattgactttggctggctggcatgactacccacagggtatcgtgccttaatttaccaggtgacaggcaacgctgccctctcctggaaccatccagcagagccagggctgtacccccaaatcctgcaacagaggtttccctccatctcacctccctgtccctgcatttctcctatctcagtagctcctctttccctctctgggcttctctttccactccctccccttcctgggcttggtaaactagtccctaatctcttcacaccccagattggaaggtgggtccctccctgacactccccagagctgtcaccaacctcctccaagtttctatagctccattgctcaacagatttgccaggggtaaccattaacccagcccttaactctgttcccccacctttcttgctggaggggattttccaattactggttagcacagctaggtcatctcacccccaccatctttcctaacttcttgggttggggggctggggaggaatctccccatctcagggtactaggaacaaagctggggaggatggtgcatttaaagggattatatatatatatatatatattttttttctttctccctcataaccccacccccgcaacacacacacacacacacacacacacacacacacaaataagctttatggagcagtgacttcattatgttcaccgctttgagtccaacccctggcccaaaataggcactaaatagttgccgaatgcatgaatgatagatacctctctgtcttcaggggtgtgtagaagtgcgaaggggtatgggcatgtcccagtaggggtgtgagtgttctgatcagaactacttctctctgccagaatttgatgtaattcgaatgcttccacctctgcttgaagggtttaaataataaattaggccctgtcgtgccattatgggggtggtcataccctgtacccaggaaacaggcacggtagggctgagacagaagtcctgcttgtttccgcttatttatttgaaacaccgctcatttaggtcttactttgtttgccaggcactgttctaagctctgtataaatattaactcagagggtacaaatattaacttaagagttgttgcaggaaaaaaaataagcgcctctggctctttaagtttggcctccccctcaaaacccccgcaacggtcccaaaccccttccagggactgggactacggaccctggtccgaccttctcgcgggcttcccactgcgccaatcaaatcccagaaacagtgagtgctagaggcccggctgctaagcaacggcagagggcgggaagtttgaacgttctggacccgccccgaaggcaaataggccaatcagcgtccagactcttcagctacggcagtccgcttctcctcctcgccctgtcggatctctaggctggatccgggcctctccaatcaacagcggctaggagggcggggcgcgtgcgcgcgcacctcgctcacgcgccggcgcgctccttttgcaggctcgtggcggtcggtcagcggggcgttctcccacctgtagcgactcaggttactgaaaaggcgggaaaacgctgcgatggcggcagctgggggaggaggaagataagcgcgtgaggctggggtcctggcgcgtggttggcagaggcagagacataagacgtgcacgactcgccccacagggccctcagaccccttccttccaaagggtaacctccgcgtgacaggaatgagggtggggcgcgtggagtttcccacaatctgtactttagttaaatacccgagaattcacctcctgtgtccacagctctccacgcccctcagccctgccccgcagccctgtagcagaagtacttagtgctttgcattctgcgcgccaccctaccccggcctcctctgtgaatcgttgcttccgaaccgccctcactttttgcatccgcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgaggtctctgaggggagtagaaacttgaatggagagttgatgggaagttagaataaaagagggttgggagccgggcgcggtggctcacacctgtaatcttagcactttgggagactgaggcgggcggatcacctgagctcaggagttggagaccagcctgggcaacatggcgaaaccccgtctctactaaaaatataaaaattagccgagcgtggtggcacgtgcctgttatcccagctactgggaaggctgaggcaggagaatcactgtaactcgggaggcggaggttgcaatgagctgagattgctccactgcacttcagcctgggcgacagagcaagactccgtctcaaagaaagaaagaaaaaaaaaacagggttgggaagagctgggcaagtctcttacctcctgagtggctgtttcacattcactaaatgggggtgatgatgcctatctcagagatttgagaaaatgattaaattatataagacatggtaaaccctacacttatgagtgattctaatagtgatttcctttcttccttgctggacagatccatctgtgtgtgctgtggaattcaggatacttgggcattgcctactatgatactagtgactccactatccacttcatgccagatgccccagaccacgagagcctcaagcttctccagagaggtggggatggaaccatgaattcctctgctctctgggattgcagatgtgttacacacacacacacacacacacacacacacacacacacacacatattttttttttctagacagagtcttgctctgttacccaggctcaagtgcagtggcgcaatcttggctcactgcagcctccacctcctgggttcaagcaattctcctgactcaacctcccgagtagctgggactacaggcgtgtgccaccacacccagctagttttttgtgtgtgtttttagcacagatggtgtttcaccatgttggccagggtggtctcaaactcctgaccttgtgatccgcccaccttggcctcctaaagtgctgggactacaggtgtgagtcaccacgcccagccatgttttacttacattaactcacctcactgtctagcatattttgtgttgctgtaaggaaatacctgactctgagtaatttgttaaaaaaaaaaaaaagttttatttggcttatggttctggatggttggaaagctcaaaattgggcatcttcactggtgagagcctcagactgcttcaactcatggaagaagggaaggcagggtgtgtagaggtcacatggcagagaagaagcaagggggagggagatgccaggctctttttgacaaccagctctctcaggaactaatagagtgagaacctctcactcatacccaccaacacactccaggaagggcattaatctgttcatgagcgatccactcccatcacccacacacctcctgctaggccctacctcacaacactatcacactggggattaaatttcaacacgatatttggcagggacaaatcacatccaaactatagcactgactcaatatattttacagttgcttcacagaggctccctcttttgtttttatgaattcatttcattatttaacaaatatttgtgaggttgttttttggtttgtttggttgttcttttttgagacagtgtcttgctccgtcactcaggctggaagtgtagtggtgccatcttggctcactgcaacctccgtctcccggattcaagcaattctcctgcctcagtctcccgagtagctgggattacaagaatctgccatcacgcctggctaatttttatatttttagtagaggcagggtttcaccacgttggctaggcttgtcttgagctcctggcctccagtgatctgcctgccttggcctcccaaagggcagggattataggcatgagccactgtgcctggccacaaatatatatgacgtatttacaatgtttcaggtgcttcagattcagccctgggcaaatcagtcatgtctgttctccaggggtttacagcctagtgacaacatccagaacatcccacttccctctcaccatcccaccactcttaactacttttctaaatctcaacttctacctgtgttcccactgtgcagagcactccctactcctagggaggaaatgtttttgagaaggagaggggtaggaagaggagggctatgggttttctcttagtcaaagacaaagatcctttaactcatttgatctctgttctccttccaagttctggatgagatcaatccccagtctgttgttacgagtgccaaacaggatgagaatatgactcgatttctgggaaagcttggtaaggacttggtaaaggatagagggaaaatggggaaggactaatatatggaatattccagggggctagaattgggtgagagggagtgtcagacagaggtagaaggactgagatgtaaagaatgatagccttttctttcctcccccacagcctcccaggagcacagagagcctaaaagacctgaaatcatatttttgccaagtgtggattttggtatctccttccttttgctttgcctaactccctgttccggtgtcccattctttcccccaactctaccttcatcatcacagatctcccctctgccttatgtcatcctaaacctttgtgctcctcatgccctatgacctgtccccccaagatctctcctgctccctaccctttaataacctgcagcttattgggaagcctctgcttaagtcatgtctagggatgagggcctcccctgaggagtggtgacactttttggacagggttttattgttggaattctccccattaagttaaagccttttatcaccaaaccaaaaggcactgcctcagtgacccttattatgatccataaggcacttctataactttcctaggtttacaataagaacaggagtgtactatcctaattagatattaaggcattagtgttactagttctattaataccattattttgaccaaaatcctcaattccagacagatgtctactttcctcagccatttatctttctcaggctgtgctttcagacaagtatctttatattatatgtagaataaaaagagaattagactaagagtctgaaaatttggttcttgctctagctttccattaactgcctgtgtgagcttgggcaagtcaaataatctctcttgcttctattgtctcattcttaaaatggggtgaaaaaattgagctacaagaccgttccctttgcttgcctccctcaaataggtctggagataagcaaacaacgcctcctttctggaaactactccttcatcccagacgccatgactgccactgagaaaatcctcttcctctcttccattattccctttgactgcctcctcacagtgagattggtcctgggggataagggctgggaggcggcacaagtgctagggctgaattctgggaggtactggcctagccctggaaaatagtaactttccctggtgctctgcagcccccaggagatttaagatttaccccgattccactgctgatcccctcccaggttcgagcacttggagggctgctgaagttcctgggtcgaagaagaatcggggttgaactggaagactataatgtcagcgtccccatcctgggctttaagaaatttatgttgtaggtgattcaccccaaccccaaccaaagtaatgtgggattgggaggcctgaaaagtaaagtgggggtggggtgtggatgtggctgtgacccagtgggtcaagtgctctaggacacccgggagaatctaagggctaatgagactttgggaagaagactgggacaatattcagagagggggacaaaggaagtggagttgtggaacgaactcagactgcttcctgcttttttgttttctgtcctcaggactcatctggtgaacatagatcaagacacttacaggtaaagaggtggaggcatgctgctgtctctggggagggagaaggattaagtttaatgccccaataatcctaatgaggctctagtttccctaatcctggggctattaagatctctctccttgaaggaaagggaaggggggttttgagggaaagagaggaagaaaagcataaagatactagctttcttttctatagggagaaactgaggcaaagaaaagtaagggacaaaccttacatcaagatatgatctcggctgggcgcggtggctcatgcctgtaatccccgcgctttgggaggccaaggcgggtggatcgcctgaggtcaggagtttgagacctgaccaatatggtaaaaccccgtctctactaaaaatataaaaattagctgggtgtgttgtgcgcctgtaatcccagccactcaggaggctgaggcaggattgcttgaatccaggaggcagaggttgcagtgagctgaaattgcaccactgcactccagcctgggcgacagagcgagactccatctcaaaaaaaaaaaaaaaaaaaaagacgtgatctcaggaggatatcccctgtccccattccatttatcagtcctcaattcttattcccttcaaaagtccaagttaccccaaactcctccatttctcctcgacagtgttctacagatttttaagagtgagtctcacccctcagtgtacaaagtggccagtggactgaaggaggggctcagcctctttggtaggtgtgccccatccctcatctcacattacaaagacctaccagaaaagcaattggctccaaagatgtgtcccagcctcccttcccacttcactcccattgtcagatatctctttcatgccaatccaaatttcttacctatttgtaccccccgccccccaagcttgagcatcttcccatactttgtggctgtacagtgttgttgcatatcagccattactttaccaattctgtgttccttccctgggtttgtatgaatgtttctactagttgggtacctgttagggactttgggagaccttgtgtatagagaagagttttgtaactgcataactgcctatttgatttgtatagagtctttatcagttgtctctggctttagggtatattagggacatctccgcaaatatccatatagtttcatatctcagtaagttgtgtccaggttttttttttttttttttttgagacagagtctcgctctgtcgcccaggctggagtgcagtggtgcaatatcagctcactgcaagctctgcctcctgggttcacaccattctgctgcctcagcctcctgagtagctaggactacaggtgcccaccacgatgcctggctaatttttgtatttttagtagagaacgggtttcactgtgttagccaggatgatctcgatctcctgacctcgtgatccgtccacctcggcctcccaaagtgctgggattacaggcgtgagccaccgcgcctggccagttgtgtccagttttgtgtgtgtgtgtgtgtgtgtgtgtgtgtgtgtgtgtgtgtgtgacgaagtctcgctcttgtcccccaggctggagtgcaatggtgcgatctcggctcaatgcaacctctgcctcctgggttcaagcgattctcctgcctcagcctcctgagtaactgggattacaggcacctgccaccacgcccagctaatttttgtatttttagtagagacggggtttcaccatgttgcccaggctggtcttgaactcctgacctcaggggatccactcgcctcagcctcccaaggtgctgggattacaggcatgagcgaccgcgcccggccgtccagttttttacatatgtgtgttgggctcttgagttttttgtttgtttgtttgttttttagatggaatcttgctgtgtcacccaggctggagtgcagtggtacaatttaggctcactgcaacctccgcctcttgggttcaagtgattcttctgcctcatcctacctcagcctcctgaatagctggaactacaggcctgcaccaccatgcccagctaatttttttgtatttttagtagagatggtgtttcgccatgttgcccaggctggtctcaaactcctgagctcaagtgatcctcctgccttggcctcccaaagtgctgggattataggcatgagccaccctgcccggccagctattgagtttttgtatttttggaggggcgggagggctcttgagttttttgtgttttgtttgtttgtttatttgtttcgttttgttttgagacggagtcttgctctgtcacccaggctggagtgcagtggcgcgatctccgctcactgcaagctctgcctcccgggttcatgccattctgcttcagcctcccgagtagctgggactacaggtgcctgccaccatgcccggctaattttttgtatttttagtagagactgcgtttcaccatgttagccaggatggtctcgatctcctgaccacgtgatccgtctgcctcggcctcccagagtgctgggattacaggcgtgagccaccgtgcctggccagttcttgagttttaactaggtctgctttgtgtatttttctggctaagtgtccctgtgagtgtccatcccttcccccatctccatgtacggtaatcccagctcatatttgtggccaggcaccagctttggctgcctttgtgccctcccaggccagcttcctcaacaaccagcacctctgacctggatgcctcagcttagacacataaacacattccattccctgtccctgccttgtaacaagttcactccctgccttatccctcacaggaatcctcaacagatgccactgtaagtggggagagaagctgctcaggtgagtgggtcccacacatactacacactaatgcatgaattccatatgcacactacatactaaagcctactaatggcagtatacagattctcacatacaccaccccacctagtagtagtaaagcaactgccctttactgagcactggctaactgcatttcatccttataacagctttgtgtagtagctgatatgcatctcattttttgttgtcagcgcaggtacacatatacccattgatgatacacagacttgcacacatacaagcagcaggaaaaaacacaaaatgtaaggccgggcacagtggctcacacctgtaatcccagcactttggggggccaaggtgggtgaatcacttgaggtcaggagtttgagaccagctggccaacatggtaaagccccatctctactaaaatgcaaaaattagccaagcgtgttggtaggtgcctgtaattccagctactcaggagactaaggcaggagaatcgcttgaacccaggaggtggaggttgcagtgagccaagattgtgcactgcacttcagcctgggcaacagagtgagactccgtctcaaaaaaaaaaaaaatgctaatgtaacacatggctatgttagcatggttatctttagttatagaaaacacacttcacatttctgtgatgactctcaaatttgtgtctctagttttgaactccgtatgtgaatgttaattgcatatcaccacctgcagttttcacaggcagctcaaactcagagcatccaaactgatgcccaccagatctgttcctcttcctgcattccctttgctggttaatggcattgctggcagtacaccttctcaagccatgaaccttggattgatgctagaaacaaaaaacctgtcattccaaaacagagatctaagcatgtcactcctttttttttttttttttttttgtgactgagtttcgctcttgttgcccaggctggagtacaatggcacgatctctgctcactgcaacctccacttcccgggttcaagcaattcttctgcctcagcctcccaagtagctgggattacaggcgcccaccaccacacctggctaatttttgtattttcagtagaggcggggtttcaccatgttggtcaggctggtctcgaactcctggtgatccgcccacctcggcctcccaaagtgctgggattacaggcatgagtcactgcgcctggccgtcactccactttttaaatagcctaagtagaaagaaaataacataaaccttaggaggttttcccattaccttcaggattaagattagcatcttaagcagtataatgatgttcagggtccatcacgtttaccccagttttaatttccagactcaccttccaaagccccttctaagtcctttcctactggatctaccttatattctagtcatttagggccacttgccattatggaaacatgtcatgcctgtgtttatgctgctccttctggaaagtcttttttttttttttttgagacggagtctccctctgtcacccaggctggagtgcagtggcgcggtctttgctcactgcaacctccacctcccaggttcaagcaattctcctgcctcagcctccggagtagctgggattacagggacccaccaccatgcctggctaatttttgtatttttagtagagatgggatttcaccatgttggccacgctggtcttgaactgctgacctcgtgatctgcccacctcggcctcccaaagtgctgggattacaggcataagccactgtgcccggcctggaaagtcttttccttgttctgtacctatcaaaatcttacatccaggtcaggcgcggtggctcacgcctgtagtctcagcattttgggaggctgaggtgggtggatgatttgaggtcaggagttcaagaccagcctggccaacttggtgaaacttcacgtctaccgaaaatacaaaaattagcccagcatcatggcgcatgcctctagtaccagctactcaggaggctgaggcaggagaattgcttgaactcgggaggtagaggttgaagtgagcccagattgccccactgcactccagcctgggcaacagagtgagattctgtcttaaaaaaaaaaaaaagtgcatcctcttcaaggtgcaatccaactgttaccctttggcttttacaggtacctgtaaggagttgatgtgcaccttctttgtgctcacatagtgcttgtttatgtttttctagttgcactgtcacatcatgttagaattagcagtcagtgaatctgcttgcctccatagctatgaactctatctagtagctatacctgttacctcagtgtctgacacatggtcttgtacatagtagcactcaatgtgtgaacacaacgcaaatgtaaacgcactggtgacatcatctctaaacagagtggaaacctttgctagcctcaggtgcacaatccttcccctacctcacctcccgctgcaatgtgtatcttgtaggagttaatttaggataatctctgaggtcatctccaggtaatcagcatctccaggaatcggcagggtaatttaattacccacacattcttcagtgcttcaggtgcagatctttaatctcagccacagatgggagggagagaattctcagtggagaagagagctggatttaaggtcggggaggaatgcgtattccccaaatggaatcagacagggcatgagatcatataacttgaagaatcatcatataatctaatgaactaaggacaggtgacatatttattaatatttctgtatacgaatttattttaatttattaggaaatacctctaacgtacaaaaagatgtaaataataatatagggccagatgtggtggctcacgcctataatcccagcatttgggaggctgaggcaggaggattgcttgaggccaggagttcaagaactaaaagctgtacaggcaccaagaatatgactgaatgtcacagtatgctctaaagggcactgtcctaggagtctggagacatgattttgagacttagctgttctcattggcggtatgactttgggcaagttgcttatcttttaacggtttcattttctcagttgttaaatttacagtttggtttaactaaagtctctcccagtacgagcagggcgtgagtcagagatacctaagtgtttagtgcagcgcatgtgctttctaaagtggggatggctatttacagactggcctacactgttctggtgggagccctcagtgaccaaggagcagaggtacctgaaacccacccttgaagccatctggatgctccgcttcattcaaatctggggtgttctaacccaaagtaactggccacagactgcaatgtaagatacaaatcttcaggacctagtgtgtgcacatgttggctcttatataagatggcatccttagtacttgttctatgtagaaaagaatttgtgggctcacaagtccctacagagtctcacactctcatggccaataagtatacagggatacccggaattagacaaacacagatgagacatttatttctgtatatgaatttattttatttatttatttattttttgagacagagtctcactctgtcacccatcctggagtgcagtggcctggctcattgcaagctccacctcccgggtttacaccattctgcctcaccctcccgagtagctgggactataggtgcccgccaacacgcccggctaattttgttgtgtttttagtagagacggggtttcaccgcgttagccaggatggtcttgatctcctgacctcgtgacccgccctccttggcctgccaaagtgctgggattacaggcgtgagccaccgcacctggcctgaatttattttcatttattaggaaatacctccaacacacaaaaagatgtaaataattagccgggcgtggtggctcatgactgtaatcccagcactttgggaggccgaggcaggtggaacaccagaggtccggagtttgagaccaggctggccaacatggtgaaacctcatctctactaaaaatacaaaaattagccgggagtggtggtgcacccctgtaatcccagctactccagaggctgagacacgagaatcgcttgaacctgggaggcggaggttgcagtgagctgagatcgcaccactgcactccagcctggacaacagagcaagactctgtctcagaaaaaaaaaaaaagatgtaaataataatactatcgggccaggtgcagtggcttatgcttgtaatcccagcactttgggaggccatggcaggaggactgcttgaggccaggagcttgagaacagcctgggcaacatagcaagacctcgtctctataaaaactattaatagtaatacaaatggccaggcgcagtagctcatgcctgtaattccagcactttaggaggctgaggcaggcagatcacctgaggtcacgattttgagaccagcctggccaacacagcgaaaccctatctctactaaaaatacaaaatttagctgggcatggtggcacacacctgtagttccagctgctggggaggctgaggcaggagaatcacttaagcctgtgaggcagaggttgcagtgacccgagatcccgccactgtaccctagcctgggcgacagagcaagactccatctcaaaaataataataataatacaaatatctatatatccatcagccaatttaagaataagacatgccgggcgcggtggctcatgcctgtaatcccagcactttgggaggccgaggcgggtggatcacaaggtcaggagttcaagaccagcctggccaagatggtgaaaccccgtctctactaaaaatacaaaaattagctgagcacagtggcgggtgcctgtaattccagaacctgggaggtggaggttgcagtaagccaagattgtgctactgcactctagcctgggcgacagagcaagactctatataaaaaataaaataaaaaaaaagaataagacactattggccgggtatggtgactcacgcctgtaatcccagcactttgggagccgaggcgggcagatcacgaggtcaagagatcgagatcattctggccaacatagtgaaaccctgactctactaaaaatacaacaattagctgggcatggtggcgcatacctgcagtcccagctactcgggaggctgaggcacgaaaatcacttgaacccgggaggtggaggttgcagtgagccgagatcgcatcactgcactccagcctggcgacaaagcgagactctgtctcaaaaaaaaaaaaaaacgaaagaataagacattgttgttgaagccccttaaatgtccctccccaatccttttttctctgcagtgttgaccattattatgaattaaagcttatcatccctaatgggacagttatgttttcacaggaagaatatgaaaagatgaatgtctgttgctgttacccagagacactttcacagctaaaaagacatacaaactcatactgactcaccgtctcttactcagcctcagagtgagctgcagtgttggcacacaaatacctcaacacactgctctccttctaaaatattgacaagctccgttacttatatacatggaatgacacacggtcttatccgttgaaactgtgatatgtagacacaattatgctcacatctagcaattttcagtagatacatgtaaacacacctgaatgggtaggacactgcacttgccactacattcccatagcacatcgtggatacatattgccacaatccccagggactgcaagcacactttttggcaaactgagatcaagatgatagatgtaacttgtagtacccccacccaaaccctcacttccaggctatggttcacacgtccgactcatgacctgggggagctcagttctcgtctggacgtcattcagttttttctgctgccccagaatctggacatggctcagatgctgcatcggctcctgggtcacatcaagaacgtgcctgtgagcccagggtggagggcagggaggtggggaaggaggttgagggctgatactgggcagtgggcttcttgaggggcattagagtgagggaagagaaaacagcggctgtaaccttgtctgactgtagctgattctgaaacgcatgaagttgtcccacaccaaggtcagcgactggcaggttctctacaaggtaaggccttccttcttgaatcccaaaagtccaggtaaaggccctcagcctgtattccagactgtctgtaccctagacatgctgtccaattttattctaccctcttttttttttttttggagacagcctcgctctgtcgcccaggctgaagtgccatggggcgatcttggctcactgcaacctccgcctcctgggttcaagcaattctgcctcagcctcccgagaagttgggattacaagcgcccgccaccatgcctggcaaatttttgtatttttagtagagacaggatttcaccatgttggccaggctggtcttgaactcctgacttcaggtgatccacctgcctcagcctcccaaggtgctgggattacaggtgtgaaccaccaggcccggcctccctctttttttttttaactttgtattcaggaaaatgtaaaaaatatttagaataatataattaacccccatgtacccaccatgcagtttcaacactttaacttacgccaattttttttttatttctttttctttttttttttagacagagtcttgctctgtcgcccaggctggattgcagtggtgcgatctcggctcactgcaacctctgcctcccaagttcaagtgattctcctacctcagcctcccaaatagctgggattacaggtgcccaccaccacactggagtgatttttgtatttttagtagagatgggatttcaccatgttggccaggctggtctcaaattcctggcctcaagtgatctgcccatctcggcctcccaaagtgctaggattataggtgggagccaccgtgcccagcctagtatgtgtcatctatatctttttctactttcccctcttggattattttgtgggttttgttgtcgtttgtttgtttttttaaataaggtcctgctttgtcacccatactagagcagagtggtgcagtcatatttcattgcagcctctaacttctgggctcaagcaatcctcccaccttagcctccagagtaactgggactataagcctgagatgctgcacctggctttcttggattattttgaagcaagtcccagccattatatcatttcatccataaatatttcagtgtaatttcttttttctttttttttttttttttgagatggagtctcactctgtcaccaggctggagtgcagtggcatgatctcggctcactgcaacctccgcctcccaggttcaagcgattctcctgcctcagcctcccatgtagctgggataacaggcacatgccaccatgcccaagttttttttttgtatttttagtagagacagggtttcaccatgttggccaggatggtcttgatctcctgacctcgtgatccacccgcctcggcctcccagagtgctgggattacaggcgtgagccacctcacccggccaatatttcagggtaatttctaaaagaaaattattttttaaaaagaataacagtattgttatcttactttaaaaattgtattatttggtatcatcaaatatctgaaatttttcttttttgagacagggtctcactctgtcacccaggcttgagtgcaatggcacaattgtagctcactgcagcctcaaactgttgggctcaagcgatcctcccccctcagcctcctgagtagcagggaccacaggtgatggccatcacaccgaactaagtttttattttttgcttgcatttatttatttatttatttatttatttatttatttttgagacgggattttgctcttgtagcccaggctggagtgcaatggtgtgatctcggctcaccgcaacctccacctcctgggttcaagtgattctcttgcctcagcctcccaagtagctgggattacaggtgcgtgccaccacgcccagctaattttgtatttttagtagagacagggtttctccctgttggtcgggctggtctcgaactcccgacctcagatgatctgcctgcctcggcctcccaaagtgctgggattacaggcgtgagccattgcacctgaccaattttttattttttgtagagacaggatctcactatgttgctcaaggtggtctcaaactcctgagctcaagtgatcctcctgcttgggcctcccaaagtgctgagactattggtgtgagccacgatgcccagtcagatgatggccctagtcctttttaatctaccggttccttctctatcttttctctcttgttctttctttctttttctctttttcttctcctggcaatttgttgaagaaactagattattatttgtcttatagtgttttccattagcctggattttgctgtttgcatttcctagatgtttttggcacatttctctctcttctatagtttctgtaaattaatatttagttctagaagcatgattaggttcagagttttttttttttcaatactgttttagaagtagaggaacataatgtctgatatgtccgattgtctctctttttctgatgttggcaaatgttctgatgtttaatacctaaatctattattcatttatttatttatttatttagtttgaggtgagtctccctctgtcgccaggctgaagtgcagtggcacgatcttggctcactgcaacctccgcctcctgagttcaagtgattctcctgcctcagcctcctgagtagctgggacttacaggcgcacaccaccacgcccagctaatttttgtatttttagtagagacgggatttcaccatgttggccaggatggtcttgatctcttgacctcaggtgatccacccgcctcagcctcccaaagtgctggcattacaggcgtgaaccactacacccagccatctattaattctttagcaattacaaagtagtagcatttaaatctctgattctttcttcatttattagccagaaatttctgtaaagagaaacttccttttatgtactatttggttgccaagtgatagaaatcatatagaaatacagaaaattgcttgatatttcccccactcttttttttttgagacagagtcttgctctgtcaccaggctggagtgcagtggcacaatcttggctcactgcaacctccacctcccgggttgggtttcaagtgattctcctgcctcagcctcccgagtagctgggactataggcgtgtgccaccatgcctggctaatttttgtatttttagtagagacagggtttcaccatgatggccaggatggtcttgatctcttgacctcgtgatccacccgcctcggcctcccaaagtgctgggattacaggtgtgagccaccatgcccagcccttttttttttccccaatatggaacgcttcttgaatttgtgtcatccgtgcccagtggccgtgctaatccctgtaaccttcgaaatttcagtatatgtgctgcagaaatgagcaccccccacctttatttactagctatcaatatggtaaattagttccctaacattctccaagatagccatgagatttttttgttttttgtttgtttgtttgtttgtttgtttgagatggagtcttgcactgttgcccaggcaggagtgcagtggcgcgatctcggctcactgcaagctctgcctcccgggttcgcgccattctcctacctcagcctcctgagtgcctgggactacaggcgcccgccaccacgcctggctaattttttgtacttttagtagagacagggtttcaccctcttaaccaggatggtctcaatctcctgacctcgtgatccacccgcctcagcctcccaaagtgctgggattacaggtgtgagccaccgcgcccggccctgatagccgatgaggtttttttgtcattgttcttcttgtatcattacagactcatggccttttatagctatatttctctttctcccgactctgtacaaactcctttgttttagagtttgcacaaccctctatcaaagcacctaccacctcacttttaaatcttctgcatgtatttctgtcttccttcctagactgtgagcacatctgggacagggaccatatctttttttgtttatttgttttgttttgagacagagtctcgctctgtcggccaggctggagtgcaatggcgtgatctggctataacctccacctcccgggttcaagagattctcctgcctcagcctcccaagtagctggaattacatgtgcatgccaccaagcccagttaatttttgtattttgagtagagacagggtttcaccatgttggtgaggctgatctcgaactcctgacctcaggtgatctacccacctcagcctcccaaagtgctgggattacaggcatgagccactgtgcctggccaggaccatatcttaattgtctttgtagtttcagtgtttggtacagtgcctctcactgtttctttttgcctttgagatcttccctctttgttactgtgatcttccctactggtctttgttcttctgagtctgtccctatcaccacctcaacccgagctggatgtggcctgtcctcctttttgtgtttctctcacagactgtgtacagtgccctgggcctgagggatgcctgccgctccctgccgcagtccatccagctctttcgggacattgcccaagagttctctgatgacctgcaccatatcgccagcctcattgggaaagtagtgagtagaaggaaaaagggagtgcacccagggaggtcagggagagagaatgcagtgtgcaagatggggaaacatggaagatattgaggtcaattggataaagaatgggatggtgggaggaggcagcagaacttcagggaagtatctggagggtgagagttaaaggaggactgcagggagaattggggcccaaggagagctgaggaacaggacagagggtgccaggtcctaagaaacagtacttatctcctcaggtggactttgagggcagccttgctgaaaatcgcttcacagtcctccccaacatagatcctgaaattgatgagagtgagtgttgggtgtggatgggcctgtgagccctgcgcagtgatggagtaccatccttggcaggtggtcaccacagctggggatcttcatagcaaccagggcaggagactcacttttgataaccacgtgtcttccaccctcgtagaaaagcgaagactgatgggacttcccagtttccttactgaggttgcccgcaaggagctggagaatctggactcccgtattccttcatgcagtgtcatctacatccctctggtgagggcaggagagtgggtgtagccttcagatgtcttttgggggagatattaggcttatgaaagacatactggtagataagaaaacttgtggggcagcctgaagaacatgaacacttttttgtggggatacagggatcttttaagctccctctagggtggggaggtgtccagtaagtctccaagcaggagagtagagtatctcctctttactctccccagattggcttccttctttctattccccgcctgccttccatggtagaggccagtgactttgagattaatggactggacttcatggtaagaccctcaacctctgtaaggtgagtgatgaggaaaatgagtcagcagctgaggaagagcgttactctacagcagcactgcccaatatgggatctctcctctgtagttttactctgagctttaccagcactgagacaaaggaaagagaagtcagagttaggggctggaggtggggttagaaagatggggaaggagaggaggaccaagagatgcaaagtccacagctttgaacccctgtacccagtttctctcagaggagaagctgcactatcgtagtgcccgaaccaaggagctggatgcattgctgggggacctgcactgcgagatccggggtgaggaaaagccagaggttatatgcattgtaagatgtttaaaaaaagcagcagccaggggaaggaggggagtgggcaacttggggatgcttccaacaggcccctcctcttcctgctctctgtctcgctcactctgactctatcttttcctctgaatgtcttgaggtctcagattgtatctgcaacctgtttccagatccccctaggggcctctgcctctccttcactttcccctggaactgacctccagctcccttcctcacccactcccagaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcaggtaagaatagaggcgggtggaggaatagacatgaggggcccaaaggctacatcttctgggggttcatctatcttgatccacaagccatgcgaggtgcctctccgcccactgcagacatcctctgatggaactctgtgcccgaacctttgtgcccaactccacagaatgtggtggggacaaagggagggtcaaagtcatcactggacccaactcatcagggaagagcatatacctcaaacaggtgaggagaagccctgcagcctgggcctctggcgtctcctgcatctactccacccctacttgccagccaactcaggctcctgcagctcttctcccattttctgaccccgctcttcatgaaaggaccatcacccacatccctgtgcttccacctcacatgttcttattctccactggagagccatgctctaatggaactttccgtggcccaaattccttcacctgcctctgagtaggtacacaccactcccaagtatgtctctgcccacgtcccgtgcctcttcactgattctaaattagcccacagggctatggtcaggattcggggaggagagacagagtcagtgtgtctgttacctatttctcctgtttcaccctgtccatttctctttgatgtgccattcatgccttgagcctcactttcacctcagcccacggcaccaggccccaggccctgtctccttccctattcaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtcaaagggaacaaagggaggtgggattgaggaaggggataatgggaaaggaacccctgaaaatgctcataacaggaaagcatgccctctgctgcatgccctttatactaaaagtggggagcactaaggtcagagataagaagaatcaataccataaacatttcttgaacccttgtttcatgtgagtcactgttggcaaagaggatgaacaaagcgtgcacctcaccattcaagaacttgcagtgcagtagggagggcatgtatacagctttattcacaggccaactgtggtcagtgcgttacgggcttccaatactaactttcccttgtccaccttatacccagcaggtggcgaaagcagtgaacaatgccactgcacagtcgctggtccttattgatgaatttggaaagggaaccaacacggtgaggggagaaactgatgaggggagaaactaaggaggggaaaatggaggaggatgaaggagcatgacagtgaggctgggcctctggaatggaatagggctgtgtgggcagaaaagaaatagaacacgagacagggaaaggcagtgcaagtgcagaggggcatatggggtccccatggctccgaatgctaacctctgccctctttgcaggtggatgggctcgcgcttctggccgctgtgctccgacactggctggcacgtggacccacatgcccccacatctttgtggccaccaactttctgagccttgttcagctacagctgctgccacaagggcccctggtgcagtatttggtgaggagaccaatctagctcctcggggacccccaggctgggcatttcccagaggtggggattggctcctctatcagaacaagggctccctcagcacagagaccacatcccttcccttttctccctccccacaggattggccaagggtttcaggacaggaaggaggtgattgatgatacactgtcttttattctcttttaagaccatggagacctgtgaggatggcaacgatcttgtcttcttctatcaggtttgcgaaggtgttgcgaaggccagccatgcctcccacacagctgcccaggctgggcttcctgacaagcttgtggctcgtggcaaggaggtgatgagatccaaatgtgcaaccacctccacatcagagctccctttcattcctagtcctactgggcctgggtctaggtccacaggatttctgacccttatttccccttctcttccccactccccttactcctcccaccttcttgcttgttcctaggtctcagacttgatccgcagtggaaaacccatcaagcctgtcaaggatttgctaaagaagaaccaaatggaaaagtgcgtatatggccccagtgtctttaccctctctgcatcttctcctgcaactcttctccccttttcagggactcagccttcctccagcactttgcccttcagaaacccaccatttctttctgaaatccctaaatcttcaagatcccaggttttctgtgccacagcctctcccctctgcccagggatttggttgtccattctgccataaatcttgcgattttctctcttcttcagttgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaagatattgtttctttagtctcaaaacaagagactaggaaagatccaaaacacagagcaggagtccacaggggaacctgccctgcctcagtaaaaatacagtgttgttgctgtaggaagactcccggattctaccccaggatacttcatgagaacgaaccccttcagagaggccctacaaaacagattagagggaagacagaggggtccaagggagatggtctctcttctcaagtaggaacaccccagcctcagacagacacagcaggaaggggcctgagaggctgacagaggcaggatgggtgcaaggcaggggtggaggggagggaccagcccgggctgcaccagtgggagtggctccacccttcccacctcagagccatggggagccagggctctggcggggtgcccttggtgcaggctccctacacagtcctgctgctgccgctggggacaagccgccaagacccaggggcccagagcttcttcctttgggtgagtatcagcccaacaagaggtcccaggggaactctctcaatagatctgccctttatatttccattcaacttgagggcccacagtgttcccgcctgcctccccttgccctccaggtcctcagtggccagtctgggttcacactcagtgaccacacagtgaacccaactaggggtggagagaaagggccataacccagagccctactgtggcgtgagagtcagcctctgtgattgcctttcccagctacgcaggatgcaggctctggagagagaacaggatgccctgtggcagggtctggagctgctacagcatggccaggcctggtttgaagaccatctgagggaggcacagcgacagcagctgcatctaggggcccttggtgaggtatgggggctgcccctctgtgtgaatggggggaggaccagggagggaggaacagggaatgtgtagacacagcctgagaccactctggagaggggagagttaatggtcagggatcatgagttggaggcagcatcgtaatgacaggatgccaccaagtgttaagttggtgttcattgttggggctggaggaagctggtctgcattccattcagagggatttggatcactccatggagatgagggtgtggcctggattattccaatggggcagggatggacagggaggctccatgaagagtagtgaaagggggtattgtgctatttgagggagatggaggaactgatgtgctaaagagatggaggtggagagtactggattttcccacctgcctgggagggtactgggacgaggggatccagatgagagggatggcctgtggtgacaggaatagagtggcagacgacctcaggttttcaccatgttgtcagcctccaactcctcctctagaattttctaacagatttacactcagagcctggtcgccccccgttagcccagattcaaaaggtgaacatctgtttgcagaatctgattcatgagaaggtgagtttattgttttcagtttagacttttgggaagttggactagagaggggagttgttggggtcagtgctggcttaacagaaaacacagcgaatttcccctccagttctccccaagtccactgaacaaggctagttcctgcaccacccaggattcaaaggaaagacgaagggagcagaacttgtggcagcaacaggtaaacttcaagaaggagggcaggagccccaccctacagggctgggaggagcccagaggccccatctgtttctcctccaggagttgtcaaggcagcagaaaggagtcacccagccaaaggaggagatggctcagcggggctgcaccaaggggccaagaggccctacccgtgtctaaaccctcctctcactcccctaagcctggtgaaagagtcagaagccccaggctcctttttctgtttcttaactcaacagctaaaaaatggctccaggtagtgagtcaatgaagttcagacatgttggtgtaaagtttctcctctgctcctgaaaacttcatcttcttggtgtctcatgtcctcattctcccctatatgacatgcaaaaacgatctttctttgaaatccctctgggaagaagacatgtttattgaaactgtccttcagccttaaatacaaaaataaaactgaaactgctccagaaagcagctttctccaaaaatgtctttggtttgtttctcatagggttaggaaaagtgcattgtgggaatatccattgccctctatcccagtcttgcagggtgttttgttttgttttgtttctgagatagggtctcactgtcgctcaggctgtagtgcagtggttcgaccacaactcactgcagcctcaacctcctgggctcaagtgatcctcctgcctcagcctcccagagtgctgggattacaggcgtgagccactgcacccagccccagtctcgaagtttctaagaaaggaaagggatgtgatggagaaagaaaaccttcattggctgggcacggtggctcacgcctgtaatcccagcactttgggaggccgaggcaggcagatcacctgaggtcaggagtttgagaccagcctggccaacatagtgaaaccctgtctctactaaaaatacaaaaaattagccgggcgtggtggcgggcacctgtgatcccagctacttgggaggctgaggcaggagaatcgcttgaacctaggaggcagaggttgcagcgagccgagattgcgccgctgcactccagcctgggcaatgagcaaaactacatctcaaaaaaaaaacaacaacaacaaaaaagagaaaaccttcatcccagctaggagaggtaaggtcctaagacctatgtgacaaatgtgtcccaggtcttcttaccaatggggcaggttgaaaatagtgctggagacccatccctttagagcccgttgtgtcaccaggaggccaggcctagcagaagcagcacccctccaactgtgccccaccaggggctgcccgcagccagccctgccccagccctgccttgagtcaccaatgtgaagggggaaaaggcaggggtggccgtggtgaggatcgggtcagatgagccggtaggggtggtgtgccggtcctgtggggaaaaggaagagaatgacagggtgtgctagagctgtactcaaattaaacctacaccaccctccccggccttgcccaccctgtgatggaaagtagtagttcctcacctgcggggctggggccgataccaggagccggaggaaagcatgagtcgggggtactgggttggcttctcgtccccctgcagtcacagtcaccatcaccacggaatccggggccgctgaatctgggacctccagccacaggcggccccaggccgactcattcagttccaggtgagccctggagagaggatataggcgtcgctaaagctccaggctgcccagagcctagagtcgggacgcctgcaggggcacgggagcggagaggaggattctgagggccagtcggagggggacaggggcagggcttgggataagcattggccgggcaagatgccagagggagctggagggttcatgagcctcacctggagaggttggaggtgagggagaagctggggttgacgaaagtcctaaggtcaagatcctgagggcccgagaagctggcgatgcggagactgagcgggactttgctgcccggggccaagaaacccgaggggccactaagctgcagagaagggttcttcagggaaggggccgctctaactctctccagccccagccgcactttcccctggcgtctcacctccagaaggacagggactacagtgctaggctgaggggcagccctgtgcaggcgccgccccgctgcgtcctggccaatcagctccagggagaagggtctaggggtggacagcagcgtgggcgacagcgaggctg

SEQ ID NO: 16888 - DNA, 7707 bp, Human; identical to SEQ ID NO: 11811

SEQ ID NO: 16889 - DNA, 17154 bp, Human
gaggccaaggccggcaatcacttgaggtcaggagttcgagaccagcctggtaaacatgtccaaaccccgtctctaactaaaataataataataataataataaattagccaggtgtggtggcgtgcgcctgtaatcccagctagtcgagaggctgaggcaggagaatcacttgcagtgagccaagatcgcgccactgcggttcagcctgggcaacagagcgagactcaaaaaaaatagcacaattctaacaatatgccaccatcactgctgatgaactggataagaggggactagtgtcacgtaaaatttaccatctaaaaaacaattttaggccaggcgcagtggctcacgcctgtaatctcagcactttggaggccgaggcgggaggatcacctgaggtcaggagtttgagaccagcctggccaacatagtgaaaccctgtctctactaaaaatacaaaaattaggccaggcggggtgcctcacgcatgtaatcccagcactttgggaggccaaggcaggtggatcacctgaggtcaggagttcgagaccagccggacgaacatggtgaaaccccatctctattaaaaatacaaaattagccgggcatggtggtacatgcctgtaacagtccgctacttgggaggctgaggcaggagaatcgcttgaatccaggaggcagaggttgtagttagccgagatcctgccattgcactccagcctggacaacaagagcaaaactctgtctcaaaaaaaaaaacaaaacaaaaattagccgggcgtggtggcatgtgcctgtagttccagctactcaggaggcagaggtgagagaaacgcttgaacctgggaggtagaggctgcagtgaactgagattgcgccactgcactccagcttgggcaacagagtgagactccatctaaaaatttaaaaataaaataaaaaacatttttaagtatataatttaatggtattaaatactttcatcatgtgcaatcatcagtcaccataactcatcttgtaaaactgaaactctgtacccattaaaacataactctccattccctccaccccctagcccctggcaaggaccactgtcctttctttctctataaatttgagtaagtactttatctaagtgtaatcatacagtatttatccttttgtgactggcttatttcacttagcataatgtcctcaaggttcatctatgttgtaccatgtcagaatttctttcctttcacctgggcagcataccaagaccccatctctaaaagaagtttaaaagaatgtttcaaaggccaggcccagtgactcacgcctgtaatcccgtactttctggggaggatcacttgacaccaggagttcaagaccagcctgggcaacatggcaagacctcttctctaccaaaaaaaaaaattaagaagacattagttaggcattgtgacatgtgcctgtaatcccagcttcccaggaagctgaggcaggagaatggcttgagtccagttcgaggctgaagtgagccatagtcatgccactgcactccatcctgggtaacagaatgagaccttatctcttaaaaaaagtatatctttcctttttatggctgaatgttattccattgtgtataaatgccacattttgcttatccattcatctgtcagtggcacttgagttgcttccgcacctcagctgttgtaaacagtcctgctgtgtatatggccacatataaaaggtcttttaactttattaagctttgttttctcatctgtaaaatggaaaagggcctgctctgcatggttgcagagatgagtgagtgttagtgtgcttgacactcttcctctgaggaaatagcacccgtggttgccagtttgtggctactggagcctcacatggcatttggaggtgtggctcactaccccacccccgcctggggctccaggctaacccaggcaaaactgtaggtgctctctgaccctcagtgtgctccctctcggcccacagcccccggtccctgagaagcggccccctgaaatacagcatttccgcatgagtgatgatgtccactcactgggaaaggtgacctcaggtcagtcccatcccccacccccggtggcttgatgtggtctgttctgaaggtttcggtgataggccccacaccattctctctcttcttccagatctggccaaaaggaggaagctgaactcaggaggtggcctggtaagcagcagaggcagagcctctacccctcgggggctgctctgagggagggtcagaggtggggctgcatcccatcctcagtagaaatgcgcagggtgtcagtggcctcaatttttctgatctttttctagtcggaggagttaggttctgcccggcgttcaggagaagtgaccctgacgaaaggggaccccgggtccctggaggagtgggagacggtggtgggtgatgacttcagtctctactatgattcctactctgtggatgagcgcgtggactccgacagcaaggtgagacagagctggtctgccctccccgccggtgctcccccagggctggggctcactgtccagtcctccttgttccctgtttttctgctttctgtcctttttatcttctgaatatccactaagtcattgccccatgctgtctataactccttttttttgtggggggagacggaatctcattctgtcgcccaggctggagcgcaatatcacgatctgggctcactgcaacctctgtctccagggttaaagcaattctcctgcctcagcctcccgagtagctgggattacaggcacctgccaccacgcccggctaatttttgtatttttagtagagacggggtttccctgtgttggccaggctggtctctaactcctgaccttagttgatccacccaccttggcctcccaaagtgctgggattacagctgtgagccaccgcgcccagctgtaactcattttcaatgtgtattctgcccgtttcatccacaaaggtggccaccaccctgcacatgggatttagtattcttttttttttaatcagctaatgaaatgaccatttaacagacatgtactgtttaaaaaaagaaaacaaaaaaagaaatgaccagaaagcacttttttaaaacatacgttatgctgtttatataaaattcaaaagcattgcattgtcatttatttgcttatttcgttgctctttgtctggttttatcttatatgtttgcctacacagtagaatgtttagtctctctgattttgccttttatttaacattttatcatgaaaacttgcaagcataatcaaaagagtagaatagggagcccccatgtacccaatacacagctccagccattatcagtacacagtccatcttgacccatctgtacatctcccagcacacacacctactaggttattttaaagcaaatcccagacctcatatcattttacctaaacatatatccatatagatttgtaaatataaggcctctttttgtcgttcaacatcattacactactgttttcacacctaaaaaaacttaccgatttcttaataccatcaaatatcctgtcagtcttcacatttcctcagctctcacaaatggtttttgtcaagatccaaatgaggcccacaccttgatttgattaacatttgtcttaggtcagccaggcacagtggctcacgcctgtaatcccaatactttgggaggccaaggcgggcagatcacgtgaggttgggagttcgagaccagcctgatcaacatggagaaaccccgtctctactgaaaaaaatacaaaattagctggacgtagtggtacgtgcctgtaattccagctactcgggaggctgaggcaggagaatcgcttgaacctgggaggtggaggttgcagtgagccaagatcgtaccattgcactccagcctcggcaacaagagcgaaactccgtctcaaaaaaaaaaaaatttttttttgtcttaggtctctctcagtatttaggtttccccatcttctttgtgtttgtttgtttgtttgtttttgttttttgagatggagtctcacactgtcacccaggctggagtgcagtggcgtgatcttggctcactgcaagctccacctcctgagttcaagcaattctcctgcctcagtctcccaagtagctgggattacaggcacccaccaccatgcccagctaattttttgtatttttagtagaggcagggtttcactatgttggccaggctggtctcaaactcctgatctcgtgatctgcccacctcggcctcccaaagcgctgggattacaggcgtgagccaccacacctggcctgatttcctcatcttctaaaaaaaaattttttggcccaggcgtggtggctcacgcctgtaatcccagcactttgggaggcaggtggatcacctgaggtcaggagtttgagaccagcctagccaacatggtgaaaacacatctctaataaaaatacgaaaattagctgggtgtggtggcgggtgcctataatcccagctactcaggaggctgaggcaagagaattgcttgaatccaggaggtggaggttgcagtgagctgagatcacaccattgcaatgcagcctgggcaacaagagcaaaactcaataaataaataagaaagattttttttttttgccatttatttgtcaaagaaaccagctcagttgtcctacagaatttttcacatttaggagttggctgattgggtggagattgacacatcctctctgcccatatttcttgtaaactgatagatctagaggcggaatcagcttcaggtgccaagaagacttgacagtgggtgcaagtgcttctggccacatcacatcaggatgcatggaacatctaatctggtcatttttcttgttagtgataagattgaccagtgggttcaggtgatgtcagcctgaacctttcatataaagtttctcatgagctttgtgtctagtgtttttagcaaccattggtggtcttgcctgtttatgaacatcataaaaggggtatcaaagtatgtttatcttctggtacttgctttttgttttttaacttaatatcacattaccaagatctgtgcacattgctgtctgtaactttttcactgctgtgtaatattccatgcaccctctctttatgtggccctttgtctcctctgctacccacacttatccccagcagccatccgtgggtagtggcggggggcaatggtggtggtggttttctttactcacctcattgtctgagtcctgggggttggatatgtctgttctgcctctctcccagtctgaagttgaagctctaactgaacaactaagtgaagaggaggaggaggaagaggaggaagaagaagaagaggaagaggaggaggaagaggaagaagaagaggaagatgaggagtcagggaatcagtcagatagggtaagagacggaggctgatatctccagaggagtgggagactatggggctggaggtctggtcctgaaggtgttgggggggcccctgggggtgagggttcctaactcctcctcctcccccttcccagagtggttccagtggccggcgcaaggccaagaagaaatggcgaaaagacagcccatgggtgaagccgtctcggaaacggcgcaagcgggagcctccgcgggccaaggagccacgaggtgaggaggctctgctgcttttgggtgccctccagcccccgcccggccccccagagtgtgtgcacgcacacacacgctctcgcatgtccacctgcatgtacccacgcgtccaggcacctgtgagctcgcactctcactctctctgtctctgtgtcaggagtgaatggtgtgggctcctcaggccccagtgagtacatggaggtccctctggggtccctggagctgcccagcgaggggaccctctcccccaaccacgctggtaattgccaattgccgggacagggagccactagggggcgacctcagggcaggagggaaagggaaggaggggaaccacgccagagccggggtgtccatggccaggctttaggggttctggggcatggcggggtggggtagggagggagtgagaggacccgccaggggtcccagtaggtgaggtgcagagcctccctcagctcctcttttcctccatccaaggggtgtccaatgacacatcttcgctggagacagagcgagggtttgaggagttgcccctgtgcagctgccgcatggaggcacccaagattgaccgcatcagcgagagggcggggcacaagtgcatggccactgagagtgtggacggagaggtggggccgtgggctggtgggagaggtgccagggcgtccagtccccggccccagcctcacgctctcttctcacccatcctcactgcgcacagctgtcaggctgcaatgccgccatcctcaagcgggagaccatgaggccatccagccgtgtggccctgatggtgctctgtgagacccaccgcgcccgcatggtcaaacaccactgctgcccgggctgcggctacttctgcacggcggtgagtgaccagtggggcagacaggtagcatgccctgtggcagagggggccccagtaacctgaccatgttgtttccctgctcccagggcaccttcctggagtgccaccctgacttccgtgtggcccaccgcttccacaaggcctgtgtgtctcagctgaatgggatggtcttctgtccccactgtggggaggatgcttctgaagctcaagaggtgaccatcccccggggtgacggggtgaccccaccggccggcactgcagctcctgcacccccacccctgtcccaggatgtccccgggagagcagacacttctcagcccaggtactggcctcccccttctgtactgtctgttccctcccccacccctattgctcctggacatgagctccttcttccacagtgcccggatgcgagggcatggggaaccccggcgcccgccctgcgatcccctggctgacaccattgacagctcagggccctccctgaccctgcccaatgggggctgcctttcagccgtggggctgccactggggccaggccgggaggccctggaaaaggccctggtcatccaggagtcagagaggtgagtggggagttgctcaggcacagcaactggggctgaggccagaggagtggtgtcgaggctgatgctggaatctgaggagctccccttctctccccgctcccgtgctcccttggcaggcggaagaagctccgtttccaccctcggcagttgtacctgtccgtgaagcagggcgagctgcagaaggtgatcctgatgctgtgtgagtgccacccattccttcagcagaccttgaccaagcttcatgtatataccaggcactgggtacagggccaggagtacagtcgtgaaggacacagtccttgccctgaaggacttagtgtggtggggaaaagacacatgtaacccataacgatggggatgtggtgactcataggtgctgggtcctgttctgagtgcttatacctgttagccttggcttgcacagagaggttagggaccttgcacagtgcacagtggtactgagaagcaaggcagggtttgaattcaggcagagctgatgcctttgactccttattctgataaatgctgtggtggaggcaagctcggagaatgccaggaggggccctgatccagcttggggccctgagaagccttcctgaaagaagtgccacctgccccctagcttgcttaccacttgtccctccctctcccggtgtggcgggctctccccgcagtggacaacctggaccccaacttccagagcgaccagcagagcaagcgcacgcccctgcatgcagccgcccagaagggctccgtggagatctgccatgtgctgctgcaggtcagcacgggcccggccccatgcctcattcaccaggcccttaggcccctcccctgccccatgcctccctggtgccagccctcctgccccctcacaggctggagccaacataaatgcagtggacaaacagcagcggacgccactgatggaggccgtggtgaacaaccacctggaggtagcccgttacatggtgcagcgtggtggctgtgtctatagcaaggtgtgcgcgcaggcagcagggcgtggcccccggagtcagggaccaggtttggggtgccagcccaaaggctcatttgcccgtgtctccctcaggaggaggacggttccacctgcctccaccacgcagccaaaatcgggaacttggagatggtcagcctgctgctgagcacaggacaggtggacgtcaacgcccaggtcagcggcccacccagcccagcccctctgggtccctggtgcctgggttccttggcttggcctcaggctttgggccgcctttcctacatctgacctcacactgctcgtgtctgtcctcattgctttcttcttcctcatttgtatttctcttcattcttttctttctcgtttctttctctttatcaagtttcagaataatcagttcctgtcttaatctctgaaagtgtccagtgaggctttttattaactcttgggttgtcatacattggatgtgttttagtcatttattggcattcttctcagtctttgaattattccatcattgtccagaagaagcccctttaagaggcctctgtggctgtgacatgacccagtggcccagtggcctttgagagcctcctgacctttcagcacatttcctgcccccaactcagaatccaccatttctctaagaaactctgcttcctttatgggaaacttttttttttttttttgagacggagtctcactctgttgcccaggctggagtgcaatggcgtgatcacagcttactgcaagctccgcctcccaggttcacgccattctcctgcctcagcctcccgagtagctgggattacaggcgcccaccaccatgcccggctaatttttgtatttttagtagagacggggtttcaccatattggccaggctgatcttgaactcctgacctcgtgagccacagcgcccggccagaagcattttttagagaatacaatctatgttcctaggagtgtttattgttattgggttgtcgctgcttctaggacttttgagtgggcagacttaggaaatttttgttcgttttttcttttaagagacagggtcttgctatgtcacccaggctgaagtacagtagcagttcacagacagtcatagctctctgcagcctcgaaatcctgggctcaagcaaccctcccatctcagtcacatgagtagctgggactacaggcatgcacctccatgaccagctcctggctgtattttttggaaagagaacaattactttattttctctctggcatcagatggtagacgctactagtcccatttttgtttgtttgttttttgagacggagtcttgctctgtcgcccaggctggagtgcagtggcacgatcttggctcactgcaagctccgcctcccgggttcacgccattctgcctcagcctccctagtagctgggactacaggcgcctgccaccacgcccagctaattttttctattttttagtagagacagggtttcaccgtgttggccacaatggcctccatctcctgacctcgtgatccgcccgcctcggcctcccaaagtgctgggattacaggcatgagccaccgcgcccgaccctactagtcccattttttagatgaagaaactgcgacccagagacgttaagtgacttacccagggtcccacagcttgtgaatggtggagctgggattcacacacacagccaatcttgaccatttgctgctttggtgagcagggccagctgcccccaccctcactcccttcccacccacaggacagtggggggtggacgcccatcatctgggctgcagagcacaagcacatcgaggtgatccgcatgctactgacgcggggcgccgacgtcaccctcactgacaacgtgagtgagcgtttggttgaggtagggcagccccaggcccctgagcaaggtggaggctggattcaagggcccagctgcctgcacctcatctgttcccctcctacctccacaggaggagaacatctgcctgcactgggcctccttcacgggcagcgccgccatcgccgaagtccttctgaatgcgcgctgtgacctccatgctgtcaactaccatggggacacccccctgcacatcgcagctcgggagagctaccatgactgcgtgctgtgagcccctgccccgcccttgatgcccctgcccccacttcttgcagcctcagaccctgcattgggcatcctgtcccctcttcaggttattcctgtcacgtggggccaaccctgagctgcggaacaaagagggggacacagcatgggacctgactcccgagcgctccgacgtgtggtttgcgcttcaactcaaccgcaagctccgacttggggtgggaaatcgggccatccgcacagagaagatcatctgccggtgagccctgggcccctctctgcacccaagaccacctcctccccacccataccctccccaggctccattgcatcctcacaacattccccaacccctccccatgcaccactgaatccccagaaccacccacaggccccctccccactagggttgccagatacagcaaataaaaatagaagacacccagttaaactggaatttcagatgcacagatgcatacttttttagtgtgagaatgtcctgtgtaatttttgggacatactaaaaagctatttcttgtttatctaaaattctatgttaactcgctgtcctgcatcttacctggcaaccttactcccctgcccccagccccaggaacctccccaactctcttccttatacctggagtagctcctcacccccttttccagcttcccagccccttcttcccgtcttctgcagggacgtggctcggggctatgagaacgtgcccattccctgtgtcaacggtgtggatggggagccctgccctgaggattacaagtacatctcagagaactgcgagacgtccaccatgaacatcgatcgcaacatcacccacctgcaggtgagtagggggcccggggcctccccaaaaggacaccgagagctgccaagtacagttggacaagcttcaaaccagcaaaggcacctggccaaggaagggttggctgaaagggagccctggtgtggggtcgcatccccaccaggggagggatccttttcctaggtcacagcaaggtatcatatgagctcccagtagccctggggacaccaccatactgattacccgtcaccctaggaccatcaccacccactgttgtaacacatggaccccaaagaaaggacagtggttagggggtcagggggcatcaagagtagaggggcccagaccgatcatggggttgagctgacctctgcctcctcgccccagcactgcacgtgtgtggacgactgctctagctccaactgcctgtgcggccagctcagcatccggtgctggtatgacaaggtgcgtgccccttgccttggccacagacacccggcccctccttcagaggagccagcctccaataaaccagctccctgggaccatgtccctcacctcctaccctgtgggggaagtgactgagaggactgggcaaggcctgggaatcctgggatgtggctgggacagcgatgggcgtgtgcccaggtctatgcaaaccagggatgatgctcctgcatttcgtgctctcggatctcagagcctgtgtgacctccccaaccccaacttccctgtctctgtagagtcttggggttcctgggtgggcagctgaggtgggccccacagagaaaccactatcctcccctccgcaccctaggatgggcgattgctccaggaatttaacaagattgagcctccgctgattttcgagtgtaaccaggcgtgctcatgctggagaaactgcaagaaccgggtcgtacagagtggcatcaagtgaggccctgctccacagcccaccctctccccacctcaccctttcctccctgcccctggggcttttccagggcctccacccaacagcgccatctctcctacccccagggtgcggctacagctctaccgaacagccaagatgggctggggggtccgcgccctgcagaccatcccacaggggaccttcatctgcgagtaagtcaccgggagcaccttaacacctggtgggaaggggatacatggccactgctgactgccaggcctccctctcagccatctgccctgatgagtcacatgtctccatctggccactctccagccagcctcctctgacccctattcctgcagctgagcagccagccgcctctgacccccatccccccagctgagaatggcacctgcctccactctgcccagaccacagagcttgtcttccctcccctccacctccaccctctaccttcccctccaccccctcctcgcccttcctagctggagaaagtgccagtttgggagacaaacagacttgggtttgagcccctctctgcttctggatgttcttggccaagttacttaacctctttgagccttatttttcttgtctgtagagtggaggtgataacagctacctatctgtccacctcctcaggggcctgtccctctccatcagttctttctctgcccagcatctgtaatctccccctttctcttggctgccatcccacaaccctcaatcttactttagtctcctttggctcttttttttttttttttttaatttattttttgagacggagtttcactcttgttgcccaagctggagtgcaatggcacaatcttggctcactgcagtctccacctcccaggttcaagcgattctcctgcctcagcctcccaagtagctgggattacaggtgcgcaccaccacacccggctaattttttgtatttttagtagaaacggagtttcaccatgttagccaggctggtctccaactcctgacctcagatgatccgcccacctcggcctcccaaagtgctgggattacaggcgtgagccaccgtgcctgaccattctttggcctttaaaaaagatagtcctctaaccatacttgcctgttcaacagaccatccagtttctttccatcatgtcatctctcaacttctctggcaagcagccccttcctgctgggcctcagtttccccaccatccactcactgcctgtccctgccaaaatcggcctttgcccttcccactctgctgaagctgtctcttgacagtcacttcccacccacgtcctctccgtgtgtctgaatctcccatgtctgctcaccctccttagatagctggctcctctcctccctctggtgtccagatatgtgtgggtgctcttgccccgaatcatgccttgagttccttgccactcctgtacctctggctcttcctgcagtcctggcccctctcctgttccatatcgcccattcctgccgggtggctcctggaacacaaacctctctgtgtccaaacccgaacttccccacccaggccaactgcccctacacattaatccccttaaccacagagcttgttgtctgtctctgtgctgactgaaggcttcctctgtcaaggctggaatgctgccctttcacttgcccaccactgctgctccaggccttcccttccccacacctgccagccctgcccattccagattccacaggcttgtgaagagagatggggcctggagccacctcctaatagcccacactcaccttcagaaccatggattcctgtcccacaggtatgtcggggagctgatctctgatgctgaggctgatgtgagagaggatgattcttacctcttcgacttagacaacaaggtgagcaggagaccctccttaccctgctgctccccagggctggctttcaggagcctctgggaagtcagcaaatggaaacctggggaggagggactggggagtcagtgggtggggagggcaagcagggtcgggggagatgtgaagagtgccatccccctgccccaggatggagaggtgtactgcatagatgcccgttactatggcaacatcagccgcttcatcaaccacctgtgtgaccccaacatcattcccgtccgggtcttcatgctgcaccaagacctgcgatttccacgcatcgccttcttcagttcccgagacatccggactggggaggagctagggtgagactctaggggtctctaggggctctgccagggggtgggagatgcagcaaacctgggacctgaaggctggcatgtacctggtgtccaggcatggagtagtgcagagcttctcagatttcagtgtacataagtatttcctggaggacttggggaaacagtcctgtgcctcccagagagattttgaatcagtaggcttgggatggggcccaggattctgcatttctaacaagtccccaggcaatgctgatgctgaaagtccatagaacatacaaggggctcagatcccatctggagaagataggttgggtgtcgggtccctctcagggagcaggatccacagggtcttcggggtgggctcttggtggctgggtccaggtcccacaagctcctgttttcctctgacaggtttgactatggcgaccgcttctgggacatcaaaagcaaatatttcacctgccaatgtggctctgagaagtgcaagcactcagccgaagccattgccctggagcagagccgtctggcccgcctggacccacaccctgagctgctgcccgagctcggctccctgccccctgtcaacacatgagaacggaccacaccctctctccccagcatggatggccacagctcagccgcctcctctgccaccagctgctcgcagcccatgcctgggggtgctgccatcttctctccccaccaccctttcacacattcctgaccagagatcccagccaggccctggaggtctgacagcccctccctcccagagctggttcctccctgggagggcaacttcagggctggccaccccccgtgttccccatcctcagttgaagtttgatgaattgaagtcgggcctctatgccaactggttccttttgttctcaataaatgttgggtttggtaataaactgcgatttttgtgttggggtggggagaaagcatacttggctagagggaatgtgggtccaagggccagaataggatgggaagcaggctggacaggtgtggctggtgtgatggccgcccagtgcggggcagggaggtggggggccactatgaagatccagtttcacaggcacggtggctgacacctataatcccagcactttgggaggccaaggcaggcgaatcacctgagatcaggagttcaagaccagcctggccaacttggtgaaaccccatctttcaaaatagaaaaaatttgctgggcgtggtggcaggcacctgtaatcctggctactccagaggctgaggcaggagaaccgcttgaagccaggaggcggaggttgcagtgagccaagattgagtcactgcacaccagcctgggcaacaagagcgaaactccatctcaaaaaggaaaaaacaggtccaatttccacactttaatctttggcgggagcgtgttgggagtgtacggcagttaaggtagtttgcgagattataaagcgttttcttatcagagcatgccaggtcgttcactgtggtccgtagtgcccccaggaaatagccctgagcccccgtcccaggctccagctccccagcccgctgggcacaaagttgagaagaaggaactagagtgtgtcggggaccacaggcgggggtggggctgtgacgtgtgggagggcggggcgggcagcaggtgagacgccaggtctccagggctccaatcactccggagactgagccatggggggaaagcagcgggacgaggatgacgaggcctacggtgagactggggcgaggcccgggaccctgtggagggaggggaggacgggtactttgggaatggtgtctggggctggctccagggagaggaactaaggagagtactgtgtccctgaggggagggcccgggaaccgggagccatggagggagggagtcagggtcctgggaggaggatggggcccgggggctggggctgttgctggggagcccatggggagtgaagctgggtgcctctgaagagttggggctgaggtccttgggaggaggggggtatttcaggcctggactctgggtccctaagggcagggccctaggaaacaaagccgagatggaaggtggcaggttggggccctgagcagaatagggctggatgctgggagtgtcctgtgctgcagagcctgcaaccagtgaggccagggtccctgtaaggaggaggaggttcagcctggagtctgggtctctgagggcgaaagctgcttgtggcctgccggctcccttgaggagtgaggggaccctgagtgggctggcctctgcctgccagggtctctgggagaagtggcagagggagtgggttctgctgggggtccctgtgaggagttggggctgagggtctttgtggaaagggggctggggtcctgcctaggggtctctgtgaggagctaggagcaggagctggtcttggggtactctgaggaatagggacagggcccctggggttcctgtgaagggtgaggcctgaggggagaaacagcagggagcctgtttccagaatctgcaaggaaaaggggctggggttctgaggagagagggagctggggactggcctccagatccccacgagcagtgaaggctggggactcacctgcggaggcccccctggtcttctggtctgaaggggaaggaacccctatgagggaccttctcgaggagaggcttgagtcccttagggccataggggagcaggcagtgaggactcccgagtagacttcctggagcggcttcaggtcaatcattgtccatgagccatggagggacagagtccagcgcacctggggaaagtggaccccacccgctccttcccagactcctgcccagccctcggctctccctcctcagtgcccacaaggaaccctgactgcccagccctcctcctccctgtgtgtgtactcagggaggaccagg

SEQ ID NO: 16890 - DNA, 22089 bp, Human
agtgctgggattacaggtgtgagccactgtgcccggctggtactgtgctttcgatatcacccagggatcttggctggtggagcagccaccatctcagacgttaccatacagaggggaagagcagggtgaagactacattgagcttccatcaggaagtgatacatatcacttgtactcacatcttattggctaaaacaagtggctggggaaatcctatcctaccatgtgattgaaagaagacaaggctacagtatttgtgaacatccttaaataccccccacctttacgatagtttatttctctcttgtaacaatctaagtggctgtgcagggctggtatgacatcaacactgtgtcagacacccaggctcctctgtctgtttgctctgtcatccccagcatgttgccctcatcctcctggtggaagacggatctccgctaggtttatattccagcccatgaaaagaaaaggcacactgcctttttattttagggacataacttggaaatgacatacataagttctactaacatcccattagccagaaccaagtcacctggctacctagctgcaagggaagctaggaaatatggtctttagctgggtgactgtgtgttcccctaaccatctcttactgtggaaggagggagaaaagatacttgaggggcaggggaggcactagcagctctgccacagcagccactttggagtccctaacaccaggatgtcctgattttcatgcacttagccctgtccaaggggagtctcaatttgtgtactcttttttttttttttgagacagagtcttgctcttgtcacccaggctggaatgcagtggcatgatcttggctcactgcaacctctgcctcccgggttcaagtgattctcctgcctcagcctcccgagtagctgggattacaggcccctgccaccacacccggctaattttttgtaattttagtagagacggggtttcaccatgttggccgggctggtctcaaattcctgacctcatgatccacccgcctcagcctcccaaaatgctgggattacaggcgtgagtcactgtgcccggtcttattttttttttttctttttgagatgtagtcttactctgttgcccaggctggagtgcagtggcacaatcttggctcactgcaacctccatcttctaggttcaatcagttctctaaggactcacttataaatcaaaagggtttttacgaacctaaatgatcacttcagagaggtttcatgttcatttttttattggtcttatttatttttaccctacattgttcaaaaaggtattgaaaagacttctgtgggtcagggagactaacacactagcttcaagtttctttgcttcctgcatttcatacaagtgtaggttatgatttaaaggcatatcccagcccccgcaaaagttttattcctttgagtaaccaaccccaaatgtatttactttgccagttgggaatttcatctactagactttccgtaaaaatgttgtaaacatttttcctgtctccaaaactaagtgttgatttcattttttccacctagattatctctagggaaggattgtagggaataaaaaagtattgtcaatcttcctatttatcaagaagttctaaaaaaattagtttcacccccctcggaagtttatcttcaagaagacagaactgttctaggctctcaggaagtaaaacccacttggtacaacccaaaagaacactaaaactttacttaaatgaaatattttgcaatatcttggatggtttgtgggtttgtgtgctttagactattgactattcacacaagagcaaggtgcatgtgtgcacacacgagcccaaatatgtgtttgcctgcgtgtttgtgagcatgcgtgtatggtgcacatgtgcacgcatgggtgggtggagcgtgggggcagtacacaaagcctgtgggggagatctattgaccctatagatatattagcatcagggagacagggcaaaggtttcacccttcagttcagtccccaatccctgcttattatttccctaacagaagaccatcccccttgccactccctggtttttcttctctggcagcaatgaagcagctgctgacccagctctagttttcgggaagtcagatgaccttttccctcccgcggctctctacctctcgccgcccctagggaggacaccatgggcccactgatggttcttttttgcctgctgttcctgtacccaggtaggaggcagggaagggggaacgtcagggtcctgtgtgtgaggttggtgctcccagcttgaattcccatgtgtgaaacagtctcttttgctttccttttctcatctgtgtcttccttctttctccattgctgtctccttgttcccacggctctaggtctggcagactcggctccctcctgccctcagaacgtgaatatctcgggtggcaccttcaccctcagccatggctgggctcctgggagccttctcacctactcctgcccccagggcctgtacccatccccagcatcacggctgtgcaagagcagcggacagtggcagaccccaggagccacccggtctctgtctaaggcggtctgcaaacgtgaggctccctgtgggctttgctcagggtgctacaccaggggccaccccagaacttttgtttaggagttgctcagggtgggacttaacctgactagatggcaaagttgcttttgcagagggcttttcaaaatatccagaaaatgtcaattgccagtagcaaggaattgggaacaggtcttgatggagactgtggggtactaaagccagggatgactttttatgtacaattgactgcctagtagtgaccattcagaacagatgctgaatggtcctggagtcctctagacatctgaggatcccaaggggagtgtctggggaggccacggccctcaggagactgagggaagtggctatttatcaatcagttcgcttagactctgtgaaattggcaatattcaatcagttgccaaaaacagcaatttcacatgttgcaacctaatatttcagtgttttgacagccagttgaccattcccatgcattccagcataaaatcacctgcttaatccccagcccaggtgttatccatccagtcctatattccccacccacttcctctctctccagctgtgcgctgtccagcccctgtctcctttgagaatggcatttataccccacggctggggtcctatcccgtgggtggcaatgtgagcttcgagtgtgaggatggcttcatattgcggggctcgcctgtgcgtcagtgtcgccccaacggcatgtgggatggagaaacagctgtgtgtgataatgggggtgagttctctggctgatgggctacacagggggctggggtctcctggggaaccctggggcccaatgtgcatccaggaagcctctgtggggataggagtctgttgttcagtgtgccataataatattcctggattttggtaaattgaggtctacaggtcacacatcacaagtctgcaagggccaggccccaggcagctggtgctaagcttcagatgtagcataaagcctccacacactctgcctggcttttctaagtgcctcaaagcaagacttcatattcaggccccacagattgttgtagggaagatatgctgggagagagtcaagtactgtgctttaatgccttgcctttaaagccaggtttgggttccaagccctactctgactttgacagactttgggaaggctatttaacctttctagccctcagttttcccatctgtaagacaaggatagtgagtgctgacctgagattgccatctggattaaatgagttgacattagtaagcatatacaacagccctggagtgcggtggctcacgcctgtaatcccagcactttgggaggccaaggggggtggatcacaaggtcaggagtttgagaccagcttggccaacatggtgaaaccccgtctctagtaaaaatacaaaaattagccgggtgcggtggcgcatgcctgtaataccagctattcaggaggctgaggcaggagaatcatttgaacccaggaagtggagattgcagtgagccgagattgcatcattgcactccagcctgagtgacagagtaagactctgtctcaaaaaaaaaaaaaaaaaaaaaaatgcccaaggcccttccgggttgccctcacgccctatacccagcacccaggctgaggtgggtggatcacctgaggtcaggagattgagaccagcctggtcaacgtggtgaaacctcgtctatactaaaaatacaaaaattagctgggcgtggttaatcccagctactcaggaggctgaggcaggagaatcacttgaacctgggaggcagaggttgcagtgagccgagatcgtgccactgcactccagcctgggtgacagagtgagactctgtctcaaaacaaacaaacaaacaaacaaaaaacaaaaaaaacagcccctggaatctgataaatgccatgtacacttttttttttttttgagacggagtctagctcttgttgcccaggctggagtgcaatggcgcaatctcagctcaccgcaacatctgcctcccgggttcaagtgactctcctgcctcagcctcccaagaagctgggattacaggcatgcgccaccatgcctcggtaattttctattcttagtagggacagggtttctccatgttggccaggctggtctcaaactcctgacctcaggggattctgcccaccttggcctcccaaagtgctgggattacaggcgtgagccacggcatccggccttgtttttgtttctttaagagacaggatctcgctgtgttgccaaggctggcttcaaactcctgagctcaagtgatcttcctacctcagcctcctcagtagctgggaatgcaggcatgtgccaccacacctggccataagcacttttgtcatagttattgctgcccctgtgaatggtgaggggctctgcttggcagaagtagggctcctaggattccctggagctgcatttgcctgtgggtttgggagcttcttggatcatggttcttagcacatcatacagaagacacggagtccacaagatggcaggaccaccttcacctagtggcccagaccatggatccccactcatgcccttgggttttggcaaatggccatttattctgtaggagggtgaagtagatgcctggtaagactgtgataagtaatgcttgaattattagacgtgactctaacttattttaaaattgaggcataatttacctattgtaaaatgtacaaatcttaactattcagctcaatgatttgttacaatgcatccactcatctaatcaccacccaagacagaatgaggttccctcttgtcccctcccacaaggtaactgctcttctgacctctgtctccatggactaggtaccttgtgcttacatttcctgtaaatggaatcatgcgggatgtggtctgttgcttctggcatcctttgttctatattctgcctgtgagatttatccatgctgttgtgtgtatcagtactttgttcttttttattgctgtgtagtattccattatatgggtatattacaatttatccattcccctcctgatggacatttggattatttccagtttggggccattaggagtaaagctctaggaacattctttttttttttttttttttaattgatcattcttgggtgtttctcacagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcaccgctcttaatccattcaaccctgagtggatacagcacatgtttcagagagcacagggttgggggtaaggtcaccgatcaacaggatcccaaggcagaagaatttttcttagtacagaacaaaatgaaaagtctcccaggtctacctctttctacacagacacggcaaccatccgatttctcaatcttttccccacctttcccccctttctattccacaaaaccgtcattgtcatcatggccccttctcaatgagctgttgggtacacctcccagacggggtggtggccgggcagaggggctcctcactttccagtaggcgcggccgggcagaggcgcccctcacctcccggacagggcggctggccgggcggggggctgacccccccacctccctcccggacggggcggctggccgggcggggggctgacccccccacctccctcccggacagagtggctggccgggcagaggggctcctcacttcccagcaggggcggccgggcagaggcgcccctcacttcccggatggggcggctggccgggcgaggggctgacccccccacctccctcccggacggggcggctggccgggcagagtggctcctcacttcccagtaggggcggccgggcagaggcgcccctcacttcccggacggggcggctggccgggctgggggctgacccccccacctccctcccggacggggcggctggccgggcggggggctgacccccccacctccctcccggaccaggtggctgctgggcggaggggctcctcacttctcagacagggcggctgccgggcggaggggctcctcacttctcagatggagcggttgccaggcagagggtctcctcacttctcagacggggcggccgggcagagacgctcctcacatcccggatggggcggccgggcagaggtgctccccacatctcagacgatgggcggcagggcagagacgctcctcacttcccagatgtgatggcggccgggaagaggcgctcctcacttcctagatggaatggcggccgggcagagacgctcctcactttctcagacgatgggcagccagggcagaggggctcctcacatcccagacgatgggtggccaggcggagacactcctcacttcccagacggggtggcggccgggcagaggctgcaatctcggcactttgggaggccaaggcaggctgctgggaggtggaggttgtagcgagccgagatcacgccactgcactccagcctgggcatcattgagcactgagtgaacgagactccgtctgcaatcccagcacctcgggaggccgaggctggtggatcactcgcggttaggagctggagaccagcccggccaacacagcgaaaccccgtctccactaacaaaatacgaaaaccagtcaggcgtggcggcgcgcgcctgcaatcgcaggcactcggcaagctgaggcaggagaatcaggcagggaggttgcagtgagccgagatggcagcagtaccgtccagcttcggctcggcatcagagggagaccgtggaaagagagggagagggagaccatggggagagggtgagggagagggagctctaggaacattcttgcatgtgattttggtacatgtatgcacttgcttctcttgagtaaatgatctaaatgtggaattgtcacatcacaggctggcatatgtttagttgtagtagaggctgagaaagtttcacccacgtacatgccagcaaggtaacagagtgccagtcgctctgcatcctctccaacacttggaattacctgttgtttcagtgttagccgttttgatgggtgtgtagggatgcctcactgtggtttatgaaatataaatgttctctgaaggagtggagggaccatcagctgacttcttccctgggtctctgggggctctgggacagacatgggtgcatccctgggttggaactgggaagcttctgctggcaactgaggccgctgaggaggcagagcctgatgggagggggctactcacctctgccttcctttgttcactcgcagctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccgtgagtagctgccctgccctcctgagattcctcggcacacccggccactgccccggctgactcctgtgtggctctccccacagaaccctactcttatgacttccctgaggacgtggcccctgccctgggcacttccttctcccacatgcttggggccaccaatcccacccagaagacaaagggtgagtgtttgaggtggggtttctggttgagcagggtgctggatctgggccggagcaagggaggatgcaaccttcctggaggccaggagccttggtgggctcagccactgaaagggagggaggcagagaagctggacctgcttggcgagagcgcaggaaggaggtggggatctgaatcctccccttccacatttctccagaaagcctgggccgtaaaatccaaatccagcgctctggtcatctgaacctctacctgctcctggactgttcgcagagtgtgtcggaaaatgactttctcatcttcaaggagagcgcctccctcatggtggacagggtcaggaatcaggagtctgcctgcagcagaggccttcctgtgctcactatctctctctgtctccttcccctcctcagaaccccactcacagcccacctcctccaagaagtcttctcagattatactcatgccatgtaggaatcatgaattcaatttatacaatcataatttttattccacaagcactgttgggacactgtgctggggctgggcgacagcaaagatggaaaggctgaggtcttactttccaggaattcatcatctagaacagtggtctccacagaaaggtagtgagataacccacaggagtgaagcagaaaaatactggtgcccctgtggaataatttaaatcagattaataatttaatatttaataatttccttttaaaacttcaacattttgtgcaggctttaaaatgtgtgtgatagactgggcatggtggctagtgcctgtaatcccaacactttgggaggccgaggcaggtggatcacttgaggtcaggagtttgagaccagcctgaccaacatgatgaaaccctgtctatactaaaaatacaaaattagccacatgtgatggcgcacgcctgtaacccagctacttgggaggatgaggcaggagaatcgcttggatccgggaggtggaggttgcagtgggctgagatcacgccattgcactccagcctgggcaactagagcaaaactctgtctcaaaaaaataaataaaataaaataaaataaaataaaatatgtgtgatagaagtttggaagccactggtttaagttcctcgccagaactttgttttgtaattgtgcttttcacaatacttcatgtaacattatagatggttttccctcccagctacattttaaagagggcagtttctgtgctctcttgggactcaaaattaagtaactcattgcactgcgaggcggcaacacacaccagttggagcagtgattgagaatcatgtgacacattcagatcccacttccacctcctcctcatggtgtgatgggggaagggggacaaggcaacatacctcagtttccttatccataaaataggggtcatcatgcccctcacagggtggagtgaagagagtctgtcaaagagaaagatgttcaacaaaggtttcttccttagctgctgctgttccttatttttattattattattattattattatttttgagatagagtctctgtcacccaggctggagtacagtggtgcgatctcagctcactgcaaactttgcctcctgggttcaagtgattcttctgcctcagcctcctgagtagctgggattataggtgcttgccaccataccaggctaatttttgtatttttagtagagatgggttttgccatgttggtcaggctggtctcgaactcctgacctcaggtgatccacctgcctaaagtgttgggattcaggcatgagccaccgcgcccagcccctagcttcttcctaacagccatttcctagtgtctcccctggtccttgcctctgtcggtctcactccagtttctctgcctcctccagggccctttgtttgctctcttaccatctcccctttggcttcagggccctttacgctgcctctcacttgccccgcacagatcttcagctttgagatcaatgtgagcgttgccattatcacctttgcctcagagcccaaagtcctcatgtctgtcctgaacgacaactcccgggatatgactgaggtgatcagcagcctggaaaatgccaactataaaggtacgggtgtcatcacgtgatggtgatgagagaggagaagatggaccctctcagggcctgcaaacaaattctggatgagttaaaaagagagtgaggcctcttggtggcacctgagtcccacgagtctggggtagtttcaacgtccagggttatggtgggggagtccagctgcccccagctcatagctcattctgagatgctgcaggtccaaagacactgtgcaggtcttcaattccttccagttgccaaaaccacactgtctggtttgcatggctgcacactgccatctccccatgtcattagccacccatacaccatgtaaagtgcctggttggcacttagcaaatggctgaagccactcaaggttttggaaacctcatctttgaatcttgggactttagtgtggtcttggattggggttatgcaatgaacatttcttttttcttcttcttttttttttttttgaggtggagtctcgcactgtcacccaggcttgagtgcagtggcacgatcttggctcactgcaacctctgcctccagggttcaggcaattctcctgcctcagcttcccgagtagctgagatttcgggcacctgccaccatgcctggctaattttttatatttttagttgagatggggtttcactatgttggtcaggctggtctcgtgatcctgactttgtgatccgcccacctcagcctcccaaagtgctgggattacaggcgtgaaccaccttgcccggccctatgcaatgaacatttctaaggtggaaaggcttttaaagtttgaacaagcaatgatgccacatctctatctgaatggcaaatgtctgagtttatcaaaacaatcgataaattgcatttccaggccgggtgcagtggctcatgcctgtagtaatcccagcactttgggaggctgagatgggcggatcacttgaggtcaggaaaccagcttggccaacatggtgaaaccccatctctactaaaaatacaaaaaattagctgggcatggtggctggcacctgtaatcccagctacttgggagactgaggcatgagaatcacttgaactggggaggtggaggttgcagtcagccaagatcacgccactatactctagcctgggtggcagagcgagactctctcaaaaaaaaaaaaaaaattgcatttccaataattgggggaatagagtgattccctacccctaggtggtaggtgggaagtttctaagagagtccttccttttggcatattccagatcatgaaaatggaactgggactaacacctatgcggccttaaacagtgtctatctcatgatgaacaaccaaatgcgactcctcggcatggaaacgatggcctggcaggaaatccgacatgccatcatccttctgacagatggtgggtatcatggtctctgagtgtgtctggaatagtggaaggggcaccaatatggggtcagaagccctgaattctgattctccctctgcctgccactttgggccccagttttgtttttgtttttagagatggggccttgctatgttgcccagctgatctcaaactcctggcttcaagcaatcctcctgcctcagcctcccaaagtgctgggattacaggcatgagccaccacacctggcccagtttcttatttataaaatagggccagtgtggtggcttatgcctgtagtcccagcactttgggaggccaaagcgggtggatcacttgaggttaggagtttgagatcagactggctaacatggtgaaaccccgtctctactaaaaatacaaaaccattagctgggtgtggtggcaggcgcctgtaatcccagctacttgggaggctgaggcaggagaattgcttgaacctgggaggcagaggttgcagtgagccaagatcatgccactgcactccagcctgggtgacagaccaagatcctaccttgtctcaaaataaaataaataaataaatagaattagtgttgatgatgatgaccgtaaccacaatgacagcaatgatgatcatgatggctgtcctcctttccttacacaatttttatggaaagctatttaagttgcctgtgtgaaagtgctctgtgttagctcttgttaccatctgggaggtaacttggagatagatgaggaaacgtggctcttgagcaggaatgtcgaagggcacggatgcaaggaacagtctgtagtggatctggccttgtcatttgcctcttgctattgtccaaattacacagttcctccaggacttagtatataaaatgaggatacccactctacctggggtttcatgagaattaaatgagttaaagtataggaagcacctggcctggtgcctggaatgtagaacatttcagtaaaagtgtgtatatatatatatgtatgtatatatatatatgtatacatacatatatatatatatatatatatatatttatttttttgagacagggtctcactctattgcccaggctggactacagtggtgcgaactcggctcactgcaacctctgcctcccaggctgaagcaattctcgtgcctcagcctccagagtagctgggactacaggcatgtgtcaccatgcctggctaatttttatttttattttttgagatggagtttcactcttgttgcccaggctggagtgcaatggcgcgatttcggctcaccgcaacctccgcctcccaggttcaagcgattctcctgcctcctgagtagctgggattacaggcatgtgccaccacacccggctaattttgtatatttagtagaggtgcggtttctccatgttggtcaagctggtctcaaactcccaacctcaggtgatccacctgccttggcctcccaaagtgctgggattacaggcatgagccaccatgcccggccacacctggctaattttttgtggttttagtagagacagggtttcaccatgttgcccaggctggtctggaactcctgagctcaggcaatccgccttcttcggtctcccaaagtgctaggattacaggtgtgagccaccatgcccagcctaaaagtatattttgaagctctcacaggcaatgtaaatgttgaggttcccaggctaaatgctttcctactcttccagggcctggggaaatcctgatattacctagaagaattctttattctctttgttctaggaaagtccaatatgggtggctctcccaagacagctgttgaccatatcagagagatcctgaacatcaaccagaagaggaatgactatctgggtgagcccctgccactgccaccacatttgttctgctcctgcagaggtcatgagatcttcagccagggatcccagcatcttagctatggtccagagccacatggttttatttctgcgttgttctgtacaaaggcaactcatgttgaagagcctggggtcaaactactgcccatggtctcaaccttaccttctttttttttttttttttttttaagacagtgtctcactgacactcagagtatattcctggaaagatgtccacccatgccggcccagaagctggtccagaaagtaacgatgtccaccatgccaccatgaagtgcagtggtgcaatcatagcttactgcagcctcaaattcctggtttcaagtgatcccctcaactcagcttcccaaagtggtaggattacaggtatgagccactatgctcagcccgtcttcacaaattttttaaaattaatttttaaattttttttgagacagaatcttgccgtgttgcccaggctggagtgcagtgactcgatctcaactcactgcaacctccacgtcctggcttcaaatgattctcctgcctcagcctccagagtagctgggattacaggtgtgtgccaccatgcccggctcatttttgcatttttaatagagacagagtttcaccatgttggcagtctggtgtcaaacccctggcctcaagtgatccgcctgccttggtctcccaaggtgctgggattacagataggcgtgagccactgtgcctggccaatttttaattttttaattattatttttaatcaacagctttagacagagaaccttggtttcatcttcagtgggctgtggccatgggcagtttcttcatctgcaaaaggggagtagtactaggacccagctcacaagctgacaggggaagatgctcagacaaacactgcctgcctggcatagaaaaatgcccagcatatgttagccatgaccacgaccgtcgtcgttatcatcatcatcatcatcatagcatctcatgtttcaggaaactttccaggaagaagggacctcgattccctctggggaatgtccctggtggttgctctttcagcagcacagctggctaactaaggctttggcagttgcagcctctaaaggaaaaattcctcaggttcagactaaacacaaattgcactgacctttgatcagaaagtaatttcagagagagagatgctcagacagggagggcagctggttttgagccccaacctttcatcttccccttagctcctctcctttccattcacactgccccctcccccatcacctggccctcgggggtaagctgattcctctttaaaactctggcccaaggaagacaaaatttaaagcccactcccttcctccttagcatcactggaccaaggtcaaatgctacaaaaacattttattgaaaataagcaggaaaccaaacgaaaatagtcaaagaaaacgcacaaggcacgatcgttgtctagctccaactgtaactgtttctatctgggccattgccagattgcctcctggctgaagatctcttggtccacctaagcaccttgctttttacacacaacgcggggctctctgagaacaaaaatgggccacaaggggtgcaaaggctgggagaggagtagactctgtggtctgtctgagggcagttctgactggcaccacagtcggaggacaggcgcggcctgttgtgtgggtccagggcctccagtgggaaaacgtggctttaggcccttctcccagatgctaccttttacagaggaagaccagatctgaggtttagtttccatgttgtgttctgagttctttctattcattcagtcatttaaaagtacttaccaaactaccacaaacctgggtggcttagaacacagaatttctttttcttacagttctggaggttagaagtctgaaatcaaggtgttggcagggccgtgcttcctcagaaggctcttgggaagaattctttcctgccttttccggctgccggcagctccaaccttggcttgcggcagcataaacccattctctgcctctgtcttcaactcgccttcttttctgtgtgtgcctctgtgtcattacatgctgttctcttatatagataggagacccactacctgtgtctttgtgtccaaattcctttcttctttttctgttcatttgtttgagacagagtctcgctctgtcacccagaagcccaggctgcagtgcagtggcgggatcccggctcactgtaacctctgcctcctgggttcaggtgattctcgtgcctcagtctcccaagaagctgggattacaggcatgtgccaccatgcccggcaaatttttgtatttttagtagagacatggtctcgccatgttggctaggctggtcttaaactcctggcctcaaggcgatctgcctgccttcgcctcaaaaaaactgccgggattacaggcatgagtcaccaccatgcccagccagttcacttttttttttttttttttttttttttttttttgagatggagtcttgctctgttgcccaggctggagtgcagtggtgcaatctcggctcactgcaacatccgcctcccggttcaagcgattctcctgcctcagcctcctgagtagctgggattacaggtgtgtgccagcatgtctggctaatttttgtatttttagtagagacagggtttcaccatgttggtcaggctggtcttgaattcctgacctcgtgatctgcccgcctcagcctcccagagtgctgggattacaggtgtgagccaccgtgcccggctcacctcttctttttttttttttgagacggggttttgctcttgttgcccaggctggagtgcaatggcgcgatcttggctcaccacaaccaccgcctcctggtgattacaggtgtgagccaccacgcctggctctggcttacctcttcttataaggacctcagtcattggattagagctcaccctaatctagtatgacttaatcttaacttgattacatctgcaaagaccctttttccaaataaagtcacagatactggggattaggactcgaacacatctttctgggggacacaattccaccattacagggaataaacaggataagaaaaccatagaacccagcaggtggtaggtgacacaagctaaggggtgttgccatgttgcccaggctggtctcaaacttctggcttcaagggatcctcccaccttgcctcccaaagtggggatgaaagtttgtctggggcattgcagttttagacaggaagaccagggaaggcctcactgagaaggtgacatttgagccaagacttaaaaaggtacgaaagtgagccatgtggaagtctgggggggaggagtgaactaggcagaggcacagctgggcaaagggcctgaggtgtgaccatgcctatggatttgaggaacttcaaagaggctgtgtgctgcaggagagtgaagggcagggagtggcaggaaatgaaggcagacaggtagcagtggggaggacgcaggggtccagctcatgtaggtcttgattggacacagtgagtttcagatgacagcctcctgtctcatggggtagccccaaagccacaggagtctggtgatttccctcttccccaccagacatctatgccatcggggtgggcaagctggatgtggactggagagaactgaatgagctagggtccaagaaggatggtgagaggcatgccttcattctgcaggacacaaaggctctgcaccaggtctttgaacatatgctgggtgagtgagctttgccctccttggtgtggggaggatggtgaggagcccgccagaggcccgtgttgggaacctggacacagtgcccctcacttgcctccttccccatctgatcctcacacccacagatgtctccaagctcacagacaccatctgcggggtggggaacatgtcagcaaacgcctctgaccaggagaggacaccctggcatgtcactattaaggtaccaggaaggaggggcagggcttggattccagaggtaaaagcggccatgggccagacatactgcaatctctgaaaatcacctgttcccctgcagcccaagagccaagagacctgccggggggccctcatctccgaccaatgggtcctgacagcagctcattgcttccgcgatggcaacgaccactccctgtggagggtcaatgtgggtaaggcaggggatgcaccagcctcctgatcctgaagccacagatcctaccacctcacccagcctctggcccctgcaggagccctggtctagcctaatctagtgtatcatttccaggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggtgcctggagtctgggatgggagggtgccctgcagggaagagtgctctggagatccctggaagagatactggggacaggctggtgtgacccttgctcttctccccaggcccatctgccttccctgcacgatggaggccaatctggctctgcggagacctcaaggcagcacctgtagggaccatggtgagtgctgggacttatggtgcttgagagctggggccggggtttgggggtgataacaaggactaggctgcagtccccaagccaggaacctggattctgggtaaaaggaccagcaccaacatccccttctcttgactatagagaatgaactgctgaacaaacagagtgttcctgctcattttgtcgccttgaatgggagcaaactgaacattaaccttaagatgggagtggaggtgagggtctcaggttggggatgctgggatccccctgtgacagctcccagaatgtctctcttccttctccaggtctggctgctttctctctctgacgcgggtcacccctcctcccaagcctcacaaacctgctaggtgtccctgggtctgcttattctttttttgttgttattgagatggagtcttgctctgtctcccaggctggagtgcagtggcacgacctcagctcactgcaacttctgcctcctgggttcaagcgattctcctacttcagcctcccgagtagctgagattacaggtgcccaccaccacaccagctaatttttgtatttttagtagagacgggatttcgccatgttggccaggatggtcttgaactcctgacctcaagtgatctgcctgcctcaacctcccaaagtgctgagattacaggcgtgagccactgcacccacccgggtctgcttattctacccttctctctggttccacccctgctgcagtggacaagctgtgccgaggttgtctcccaagaaaaaaccatgttccccaacttgacagatgtcagggaggtggtgacagaccagttcctatgcagtgggacccaggaggatgagagtccctgcaagggtgagtccctcaccatgcctggattcccaaggggaaggccacctgtgtctctgtggccagcatgcatgccagaacaccagtccactgccctagatgacactgtctcctgtcaccctttgctggcaggagaatctgggggagcagttttccttgagcggagattcaggttttttcaggtgagaaggtagaagcttgcaggacccaggggttacaggatctcagccttgttggggggatgagggaggcctttgagggatctagggaggttggggcttacagttggggctgtggcagcctcccagccagttctctccttttctccaggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccagaatctgccgcccctccatcttctacctctgaatggccacccttagaccctgtgatccatcctctctcctagctgagtaaatccgggtctctaggatgccagaggcagcgcacacaagctgggaaatcctcagggctcctaccagcaggactgcctcgctgccccacctcccgctccttggcctgtccccagattccttccctggttgacttgactcatgcttgtttcactttcacatggaatttcccagttatgaaattaataaaaatcaatggtttccacatctctcagtgcctctatctggaggccaggtagggctggccttgggggagggggaggccagaatgactccaagagctacaggaaggcaggtcagagaccccactggacaaacagtggctggactctgcaccataacacacaatcaacaggggagtgagctggatccttatttctggtccctaagtgggtggtttgggcttactggggaggagctaaggccggagaggaggtactgaaggggagagtcctggacctttggcagcaaagggtgggacttctgcagtttctgtttccttgactggcagctcagcggggccctcccgcttggatgttccgggaaagtgatgtgggtaggacaggcggggcgagccgcaggtgccagaacacagattgtataaaaggctgggggctggtggggagcaggggaagggaatgtgaccaggtctaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtaagcgagggtaaccttcccttcctgctgtctccagcatccctccttggccttttggggccaggcttcatcagcctttctcttcaggtgtgaccaccactccatggtctttggcctggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagaggtttgagggcaatgagtgtgggcagtggcctaaggcagaaacagggcaggcggcagcaaggtcaggactaggatgagactaggcagggtgacaaggtgggctgaccgggagtaggagcagttttagggtggcaggcggaaagggggcaagaaaaagcggagttaacccttactaagcatttaccctgggcttccaggcagccctggaagtcaagagaacactcagaaatggggagggagaagcagtggaaatccatatgggttgaggagtaggtaagatgctgcttctgcgggactgggaatgcgctgtttctcagtgacatggtctccgagaccaggagggatacacctaaggcagcctttccctcttgatgacttctacttgtccccccttctcaaagcaatccactgtccaagaccacacgacttcgagaacggggaatactggccccggtctccctactacaatgtgagtgatgagatctctttccactgctatgacggttacactctccggggctctgccaatcgcacctgccaagtgaatggccggtggagtgggcagacagcgatctgtgacaacggaggtgagaagcatcccctccccctacattgctgtctccctgacggcgcccagcccgaggagtgggcactcggctccggacactgtaactcttgctctctaccttgctcacggggcctcaggcttcagtgcttacctcgatgtctcatacctctgcagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaaggtgacctttgacctgtacccccaggtcagatcctggtcttccatcctactgtcttctctccccacctcaaccctgctctttcctcactttgtttaaacctccctgtacaactatctcacttctgagccttttataccctggaaacccatga

SEQ ID NO: 16891 - DNA, 16541 bp, Human
tcactgcacactggtgaacaaattgtgtacattatataaacctaaaagataccatttacaggacagatgctgtagatagggatgtttgctatgacactttcccaacagatgacagtaaaggttgttgtagaaatttcccagcagatgacagtaaaggttgttatggacagaatatctttttctaattttctcaaaaacatgggagggctagcagtagcccagtgatagcctgggctcttcctcctcaaggctcagactcagagccccaccttacctttctcaaagtctatctcctcctcagcctcctcccgtgtgttcagatctgttatggtgggttcatccatcccccctgggaagagacaggacagacagggattcatgggatgagggtaatacgagataggtggggaacccttccctggagattaaagacaccctcttctaccatcccatctccacaagagtcacctggccagaagggatactgagttggatttccccataaggactgggaggctggccctggaggccggcgaagagacaaggaggttgtagccgagagatttgtgttctccagcaagacctaaggcaagagatcagagccccaatgaggctgagcttgtctctgaccacctccccttctccccaactgtttctcatgacccctgacctcctacctctttgtaacccagtatctggcctgtggttgggtgtctttgggcctgtaggtcggatgggactggggctcccaggacagccaaaagagaccagggatccgtcttcctctgccattttctggagagaaaaatagtaacttttgggtcttctttcttcctctgtcccagcttccttcaggaacccatcaccctagtctaagcccctccagactcctcaccgggctgagtgctccacaccatgcagaggcagccaggctggggatgacagaaacaactgttctgcttcttgctgcagatctggggcacaaggagggaggccatggggaagctgaaacaagggcaagatgagaggcattaggtaaggaaagaggataaaatgcagacaaaagagatgatgggacttgtgttcagatcagaaatggcagatgtgtcaaacagactaggacaatcaggcttggccaaaaactacctgctactgaattacctggggcagattttggatttcagaaacatggaggctggacctaggaatgtgcatttttaaaaagctccctggctaatcatgaagcacactgaaattggagactcactgattttagaaaaaggggtcccagacctaaggatgaaaggttggaggctcaaagcctatcatctcagtcaccaagtgccctggtgcttggatacagaagggagctccacggagaaatgccacatttgaaagagcagctctcaaagcaaaaatatccccagccctttctgctctgtcctcacacgtactgcaggtacactgggctgtaatctgtccagcaccccttcaggctgggatggacaggagtacaggcacagatgaacaaggttaagctagatcctactgtgaggagggtgaaggaggtttggactcaatgcgggtcaaaggttagggtcaaaagtcactcacgctactctctggagctccaggcaagttcagcagctcccagtgccccgtgcatccgagctccacggcccgaaggggtaggtccaggggatctggagggggtagcactacggggaaaggtcaaaagtcaggggtcaaagttcattccatatcggctactccgttccatttccctcccctccccctcaccaagtcgctctgtctccatcatcctggagccacagcagctgcctggcagcccggaagtgcggcaagtagtcgctgcgaagtaagccccgccccggaacgggcggaagtagaggcaacttccggtacagccccgccgagagcgtgaactatcgctgcggaggggcagacctggaccggtggaaggccgggcggaagtgcgcgcctggggccgccttggttaccgcgttttccgctcctcgctacgtcatcgttgtgagcccgctatcagcggccagcgcgggcgcggccggagaccgtggggcccccggttgccgccccctcgggtaaggccctctgcttctcactcttcggccctttttctcatagccgtttctctgttcttcctctttgcgttgctctgcgggcgctacgctggctccaccgccttctctgccgttcaaaccccgcggttgtccttaccctagcgagggtaggggggtcgggtgccatcgtctttccgacggagtggatatttgtccctccttgaaccacatggtacctaaaggtgctggtgtctgtgatccctggagacaggagggaatgctggatgatcccgaccagcgggagcttggacagcagcctggtttaagcaaggggtagggaaagccaaagacaagagtaggcagacctgaaggggtggggttgggtacagtgtggacggcgtgtgaaccccgggtggtaacagtggagaaagatgtcttgggccctgcccctgaactaggagccaccatgttggtgataccccccggactgagcgaggaagaggaggctctgcagaagaaattcaacaagctcaagaaaaaggtgagggactgtgtgtggacatggcctaacctttcacagactctgcactctgagaagatatggggtgagtgtgagcgaatggggaagtttttctggcccatacctagagacatatcacctcacagtgtagcttcgagaggtgggctttcccaagccttggtgtggaccttctgtcttttctatgcaatttgccatggattgtcttcctttcccatggcttttagtaccgcttaagagctgatgatccccaagtttgttttttccagttctatccagtgttatactgaaaaacttcagatactcagtgttgaagctatcatctttctattcttgatcttccaaataagattgactacaccaattctgccacatgtttggactcaaaactctgacttccccactatttgcatagtcaaacctttgccaagtcttattgtttcttcttttgaagtaatttttcctgtttattcttcactgtgcattcccccgagcagggctttattgacattcatgtgggccattgtaatggtctctcaacaaatttctcagtctttttttttgaacagacttcttcactcctgttcaaatgatccattgaaaacacaaaattctgctccctctgtttctcaaaaaccataaatggcttcacattgtctataaaaaagcctcaaaaccttagtttggcagccttgtctagtaaagtagaactattcactacttccaaaagatgcattcccaaagccttcttatctctgcatctttgccaccctgttttctttttctaaaatacccttctcctctctgtgttgtgcagagatacgggagagggcctagtttaatagccattaaacatcagaaaatcttactagctttcagctatgaataatctgcacctcttataattgtattgctaactcaatgtattttatttctcagactgtaagcttcttgagggtaggaacaatgcattagcctcctggatatccctgttacgaagtcatggctgggcctcattcaatatgcaggaaatagatggatgaagcttccaggaaaggcacataaacttatacttacttgcagcttatatcctaggattctagtccatgattgagttatttgtcttcaacttcaaaaatgtaacactctggaaaacctctgggttccgtggtttggttagattaggaatttccagcatcatacatgatctaggggaccagaggcaagaggcagagcacatcagtgtaccactctgagggcatcaagaaagacggtccctggagtgatgtgcccaggggccttaggagaggaaccggctaggggctggccctcacttacctctctcttctcacccttgttcccagaaaaaggcattgctggctctgaagaagcaaagtagcagcagcacaaccagccaaggtggtgtcaaacgctgtgagtgacaggggaaatggggatggactggaagtgggcagcatggagctgaccttcatcatggcttggccaacataatgcctcttccccttgtctctccagcactatcagagcagcctgtcatggacacagccacagcaacagagcaggcaaagcagctggtgaagtcaggagccatcagtgccatcaaggctgagaccaagaactcaggcttcaagcgttctcgaacccttgaggggaagttaaaggtgagcacaagcagaaagattgtttaaagggcatccctccaagttggaatgtagatgggtttggggaaaaatatgcatactcaagcactggcaaattgctgtaccattctgagtttcacctctcatgtataaaatgaaaaaactagacgactcctgaattctccattttacaaattctgtggttctaatccaccttggattggagctcttggaatatgttgccctaagggatggaaagggctgaaaatgttatcaggttcaagagaggttcaaataaactgaatacataatatatcgagtcacttataaaaaataccagctgggcgtggtggctcatgcctgtaatcccagcactttgggaggctgaggtgggcagatcacttgagattaggagtttaagaccaacctggccaacatggtaaaaccccgtctctactaaaaatacaaaaatcagcagggtgtgaggccgggcgcggtggctcacacctgtaatcccagcactttgggaggccgaggcaggcggatcacgaggtcaggagatcgagaccatcctggctaacaaggtgaaaccccatctctactaaaaatacaaaaattagccgggcgtggtggcgggcgcctgtagtcccagctacttgggaggctgaggcaggagaattgcttgaacccaggaggcggagcttgcagtgagtcgagattgtgccactgcactccagcctgggtgacagcgagactccgtctcaaaaaaaaaaaaaattagcagaatgtggtggtgcacacttatagtcccagttactgaggaggctgaggccagagaatcacttgaacccaggaggcagaggttgcagtgagtggagatcacaccactgcactccagcctggacgacagagcaagattctgtctcaaaaacaaaacaaaacaagccacaatggcaggtgcggcaatggctcattcctggttaatttcagcactttaggaggccgaggtaggaggattgcttgagcccaggagtttgagaccagccctggcaacatagtgaaaccctatctctacaaaaaaaaaaaaaaatacagaaattagccaagcatggtagagcacatctctagtcccagctactagggaggctgaggtaggaggattgcttgagcatgggaggtcaaggctgcagcaagctacgattgctctattgcactccagcctggacaacagagcaggaccgtgtctcaaaaaaaaaaaaaaaaaataagtaaaaccacgtcaaataagaaatgtatgtagaattaaaagggaagaaaagatcagaggaaacctagaagagggtgagggaagaggaacacctctggtccatggttgggcaacctcctgctccacactgaggtaggtctctcaccactccaggaccccgagaagggaccagtccccactttccagccgttccagaggagcatatctgctgatgatgacctgcaagaggtaaaggctcctaatttctgtccctgaggggttggggatggaggaatatgagagacaaatatattttggaccacatgtcagcaactggaaatcatcttaactgttcttggtctcttttacagtcatccagacgtccccagaggaaatctctgtatgagaggttagagagtagagataaggctgggcccatttggtggagttgattgcctgagtccttgggaggtttgggctgtaggagctgggctatagagggaatattgagtctccacagggtctgaggggagaaggtaaaacccccctttgatcttcagtctgcatctccccagctttgtgtcttctagtgatcgacttcgagaactaggaccagatggagaagaggcagagggcccaggggctggtgatggtccccctcgaagctttgactggggctatgaagaacgcagtggtgcccactcctcagcctcccctccccgaagccgcagccgggaccgcagccatgagaggaaccgggacagagaccgagatcgggagcgggatcgagaccgggatcgagacagagacagagagcgggacagggatcgggatcgggatcgagatcgagaccgggaacgggacagggatcgggagcgggatcgagaccgagaccgagagggtcctttccgcagtgagtgattttggctggaggtcaaggtgaccttaactgaggtttatgtgggtcctactaagtgaaatgtggcatgggctatgtcttgtgactatgatttgtgctcccaaagggtcggattcattccctgaacggcgagcccctaggaaagggaatactctctatgtatatggagaagacatgacacccacccttctccgtggggccttctctccttttggaaacatcattgacctctccatggacccacccagaaagtaaggatgacaacagggcatgatgagaagtcctgggagaatcctggggtgtgagacctgagggaagaagctgccctccctgcagccgcctattatcactgggtttggttgggtccagaagagccccttggctctccactgaccgtgttttctcttatcccagctgtgccttcgtcacctatgaaaagatggagtcagcagatcaggccgttgctgaggttggaacttcccaaatctgttcttcccatcgcttctgctgttctcatgtgttctcctcaaaatactagatgccaggaagaagttggttcctcttgataaagaaagcctctccctattcacacagaaaaactcacattctcagattccttattcagtctcctcctaggatagcaactcctggaataacttctttggtttatctgtaatgttttcctccccatcctctgcctcccctcttctgcttcagctcaacgggacccaggtggagtctgtacagctcaaagtcaacatagcccgaaaacagcccatgctggatgccgctactggcaagtctgtctggggctccctcggtaagaatgggattcttcctttcccatcctctcccccacaggccattccttttggttcccccacacatccttgggtttcctagagatgatcgaggtcagagtgtgtgcggaggctatgggaatgggaaggaaaatttcagatcctctgtcagttagaggtaaagaaaggagagaaaaggattgaaaacagcttccaaagcagtgactggaacagggaagaaagtgggagctggagtgagattggtgaggaagatgagtgtctcatggggcttgttcattttgagatggagtagagtgagtttcataagtattcgaaatcagggatctggaactcaggtgtgaggtaaggaaggaaaacatagattaagtcatccacatcacagggtggctgccaaacaataggatcatcagggagactctgatttcagagaaaaaaaaacgacccaggactcagtttgaggagtactctgggactatgttaggaaacaggactgttcacctcacaccccacatgtccccagctgtcctgacatgttaggctaacgttgagcctaacgttagcaaaggagacaggaggaggggtcggagggctgggagcagcaccgcaggggcctgggccactgaagcaaaaggacacacactttgagaaagagggagtagccagcagtgttgaggcacagagatcacaggatgggagtgggtgagagagattctctgtagctcaagggtggtggggatggaaccattggatggggtgaagagagtaacatgtctggtggagggaggaaagaggaaggggaagaaacagctagaggcttgagagagaatggtgagggccaaagctacaccctgaatgagttctggtggagctagtagcatttcttagtgtgaataatccattttccctgaaagtagattttcctgggaaaggagtgagcagaaagaagggctcagctacagtggcccttcaggcaaaagaaaggaactagaattgaccagcatgtcaaaaaagggctacagaggttttctagtttttagcttctgacatactgactgtaagtagtgggttaatatcattcacgtgtctcaacaatgacatttgggatttttctaagaacaaaacattcatcaaaatgtccacttatacttttcttggccatgggttggcacaaaggagctaaggaagacaggccatcctggccaccagagggcagcgtggaaactgggcttccaggggccagtggccaggagtgaggtggtcaggagtcagcctcagggtctgttctatgatctcctttagaccttaactgttcctctcctccctccctagctgtccagaacagccctaagggttgccaccgggacaagaggacccagattgtctacagtgatgacgtctacaaggaaaaccttgtggatggcttctagggaacagagctggattccttgtgcctcatatgccccaatgctggtctcagtaaaacactgaggtggaagcttacacatctccctcagcctctggtttttcagcacttgggattggggttaaacctttaaaaacggctgtcaggtttgatctcagtgtaacaacatggccagtgcctgttccccactcccttgccccaaaaggatctggaacacaggtgttgtcgcagctgttttaattcaatcccacgcccctgtccagcaggaaaccccttatagaaaacccaaatcctcatcttggagtttctccttcagccagggcagcacttgaaagaggttgatgtgaaagtctcgggcgtgagcaggtacctgcttttgccgcttctggtttttgcagacatccactactccccagctgattacaccaacctgcagaggcagtggggtgccatggatcattcagtagaattcctaatcctggaagcatggctgttcctgcttgcgtcttagctgacctaaaggaatcagactagggacccagctcagcctcgttcttgacacacgcaggcaagacatgcggtcctaaggtgaggcaggctctgcctacctcgaattactagccacatgcattgagctttcctgctttggggcccatgctgaccacttggcatctccccagataggaaagggaggactcacttgaatgaaacgacttctcttgtgaactatcaaggggccgccagaatcacctgcaaggagaggagaagctgtagagaaaaggactgttgggccttgggcacttgtagcacaaccaaagagcattctctcacctctgcaagtattggggtcagcatagggactcactcctccagtacaaaggaaccgaggggtgaccacctctgagatgtccttgactttgtcatagcctggggcatattgagcatctctctcacagctgcctttctgtaggggaggtgggaagcatggagaagtaatgaacagaagtggcttaggaaggattggggcctagagtgcctccttaggatgcccgtttctcaccttatccccattcttgatgtagacctccttccgagtcagctttttctcctcctcagacacaaacagagctttgatatcctgtgcagggagcagctcttcctctggacgaatagactgcgtcacttcagctgctcccaccactgtcatctccccattgcctttgtcactcagtagatgtcccctaagcccttctagagctaggttctgggccaggcatcatctcttcctattgcacctccctctcatgccccacttgtctcttgggatctcatccttatcctcttgccaagtatgtcttactttgttgctggcaagtggtagttggaggaagcctcaaagctcgagttgttccctcggtgcaggggagacaaatgggcctataaaggacaaggagaacagcaaaccaggcctgctcctcaccccagtcctccagcctttcccagcctttcctcagggatctggacgctctcacctgatagtctggccatatttcagcttattcttgagcttgatcagggcaacgtcatagtcataaaattcaggaattcctgcttcttttttcccattaatgttgtagttggggtgaaataggactacttctatctccaggtcccgcttctcccctcctgaagtaggagagtaggtaccacctctttgtgggcagcttcctgcctctggccccgtgtcattcctaacttcacgtcttcccccatccctgactggtctggggtgcaaggaatggggctgcattgaggatgggtggagtgtaggatctgtagaaagtgggaggtgttgcctggagagcataggtgcagcccaggaccttcagttgcatccttacctacgctgaccttgattgagtgttccttgtcatccacagtgaaacaatgtgctgctgtcagcacaaagtactcagacaccacagcccccatacagctctcgtgtccctttgaagggcgctggggacacaacagtagagagggaaagctcaactttcacaaaccaccatctcttatggccattttttccttcccctactcccatttcaccttgacctcacctcccccaagtccccactactgggattctgtgcttacaatgactgagatcttggcctgccatggttgcttgtggtaatcggtacccttcctgtgttcccaaaccatgccacagagactcagagactggctttcatctggcagagaaggagaatgtgctgaaaactcggaacacttcattcccaaatggcagcagccttttgggtaggagtctatggggagcaaaggcccaaaaggagaaagggaaagaccacgggtatttgtttcctcgtgttaggagaaaactgctatggtggactgaaaagggaaagaacttgggatcaagctgtcagaggcctggctgttttcaagcccacccttgttgctaacttgctgtcccttgacctcctttggcttctgtttccacgtgtcaaatgtaggactatagaaagatctctgaagtgctcagagctctgtgattctaaggttaagtgaacagtgccaggaaacaagaatagtgacactgaggtagagaaggaggaatgaagaaggctttccaggcaactagagcttcaggtgtagaggaagaatgaattacttcaggggaacctgaggagagttgtgttctttattcccttgtatctccctaccgatcatttggtagaaaacatcttccaggttttccatatccttgactttgaacacatgttgctcattgtctttcttggaagccaaagcattgatgttcacttggttcaccaaaggcccgaccccaaacacatagacatctgagggataaaaaggaaggatgagggtccaagccctgaggaagtggggtgctgggtcctaggcaggttactcacccagataatcctcccttgggtttttgcgatccttgccaatgtatagcaagtcccggatctcatcaatgacagtaattgggtccccgcccatgttgtgcaatcctgcagaagagacaggaccatgagggtaggagataaggaagataaactggctaaaggcagggatacacatggcagggtgagcaagttgaggaagggttagagatagttgatcacagggcttaggaagaattccttatgaagggtcacaggagagatgaacagccagctatgagtcacattcagggccccaaccatgggtatagtgttacaagtggacttaagggccacatgctggtctgagaaggtggggaggctgggacaggagagaggtcccttctgaccatcagtcatgaggatgatgacatggcgggtgcggttccagccttcaggagggacgtcatctggccagctcatcatgctgtacactgcctggagggccttcttggtgttagtccctgacttcaacttgtggtctgtggagagggaagagaccatcacctcacctggtcttccaagccatcttttaaccccagagaccaatctgcaactgaaatcccacatctttcaactttttaagttaatcatcattacacggacttccctttgaccacaaagtggcccttccagcccccaacaggttcccactaacctccattgcccaacgatcctgctgttcaacctttgactacaaagtggtcctccctgtcgccctcaaggtagtctcatgaccccctccaccctgaacctcctgaccccaaagtgaacctcccaccattccctaacctctgaccttcataattgatttcattgagctgcttcgtgacccagtctgcattactgctgtctgcttcagacactttgacccaaattttggggtatgtggcatatgtcactagaccatatcttggcttcacaccataacttgccacctgtgggtgaggagaacaaggcgccatggcattgaaaatagaatactgtgattgggagatttcagcgactttgctgggacagggaggctctcagtaagaggctcaagggctgaggttcatggaggaattaccagtcaagaaactgcttcaagtaaaagggaaggaggacagaataggacctggagattttcctggggccctgttgttcagaggggctggaatgatcagggagctagtcctggaagatcagcgagattccattcccccgagttcagggataggaggattccaccttctcaattaagttgactagacactttttggctcctgtgaagttgctggccccaatgctgtctgatccatctagcaccaggtagatgttcatggagcctgaagggtccaggacgatcttccgcttctgttgttcccctgggtgccaggagagtggctcaggctccagcattaacagttctgtcccttctccattttcccccagttccctgccctgcctcccttctctgtcttcaaacctgggccgtgcccatcctcagcatcgactccttctatggtctctgtcagggaagacaggaaagcttcggccacctcttgaggggtgtcgtacatgaaggagtctgggagagtcagaaatgaggtcaaatgtctgggagtgtcagggatacagtgaccaaagagacgggggatcatgggtttccagggtataaaaggctcagaagtgagatagttgtacagggaggtttaaacaaagtgaggaaagagcagggttgaggtggggagagaagacagtaggatggaagaccaggatctgacctgggggtacaggtcaaaggtcaccttggcaggaaggctccgtcccgctccaagagccaccttcctgacacgttcgccgctgggagccacgcagggtaagcccccggctgcagtggtaggtgacgctgtcttcaaggcggtactggctgcccaccttccttgtgccaatggggatgcccgggttggagcagtaccccgctgcagaggtatgagacatcgaggtaagcactgaagcctgaggccccgtgagcaaggtagagagcaagagttacagtgtccggagccgagtgcccactcctcgggctgggcgccgtcagggagacagcaatgtagggggaggggatgcttctcacctccgttgtcacagatcgctgtctgcccactccaccggccattcacttggcaggtgcgattggcagagccccggagagtgtaaccgtcatagcagtggaaagagatctcatcactcacattgtagtagggagaccggggccagtattccccgttctcgaagtcgtgtggtcttggacagtggattgctttgagaaggggggacaagtagaagtcatcaagagggaaaggctgccttaggtgtatccctcctggtctcggagaccatgtcactgagaaacagcgcattcccagtcccgcagaagcagcatcttacctactcctcaacccatatggatttccactgcttctccctccccatttctgagtgttctcttgacttccagggctgcctggaagcccagggtaaatgcttagtaagggttaactccgctttttcttgccccctttccgcctgccaccctaaaactgctcctactcccggtcagcccaccttgtcaccctgcctagtctcatcctagtcctgaccttgctgccgcctgccctgtttctgccttaggccactgcccacactcattgccctcaaacctctgcactctgccttcctgacagtcttttggtcttgagtcttcagggtgctccaggaccccgtagatctgcaggtacgtgtctgcacagggtacgggtagaagccagaaggacacacgtactccagtgcctggccctcttggagaagtcggaaggagccgcctttgatctctaccccctccagagagcaggatccctggggccaggccaaagaccatggagtggtggtcacacctgaagagaaaggctgatgaagcctggccccaaaaggccaaggagggatgctggagacagcaggaagggaaggttaccctcgcttacctccagacaagaggcccaagataaagggcatcaggcagagttgggggctgagattgctccccatggcgttggaaggcaggagagaagctgggcctggggcaggatggtgtgtcctggcttgctttgcttgtctgcttggctcagtgtccaagctgaaactccagacctagacctggtcacattcccttcccctgctccccaccagcccccagccttttatacaatctgtgttctggcacctgcggctcgccccgcctgtcctacccacatcactttcccggaacatccaagcgggagggccccgctgagctgccagtcaaggaaacagaaactgcagaagtcccaccctttgctgccaaaggtccaggactctccccttcagtacctcctctccggccttagctcctccccagtaagcccaaaccacccacttagggaccagaaataaggatccagctcactcccctgttgattgtgtgttatggtgcagagtccagccactgtttgtccagtggggtctctgacctgccttcctgtagctcttggagtcattctggcctccccctcccccaaggccagccctacctggcctccagatagaggcactgagagatgtggaaaccattgatttttattaatttcataactgggaaattccatgtgaaagtgaaacaagcatgagtcaagtcaaccagggaaggaatctggggacaggccaaggagcgggaggtggggcagcgaggcagtcctgctggtaggagccctgaggatttcccagcttgtgtgcgctgcctctggcatcctagagacccggatttactcagctaggagagaggatggatcacagggtctaagggtggccattcagaggtagaagatggaggggcggcagattctggcagggcagcagagggctcagtggccatggctagaggggtaaaaaattcaggacatcccccaggtgctgcctcagccagggctgcatgcggaagagattgatgtgaaagtctcgtggcggcgggaccttgctacgaggggcccttttgcgggagtttttgtcagcagagccaaggcaggggttgtaaagaccccagctcaccagacccacctggagaaaaggagagaactggctgggaggctgccacagccccaactgtaagccccaacctccctagatccctcaaaggcctccctcatccccccaacaaggctgagatcctgtaacccctgggtcctgcaagcttctaccttctcacctgaaaaaacctgaatctccgctcaaggaaaactgctcccccagattctcctgccagcaaagggtgacaggagacagtgtcatctagggcagtggactggtgttctggcatgcatgctggccacagagacacaggtggccttccccttgggaatccaggcatggtgagggactcacccttgcagggactctcatcctcctgggtcccactgcataggaactggtctgtcaccacctccctgacatctgtcaagttggggaacatggttttttcttgggagacaacctcggcacagcttgtccactgcagcaggggtggaaccagagagaagggtagaataagcagacccgggtgggtgcagtggctcacgcctgtaatctcagcactttgggaggttgaggcaggcagatcacttgaggtcaggagttcaagaccatcctggccaacatggcgaaatcccgtctctactaaaaatacaaaaattagctggtgtggtggtgggcacctgtaatctcagctactcgggaggctgaagtaggagaatcgcttgaaccca

SEQ ID NO: 16892 - DNA, 12270 bp, Human
gcaccaacatccccttctcttgactatagagaatgaactgctgaacaaacagagtgttcctgctcattttgtcgccttgaatgggagcaaactgaacattaaccttaagatgggagtggaggtgagggtctcaggttggggatgctgggatccccctgtgacagctcccagaatgtctctcttccttctccaggtctggctgctttctctctctgacgcgggtcacccctcctcccaagcctcacaaacctgctaggtgtccctgggtctgcttattctttttttgttgttattgagatggagtcttgctctgtctcccaggctggagtgcagtggcacgacctcagctcactgcaacttctgcctcctgggttcaagcgattctcctacttcagcctcccgagtagctgagattacaggtgcccaccaccacaccagctaatttttgtatttttagtagagacgggatttcgccatgttggccaggatggtcttgaactcctgacctcaagtgatctgcctgcctcaacctcccaaagtgctgagattacaggcgtgagccactgcacccacccgggtctgcttattctacccttctctctggttccacccctgctgcagtggacaagctgtgccgaggttgtctcccaagaaaaaaccatgttccccaacttgacagatgtcagggaggtggtgacagaccagttcctatgcagtgggacccaggaggatgagagtccctgcaagggtgagtccctcaccatgcctggattcccaaggggaaggccacctgtgtctctgtggccagcatgcatgccagaacaccagtccactgccctagatgacactgtctcctgtcaccctttgctggcaggagaatctgggggagcagttttccttgagcggagattcaggttttttcaggtgagaaggtagaagcttgcaggacccaggggttacaggatctcagccttgttggggggatgagggaggcctttgagggatctagggaggttggggcttacagttggggctgtggcagcctcccagccagttctctccttttctccaggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccagaatctgccgcccctccatcttctacctctgaatggccacccttagaccctgtgatccatcctctctcctagctgagtaaatccgggtctctaggatgccagaggcagcgcacacaagctgggaaatcctcagggctcctaccagcaggactgcctcgctgccccacctcccgctccttggcctgtccccagattccttccctggttgacttgactcatgcttgtttcactttcacatggaatttcccagttatgaaattaataaaaatcaatggtttccacatctctcagtgcctctatctggaggccaggtagggctggccttgggggagggggaggccagaatgactccaagagctacaggaaggcaggtcagagaccccactggacaaacagtggctggactctgcaccataacacacaatcaacaggggagtgagctggatccttatttctggtccctaagtgggtggtttgggcttactggggaggagctaaggccggagaggaggtactgaaggggagagtcctggacctttggcagcaaagggtgggacttctgcagtttctgtttccttgactggcagctcagcggggccctcccgcttggatgttccgggaaagtgatgtgggtaggacaggcggggcgagccgcaggtgccagaacacagattgtataaaaggctgggggctggtggggagcaggggaagggaatgtgaccaggtctaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtaagcgagggtaaccttcccttcctgctgtctccagcatccctccttggccttttggggccaggcttcatcagcctttctcttcaggtgtgaccaccactccatggtctttggcctggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagaggtttgagggcaatgagtgtgggcagtggcctaaggcagaaacagggcaggcggcagcaaggtcaggactaggatgagactaggcagggtgacaaggtgggctgaccgggagtaggagcagttttagggtggcaggcggaaagggggcaagaaaaagcggagttaacccttactaagcatttaccctgggcttccaggcagccctggaagtcaagagaacactcagaaatggggagggagaagcagtggaaatccatatgggttgaggagtaggtaagatgctgcttctgcgggactgggaatgcgctgtttctcagtgacatggtctccgagaccaggagggatacacctaaggcagcctttccctcttgatgacttctacttgtccccccttctcaaagcaatccactgtccaagaccacacgacttcgagaacggggaatactggccccggtctccctactacaatgtgagtgatgagatctctttccactgctatgacggttacactctccggggctctgccaatcgcacctgccaagtgaatggccggtggagtgggcagacagcgatctgtgacaacggaggtgagaagcatcccctccccctacattgctgtctccctgacggcgcccagcccgaggagtgggcactcggctccggacactgtaactcttgctctctaccttgctcacggggcctcaggcttcagtgcttacctcgatgtctcatacctctgcagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaaggtgacctttgacctgtacccccaggtcagatcctggtcttccatcctactgtcttctctccccacctcaaccctgctctttcctcactttgtttaaacctccctgtacaactatctcacttctgagccttttataccctggaaacccatgatcccccgtctctttggtcactgtatccctgacactcccagacatttgacctcatttctgactctcccagactccttcatgtacgacacccctcaagaggtggccgaagctttcctgtcttccctgacagagaccatagaaggagtcgatgctgaggatgggcacggcccaggtttgaagacagagaagggaggcagggcagggaactgggggaaaatggagaagggacagaactgttaatgctggagcctgagccactctcctggcacccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggaatcctcctatccctgaactcgggggaatggaatctcgctgatcttccaggactagctccctgatcattccagcccctctgaacaacagggccccaggaaaatctccaggtcctattctgtcctccttcccttttacttgaagcagtttcttgactggtaattcctccatgaacctcagcccttgagcctcttactgagagcctccctgtcccagcaaagtcgctgaaatctcccaatcacagtattctattttcaatgccatggcgccttgttctcctcacccacaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaaggtcagaggttagggaatggtgggaggttcactttggggtcaggaggttcagggtggagggggtcatgagactaccttgagggcgacagggaggaccactttgtagtcaaaggttgaacagcaggatcgttgggcaatggaggttagtgggaacctgttgggggctggaagggccactttgtggtcaaagggaagtccgtgtaatgatgattaacttaaaaagttgaaagatgtgggatttcagttgcagattggtctctggggttaaaagatggcttggaagaccaggtgaggtgatggtctcttccctctccacagaccacaagttgaagtcagggactaacaccaagaaggccctccaggcagtgtacagcatgatgagctggccagatgacgtccctcctgaaggctggaaccgcacccgccatgtcatcatcctcatgactgatggtcagaagggacctctctcctgtcccagcctccccaccttctcagaccagcatgtggcccttaagtccacttgtaacactatacccatggttggggccctgaatgtgactcatagctggctgttcatctctcctgtgacccttcataaggaattcttcctaagccctgtgatcaactatctctaacccttcctcaacttgctcaccctgccatgtgtatccctgcctttagccagtttatcttccttatctcctaccctcatggtcctgtctcttctgcaggattgcacaacatgggcggggacccaattactgtcattgatgagatccgggacttgctatacattggcaaggatcgcaaaaacccaagggaggattatctgggtgagtaacctgcctaggacccagcaccccacttcctcagggcttggaccctcatccttcctttttatccctcagatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcggtagggagatacaagggaataaagaacacaactctcctcaggttcccctgaagtaattcattcttcctctacacctgaagctctagttgcctggaaagccttcttcattcctccttctctacctcagtgtcactattcttgtttcctggcactgttcacttaaccttagaatcacagagctctgagcacttcagagatctttctatagtcctacatttgacacgtggaaacagaagccaaaggaggtcaagggacagcaagttagcaacaagggtgggcttgaaaacagccaggcctctgacagcttgatcccaagttctttcccttttcagtccaccatagcagttttctcctaacacgaggaaacaaatacccgtggtctttccctttctccttttgggcctttgctccccatagactcctacccaaaaggctgctgccatttgggaatgaagtgttccgagttttcagcacattctccttctctgccagatgaaagccagtctctgagtctctgtggcatggtttgggaacacaggaagggtaccgattaccacaagcaaccatggcaggccaagatctcagtcattgtaagcacagaatcccagtagtggggacttgggggaggtgaggtcaaggtgaaatgggagtaggggaaggaaaaaatggccataagagatggtggtttgtgaaagttgagctttccctctctactgttgtgtccccagcgcccttcaaagggacacgagagctgtatgggggctgtggtgtctgagtactttgtgctgacagcagcacattgtttcactgtggatgacaaggaacactcaatcaaggtcagcgtaggtaaggatgcaactgaaggtcctgggctgcacctatgctctccaggcaacacctcccactttctacagatcctacactccacccatcctcaatgcagccccattccttgcaccccagaccagtcagggatgggggaagacgtgaagttaggaatgacacggggccagaggcaggaagctgcccacaaagaggtggtacctactctcctacttcaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggtgagagcgtccagatccctgaggaaaggctgggaaaggctggaggactggggtgaggagcaggcctggtttgctgttctccttgtcctttataggcccatttgtctcccctgcaccgagggaacaactcgagctttgaggcttcctccaactaccacttgccagcaacaaagtaagacatacttggcaagaggataaggatgagatcccaagagacaagtggggcatgagagggaggtgcaataggaagagatgatgcctggcccagaacctagctctagaagggcttaggggacatctactgagtgacaaaggcaatggggagatgacagtggtgggagcagctgaagtgacgcagtctattcgtccagaggaagagctgctccctgcacaggatatcaaagctctgtttgtgtctgaggaggagaaaaagctgactcggaaggaggtctacatcaagaatggggataaggtgagaaacgggcatcctaaggaggcactctaggccccaatccttcctaagccacttctgttcattacttctccatgcttcccacctcccctacagaaaggcagctgtgagagagatgctcaatatgccccaggctatgacaaagtcaaggacatctcagaggtggtcacccctcggttcctttgtactggaggagtgagtccctatgctgaccccaatacttgcagaggtgagagaatgctctttggttgtgctacaagtgcccaaggcccaacagtccttttctctacagcttctcctctccttgcaggtgattctggcggccccttgatagttcacaagagaagtcgtttcattcaagtgagtcctccctttcctatctggggagatgccaagtggtcagcatgggccccaaagcaggaaagctcaatgcatgtggctagtaattcgaggtaggcagagcctgcctcaccttaggaccgcatgtcttgcctgcgtgtgtcaagaacgaggctgagctgggtccctagtctgattcctttaggtcagctaagacgcaagcaggaacagccatgcttccaggattaggaattctactgaatgatccatggcaccccactgcctctgcaggttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggcgtgggattgaattaaaacagctgcgacaacacctgtgttccagatccttttggggcaagggagtggggaacaggcactggccatgttgttacactgagatcaaacctgacagccgtttttaaaggtttaaccccaatcccaagtgctgaaaaaccagaggctgagggagatgtgtaagcttccacctcagtgttttactgagaccagcattggggcatatgaggcacaaggaatccagctctgttccctagaagccatccacaaggttttccttgtagacgtcatcactgtagacaatctgggtcctcttgtcccggtggcaacccttagggctgttctggacagctagggagggaggagaggaacagttaaggtctaaaggagatcatagaacagaccctgaggctgactcctgaccacctcactcctggccactggcccctggaagcccagtttccacgctgccctctggtggccaggatggcctgtcttccttagctcctttgtgccaacccatggccaagaaaagtataagtggacattttgatgaatgttttgttcttagaaaaatcccaaatgtcattgttgagacacgtgaatgatattaacccactacttacagtcagtatgtcagaagctaaaaactagaaaacctctgtagcccttttttgacatgctggtcaattctagttcctttcttttgcctgaagggccactgtagctgagcccttctttctgctcactcctttcccaggaaaatctactttcagggaaaatggattattcacactaagaaatgctactagctccaccagaactcattcagggtgtagctttggccctcaccattctctctcaagcctctagctgtttcttccccttcctctttcctccctccaccagacatgttactctcttcaccccatccaatggttccatccccaccacccttgagctacagagaatctctctcacccactcccatcctgtgatctctgtgcctcaacactgctggctactccctctttctcaaagtgtgtgtccttttgcttcagtggcccaggcccctgcggtgctgctcccagccctccgacccctcctcctgtctcctttgctaacgttaggctcaacgttagcctaacatgtcaggacagctggggacatgtggggtgtgaggtgaacagtcctgtttcctaacatagtcccagagtactcctcaaactgagtcctgggtcgtttttttttctctgaaatcagagtctccctgatgatcctattgtttggcagccaccctgtgatgtggatgacttaatctatgttttccttccttacctcacacctgagttccagatccctgatttcgaatacttatgaaactcactctactccatctcaaaatgaacaagccccatgagacactcatcttcctcaccaatctcactccagctcccactttcttccctgttccagtcactgctttggaagctgttttcaatccttttctctcctttctttacctctaactgacagaggatctgaaattttccttcccattcccatagcctccgcacacactctgacctcgatcatctctaggaaacccaaggatgtgtgggggaaccaaaaggaatggcctgtgggggagaggatgggaaaggaagaatcccattcttaccgagggagccccagacagacttgccagtagcggcatccagcatgggctgttttcgggctatgttgactttgagctgtacagactccacctgggtcccgttgagctgaagcagaagaggggaggcagaggatggggaggaaaacattacagataaaccaaagaagttattccaggagttgctatcctaggaggagactgaataaggaatctgagaatgtgagtttttctgtgtgaatagggagaggctttctttatcaagaggaaccaacttcttcctggcatctagtattttgaggagaacacatgagaacagcagaagcgatgggaagaacagatttgggaagttccaacctcagcaacggcctgatctgctgactccatcttttcataggtgacgaaggcacagctgggataagagaaaacacggtcagtggagagccaaggggctcttctggacccaaccaaacccagtgataataggcggctgcagggagggcagcttcttccctcaggtctcacaccccaggattctcccaggacttctcatcatgccctgttgtcatccttactttctgggtgggtccatggagaggtcaatgatgtttccaaaaggagagaaggccccacggagaagggtgggtgtcatgtcttctccatatacatagagagtattccctttcctaggggctcgccgttcagggaatgaatccgaccctttgggagcacaaatcatagtcacaagacatagcccatgccacatttcacttagtaggacccacataaacctcagttaaggtcaccttgacctccagccaaaatcactcactgcggaaaggaccctctcggtctcggtctcgatcccgctcccgatccctgtcccgttcccggtctcgatctcgatcccgatcccgatccctgtcccgctctctgtctctgtctcgatcccggtctcgatcccgctcccgatctcggtctctgtcccggttcctctcatggctgcggtcccggctgcggcttcggggaggggaggctgaggagtgggcaccactgcgttcttcatagccccagtcaaagcttcgagggggaccatcaccagcccctgggccctctgcctcttctccatctggtcctagttctcgaagtcgatcactagaagacacaaagctggggagatgcagactgaagatcaaaggggggttttaccttctcccctcagaccctgtggagactcaatattccctctatagcccagctcctacagcccaaacctcccaaggactcaggcaatcaactccaccaaatgggcccagccttatctctactctctaacctctcatacagagatttcctctggggacgtctggatgactgtaaaagagaccaagaacagttaagatgatttccagttgctgacatgtggtccaaaatatatttgtctctcatattcctccatccccaacccctcagggacagaaattaggagcctttacctcttgcaggtcatcatcagcagatatgctcctctggaacggctggaaagtggggactggtcccttctcggggtcctggagtggtgagagacctacctcagtgtggagcaggaggttgcccaaccatggaccagaggtgttcctcttccctcaccctcttctaggtttcctctgatcttttcttcccttttaattctacatacatttcttatttgacgtggttttacttattttttttttttttttttgagacacggtcctgctctgttgtccaggctggagtgcaatagagcaatcgtagcttgctgcagccttgacctcccatgctcaagcaatcctcctacctcagcctccctagtagctgggactagagatgtgctctaccatgcttggctaatttctgtatttttttttttttttgtagagatagggtttcactatgttgccagggctggtctcaaactcctgggctcaagcaatcctcctacctcggcctcctaaagtgctgaaattaaccaggaatgagccattgccgcacctgccattgtggcttgttttgttttgtttttgagacagaatcttgctctgtcgtccaggctggagtgcagtggtgtgatctccactcactgcaacctctgcctcctgggttcaagtgattctctggcctcagcctcctcagtaactgggactataagtgtgcaccaccacattctgctaattttttttttttttgagacggagtctcgctgtcacccaggctggagtgcagtggcacaatctcgactcactgcaagctccgcctcctgggttcaagcaattctcctgcctcagcctcccaagtagctgggactacaggcgcccgccaccacgcccggctaatttttgtatttttagtagagatggggtttcaccttgttagccaggatggtctcgatctcctgacctcgtgatccgcctgcctcggcctcccaaagtgctgggattacaggtgtgagccaccgcgcccggcctcacaccctgctgatttttgtatttttagtagagacggggttttaccatgttggccaggttggtcttaaactcctaatctcaagtgatctgcccacctcagcctcccaaagtgctgggattacaggcatgagccaccacgcccagct

SEQ ID NO: 16893 - DNA, 16984 bp, Human
cctacccccgcctcccgcaccgcgcccctctccggctgccctctccgtgtggggcaaggctccgagggcagcattcagtagccatttagctttggaaggagaggtgattcgaatggcccggctcctcctgtcaccatgctaggcactttggccgcgcaggtacttattgacccgaccgggtgtccgtagttggcgcggctaccttaaccgcagggaattgtggaatttatagttctaaattatatgtgggtggaacggggaagctggagcagatttttggaggaaagcaaaactggggactttcaggactaggggcctgggtctcagaagaatgggaaaggacgagaaaggagtctaaataagaaccctgctattagcattgtttggttttcttttcaggtgctgacctgaacctggttcatccctttctgaccaaaactgttcactcaccgtggaagggactaagcatccatatggagacgccaccagtcaatacaattggagaaaaggacacctctcagccgcaacaagagtgggaaaagaaccttcgggagaaccttgattcagttattcagattaggcagcagccccgagaccctcctaccgaaacgcttgagctggaagtaagcccagatccagccagccaaattctagagcatactcaaggagctgaaaaactggttgctgaacttgaaggagactctcataagtctcatggatcaaccagtcagatgccagaggcccttcaagcttctgatctctggtactgccccgatgggagctttgtcaagaagatcgtaatccgtggccatggcttggacaaacccaaactaggctcctgctgccgggtactggctttggggtttcctttcggatcagggccgccagagggctggacagagctaactatgggcgtagggccatggagggaggaaacttggggggagctcatagagaaatgcttggagtccatgtgtcaaggtgaggaagcagagcttcagctgcctgggcactctggacctcctgtcaggctcacactggcatccttcactcaaggccgagactcctgggagctggagactagcgagaaggaagccctggccagggaagaacgtgcaaggggcacagaactatttcgagctgggaaccctgaaggagctgcccgatgctatggacgggctcttcggctgctcctgactttacccccacctggccctccagaacgaactgtccttcatgccaatctggctgcctgtcagttgttgctagggcagcctcagttggcagcccagagctgtgaccgggtgttggagcgggagcctggccatttaaaggccttataccgaaggggggttgcccaggctgcccttgggaacctggaaaaagcaactgctgacctcaagaaggtgctggcgatagatcccaaaaaccgggcagcccaggaggaactggggaaggtggtcattcaggggaagaaccaggatgcagggctggctcagggtctgcgcaagatgtttggctgattaaaagttaaaccttaaaagagacaggaacttgtgaattgtggtctgtgctgtgagatttgggggtggggggccagagggaaggtttcagcccatatcccattctcagcttttggcttcctaggggaggtagcagtggtcacagtgcgccccttttgaggggcttatctatctccgaggacacatagaagctgtctaaactaaacttagtagtggctgggggagatggtggaccttaatactgggtactacatctcccaggcgctttatcactggagcctgtttggcgcatgcgcttggcggtatggcactgtctggaagttacttcctgctgctgtgctcccattgggcccgcctacacagtcatccgcatctgttgattcacgtgctcagcacccaggtctcttactggtcggtagagcttccgggacgcccccttttttgaaagagtcaactgattagttggtgatggggagaggcgggccttgggaaccgtctcctggttggggggtgggggggaaagatggcggagctgatgctgctcagcgagattgctgacccgacgcgtttcttcaccgacaacctgcttagcccggaggactggggtctgcagagtgaggcaccggggaggggagagggctgtggcaaactgtccctgaggcacgcgggaaagaagcgggggcctaaagaggaagtctgggcaaatacggaatccgccatctgaaggagagcggagcagggggctcgttgtgcattaagggggatacaaaagtcagggaagaactctgctccctgctggaacgtcgagttgttccggggtcggggaaggaggggctgaagcgccctggttgtatcacttttcaagtgggcgggcggtgggtctggccgagcggagccaatgagggatggggcgggggcttgtgtgcgatctgtaggctggggccaccgaacgaccccccgacgctcagcatttcttgcagacagcaccttgtattctggcctagatgaagtggccgaggagcagacgcagctcttccgttgcccggagcaggatgtcccggtattgtgtccccagcctttctctaacccttggtgggtggaaagtgagcccagaacctggacccattcacaggccataactcatctggagtcacccctactttctcatcctttctcacactcctgccctcttgtatcctcccttatttagtttgacggcagctccctggacgtggggatggatgtcagcccctctgagcccccatgggaactcctgccgatcttcccaggtaaggtagtctttgtcgttccctcagatttccagaaaccctcatcttcccactgtttcccagaaactacgtagcttcctatatcctcacgcttctacataagtgcctatcctctctccttcaatcccctatttttgtttcttctcccttgctgcggtacaggaatccccaccgacatgtccttgggtactttttggactcttcttaagctctgcttcctgataatttctaactccctttcctccagatcttcaggtgaagtctgagccatcttccccctgctcttcctcctccctcagctccgagtcatcgcgtctctccacagagccatccagcgaggtgagagagccatatccctcttactctctgtgacggggactctgcttcattcccttcacccgtgggtgacaaagaaatgatttaaatgatttgtgtgctatgagtcatgaggtgtgtgaggtgtggggggccttctccactacctttgccgtttccttaatatcttcattttccacatcccctttggttatctagcagtgaagatttttttgtttgtttgttttttgttttttgcttttttttgagatagggcctccctctgtcacccaaactacagtgtagtgacggggtcacagctcactgtagccttgacctcctgagctcaggtgatcctcctgcctcagcctcctgagtagttgggaccacagacacatgccaccatgtctggctaattttttttattgtttgtaaaaatggggtcttcctatgttgcccagagtggacttaaactcctgggctcaagtgatcctcccaccttggcatcccaaagtgcttggattacaggtataagccaccacgcctgatcttgggtctttttaatataaagagttatgtggggctgggaagaagagagttattgactgctgagaattctggaactgttcttgcccaagttgtccactctgaggccatatttgaagtcatgagacttcatcaattctcccagaaataaagtagaaagaatgaacaggttagaaagatggtcagtaccattcagaccagaatgtcaaataattgatggcttgtaagccctaaacttctaaagcttttgttctcgctcttactgtcaacatctcccttgttttttgcccttctttctgccccctgccccacaccaactctcacccaggctcttggggtaggggaggtgctccatgtgaagacagagtccttggcacccccactgtgtctcctgggagatgacccaacatcctcatttgaaaccgtccagatcaacgttatccccacctctgatgattcctcaggtaataaaacagcctgcccccaatccttggctctactacgggagaatgtgttatgtgtgtgtgtgtatgtgtgtagatggaggggaagtgcaggcagcaggacagggagaaaaaggtggggaggggaaatggcagaaaaccaggagggaaggcaggaaggagaggaaacatttcagggaaccacagcaagggcagtgctgaggagatggatattatttttctctctttttcttgttcctagtattctgtcatgccattcaacttactttttaaaaacttgtgagcagtttagggcatatgtatctgtgtgattcccctccacccaacattttattataaacatttttgttgttgttgagacagagtctcacactgtcgctcgggctgaagtgcagtggtgtggtctcagctcactgcaacctccacctcccaggttcaagtgattctcctgtctcagcctcccaagtagctgggattacaggcacccaccaccacgcccagctaattttttgtatttttagtagagatggggtttcaccatgttggccaggctggtcttgaactcctgacctcatgagtcgcctacctccgcctcccaaagtgctgagattacaggcgtgagccatcgcgcccagcccataaacatttttaaacatacagaaaggctagaacaccatatactaaactagattctacaattaacattatttgttctatttttaaagtgttcccaagtttatttactcgtagctgtgtatttagtaaatgtttattgatgtgatcatatctgaggtataataattataaaaaagaaatatttattaagcacctactccatgccagatactgagcagcatgctgggaatgcaaagatgaacaagacctgaccaccatgctgactttcaaaccctgtgatttggtaatgggagaaagacaagtaccagtcaatacaggtgtggtcattctaggatagaaatcactagaggtggggctgggtgtggtggctcatgcttgtaatcccagcactttgggaggccgaggtgggcggatcacgaggtcaggagattgagaccatcctggctaagatggtgaaaccccgtgtctactaaaaatacaaaaaattagcctgtagtcccagctacttgggaggctgaggcaggagaatggcatgaacccgggaggcggagcttgcagtgagccgagatcacgccactgcactccatcctgggcaaaagagcaagactccgtctggaaaaaaaaaaaaaatcactagagggtaccatgaaagctcataagaggggacatttcatccacattggcgctgaatctgggatgtgcccctggaagaagggtttcctgagagttttaaaggacacgtagaaattagccaggaggacagtgtgggggttgacttgtgtctgaggaccctgcatttcttcagagtggatgtaagaaggatttggggagtgatgtggaactgcaggggctacagggccaggtggggcccctgctaaggggctcttagcttttatcctgtggataggtgggggcctttggagaattaagcagggaagtaatatgattaggaagatgattctagtggcaaagtagagaatgggttgcagaggggcagggccagaggcaagagaaccaaggaagaagcttatgcagttgatcaagtaagatattcggatgtcatgaagaaagcagacttgagaaagaatgaagtggaatagatgagttgtgacctcctggacattggagagaggtaggagtcaaagaggtttgtggctaggatggctgtgggtgggtgatgttactgttcactggatggagactgcaaaagcaggggctttctggtcagggaagatgatgaattcagcgttggacatgttgattctgttgttgttgttgttatggagcttcactcttgttgcccaggctggagtgcaatagtggtgtgatcttggctcactgtaatctctgcctcctgggttcaagcgattctcctgcctcagcctcctgagtagctgggattacaggcatgctccaccacgcctggctaattttgtatttttagtagagacagggcttctttcatgttaggctggtcttgaattcccgacctcaggtgatccacccactttggctcccaaagtgctgggattacaggcgtaagccaccatgcccagttgacatgttgattgttgatttcaaagtaccttctggatctcctggcaccatctctcactggctgaactccaaccagggagcccgctgatgcagtccattcagattctccctggatctcagggagcacagcagggagggatggaaagtggatttggagggacaaacagattatatctagcagattaatacatgttataaaaaagatacacaaaataaggattgaaataccattagcaggccaggcacagtggttcacacctgtaatcccagcactttgggaggccaaggcgggcagatcacgaggtcaggagatcaagaccattcgggctaacacagtgaagcgccatctctactaaaaatacaaaaaattagccaggcatggtggcaggcacctgtagtctcagctactcgggaggctgaggcaggagaatggggtgaacccgggaggcggagcttgcagtgagccgagatcgcccactgctattagcagcaaaaggattgtaaggattgttggtggctttgcattgcatagtgttattagagtcagattctcctccatacttaggtattttttgagggcctgtactttaccctcaatggacatgagacatagttcttgcttttggagagttttgtgagggttataatacatcatggttaaatagttccctttttttttttttttttttttttttgagacagagttttgccctgtcacccaggctagagtgcattggcgtgatctccactcactgcaacctccgtttcctgggtttaagctattgtcctgcctcagcccccctaatagctaggactacaggcacgtgccaccatgtccggctatttttttgtatttttggtagagacagggttttgccatgttgttcaggctggtgtcaaactcctggcttcaagcaatccacctgcgttgggtgtcggcctcccaaagtgctgggattacaggcgtgagccaccatgcccagccatggttaaatagttctgatagtggttatctctgtgtagggaatctgagtgactggaggaccgggaagggaagttttttttttttttttttttgagacagagtctcgctctacccaggctggagtgcagtggcgcaatctcggctcactgcaagctccgccccctgggttcatgccattctcctccctcagtctcccaagttgctgggactacaggcgtccgccaccacgcctggctaatttttctatttttttagtagagacggggtttcaccgtgttagccaggatggtctcgatctcctgacctcgtgatccacctgcctcggcctcccaaagtgctgggattacaggcgtgagccaccgtgccccgccaagattttttttttgacttaattttcctttgttcgtttggatttgtatcatgactgtattatctattcaaaaatataaattgaagttttaaaaagcaatcttagtgatcatataattaagtaccaaagtgaacggtatggaccagaggtagtggtggactgttgacctgtgggctgaatctggccctcagaagggttttatttcaccgacatggggcctagcattttctttcatggagtgatcaacaagtcataaaggcagatttattggaggccatggaggctcagaggtgactgaggctttgctgtttggtgcctgggaggaaaacttgtgtgacggggcaatcaggaagcctcatttatggccagttagatttgggtgactggtgaggcatgagaatggaagggaccagcaggcagcttggaagtcagaatctggtgcaggtgagcagccagggggagatgcacacttggcggttgtcagcatggagatgcattgggcagggataaggtggaaatccagcaagataggaatttgggccatgtgaatgctggagacccccctgccacttcccctgctcaggcctattctatgtgaatagacaagttctgtgaacaagaaagagggaaacgcagaagggcaaagacagctttgaggaacatggagcagggatgagaaaaatcagaggagccactaaaggagaaagggaagcactaggcgaaaagcggggcggagagccagcaggtgagcagctctgtgactgcccctcctggatggcctgtaatctagggccagaagagttttattttcaggttcaaagagaaaggacccatttccccatcttaaccctcttttttatttttttgagatggagttttgctcttcttgcccaggctggagtgcaatggcgcgatcttggctcactgcaacctttgcctcccaggttcaagcgattctcctgcctcagcctcctgagtatctgggacacagggatgcgccaccatgcccgactaattttgtatttttagtagagacggggtttctccatgttggtcaggctggtcttgaactcctgacctcaggtgatctgcccgccttggcctcccaaagtgctgagattacaggcgtgagccaccatgcccagcctcccatcttaaccctcttaacccttcagtgtttacatgatatccagcttttgcctcatcctgcctcccacagatgtccagaccaagatagaacctgtctctccatgttcttccgtcaactctgaggcctccctgctctcagccgactcctccagccaggtgagcaccaccttccttccttcctccaggttttccagtgagttcctcctgacctagaggtatgagagctttcccttcttcagctccttctcctcgacactcttcctgactaatgtatctctggaatgccccacataggcttttataggagaggaggtcctggaagtgaagacagagtccctgtccccttcaggatgcctcctgtgggatgtcccagccccctcacttggagctgtccagatcagcatgggcccatcccttgatggctcctcaggtaatggagtctcctgacacttggaatccctagtgagaggcctttggtcctgacatttcttgttcttttctctcaccttccttcaggcaaagccctgcccacccggaagccgccactgcagcccaaacctgtagtgctaaccactgtcccaatgccatccagagctgtgcctcccagcaccacagtccttctgcagtccctcgtccagccacccccaggtactgaagaaggagaaaagggccgggcatggtggctcacgccggtaatcccagcactttgggaggctgaggcgggcgaatcacctgaggtcagaagtttaagaccagcctggccaacgtggtgaaaccttgtctctactaaaaatacaaaaattagcgtggagtggtggcaggcgcctgtaatcccagctcctcgggaggctgaggcaggagaatcacttgaacccaggaggcggaggttgcagtgagccgagatcatgccactgcactccagcctgggcgacaaagcgagactttgtctcaaaaaaaaaaaaaagaaaaaagaaaaaccaaaaaataaaaataaaaattaattaattaattaaaaaaaaaaggccaggcacagtggctcacgcctgtaatcccagcactttggcaggccaaggcaggcggatcacaaggtcaggagatcgagaccatcctgactaacacagtgaaaccccgtctctactaaaaatacaaaaaaattagccaggcgtggtggcgtgcgtctgtagttccagctgctggggaggctgaggcaggagaatggcgtgaacccgggaggcggagcttgcagtgagccgagatcgcaccactgcactccagcctggtcgacagagcaagactgcatctcaaaaaagaaaaaaaggagaaaaggaggcgggctgcattgaccctgtcagagagcttgcagccattgaggctgcccaatccttgggtgctcttgtgtgggtgtggacacaaggaccccacccagcgcacagccctctgacctctgctcacttgccccagtgtccccagttgtcctcatccagggtgctattcgagtccagcctgaagggccggctccctctctaccacggcctgagaggaagagcatcgttcccgctcctatgcctggaaactcctgcccgcctgaagtggatgtaagtgttggggaggagagaagtagggcgagtgatgggaagggaagagggaagtcttgccatagagagaactgtgggatgaggagggagtcgatacctaggagaaaaaagtgaggaaacggacccattagatcattctgagggtcagaatggactcctgtttctatatgaatatcaactccaggtagttttagggtcctttaggtttgctgtcactgcagatggagaaatggggttggtctccataaattaaaggcaaggaagtcgtactgtactatacgactacggtcatggccatagttggggagggaggctgcctcctaggggaaaatcaggtaaactgtataagcagtataacaaggttaaactttgaaccctacaaatgtgggctgacaggaagaaagagttacgaaggaaagagtttccaccagcatggagaaagttcttcccacactctaacctttcccacctctgaggagcagtagcagggaatgtttgaaagaagggccccttccctagcgtgtttgagtagagaggaaaaacctctctggctatgtaggtgggtcaggaaggcaggggaatggccatgtgagctttgggtaaatcattccttggggtttgagagcatagtctccttctgccaactcatctgtcattcttttttgaccttccgggtgcctaggcaaagctgctgaagcggcagcagcgaatgatcaagaaccgggagtcagcctgccagtcccggagaaagaagaaagagtatctgcagggactggaggctcggctgcaagcagtactggctgacaaccagcagctccgccgagagaatgctgccctccggcggcggctggaggccctgctggctgaagtaagaccagtctgtccctgggagaccaacaggaatacagcctccttggaatgattcccctttttcttgtctccttctttgtaccttagaacagcgagctcaagttagggtctggaaacaggaaggtggtctgcatcatggtcttccttctcttcattgccttcaactttggacctgtcaggtgagaccttccttgcttcactagaaccttccaggtggagcccacgttacagcctcctagctgcctgctttggcccaggccatttccttctgcttatatacaaatggttctggtgtccttggcaccgatgatgtgtctggccagccccttcctgctccattatttgtctttttttcttggagatggagccttgttctgttgcccaggctggagtgcagtggcacgatctcggctcactgcaacctctgcttcctgggttcaagtgattctcctgcctcaacctcccaagtagctgggactacaggcgcacgccaccatgcccggctaattttttgtattttttagtagagacagggtttcactgttgttgcccaggctggtctcgaactcctgagctcaggcagtctgcccacctcagcctcccaaagtgctaggattacaggcttgagccacctcgcccggcctcctgctccattatttttccagtggagagtagatgatggtgataatgctggtagaaatagtgactattaagtgcttactgagttctaggctctaggtgatgcactgtcttttttgtatgtagggaccatccttattcccatcttacagaggcagactcaggcttgtataacagattgcaactcaagcagtccatctgcagagtctttattcttacctagatacttgatacagctgaaattcttcattgtgctcagtccttctttatccacagcatcagtgagcctccttcagctcccatctctcctcggatgaacaagggggagcctcaaccccggagacacttgctggggttctcagagcaagagccagttcagggagttgaacctctccaggggtcctcccagggccctaaggagccccagcccagccccacagaccagcccagtttcaggtgaggagagagagagagggccccctctcgtttgagggtatgagttggtcttctccccgctttcagtgagggggacccaaagctttctcttgccgtcatcgccttctttgttgtgggagtgctgggcagtctccaagtgttgtctccttcctgcttcactccagcaacctgacagccttccctgggggcgccaaggagctactactaagagacctagaccagctcttcctctcctctgattgccggcacttcaaccgcactgagtccctgaggtgtgggattcattgctggggcatccagctcccccggcctcccaaggccttctgcagtcagcctggctggcctgtgtactaaagcgccagtgctccctgccctctcctcactcctgtgggtgggcaaggagggtgggaatcttggcctggcatggaggtcctgagctcctccatttccccaggcttgctgacgagttgagtggctgggtccagcgccaccagagaggccggaggaagatccctcagagggcccaggagagacaggtagggcgggtggctggttcaaggaaggccacttgaagacaagggctaaaggccttgtctggggatttctagtgggcatctcgctgtggaagtttgagggatcgtttgaaggaagtggagggttgagtgggaggtggcatcagcttccaggggctgtttgtctctttcccttttcccttcaccctctccaagtccttagatacttctccttccagaagtctcagccacggaagaagtcacctccagttaaggcagtccccatccaaccccctggacccccagaaaggtgagtgtggggtggggtgcttacttattaagtgaaattccactttcaagagctgtacccccagtagctgtcctgtgcctgtcattactgtcaccagtgggattatacctccctcctccactgggggtctcctgtctttttctctcatcctacccgcttccctggtagaaactgagcattgggcttagttcccctcaaatcctgtttccccacctgcctagggattctgtgggccagctgcaactatatcgccacccagaccgttcgcagccagcattcttggatgcaattgaccgacgggaagacacattttatgttgtctctttccgaagggtgagtttctcctgcccttccatctctgtcaccccaggttcccagcagtctgtcttcagtggggggatgtagagtagggctggggagcttgttggcatctttgcctccacccttctggcctggcccatctgttccccaggaccacctgctgctcccagccatcagccacaacaagacctcccggcccaagatgtccctggtgatgcctgccatggcccccaatggtaactctttccctgctgggtatgggggcagttccaacagggagatccagcctgggagctgagggggaagggggagaggagcagggcatccagagagctgctggacccacaggtgagaagcagcaggaagtaggtggagggaagagcaccatgcaggagacttgggagggagacaagggtgagggtccttccctggtgaaggtgcttgggtagatgactgggcagaggcggggggccgggaacctgctagactctcacttacttttttctcttgatgtcctctcctgtgtgaccccacactcaatgcccttttcttttcctaccctctccttgcccctgcaccaaactctgtccctgccatcctgtttaactcccgctatggatctgcctcctcactattgccctttctttttctctctgctcacctctacttttctgacctcctcccctcctccctgcaatccctgtttgcctccccatctcctcttccttaactctccccttctcacagagaccctgtcaggccgtggggccccgggggactatgaggagatgatgcagatcgagtgtgaggtcatggacaccagggtgattcacatcaagacctccacagtgcccccctcgctccgaaaacagccatccccaaccccaggcaatgccacaggtggccccttgccagtctctgcagccagccaggcccaccaggcctcccaccagcccctctacctcaatcatccctgacctctgccattcacactgacttagaacggggggagggggtaccaggtggccaggtgggactgtttcaaatttccctgatccccaggcttggggcaattggtaaaggaaagagcaggtgtgggggttaagcacttatttgaggtgggggtgttcacctctcttctcatcccttttcagaatatagggctcctctcattcctgtgaacccccagtcccggcttctttgtttgaggggattgtgtgaggttcagttgtggggtgggtggtgagctgctgcatattttttattttgtttctctagtgttatggcagtggaggtgggaatttagtccccaggtgggacaagggaagttttttcattttggagctagttactgggagtaagggagggtggggtgggggggagttcaggtttatgtgtgtgcatttcttttttattattattaaataaacaacttggagggagttgaaggaatggtggctgccttcctggctcgtgatggggagtttgggggaaagtggcttttccagagccagcatcaaagaatcaagcactgaagacatagctggctctgaggtggggtgggtgcgggatcacagaccgcatgtcatccccttgcccccacccctgcaactctggggtatatctgtgtctagcaacgatgtctcatggcgtgacagactagaggatacgcatccctggaatgtgagtcaacaggaaagatggggccccacgcccttcagggtgagcagcctctgggtctcctgctctcgagcaggttctccccctcttcttgctgtccaggatgagcagctcaaacaaacaacaagagctggggccagaggctcagagcccaggaagtgggggtctcggtgaagaaggggtgatatttggaagggaagggggatgtggcaggatatcctctaagccctaaactggaggggactgagacttgagagtccagatgaaagacaaagacaagagtggggcaggcagaaaaagctgtacattcttatgtttttaattttttttttttttttgagacggagtcttgctctctcacccaggctggagtgcagtggcgcgatcttggctcactgcaacctccgcctcttgggttcaagtgattcttctgcctcagcctctcaagtagctgggactacaggtgcacgccaccacacccggctaatttttgtatttttaatagagatagggtttcaccatattggccaggctgcccacttcggcctcccaaagtgctgggattacaggtgtgagccaccatgcctggctaggctgtgcattctaattaggaggaaggggagcaggacaaagtgagggattgagtctgaggccaacctggaagaatccccctccagctgctcctgttcagcagtgcctcaggcctgaccctgcaggagtgtcctgggtcagctggagggtgtgagctgggcctgggctcaatgcccagatgactggacaggggctgcctgggccataagcccaggcctgaaggagggaggaagaacctcatgtgtccagccaggcaacccccacacccctcccactgccctcacccattactgtgtttggggtgaaaacagaccaagtaactatggcaacctggaaccagggatcccaggaactagacctttcctccctccagagggcagcccagcttctcagctatgctttctatcccagagtccttgagccttatccaccgtatctctggagggggtgcagtgagaacaaggattttggaagcacatcacctaagctggattccctaccctgcctttcgttagtagatgtccttaaacattctgagccttagtttgcttatctgtaagatgggatgttcctacctcctaatcagggttgatgacaggatgaaagacgacgtcctcagtgcctggtccataatagatacaccttttcctcatcccttgcccctttctgtccccatctctgttgtccttctctcttccacttttatcccatttgggttcattactgtttcgttgtcccattgtcttcctccttcctgcccccagttcgggaaagtacttgaagtgctggcatctcaggggtcaccctggggtgggacatcctgctcctctgctgattggcaagggacagctggcactttggtgtggatgagacatcagacctctcttggctgagggattgtggtggcaggaaggattgagaaggacggtgagtgggtacctgatgcagggtgaaagccgggcaggctctgggctgctgccttctaggcccatgtggatctccattcctctggccacacccccaaggccactcagcatgccaggtcgctgtcactcctgcacctcattggcccctcctgccctatgcccactttgtctttctgttctgctttccttgtgccaccatctccttcatttcttcctcaggatcccaccttttgttctctctcatccctga

SEQ ID NO: 16894 - DNA, 14160 bp, Human
tcccaatgatgccatccctgcaaaacctggctgtacctccttcaccctctcaacctacccccctgaccatgttgttggcaaggggcagaggctgccactggaaagaggaaaggaagagaaagggggagacagaaagaggagggggactgggggagtgttgagagctggagagaaggggaatgaaatagaaccacagctgaggaggggtaagggagggggttggggcaagggggacggagagtctggagacagtggagggggtgggaggttttgttattgtttttacctgacttttcggatgacatgcctgcggtctcgctgggacagggtccctgcagccggagtgggggtcctcggccggtgctggagtctgggtgctggatggcgcagcggcagcagcgcagagatggagagatgaaggcagcggcggggggggggggcggggggggcgggcggagggagagcggggagggggggagcttaaagggaccgaggcgagggagggggagcgcttcagatgtttcccactcggtctctctctgctctcggaccacctctctcctcctcttaccccggcattcaagcccccagtttgggctcctttggagttgtcatggaaacacggaggctagaccaggcgaggcgggtgggactaaggaaaggaaggaaggagaactctctggagtctcccccaccaagactcagtgattgtattgtgggaggaagtgaacaggttctcagtggagttaataacccaggtgcctccagaggcaggtcgtctccccctcttagctccctgcaaggtgccagggtcttctcccaaatccttggccccagtttcctcctctttagaagagataaatacttgtgtgtgagagagaattgtgcagagttcagaactgcgatggtctgaaaagttcccagggtttggtgaacctaccaacctagcagtaaagagggaggcccaggtctgtaaatcagggggagctgggccttggagggaaaagggagagagagtttgggcggtgtgcatacataccttcttcgtccaggactaaggagctgaagctcttttggagggggtagggggtatgacttaactgctcatttctggcagctctgttggtaatgtgtgcttgttcccccactttccctttgcttttgaggctgcttagagtctctgggctggtcaatgttcagatccattccctaaacccccctactcccacccaccacctcccaccaagacgcatctccagctcctgagtcgacctgcagtacagcgttattagtctttttatttgcttattgcatcttgggagcgcgtgggtgggtgaagggagcgaggataggaagtctatggagatttacaccagtttttttttttttttaaacaaaaacacagccagataatcattattcttcccttacgtccccccagcccccacctggggcagtcgctctcccggctgcgtcccttttcgtccatgtcctagcagagactacagagcagtacagaggctctcgctgaaaccagtcccaggctccacagagtcagatcacggcttcacaccagtcgttctggtcacttaggcgttcgcgtgagcgctcaaccccttaccgccacctcatcgtcactctacaccattctgagcgcaaaaatgttttgattgagacaaatttagaccaagcaatgaccttgtaaacagagagaggggctcagacatgctgagaaatccttatctctagagaaacgtctttaaatgctaagtaaaagccctagcaagtaaaagccctgaggcactagggtgtcggttaggggtcacaggcggagaggtggggcgcctgggggtttcggtagggagccacccacagataactcagacagccagattctgggggtcgttcaggttgaaagactggtcgaaattacgcgggcatgagtcagcgcatccctacgcgccctccgccccttgagggtgggtcgcttatagggaggggagtagagtagggcaggagaaactgggccaggctgcacttagctcaaggggcctcgaggactctctgcgtctctggagacaagggcactacacgcacttcagaatgaagagttgtaagtcgctgacctggggcggactggagggtggggtggggtgggtgttgaggggcacgcccgggctggcatcagccctccaggccaccctgccactcacccagcacacggcaaaatgcagaggactacctttccctggtccgccccctggccgccccttggggaatgcaaacttcgtgttctgctgcggagccagacgcctgtattgggaagtggggagaatcaaggcggggaaatcggacttttgggtcgctgggggcaacgaagcctggagaggccttctttccattcccagaatatgtttgctgctttttcctctccccactggcctaaatggatcgctccgcctgtttcctccccagcacctagggcgcaatggaatattccattgcccctcctgtcctgggtctgtgttgcggggaacgctcgcgcggttgccagagaaagccccggacgtgacggatttgcgcgaccccaagcagcccgcccttccccctcccatccgtcattcccctgcgctctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggtgcgtcaacgtggtgggggggtgtgtttgtagggagagggctggagtaagttaaaagtaggctattttgtgacacggacctggtgtgggagcgagaggaggtggcttgattgccgggcgtctgttccgagggaggagggtgttgccatctccctcacatgcccttatcacccctttctcaggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgaggtctggcaggggacacctgggtgcagggcgttagaggcgtctactgtggcaggggagggagagcggggaactgaaagccacccctctgggcctgcccagttcctcagggagctggtgctggcgtgggggagagttgggggacgggatccctggttctagcagggtacaatagacctgtggacgcgggccagggggtggcgtgtgggagcttcttagcctatccccggtggctgcattgcccccttcccacagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcagggtaggcgactcccctgcccctaactcctaagccctatctgaggcttgatccttatctgagggacacttcctagcgtccctttttctgaaccacattgctccaggcacaaccctggtacctgagcccttcctttctgacttccctcagcacctgggtctcatctctgtcttgaatgggagggaggctccctacactgctgcccttttgcttcctgttacccatggttcttggacataagggctaatggggcaggtaaaaacatcctagaactagaggcaggaggcccagcatctaattcgggctcagtcacttatatgatgtgtgaccttttggcacagggtgtgcctgccttctgtaagcctcagtctcctttgtgtacagtgtgtgtctgtgtgtgtctctgtgtgtgtgtgtgtgtgtgtgtgtgtgtgtgtgtgtggtgggggtggggggtgctgctggctttgctgtccttaagtgcctgcccaatgtggtgttctgcttacagggggccttgtgtgccgggctctgctttctgtcatggatgatcacaacgtggattctttcatctccctctcctctccacagatgggacagtatggaggtgagtgggcactagactccatagaatgccctgagttttgggggaacagaggtttatggtcacttagcattgccattcgcttgccagacacggactacttgaagtggctgttccccacctccatgcggtctaacctctatcggatctgctatagcccctggggccaggaattctccatctgcaactactggcatggtgagtggggatgctgaactggggcttccatggatcaggtcagttgcttccacctctgctacaaccaatagcagtgatgacaataaagataacttacatttattgagttatttgaacaggctctgttcagaattttttttttttttgagacggagtcttgttctgttgcccaggctggagtgcagtgcaccatctcggctcactgcaacctccgcctcccaggttcaagtgatcctcctgcctcagtccccctagtagctgggattacaggcaggcgccatcatgcccggctaagttttgtattttaagtagagatggagtttcgccatgttggccaggctggtctcgaactcctgacctcaggtgatccactcgcctcggcctcccaaagtgctgggattacaggtgtgaaccattgcacctggcccagaatgttttaagtgtgtcaccttattgccttagaaggtttagtctgatgtgggagtcagcaaaccttgtctataaagggccagagagtaaatatttttgactttgtaggacatatagtctgtttcacaactcctcaattctgctgttgtagtgtgaaagcagccatgtaccatatgtgaatgaatgtgcctgtgttccagtaaaacttcatttacaaaaacaagtagcaggctggatttggtcctttggtcacagtttgccaacctctagaccagaccatggggccagaatacttgggtttgaatcttgaccctattgggtgcctttgggcaagttacttaaccattctgttactcagttttccttatctgtaaaatattatagcatgtacttcaccaggtggttgtaaggattaaataaataaatgaatgcaatgtactttgaatagtacctggctcatatagtagatactagatagaagtacttgctattgccaggtgtggtggctcacacctgtaatcccaatatcttggcagggggaggtgggcgcatcacctgaggtcgggttcgagaccagcctggccaacatggtgaaaccccatctctactaaaaatacaaaaaaaatttagctgaatgtgggcacacgcttgtaatcccagctactcaggatgctgagtcaggagaattgcttgaacccgggaggcagatgttgcagtgagcggagatcctgccactgcacttcagcctgggtgacggagtgagatttcatctaaaaaaaaaaaagtacttgttactatgtttacggttgttatcactactattattattttgagatggagtctcactgtgtctcccaggatggagtgcagtggtgcagtctcggctcactgtaacctccacctcctgggttcaagtgattccagcgccccgagtaactgggattacaggcatgcaccaccacgcctggctaacttttgtatttttagtagagacagggtttcgccatgttagccaggctggtctcaaactcccgacttcaagtgatccacctgcctctacctcccaaagtgctgggattacaggtgtgagccaccgcacctggcctacattatcactactattttattactatccaccttgactattgctgcagcttccttattgggcttttcaccaccagtcttgcctcccttttctgcttctttttctaactgctgtttgtacccagatccccaccacgatgacttgtacctcaatgccagcagcttcctggccctgatcaatggggaaagagaccatcccaatgccacaggtgagaattcaggctcctacctgtgttgctttttctgcttctttgactccctatgtctccctctccaacctggcctgacccctgtggctgactcagcctctcttcttcccatcctacagtatggcggaagaactttctgcgtgtgggccacctggtgctgattgggggccctgatgatggtgttattactccctggcagtccaggtaataagggattttgtggcctgaagattggctaaagacatcccccaaccccagttggtctttatctcatgcctaaactggcctgctccttccactgttcagttagtgctcctccccccattcatcatgtcacccaagaccaaaacctgggagtcatatcccaaccccttgtatcaagccagtcactaagtcctgctgactcttctcctctccatccctatcaccccctcccccactttataaaaacttttaattttgaaattcttatagattcataggaaattgcaaagatagtatagcgaggcccttcacccagcttcccccagtggttgcatcctatgtaattatagcacagtatcaaaaccaggaaattcacattggttcaatgtgtgtgtgtagttttataccattttatcacatttcctaccacctctttacttacctggactattataacagcctccagctttgtcccctccatcctattccttagaaaaaaatccatggctccatggtactatgtgcttgcctgtgttataggtcaccatgtgtgatctgtaatgtcacctgagctacttgaattgctcaacaaatatttattcaacattatgggcgcaggcttgttctgggccctagggatgcagtggtaaataaaagagaagtccctaatgttatgtagcttatattctagtttgtaagatagctgatacatacatacaaatatatatgtcaggtaataaggcaggggaaaggattagaggatgtccggggcctagtttcaatagtggccgaagaagtcctcctggaaaagtcaccattcaattagagactgaaggaagtgaaggagggagttgtgctctgggtggaagaaccccccagggagaaggtctggcacctgcagaggccctgaagcacgtgtgagcaataaggaggccagcatggctagtgcacaaggagctggggagaggacaggagaggagctaaaagtggtagcaggggaccaggcatgtcaaaccttagcaggtcaaggtaaggcccttgatatttttttttcttttttttgtgataaaatatacataacataaaattgccattttaaccatttaaaaatgtacagttttgtggcattaagtatactcacatcattgtaaaaccatcacccatcagcaccatccatctccagaacttctttttccccaaactgaaaccgtatacccattaaaaaatagactgggtgtggtggctcacgcctgtaatcccagcactttgggaggccgaggcagtggatcacctgaggtcgggagttcgagactagcccgaccaacatggagaaaccctgtctgtactaaaaatacaaaactagctgggtgtggtgatgcatgcatgtaatcccagctacttgggaggctgaggcaggagaatcgcttgaacctgggaggcagaggttgcagtgagctgagattgcgccattgcactccagcctgggcaacaagagcgaaactccatctcaaaaaaaaaaaaaaaaaaaaaatatatatatatatatatatatcctcatccctatttcccgacagtcccggtaaccaggcttttgatttttttttttaaattctgagtgagatgggaaggcactggacagttttcagtgaaggcaggacatctcttaaaatattgtaataatataatagtaagtgatgagttttatgtacatcatgtcatttcacatctaccacaaccctatgaatgacagtgatagctcatggttatataacatttttaatgttccaagtcactgtttcttccttttttttttttttgagacagagttttgttcttgtcgcccaggctagagtgtaatagcacaatctcggctcactgcaacctccgcctcctgggttcaagccattctcctgcctcacctcccaagtggctgggactacaggtgcccaccaccatgcctggctaatttttagtatttctggtagagacggggtttcactgtgttagccaggatggtctcgatctcctgaccttgtgatccgcctgcttcggcctcccaaagtgttgggattacaggcgtgagccactgcgcctggccaatatatatctctctctatatatagatagatatatattttttgagttggagtcttcgctcggtcgcccaggctggagtgcagtggcgtgatctcggctcactgcaagctctgcctcccaggttcacgccattctcctgcctcagcctcctgagtcgctgggactacaggcacccgccaccacgcccggctaatttttttgtatttttagtagagacggggtttcactgtgttagccaggatggtttcgatctcctgacctcgtgatccacccgcctcggcctcccaaagtgctaggattataggcgtgagcccacgcacccggccttgcctggccaatattttttaattaaaagattttaactccatctggctgggtgcggtggctcacgcctataatcccagcactttgggaagccgaggcgggtggatcacctgaggtcaggagttcgagaacagctggctaacattgagaaaccccatctctactaaaaatacaaaaattagtgggcctggtggcgcacgcctgtagttccagctactcaggaggctgaggcaggagaacttgaaaccaggaggcggaggttgcaatgagccgacagggtgccactgcactccagcctgggtgacagagcaaggctctgtctcaaaaaaaaaagaaaaaaaggattttaagacctttctattttgaaataatttcatacttaagaaaagtttgcgcctgtaatcctagcactttgggaggccgaggcatgagcccaggggtttgagaccagcctgggcaacatggcaaaaccctgtctttacctaaaatacaaaaattagctgggcgtggtggtgtgcccttgtagtcccagctacttgggaggctgaggtacgagaattgcttgagcctaggaggccaaggctgcagtgagccgagatctcaccattgcactcctgcctgggtgacagagtaagaccctgtctcaaaaaaaaaaaaaaaagttaccaaaatagcaaaaagcagtcatttatactcctcacctagatttcgcaaatgttaacattttgtcatgtttacattaatatcttttttctctaaatatatatacatttatttatatacgttaatgttatatttaaatataaacatagattcaaattttcctgaatatgcgctcacagattattcaaatttttccaactgtccttacagaaaaaaatatacagtggaagatccaaatcaggatcttgagttgcatgatcttgttacgtctctttagtatctttttgtttgtttgtttgtttgagttggagtttcactcttgttgcccaggctggagtgcaatggcaaatctcggcccactgcaacctccgcctgccaggttcaagtgattctcctgtcttagcctcctgagtagctgggattataggcgcccaccaccatgcccaactaattttgtatttttagtagagacggggtttctccatgttggccaggctggtcttgaactcctgacctcaggtgatccaccctccttggtctcccaaagtgctgggattacaggcatgagccaccacacctggcctcttttttttttttttttgagacaaagtctcactctgtcgccaggctggagtgcagtggcgccatcccggctcactgcaacctttgcgtcccagaatcaagcaattctcctgcctctgcctcctgagtagctgggattacaggcgcccaccacgcccagctaattttgtatttttagtagagacagggtttctccgtgttggccaggctggtctcgaattcctgacctcagatgatccaccctcctcggcctcccaaagtgctgggattacaggcttgagccaccacgcccagctaattttgtatttttagtagagatggggtttcaccacgttggccaggctggtcttgaactcccgacctcaggtgatccgccggccttggcctcccaaagtgctgggattacaggtgtgagccacctcgcccggccagtaatgcatttttgatggggtttctacagaagtgaggtcgtatcttcagtgtatcacctcatgaagtacattatatccagtaaggtagttttgagtgtcctccctgctacctgtctccccagtaggccttgggttcctttgggaccttagcccaccttgatttcttcctttcttttttccttttcttttttctttcctttttcctttcctttcctttttgagatggggtcccgctctgtcacccaggctgaagtgcagtggtgcgatctcgactcaatgcaacctccacctcccgggttcaagtaattatcctgcctcagcctcttgggtagctgggcttgcaggcatctgccaccatgcccagctaatttttgtatttttagtagagatggggtttcaccattttggtcaggctggtcttgaactcctggcctcaggtgatttgccctccttggcctcccaaagtgctgcaattacaggcgtgtgccactgcgcccggccagattttctccagctcttctgataacctccccccaaatctctttgtagcttctttggtttctatgatgcaaatgagaccgtcctggagatggaggagcaactggtgagccccctgggattacttccccttctagccgctgtcccaccttattccagagccctctctgtgactcctgagctgaagggttcaccctgtggggaggaggtccaggatcccagcagtaactcactttgtctctccttgtgtctctcttccatgcttccacgccccttcgaccaccttgaaggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtgtgacttggctcatttccaggtggaggggacctggctccccaaggagggtgggggcggagcctgaggcctgggtgcccagatgcctggtctagggtggggacccccttggtgtttccgctctctctcaatgcccattctttgtgggttcctggttctctgcgggttctttcctgctgaagacaattctcttcctctcccagtccccaagactggggggttaagctcagggctccagtggtttgggcctcagcctcatgggtggaatgcgcctgccacccccaggctagacgagggggcagagggtcagggtgggcattcgttgtgccgcttttgagctttgtgggccagagctgggtgtagggctggacaatgagcctcctcttccttgaaagaaggaattttggctgagacaatagggccctgtctgttctggcatggggggtggtggctgactcaattctgttccccctaagccctaacaaatgtcatgaagagaggggggcagttttccccttggtgccctgggctgcccccctgcccctttgtgacgacttgcccttctagctttcctcagctgatcttgctttttctcccataacctgaactgctttgttccctgcagctggttctctccctgccccctaactctcccctagtctgttttgggttcaagggggtactggtggtgttacagagctcatagcttctgatctggggagtccagaaataggggcctcagagggttggaaagatacttctagggagccctttgctggggtggggatgagggtagtgggacttgaccctactgagctgaccctgctggagctaaggaggaggcttgtgggagggggcaggaatgggaggactctctggcccagcccctcctctccttcttagcctgccaggcccacccaccagtctgagctgcttctgctgaggctggtctgcttgaagcctcccaggagaaagaagccaggtgggaatggagagagagaggaaggcaagtggggagagaatttcaaatggggaaagagtggggtttactcagagccttagggtgggcatgagttgcggggtgttttgttggagcaagggatgtgcatttagggcgttatgtgacggtgtgggtatatgaggggagtagcagtgtgtgaaaggtgtggagtttccaggtgcttggtttgtgtgtacggtgtgaaggtatatagctaggggttttttttgtttgtttgttttgtttgtttttttgagacggagtcttgctctgtcgcccaggctagagtgcagtggcatgatcttggttcactgcaacctctgcctccagggttcaagggattctcctgcctcagcttcccgagtagctgggattacaggcgtccaccactgcgcctggctaattttttgtattttttagtagagatggggtttcaccatcttggccaggctggtctcgaactcctgacctcatgatccacccacctcagcctcccaaagtgctgggattacaggtgtgagccaccgcgcccaaccagctagggttttgaaggtatgaagttataagagggcatgttaaagacaggagggttggccaggcatggtggctcacacctgtaatcccagcactttgggaggccaaggcaggcggatcacctgaagtcgggagttcgagaccagcctgaccaacatggagaaaccccgtctctactaaaaatacaaaacaaaattagccgggcgtggtggcaggcgcctgtagtcccagctactcgggaggctgaggcaggagaatggcatgaacccgggaggcggagcttgcagcaagccgagatcgcaccactgcactccagccagggtgacagcgagactccgtctcaaaaaacaacaacaaaaaaaaaaccaaaaaaaaaaaaccctagctatataccctcacaccctacaaaacaaaacaaaacaaaattagccaggcgtggtggcgcatgcctgtaatcccagctattt

SEQ ID NO: 16895 - DNA, 9129 bp, Human
agaccatgctgtaggtctctttctagcgatctaggagttaatgccacagtgtgttcaaagccctttgatgcgatcagataatcagtaatgtatggaatatttgtgttcataacttgtgagaacggctgcatggcaggacaagaccccagcacaacagtatggaaaatccaccctaagcagacatgtcatgactgatgttgaacaatggactcaccagccaggcacggtggctcatgcctgtaatcccagcactttgggaggcagaagcaggcagatcacgaggtcaggagatcaaaaccatcctggttaacatggtgcaaccccgtctctactgaaaatcaaaaaaaaaaaaaaaaaaaaaattggccgggcatggtggcgggtgcctgtagtcctagctactcgggaggctgaggcaggagaatggcgtgaacccaggaggcagagctttcagtgagccgagatcgtgccactgcactccagcctgggcgacagagcaagacttccgtctcgaaaacaaaacaacaacaaaaaaaacaatggattcaccatccgatgggctccctcactgccaggtcactcttcatggaagtatttgtattccagtcctttctgtggaaagaacttaacattctccttttcataacactgtatcttcagaaacaagagagtcgaagtctcctaattttcaggactgtctatgttgaacatcaaaatatattctttagagcagatctttaataatcatatgacaagagaaaaactttcataatcttatgacatgagggaaggaatattaaagccgttctgtgggttattatctctaacgttcccaatagaataggctttgccagctgggtgcggtggctcatgcctgtaatcccagcactttgcgaggccaaggcgggcaaatcacgaggtcaggagtctgagaccagcctgaccaacatggtgaaaccccgtctctactaaaaatacaaaaattagccgggcatggtggtgggcgcctgtaatcccagctactcaggaggctgaggcaggagaatcgcttgaacccgggaggcggagattacaatgagctgagatcacgccaccaactccagcttgggcgacagagcaagactctgtctaaaaaaaaaaaaaaaaaaaaaaaaaaaaaaaaaaaaaaaaaaataggctttgcccattatactctctcatattcattgacctgaatcctcaaatgaggtgtgtccattagtcaactccaatctcttgtcatatataagatggtagagatgagaagaaggtagctcctttacagcccactatttccactaactactacctgtgtttcaagatacagcctttcatccttctccagtgttgagagtgttgaacctcagagtttctcctctcattttctctaaatgagatacaatgccagccatcccaagctcttggcctgagttgatcatcttgaagtctaggactccaagaagcatgaaagagcttctttagtgaagctatgtcctcagtactgccaaaattcagacaatctccatggcctgacaatttaccttctatttgggtaatttattgtcccttacgcaaactctccaactgtcattgcacagacatatgatctgtatttagctctcactttaggtgtttccattgattctattctcactaatgtgcttcaggtatatccctgtctagaagtcagattggggttaaagagtctgtccgtgattgactaacagtcttaaatacttgatttgttgttgttgttgtcctgtttgtttaagaactttacttctttatccaatgaacggagtatcttgtgtcctggaccctttgcaagaacccttcccctagcaacagatgcgtcatctcaaaatatttttctgattggccaaagagtaattgatttgcattttaatggtcagactctattacaccccacattctcttttcttttattcttgtctgttctgcctcactcccgagctctactgactcccaacagagcgcccaagaagaaaatggccataagtggagtccctgtgctaggatttttcatcatagctgtgctgatgagcgctcaggaatcatgggctatcaaaggtaggtgctgagggaatgaaatctgggacgatagactacgaagcattggagaaaagacctatggacatttggaagataatgtgtggagtgaaagaatagtgtgacaggtattatgtggtctcgacagaaagtataacaaattgtggtttggtggagttcttccctcaccacaaactgaagtaagtcaaatttggtttagaggatcaaaactgagttgtgtattgatgaatagcaaggtcctgctacaagccaaactgggggtgggggtgggggtgggggaggaagaatattttctggcaagcattaacaagttatatttctgggctttaattattctttctggaaaattagtaaaattaaaaactaaaaaccacacatagttttgctagaattaaatgaaaaaaaaagttattagccctgttcttatctgaatacatgatacagtagttattttttggagtgtaaatcctgtcggtatatattgagcacatatattgtgttgaagattactagaaggaaaagtcatcaaaaagcaacaatttaccccaggaaaaggggagggaaggcatgctgatatgagttgcctcatgggacagtgatagccattccctgccttcccatctccatggtacagcagatcttatatcatgttaacttagtaatatttccaagagagtagaaaaataagtaaggaaatggggaatctgatattattctctctcatctccagagcaacattggtgctgttgtaaagatgtactgtagaaaagtattcttcacccagcatgacccccacagaaggtgtcaggtagacttgaaataagcaaagtaataacccagctcccatacccatagtggcaattgtagatttctattgccccaaaagagccatacatagggatacttacctagaaagacagaggctcttcccttggtttgtgaagaggcagctagtatatttgtgtgtgtttgcatagatgcaaacggtaaataaattcctaggtttatcaatacacagtcaaacattaaaatctctcatcttggctgggcacggtggctcacgcctgtaatcccagcactttgggaggccgaggcaggcggatcacgaggtcaagagatcgagaccgtcctgggcaacatggtgaaaccccgtctctactaaaaatacaaaaaattagctgggtatggtggcacacgcctgtagtcccagctactcgggaggctgaggcaggaggattgcttgagcccgggaggcggaggttgcagtgagctgagatggtgccactgcactccagcctggcgatagagcaagactccgtctcaaacaaccaaaccaaaacaaaacaaaatatctcaccttatctttgaagactaaggaaaaaaaaatctcccactcatcgatacactccacagaggcagcatactctccaagtgtagctttctcttttcatgttcattattcccttggtgttggttattctcaatgtcaatcataacagaacatcttccataataacagtcccaatttaaggagcattaagataaaaggtggaattgccaaggtcaatccagacgagaaccttctcatagaggtaaccaccgtgtgggtttggatgctgggaagcagggggactatgacgctacaaggtctcagtcttaatttttggagtacttcagtccccaggtatattttccatagatttggcccttaaataaaaagaagcttctgactctaaaatgtaaacagtgcttgttacagtcttgttgatatattaagaaattactcaccttatctcatttaatcttaaaaacaaacccctgacaggatcaaaaccacagcagggctacataataggaaaactatacataaataggtagaataatctgctcaggatcactaggtaagttgctgaataagaattcaagatgtttttgatcccagagtttaaaacccaacctttcaaacagtgtttccttcttcttagagtacaatgttctgagaaagagatcctctggaattctggcctaagtgtatttaatgcccgggtaaagaaagtgagagaacatttctctttaggggctgctgctggatttctaaaaagaaaataatttctcagctagtaacatggagccaaacaacagcttcacaagactctgggttctttagccctcatctccttcaatccaccctctttataaccagtccttcttgtttttcccctcccagctttgttcagcagcatgcccttcacccagaccttgtcttgtcactcatccctactcgccatcattctttcattcctcttggcccaatctctctccaccacttcctgcctacatgtatgtaggttattcatttccctctcttgattccccccacccaactctctttctccatttcttgcctttcagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatggtacctccctctctgctgcactcctggacatgggaatccatagtttgaaagtagttgcttcagctctttgtgttagattattgtaactgattttccctccaagggcctaaccttgccattaacaagccccaaattctcatgccagaggtctgagaactttatgggtttgatcctatcttgttgtgctcaagtcttgtctctgtcatccatggtctcctacgaagtcattgccctaagttcatgctgggggagccagaagggaagtccttggatatcttatacctcaatattggctcaatttcttggggagggggtgctgtcagagattgttatctgaggatgtgacatagatttctcagggcacaatttcaactactttttcagctttagggtttttagatacgtttgtaccacaattgagcatgggagggagaggggtgagcctaagcagtgatggctgatttctgtcacgtctgtcatgtgtcccccagtacctccagaggtaactgtgctcacgaacagccctgtggaactgagagagcccaacgtcctcatctgtttcatcgacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactggggtatggaccaacactcaatctcctttatttcaaggtttcctcctatgatgcttgtgtgaaactcggtgttctaactgtttcataatatctgctacaattaatataactgtcttctcctcctatccagcttcctcctttttttaatctgtaattctctcaatacatcattctgtcttcctcttctttaatctatgaataacttttctctttattaagaaccctacatttgattctgagtgttacttcttcccacactcattaccatgtactctgccttatttccccccagagtttgatgctccaagccctctcccagagactacagagaacgtggtgtgtgccctgggcctgactgtgggtctggtgggcatcattattgggaccatcttcatcatcaagggagtgcgcaaaagcaatgcagcagaacgcagggggcctctgtaaggcacatggaggtgagttaggtgtggtcagaggaagacatatatggagatatctgagggaggaaaacagggtggggaaaggaaatgtaatgcatttaagagacaaggtaggaacagatgtggctcttgatttctctttgctagaatgaatcagacattggtatcatctggtatcccaaagcttcagggtctgtcatccctttctatagacgggcaccttgatcacggctccagtcttagaaatcatctccagtacctaaaaccattgtttcacattagaatactgagtctagggatctagaaaatacattagaatatggagtctagggatctagaaaatactgagtctagggatctagaaaaataagcctcaagatttgggcacatcctagcttgtatttcctggggcaggtcatcagttcagaagcatttccagatcctggctcctttcaggttagggtcaattcattgcatgaaatgggaatctcttagaggccaatgcctgcttttgcttctttagtctcaaatgtagtatgagaaactctaaaaaaaggtaaagcatggttgcttattatgttcagttggagagtaggaactaactgtatacagttagttcatgttggaaaggttagatgaacattgaaagaattttgcaaagtcaaaggattaagagagaagaggaaggaatctgaagcaaggagctcaaaacggatcttaaattccttggtaactatgtgtgtcttgctataggtgatggtgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgatcttgggtggaatttttggtgtttaagccagttctttgggtggcggtggggggtggggagtcggtcctggggaatatatgtgatcctttcccggtaaaatatctgaatgttgaatttatcttataaattctagaattcatcagacatatcccggttcatttgggcttggtctcattttgtgcatctgcaggcaaccctcttgttgtggtctagtcctcatcaggaaaacctaaagtggggttggtttgttgggagatctctactgagcaatgatataactctgtcttcagtagagtgaatctgaaaccccaaggtatggatctcagaatgcatgggatggaggggagcagatggggttagagtggggagaaggaagacagaagaatccataaacattgcaggatttacatatcaacatcgttcattccagatttaatgagcaaagagattggacactgaagactggccttacccattctgttagacatagtctcagatgcctattttattaccgagagagtagtctgactgattcttgaaaccaccttatatttgaagatgtgtctttgagtggaaaagctgagtgaaatttggggttggggagaaagatatgacattaagatgagaggaaggaatatttgaaacacaatgaactgttgctcatttgtctataaaactatgacttgatatttatctctaaaatagtttctagaacctgccataaaccactaagataaactattcatgatagtgtggtagactgcaaataaatgctgttgaaatgagttaggcttgggtttcatcttggctgtatcatttactagctatgttttcactggtatcttacttaacttagcctcacattactcatgaaaatactggtgttaatttttactacattgaattaatatcagaattaaaaggaaaacgcaagcaaagtaattagatacatgcttagtgataataaaatattgcaaaaaattatacattctgttgtttttctcaaaatttctatagactgatgataaaaatctaagagaagctaaacaaaacaaggataaaccaaagcatcatgacattctaagccttactaataaataagaagtttctcggctgggcacggtggctcacgcctgtaatccagcactttgggaggccgaggtgggcggatcacaaggtcaggaaatcaagaccatcctggccaacatggtgaaaccccatctctactaaaaatacaaaaattagccaggcgtggtgataggcgcctgtaatcccagctactctggaggttgaggcaggagaatctcttgaatccgggaggcagaggttgcagtgagccgagatcgcaccactgcgctcctgcctggcaacagactgagactccgtctcaaaaaaaaaaaaaaaaaaaaagtttctctactgttggttcagagaatcaaagcagaatcttgagactactgatggtagaataggtatgaatgtctttcttacatgactacaaactttattataaaataaatagcttaacacagagaatacactaaaacttagacaagcatggattaagaaagcaaaaagtaaacccatatactaccatgtaagaaaaccatttttggccaggcgcggtggctcacgcctgtaatcccagcactttgggaggccgaggcgggcggatcacgaggtcaggagatcgagaccatcctggctaacatggtgaaaccccgtctctactaaaaaaaaaaaaaaaaaattagccgggtgtggtggcgggtgcctgtagtcccagctactcgagaagttgaggcaggaaaatggcgtgaacccaagaggcagagcttgcagtaagccgagatcgcaccactgcactccagcctgggcgacagagcgagactccatctcaaaaaaaagaaaaaaaaaaaaaaaaaaaaggaaaaccattttaatagacttttatttttagagctgttttaagctaacagaaaaattgcagaaattgtatacagagctccccca

SEQ ID NO: 16896 - DNA, 7080 bp, Human
gctaattacatggcaggaagaatggggcctctaaggggagtgtggggtctgtctctcccttttttccatctttttcctctctcgctttctttcttacacagaaacatacacataccgagaaacctatttctcagacccctttttctcctctgtctttctctctccctctcccacacctcacacacacatactcccacttgcaactattctgtttctctcctgggctcccccactttcccttccccaccccacttgtatgctctggaatctgtggagacgccagccctgcccaatcagagatgccaaaaatggggacatgacttctggacagaggacatgggccacgcccccatgcatccccacccccgcccctccggacggcttacttacctcatacgcagctcatcttaaaccaatagaatcgctcggtggacgagagtgtctgactcagatatctacctcggagggagtttctgctactttagggaattattgactgggctttggggttgaacttttttttttttaaagaaagaaaaagaaaccctgggatccatctgttttttttgttgttgttgttgtttttgttgttgttggtggtggtggtggtggtggttcttaatttttaatttagtttggggaagtagcttgtttttttttttataaatatgttgatttcttgtcttttttttttatttcttactttcccatattaggggtgatagccaaaggggttctggtaagagaaagggggacaaacagaactggtaaagaggcccccctggctccaggcctgtccatcaggaagtaaattttacagggcaccaagctttgccccctaaaatcccttaggtgttctttgttcatgcaggcaggtttctgccgcatttgatgtggaggcagtgaagggcttgccctgctggcctctcatcccccttcttcccacaacccttgggcagggctggactcagtaattttgaggaaattgaagatgccatcttcccctgtgagtgacatgtctttaattttttaaaaaactactatttgaaaattggagggggaagaatgggaagggagttattgccaaatatgttaaatatgggttggggtgcttgtatatgtatcttcctcaatttccccataaatgaggtatctttttgtcacaccaaaatcaaggggtagggagagggaggaggttgcaaaaagccagatgtgggggaaaagtaacatcaacactgtcccatcctcagccctgaactagctaccatctgatcccctcagacattctcaggattttacaagactgtcagagtggggaacccctcccattaaagatccgggcaggactggggacaggttggaagtgtgatgggtgggggggtgggaggcatgggccgggggcagttctctcctcacttgtaaacttgtgtagtttcacagaaaaaaaacaaaatgcagttttaaataaagaaatttcttttttccctgggtttagttgagaatttttttcaaaaaacatgagaaaccccagaaaaaaaatgattttctttcacgaagttccaaacaggtttctctcctgttccccagccttgccttcatgatgcaggcccaattgcacccttgcagacaacagtctggcctgaaccctattgatgcaactttgcgcaatcaagatggggctccagtgggtcaccaggcagccctgatggactgatggaataaataggatcgggggctctgagggaatgagaccctagagggtacactccccatcccccagggaagtgactgtacccagaggctggtagtacccaggggtggggtgataattatttctctagtacctgaaggactcttgtcccaaaggcatgaattcctagcattccctgtgacaagacgactgaaagatgggggctggagagagggtgcaggccccacctagggcggaggccacagcagggagaggggcagacagagccaggaccctggaaggaagcaggatggcagccggaacagcagttggagcctgggtgctggtcctcagtctgtggggtgagccactccctcaaccccactgaccctccctgcagaaagcactttaaccccacaccccagtcgtcctagaacttttcccagaacccgaggaagtgcctttcaaggtccctcacccaccctgtccaaattttgttagccctcattcccttcctacccctctaccatggtgctatctcccaggggcagtagtaggtgctcaaaacatcacagcccggattggcgagccactggtgctgaagtgtaagggggcccccaagaaaccaccccagcggctggaatggaaactggtaagcggggctcctgttgcagcctcccaacttccagggagaccagcaatgatttggatccccgtcactctgcctcacagtcctttcccaaaggccttgcactgtttaggccctgcttctctgcttctagaacacaggccggacagaagcttggaaggtcctgtctccccagggaggaggcccctgggacagtgtggctcgtgtccttcccaacggctccctcttccttccggctgtcgggatccaggatgaggggattttccggtgccaggcaatgaacaggaatggaaaggagaccaagtccaactaccgagtccgtgtctaccgtaagaattccagggtcttctccaaggcctccctcttacctaagaaaaagccttcaaccccagccttggcccatgagggcctctgacttccactggcctcatttccacacacagagtttgagaaccttcacaattacagcctctgactggatttttcctccttcagagattcctgggaagccagaaattgtagattctgcctctgaactcacggctggtgttcccaataaggtagtggaagaaagcaggagaagtagaaaacggccctgtgaacaggaggcgagtgtgtgtgggtgtgggtgtgtggcatctctcattttcaaaggattctgaggtcaccactctttccccaggtggggacatgtgtgtcagagggaagctaccctgcagggactcttagctggcacttggatgggaagcccctggtgcctaatgagaagggtgagtcctaaggtgccccccaagctgccttctccctgatctcactcccacacccaccctgggataatttgtcttatcctcccatcataggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagcccccatccagccccgtgtctggggtgagcataggtggggagggccccaagctcacgtgagcacgttctggaagtctgacccttagggaaagagggagtcaagcccatggccactgggatcactcacaagtgtaactctccacctcaaaacccttccaactcccagagcctgtgcctctggaggaggtccaattggtggtggagccagaaggtggagcagtagctcctggtggaaccgtaaccctgacctgtgaagtccctgcccagccctctcctcaaatccactggatgaaggatgtgagtgacctggagagaggggctgggaggtagggtgaaccataactagcaacagggagggcagagggctaacgagggaaaggcaggctaggagctgaggaggaagagagggtatctgaagatatggagacaaaaagacaagggttttgaaatagtctcctctccccttcccccaccagggtgtgcccttgccccttccccccagccctgtgctgatcctccctgagatagggcctcaggaccagggaacctacagctgtgtggccacccattccagccacgggccccaggaaagccgtgctgtcagcatcagcatcatcggtgagacctctccccaagccctacagaccctgggactagggtgcaggacagcacaggctctaatttcctgccccattctggccttatccctaacagccaccccacctctccctccatgcacccacacccaagcctcccctgccccacccaaattctgccaagagagcagccaagcctctcccttcttccctctgagctaaaaaaaggaacagacggctgggcgcggtggctcacgcctgtaatcccaacactttgggaggctgaggcgggcagatcacctgaggtagggagttcgagaccagcctgaccaacatggagaaaccccatttctactaaaaatacaaaattagccaggcatggtggcacatgcctgtaatcccagctacctgggaggccagctacttgagaggctgaggcaggagaattgcttgaacccaggaggcatagattgcgatgagccaagatcgcaccattgcatgccagcctgggcaacaaaagtgaaactccatctcaaaaaaaaaaagaaagggaaagactccactggggctcccactaaataaccctctctcaacccgaagtcttcctttctgactggatccaactttgtcttccagaaccaggcgaggaggggccaactgcaggtgaggggtttgataaagtcagggaagcagaagatagcccccaacacatgtgactggggggatggtcaacaagaaaggaatggtgagtggtggtggctgtgctctcaattttccctgtctccgtacaggctctgtgggaggatcagggctgggaactctagccctggccctggggatcctgggaggcctggggacagccgccctgctcattggggtcatcttgtggcaaaggcggcaacgccgaggagaggagaggtgagtggagaaagccagacccctcagacctagggcttccaggcagcaagcgaagaggggtcggggggtggaacgacaacgtgccgcattccccccaatctttctcctcaggaaggccccagaaaaccaggaggaagaggaggagcgtgcagaactgaatcagtcggaggaacctgaggcaggcgagagtagtactggagggccttgaggggcccacagacagatcccatccatcagctcccttttctttttcccttgaactgttctggcctcagaccaactctctcctgtataatctctctcctgtataaccccaccttgccaagctttcttctacaaccagagccccccacaatgatgattaaacacctgacacatcttgctcttgtgtgtctgtgtgtgtgtatgagacacaacctcacccctatacccttgagggccctgaaggaaagggactcacccccatacttcaccatactataccaaacatctactcaagttggggagaagatgcttctgtcgggggtgggggcgaacttgggaagagatcccatcaatatatttcaccttttttattgaatttgtattaaaggaggtagtgagggggcggaagcacttaagagtcagaatccatattagactctggggagtgaaaaattaaattaaatcagtaagatggggagtgggggaagagtcagagggaactttgcccacctttgaagatcaaatcaagaaatcagggaaagcaaagacttaggagaggagaaagacattctctcaatccatcctccttccccagggcagagaattaaacaacgttactgagtgagcctctgagcagaaggctctcccatctatgcacagacttcactcctcctccccaggccttcctggacaatgtccagggctggccttagccaacagaaatagaggggtcaagggggtccaggagtacggaagggtcagcagggaccctcaatactgattcttctctggctggaggtgggcaggaagcagacatagctcaaatactgagcagccaaaaaaagaagaagatggcgagaaacaggaagagggaatcctgccagctggaggctgggtgaccctgtcccagatccacacctgtgggagagaggaaagctgtggaagcatatgctcctaggctgggagggggcctgaggggattcacagggctccctgatgggagctgagtgtgactcttacctgtaccccggcggaaaggctcatgggcattgaagacggtggtgaaaaagccaaagggaaaagcaccaacaccaaatgagaagtggaagcccccggtatcaccaaatggctggaatccctagggaggcagaaaaagtcagacgggaagccggcaaatctgtcaaggaagggacacaactggacaagaagactcacccctctgctctccggagctggtctctggccctgggggcggggtggagtttttaatctgaggaagtggagagagaaagttaacagggatttttctcctcccatcttccacaccgttttccaagggcagaagccttcaatcttccctaagcaacacctccagtctctcacctgggatcctggggcttctggctccctcgcccataaagcgggacaaccttctctctgctgatcccagctttacatactggacactcttgccgttctggccgtgtctccagccactggggagaaaaaaggtggtttccagtatacaagagggtcttacagctcctcagacctccccatttccctcttcatctcctgagtacgcacctgatgaagacatggccaactggatgggggagaaaaaaaaaaaaaggtcaaactagctacagaaaagagagacacagaccctagacttcgcagaatcccatctaacccctcttcccaagcaacctgctgttgcttttcagattttctgcaacctctaccatgccagccaacttagttagccttcctgcttgtctgatcttccaacacctaaagctctgtccatcctcaacacactcaaccctctcctttctcctctccccaacaaacacatacaaattttcgtgccctctcttttctgcctttcaagttaatttctaatttccttcagccacctctttctgggtctcctcttttcaaccccaaccccatcactccaaaccaaacccctttactagcacattcccccattactcactt

SEQ ID NO: 16897 - DNA, 16373 bp, Human; identical to SEQ ID NO: 12820

SEQ ID NO: 16898 - DNA, 6682 bp, Human
agccctagtactgtcttctttggagccttcgctctgtagaacttggaaaaatccagaaagaaaaaataattgatttcaagaccttctccccattctgcctccattctgaccatttcaggggtcgtcaccacctctcctttggccattccaacagctcaagtcttccctgatcaagtcaccggagctttcaaagaaggaattctaggcatcccaggggaccacacctccctgaaccatccctgatgtctgtctggctgaggatttcaagcctgcctaggaattcccagcccaaagctgttggtctgtcccaccagctaggtggggcctagatccacacacagaggaagagcaggcacatggaggagcttgggggatgactagaggcagggaggggactatttatgaaggcaaaaaaattaaattatttatttatggaggatggagagaggggaataatagaagaacatccaaggagaaacagagacaggcccaagagatgaagagtgagagggcatgcgcacaaggctgaccaagagagaaagaagtaggcatgagggatcacagggccccagaaggcagggaaaggctctgaaagccagctgccgaccagagccccacacggaggcatctgcaccctcgatgaagcccaataaacctcttttctctgaaatgctgtctgcttgtgtgtgtgtgtctgggagtgagaacttcccagtctatctaaggaatggagggagggacagagggctcaaagggagcaagagctgtggggagaacaaaaggataagggctcagagagcttcagggatatgtgatggactcaccaggtgaggccgccagactgctgcaggggaagcaaaggagaagctgagaagatgaaggaaaagtcagggtctggaggggcgggggtcagggagctcctgggagatatggccacatgtagcggctctgaggaatgggttacaggagacctctggggagatgtgaccacagcaatgggtaggagaatgtccagggctatggaagtcgagtatggggacccccccttaacgaagacagggccatgtagagggccccagggagtgaaagagcctccaggacctccaggtatggaatacaggggacgtttaagaagatatggccacacactggggccctgagaagtgagagcttcatgaaaaaaatcagggaccccagagttccttggaagccaagactgaaaccagcattatgagtctccgggtcagaatgaaagaagaaggcctgccccagtggggtctgtgaattcccgggggtgatttcactccccggggctgtcccaggcttgtccctgctacccccacccagcctttcctgaggcctcaagcctgccaccaagcccccagctccttctccccgcagggacccaaacacaggcctcaggactcaacacagcttttccctccaaccccgttttctctccctcaaggactcagctttctgaagcccctcccagttctagttctatctttttcctgcatcctgtctggaagttagaaggaaacagaccacagacctggtccccaaaagaaatggaggcaataggttttgaggggcatggggacggggttcagcctccagggtcctacacacaaatcagtcagtggcccagaagacccccctcggaatcggagcagggaggatggggagtgtgaggggtatccttgatgcttgtgtgtccccaactttccaaatccccgcccccgcgatggagaagaaaccgagacagaaggtgcagggcccactaccgcttcctccagatgagctcatgggtttctccaccaaggaagttttccgctggttgaatgattctttccccgccctcctctcgccccagggacatataaaggcagttgttggcacacccagccagcagacgctccctcagcaaggacagcagaggaccagctaagagggagagaagcaactacagaccccccctgaaaacaaccctcagacgccacatcccctgacaagctgccaggcaggttctcttcctctcacatactgacccacggctccaccctctctcccctggaaaggacaccatgagcactgaaagcatgatccgggacgtggagctggccgaggaggcgctccccaagaagacaggggggccccagggctccaggcggtgcttgttcctcagcctcttctccttcctgatcgtggcaggcgccaccacgctcttctgcctgctgcactttggagtgatcggcccccagagggaagaggtgagtgcctggccagccttcatccactctcccacccaaggggaaatggagacgcaagagagggagagagatgggatgggtgaaagatgtgcgctgatagggagggatggagagaaaaaaacgtggagaaagacggggatgcagaaagagatgtggcaagagatggggaagagagagagagaaagatggagagacaggatgtctggcacatggaaggtgctcactaagtgtgtatggagtgaatgaatgaatgaatgaatgaacaagcagatatataaataagatatggagacagatgtggggtgtgagaagagagatgggggaagaaacaagtgatatgaataaagatggtgagacagaaagagcgggaaatatgacagctaaggagagagatgggggagataaggagagaagaagatagggtgtctggcacacagaagacactcagggaaagagctgttgaatgcctggaaggtgaatacacagatgaatggagagagaaaaccagacacctcagggctaagagcgcaggccagacaggcagccagctgttcctcctttaagggtgactccctcgatgttaaccattctccttctccccaacagttccccagggacctctctctaatcagccctctggcccaggcagtcagtaagtgtctccaaacctctttcctaattctgggtttgggtttgggggtagggttagtaccggtatggaagcagtgggggaaatttaaagttttggtcttgggggaggatggatggaggtgaaagtaggggggtattttctaggaagtttaagggtctcagctttttcttttctctctcctcttcaggatcatcttctcgaaccccgagtgacaagcctgtagcccatgttgtaggtaagagctctgaggatgtgtcttggaacttggagggctaggatttggggattgaagcccggctgatggtaggcagaacttggagacaatgtgagaaggactcgctgagctcaagggaagggtggaggaacagcacaggccttagtgggatactcagaacgtcatggccaggtgggatgtgggatgacagacagagaggacaggaaccggatgtggggtgggcagagctcgagggccaggatgtggagagtgaaccgacatggccacactgactctcctctccctctctccctccctccagcaaaccctcaagctgaggggcagctccagtggctgaaccgccgggccaatgccctcctggccaatggcgtggagctgagagataaccagctggtggtgccatcagagggcctgtacctcatctactcccaggtcctcttcaagggccaaggctgcccctccacccatgtgctcctcacccacaccatcagccgcatcgccgtctcctaccagaccaaggtcaacctcctctctgccatcaagagcccctgccagagggagaccccagagggggctgaggccaagccctggtatgagcccatctatctgggaggggtcttccagctggagaagggtgaccgactcagcgctgagatcaatcggcccgactatctcgactttgccgagtctgggcaggtctactttgggatcattgccctgtgaggaggacgaacatccaaccttcccaaacgcctcccctgccccaatccctttattaccccctccttcagacaccctcaacctcttctggctcaaaaagagaattgggggcttagggtcggaacccaagcttagaactttaagcaacaagaccaccacttcgaaacctgggattcaggaatgtgtggcctgcacagtgaagtgctggcaaccactaagaattcaaactggggcctccagaactcactggggcctacagctttgatccctgacatctggaatctggagaccagggagcctttggttctggccagaatgctgcaggacttgagaagacctcacctagaaattgacacaagtggaccttaggccttcctctctccagatgtttccagacttccttgagacacggagcccagccctccccatggagccagctccctctatttatgtttgcacttgtgattatttattatttatttattatttatttatttacagatgaatgtatttatttgggagaccggggtatcctgggggacccaatgtaggagctgccttggctcagacatgttttccgtgaaaacggagctgaacaataggctgttcccatgtagccccctggcctctgtgccttcttttgattatgttttttaaaatatttatctgattaagttgtctaaacaatgctgatttggtgaccaactgtcactcattgctgagcctctgctccccaggggagttgtgtctgtaatcgccctactattcagtggcgagaaataaagtttgcttagaaaagaaacatggtctccttcttggaattaattctgcatctgcctcttcttgtgggtgggaagaagctccctaagtcctctctccacaggctttaagatccctcggacccagtcccatccttagactcctagggccctggagaccctacataaacaaagcccaacagaatattccccatcccccaggaaacaagagcctgaacctaattacctctccctcagggcatgggaatttccaactctgggaattccaatccttgctgggaaaatcctgcagctcaggtgagatttccggctgttgcagctggccagcagtccggagagagctggagaggagccgcattctcaggtacctgaatcacacagccaagggacttccagagattcgggtgtctaggcttcaaatcaccctgtcctaactctgcaacctgaaccagccacttaacctatctatccaatggggataggaatgtccaccacacatagggcatgtgagagaaggcctgacctccatcagaggacctcactcagcccttggcacagtgggcacttagtgaattctggcttccttcaaccagtttccagctgttctatccccttccattctctcagtgggtgaaatcgaagagactgaggacaataaagaacaaggaaccgaactgccggacgtggtggcatgcacctgtaatcctaccactttgcaaggccaaggtgagaggatcgcttgaacccaggagttccagagcaacctgggcaacatagtgagatcctgtctctattttttaaaaaagaatgaaacataggaataagatgtgggtgaaggactcacatgccggcttggtcccactggtctttgtggtgaaggaggggagaggtgagaggtgggtaatccggaaagagaaaagcaccccctccctggatgaaggctcttctggagagagtcaaagacaaataagggtggggcgcagtggctcatgcctgttatcccaacactttgggaggctgaggtgggaggaccacttgagcccactagttcaagaccagcctgtgcaacatagcaagaccttgtttctagaaaaaaaattaaagattagtcaggtgtagtggtgcatgcctgtaatcctagctcctcaggaggctgaggcaggaggatcactcaagcccaggagtttgaggttacagtaagctatgatcatgccactgtacccccgtctgggtgacagaacgagaccctgtctcaaaaaaataataattccaaaaacaaatatggagacggaaattgagcccccctagactgggagcccccactgagttcggaaattaggctttacctccagccctggggtgccaggcaggagaaaaccatgtggtaggctgagggggtagggtgacccattggggtgacctagatagggccttgggtcaccctctgcctcctccagcctgtggctgaaagtcagccatgaagtaatgggggacactgttactcatcccagaagcacccacacttactcacttttgggaagggggacctaaagtgtgaaaaaaaggtgaggattttccgtctcaccctaaatgggacaccctaagtggggcatcggtttttcctcctccccagaacttcctggtgttttcaggcaccacaggctccttcctgccatccccatctctctctaatattctccccttctttctccttcagcctcctcccttcagaccccatgagccttgaattaagctccttggaggagaagagttgactgtcgggtaggagacagagaggccttcaggcagctctagggggagaagtgcggggcccctccaggcttcattcctctgtcatgataggggcttactctgctgctgggcctttctgagtggtgcttgctgggctctgtaatgacccctctcactgttggggggtacccaagagaaaagagtatggtgcagagtctggttgggaccatgtggccctgaaaatcaggatgcctagagaagcttcggagtt

SEQ ID NO: 16899 - DNA, 8181 bp, Human
tggctctccctgaccatgcgggctacctcagggaagccagcttcttcagcgagctgagccgcatccctgccactcagctcacagacccccacccaggcagccccacggcccaggagatagctcacagctgccccctggcccgctcgagcagcacacatcagtggggtccaccagaaggcatcccgggcgttgatattccccccagctcctcctgcctcatgcggttccagcagtctcctaagttctggcaggtccccctcctgggctgccctcagtatccggtgagtcatcttatcctcagcctcaagggatctcccttgtccatgtcttcctgatgctccttctgccactgcttctgctgctggtgccttcattattcttcttttctttctctttctttctctggcaggttcagtctgagatctctgggagtcaggagcgctgctctcatccccaatcagggcctcatagaaagctcgggctgcagccccatccagggtggactctggcttctcgggctgtggctgctgctgcccatccttccagaggtcgctggggtcagtggctggggtgaaggtgatgagcaagggccgggacatggcttttgggagaactgagaaaatgataccaggcaagggaaggatgagacaagtaagccaagctcgtggtgaccctgtagcaaccacagcctcagagacctgctgggatgagaaaaagtagtcaaaaacactttcctgccactaaagtaaccccacaacttaggactctgcagggcctaagggagagagactttgcgtaaaaacatggaaccctacaataccgactttgctccttagtaaagattaataaaactccatgagactgttgtccagaggtcctgcgtccggcccccacccccatcctcaccaacaataaacaccagcctctttctgaaaccactttcccaccccgtaagacataccagtaggaaaaaaaaatcagcctggccctttaagtcttccgcgatcccatttcggagtttcctcttcccaaacaaaaatagatgggtcactccctagaagatctcggggagagtctcctatacgtgttgctgtgtagcttccgtaccgcaaaatggcgccattctaatcagaagagttgacacaatcaaatagccacacggcacgaagacgcatgcgtggcgacaacaacaacaaaaaccacaacccacattacttgagggctcgggcgtgcgcaaagctccgggttcagtttcccgcgctggaactttttcaatagtaaacgagcaaagctccgcgcgcccaggtggcgcgagcactaggatctgtcggttggggtcctacttttacataacgcccccacaatgcccttcgccttcctcaacgtggcccccgctccaagcccattttctggagccaggaatccactctgtgggttaggaaaggccctcaggaggcggagggaaacctgtggaatgccgagaagccgtgtaatgaaataacgtcacgcctgcccctcaccattactctgaccagggttcgaaggtcacacttagagcctaaggggaaatggagaagtgcaaagggacgagcagaatggctggcaccacctcaggttagcgcactgggacgttccagttctcacaccgcccaccccaccccacccaagtccctacgcacggagccaagccgcacctctcccctcatgaggcaggagcccggaggaaacagtatgcccgtcaagggtctctggcgggactgattcgcactaggggcccaacaggcaataaggacccagcggattggccgaggataggccagtcccctgggcagcagcgccgcgccgggactagaggggaacgtgaggagagctgcggaaagagatccagcctggctccctcctttccccgccctaagtcagcctcttcacccagtgagcacaaaactgtattgcccagactcccgggccccgaacgccatacctggcttccgcttccggtggcttctcgttgtgccccgcccgcaagcgccctcctccgggccttcgtgacagccaggtcgtgcgcgggtcatcctgggattggtagttcgctttctctcatttagccagtttctttctctaccggggactccgtgtcccggcatccaccgcggcacctgacccttggcgcttgcgtgttgccctcttccccaccctccctaatttccactccccccaccccacttcgcctgccgcggtcgggtccgcggcctgcgctgtagcggtcgccgccgttccctggaagtagcaacttccctaccccaccccagtcctggtccccgtccagccggtgagtctgaagtcgtcgctgctccgagtcccttgtcgctgggagcggcacatggggtctccggactttgatgtgggggcgggggaggaagcgaccaggtccggcacgaaggagggagaggtggcctgaggagcggaggggggatgtgtggattccggtgaaagggacctgacaatcgcccccaacccgtgagaaaaggaggagcccggttcttgcttgagaatgataaacttggaaacccttgggaaaggcgtgggggtcatgcagagacttgtattggtagggagcctgagtcgaggtccctgccggagttgacacagaggagagagggccctggccttcgggagctccagggatgtgggtcgggctggtgggtcaaagtatctgttggcttctttcaagtggtgggaccccaaagaatgtttaacttcaaagaaaaggggctgagatgtaaattagaggagctggagaggagtgcttcagagtttgggttgctttaagaaagggtggttccgaattctcccgtggttggagggccgaatgtgggaggagggaggataccagaggcagggaaggagaacttgagctttactgacactgttctttttctagctgacgtgaagatgagcagctcagaggaggtgtcctggatttcctggttctgtgggctccgtggcaatgaattcttctgtgaagtgagttctcttcaacctccctacttgccagcttcacatatcttcccaccagacgttccttcacatattccacttctacactgttctcttacatgctatttgaaaacttcctatcagcaaagagtcccccctataaaccccgacgaacctgtgctaaagtggcaaaactggggcccaagtcctgagtctgccaccgtccagcaatataacgttgggctagtcaatttgtgtctttttcttttttttgagactgggtctcactctgtcaccgaggctggagggtagtggtgcgatctcggcttactgccacctctgcctcccaggttcaagcgattctcctgctccagcctcccaagtagctgggattacaagtgcctgccaccatgcctggctaatttttgtatttttagtagagacagggtttcactatgttggccaggctggtctcgaactccagacctcaggtgatctgcctgcctcggcctcccaaagtgctgggattacaggcgtgagccattgcgcccggcctgtatcttttgttactaaagtggcactgctagtacttgtctcaggtggcctttaggaaaactgaaatgctacacattgaaatgttttgttcagaaaccatgctgttcagcttccaccttccttagccagctgagaggacaaaactggttcctagagacgggatacaggagtggagtagggacaaagatcttgaaaagaatgtctaagaaaaagattgctgtatctacttatccttagaaaagaaaagccaaagcttttatgggagagagtgtaggtgaactagggagagacacaagtacttctgctgagttgggagtgagaaacaagcacaacagatgcagttgtgttgatgataaggcatcacttagagcattttgcccaggtcaaagatgaggattttgatatgggttccctcttggcttccatgtcctgacaggtggatgaagactacatccaggacaaatttaatcttactggactcaatgagcaggtccctcactatcgacaagctctagacatgatcttggacctggagcctggtgaggcaccctcagggttgttttgtgtgtgtgcgtgcactatttttctcttcaaatctctattcacttgcctgaattttgaaatttcctttggttctctgatttctttaaccccaaattcatgctttattttgatcctccacctgactcttgtctagttttgtgacgtatatcacttgttctcatgttttctaaatccgcaattcagacctcatgcgtttcctcatgggtctggtttgttgtctgtttctcctgctttgcaccttccagtctagagtttcatcttctgcattgacattgttgcagttatgtattgaggagggagttgggagggagagcaaggagcagaggctgaaaaggtgtgaagggaaggcagagctgtcttcgtttgatgcaagggtcagaagcccaggtttctgggtcccatgcccagatgttggatggggtaaggcccaaaagtaggtgctaggcaaactgaatagcccgcagcccctggatatgggcagggcacctaggaaagctgaaaaacaagtagttgcatttggccgggctgtgtttcagatgaagaactggaagacaaccccaaccagagtgacctgattgagcaggcagccgagatgctttatggattgatccacgcccgctacatccttaccaaccgtggcatcgcccagatggtgaggcctctctgctcctacctgcctccttctgagcagtaagagacacaggttcctgcagcaagaagtcatgtttaagccctgtttaaggaagctagctgagaagaggggaagaaccccagaacttgggcctgggaattgaattctgattgggggtcatcctgaagggattgttttcagggagggagacagaccttgaatcagagagttgtgatagactgcctcttcctcaaggaacaaacaacaaatggctctgatggtttgtagcctgcctaattggaagaaaggcaacacagaagtttgagagcccatctagtccagagaaggggcctctggacagaggtgggaggagtgggggacagagtggtatgggttgggctgcgaagggagttgcctcttctttacatctacctgccaaccccttccattgtattcacctcagttggaaaagtaccagcaaggagactttggttactgtcctcgtgtgtactgtgagaaccagccaatgcttcccattggtgagtgttgaagaagggaaaggaaagcaccgtgtggcagtcttatgggaaggagttggggctcaacacattggagcctgagtcctgaggggaggttaggtaggaatagggggatacctggcctgctgagtctggctgtctcccaggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggtagggagcagggagagtcattaagggtcaaaggaaaggcccaagatcccccagagaggggaggacagggcatggccctttcttgaggtctgcttctcccagaatcagggcatctccctgctgagtgactgtgggaaagttatttgattatctgtgcttgagttaccttattgtagaatgttcttgagctgagaagttgggaaccacgaggctttagctctgagcaggtccatagaggagctcaggtggggaggtgggaatgcaggtgactggcagggcctggatggggctcatgctgctgcctctctgacctctgccctggcctaggctctacggtttcaagatccatccgatggcctaccagctgcagctccaagccgccagcaacttcaagagcccagtcaagacgattcgctgattccctcccccacctgtcctgcagtctttgacttttcctttcttttttgccaccctttcaggaaccctgtatggtttttagtttaaattaaaggagtcgttatcgtggtgggaatatgaaataaagtagaagaaaaggccatgagctagtctgctggtgcttgctgttggggaagggaaggtgatggtgtgttggactccaggggccctcatggcccagcccaccctccccagattgaaaaccaggacagatttgtgctcagtggattgggtggtgtttttagtatggagcagaacagaattcctaggactgcgtgtgatgaaatgcaaggtcaaaaggaaaagacaaagcatatttcaaagatgagaaatatttgtttggatatctatgactgtctgtttatactgtaaggggcttaatcagcagctccatcttttagttttagttctaaaggaaaagtagcctaaagtcagtataactaaagggtggaacgaggtgggacaaggtccggaattgctgctcagtgatgtgtgtgtgcctgccgctggtggagctgagactgctcatctcagaaggatggggatgcttgatttcctggccaggttgtcccagcacagtggggattggccctgttgtatgacgaagacagcacatggtggcagagatagatactaacccatggactttccaagggagggaataggtctttggagggtatgcaagacaaaggtagacactggataaagaacccggtagtgcccaggtattaccccatctgggccattactcccacactcaggaaccagacgttgtgggtgaggacatgctgtccctcctgccaagtaataacttccttcccagccaggatcctgccccaagtaggaatatagctctgcatttacagcagctcctgctcagaccttgtcaaaaccaccctgcagcttaggattaaggagcatggtcacaggaaggtggggtttcagggcatcccctcaggaactgcccatctccccagaattccaaaatgaaggtccatatgcttgtaggtgtgctggtcatggtgggcttcacagtaggaaagggtaagtggggcccaggggcagggagggaggaaggggtaactgagtccaggaagggggtggagcgtggccatggataatcgggcttcctactggcccagggtatttgagagtgacccagtgcctccatccctccttctgcctccccagttcctgttcccgacatccggacgtgccacttctgcctcgtagaagacccttctgtaggatgcatttcaggctcagagaagtgtaccatcagcagctcatccctgtgcatggtgatcaccatctattatggtaaataaggtcccaggaaggggctgctggtggggcagccaatggcttggtcttctctcctctcacagatcagggctgctccgggcatggggtacaagaagagaggaggggctgagtgcaatggctcatgcctgtaaccctagcactttgggaggctgaggcaggtggatcacttaagctctagagttcaagaccagcctaggcaacatagtgagaccctgtctctacaaaaaaatagccaggcatggtggtatgcacctgtagtcccagctactcgggaggctgaggtgggagatctcttaaactcaggaggcataggttgcagtgagccaagattgcgccaccatgctccagcctgggtaacagagctagaccctgtctcaaaaaaaaccagaagaatcttggaaggaggggtctaaggttctagggggccagcagagctcacttttctagcctcttgaaggactctgggttagaagtaaattaggtctgggtgaaggatgggaaaagtcagtagcaggggttcttggactatgggaagctattggaaggggttatcagctttcccctctccctcagatgtcaaggttcgcttcatcgttcgaggctgtggacagtacatttcctaccgctgccaagaaaaacgcaacacctactttgcagagtactggtatcaggcccagtgctgtcagtacgattattgcaactcctggtcaagcccccaactccagagctctctgccggagccccatgacaggcccctggccctgcctctgtctgact

SEQ ID NO: 16900 - DNA, 5816 bp, Human
tatgacaagcattaagttcacctctcttctttttctctccaggactccatctcactccatctcactctccagtcctctggtctggtttcctttgccctttgtccctcactatctcccagcagtccagctcccccctccacctgccttctctggcctttaaagagaagagatctctttggccttatccctgaccctttccttttccatgctcttttacctctgtaccttttctttcctacttccttcgtatcagtctccttacttgcccaagctgagacaaccccttctcacaacatacaatatgggtacatcttttcttccaatggaaatttggcttcaggggtgctttctagaaaaataaaaagtgaggaagaatgccgattcctctggaatgcgcgtgcctccttaatttggtagccatgtatctagttttccaccccctcttctcttcctccactcccattatccctttactaggatcattccatcacttcactctccttcatttccacctttccctctcaatatcttccttcctaaacctcaagcttcctgaatcctcatctgccccagtccttctttacgcaactgctaacttctcatctttccttactcttgagtcacatgggatcttttatcaaggtcccccctctagccacacctttaccctgcattagtttacatgccctcgggaagaggattggtagtgggaggactgttacctaattctgctcctttagtcacagtgagggtcagtgattgtaggaaaagcccaaactccccggggtccaacctgggaagaagaccctatttctgatgggcaaattataaagaggaaagggcgggtctagcctccgcgggtctccttaaaaggggcgggctttgtcccttttgcaccactcacaaaggggttgagcccagagctttcctgctctgaaggtttaaaacggagttgaagtcaatcctgttctactctgtgtacaacattaagaaaggggtgggcctttagttcagttttgctctgtaaatcacctaatatggggagggctgagtcgtccagccgaatgagttgggttaacaccagcgccgcagatcgatgttcccactatccaaacgtcgggctaatcccagttctgctcccttaactaaaagggaggggcagacccaagttctgctctctacgtcaccaaaggaggttggagccattttgaaccctgcgaccctagtgttttccctcttttcctagctcttcgccgtctttcccgatgtcggccaatcaggggaaaaggaaaaggcccaatcagcagaaagtccacagctgaaggacccggatgaagcgagcctaggactttgaagtgcaagcctcgccaattgtagagcagtcaccatggcgacaagataggggtgaagaggtggaacaagagaaggttaaaccctcacaggattggcccacccccgtcccgccgcgtgctgcgcaggcgcgttttacctaaccaccattttccgtcaagttttagccaatgagttgatttggagccatacgctccaaagtccaatagcaatccggacattctctaaaagaggaagcgaaggaaagaaaggggcttatagtgggcgaggtctataggtagtcccgagcaaattgcttatggctttggttatgactgacaactactcagacgaataaagccctccttggccaggcgacagcgtgtagcgagttattaccaatcccttggcattgcacattgacttagaccgtatcagccaatagccattgtgcgaaggcaggactgcactaaccttttcccgcccctaccctttgggccaatcctttcttttgaattctttgtgactggcaggcattcagaccaatagtgattaggaaaccttgaagcctgcccaacgatcgtgggcaggaggtggtttctggtttgttggggcgtgtgtatgtgtatttggggggactgaagggtacgtggggcgaaacaaaaccggccatggcagcagcggaggaggaggacgggggccccgaagggccaaatcgcgagcggggcggggcgggcgcgaccttcgaatgtaatatatgtttggagactgctcgggaagctgtggtcagtgtgtgtggccacctgtactggtgagaatcgaggaggggggcgggaggtggtgggtctcgcttatatactggagaggctaggagcgaataatcatacagtcatacagataatcggagggcacgttcccataggtgaagcccgacaggagacataagactttgctggtatgtgtgggtgggagtataacggtcgagatctgtggaaagaaaggtcttaggaaccaggagctgaggcacgtgatgtgctgagaagagaaggtggggcggggagtggcaggacaatgtgagacccgagccaccttaccccagagaagtgaggggtcttagctgtgcaggtggaaacaagtgagacacaaaggttaagggaggcacgcatcagttgagtcggggagaaccaggaaatatggatcacattcagatgagatctgggagggggctggtataagggcactgtggagaggcagacttgaaaggttaaagggtcataaagatagggacattattgagcttgaaagtgagtaatgggggaatgtgctagtaaaggggtttggtttggagtgatggggttggggttgaaaagaggagacccagaaagaggtggctgaaggaaattagaaattaacttgaaaggcagaaaagagagggcacgaaaatttgtatgtgtttgttggggagaggagaaaggagagggttgagtgtgttgaggatggacagagctttaggtgttggaagatcagacaagcaggaaggctaactaagttggctggcatggtagaggttgcagaaaatctgaaaagcaacagcaggttgcttgggaagaggggttagatgggattctgcgaagtctagggtctgtgtctctcttttctgtagctagtttgacctttttttttttttctcccccatccagttggccatgtcttcatcaggtgcgtactcaggagatgaagagggaaatggggaggtctgaggagctgtaagaccctcttgtatactggaaaccaccttttttctccccagtggctggagacacggccagaacggcaagagtgtccagtatgtaaagctgggatcagcagagagaaggttgtcccgctttatgggcgagggagccagaagccccaggatcccaggtgagagactggaggtgttgcttagggaagattgaaggcttctgcccttggaaaacggtgtggaagatgggaggagaaaaatccctgttaactttctctctccacttcctcagattaaaaactccaccccgcccccagggccagagaccagctccggagagcagaggggtgagtcttcttgtccagttgtgtcccttccttgacagatttgccggcttcccgtctgactttttctgcctccctagggattccagccatttggtgataccgggggcttccacttctcatttggtgttggtgcttttccctttggctttttcaccaccgtcttcaatgcccatgagcctttccgccggggtacaggtaagagtcacactcagctcccatcagggagccctgtgaatcccctcaggccccctcccagcctaggagcatatgcttccacagctttcctctctcccacaggtgtggatctgggacagggtcacccagcctccagctggcaggattccctcttcctgtttctcgccatcttcttctttttttggctgctcagtatttgagctatgtctgcttcctgcccacctccagccagagaagaatcagtattgagggtccctgctgacccttccgtactcctggacccccttgacccctctatttctgttggctaaggccagccctggacattgtccaggaaggcctggggaggaggagtgaagtctgtgcatagatgggagagccttctgctcagaggctcactcagtaacgttgtttaattctctgccctggggaaggaggatggattgagagaatgtctttctcctctcctaagtctttgctttccctgatttcttgatttgatcttcaaaggtgggcaaagttccctctgactcttcccccactccccatcttactgatttaatttaatttttcactccccagagtctaatatggattctgactcttaagtgcttccgccccctcactacctcctttaatacaaattcaataaaaaaggtgaaatatattgatgggatctcttcccaagttcgcccccacccccgacagaagcatcttctccccaacttgagtagatgtttggtatagtatggtgaagtatgggggtgagtccctttccttcagggccctcaagggtataggggtgaggttgtgtctcatacacacacacagacacacaagagcaagatgtgtcaggtgtttaatcatcattgtggggggctctggttgtagaagaaagcttggcaaggtggggttatacaggagagagattatacaggagagagttggtctgaggccagaacagttcaagggaaaaagaaaagggagctgatggatgggatctgtctgtgggcccctcaaggccctccagtactactctcgcctgcctcaggttcctccgactgattcagttctgcacgctcctcctcttcctcctggttttctggggccttcctgaggagaaagattggggggaatgcggcacgttgtcgttccaccccccgacccctcttcgcttgctgcctggaagccctaggtctgaggggtctggctttctccactcacctctcctctcctcggcgttgccgcctttgccacaagatgaccccaatgagcagggcggctgtccccaggcctcccaggatccccagggccagggctagagttcccagccctgatcctcccacagagcctgtacggagacagggaaaattgagagcacagccaccaccactcaccattcctttcttgttgaccatccccccagtcacatgtgttgggggctatcttctgcttccctgactttatcaaacccctcacctgcagttggcccctcctcgcctggttctggaagacaaagttggatccagtcagaaaggaagacttcgggttgagagagggttatttagtgggagccccagtggagtctttccctttctttttttttttgagatggagtttcacttttgttgcccaggctggcatgcaatggtgcgatcttggctcatcgcaatctatgcctcctgggttcaagcaattctcctgcctcagcctctcaagtagctggcctcccaggtagctgggattacaggcatgtgccaccatgcctggctaattttgtatttttagtagaaatggggtttctccatgttggtcaggctggtctcgaactccctacctcaggtgatctgcccgcctcagcctcccaaagtgttgggattacaggcgtgagccaccgcgcccagccgtctgttcctttttttagctcagagggaagaagggagaggcttggctgctctcttggcagaatttgggtggggcaggggaggcttgggtgtgggtgcatggagggagaggtggggtggctgttagggataaggccagaatggggcaggaaattagagcctgtgctgtcctgcaccctagtcccagggtctgtagggcttggggagaggtctcaccgatgatgctgatgctgacagcacggctttcctggggcccgtggctggaatgggtggccacacagctgtaggttccctggt

SEQ ID NO: 16901 - DNA, 24553 bp, Human
ttattggttgaagagggggaactaaagagagggaacactgggccgggtgcggtgtctcatgcctgtaatcccagcactttgggaggccaaggctggtggatcacgaggtcaggagttcaagatcagcctgaacaacctggtgaaaccccatctgttttaaaaattacaaaaattagccagatgtggtggcatgcacctgtaatcccagctactcaggaggctgaggcaagagaattgcttgaacctgggaggtggaggttgcagtgagcagagatcatgccaatgcattccagccagggcgacagagcgagactccatctcaaaaaaaaaaaaaaaaaaaaaaaaaagagagggaacccccgaggagacgctcaggtgtttttacatcctcagactcagatgtcccctctcattctcctgctggaagcctctggcctcactcctgacctgtgtgcctctctctccagtgccgctcctcccaggggcagcgccgaggtccctgctggtgtgtggatcggatgggcaagtccctgccagggtctccagatggcaatggaagctcctcctgccccactgggagtagcggctaaagctgggggatagaggggctgcagggccactggaaggaacatggagctgtcatcactcaacaaaaaaccgaggccctcaatccaccttcaggccccgccccatgggcccctcaccgctggttggaaagagtgttggtgttggctggggtgtcaataaagctgtgcttggggtcgctggcttgtgtctctgtgtctgcctctcacaattctggaatccctggccctctctttaccccactacagctcactcacagcatttctcctttcctgtggatacctttagtccttcctgtgacagccaggcagaagcttcaagccatcaagcctcacagagctgcccaccaggagttgggagtgggaaggggagacactgagatcatggccttaatctgaagttgtgaccttgtttctaacactgatctttggacacaaagggaggggaaggattaatagttaatcccagcaggaacccagcaaagaggaactctcaaagcacatacccttctgttacttcctactaaaaaaagaaggaaattattactaatatatgagctcatcccatggccctgaaccatgtgattttacctggacaacctcattttgagcttacgataaccttgtgatatagggatttttacccctatttttcagaggaggaaactggcttaaaatttggggtcacttgcctgaaattatatagctggtaaatgacagagggaggtttgcatccggttcttccatatgtgacaatacctggtattccctaggtgctgaatacgtgtttgtttagtctcctttctgcctacatgctcacccaagcaggtgtcaggaagcggccctgtcagttcaggggccctgacactcagcctttcctggaggggccccagttccgtgagtagcacagtgccaaccccatcagaatattaccacatgtgtcaatcacacaccttgtggtgaaagcgagctgaacgcactgatacatgaagacatttctgactcctccctgaccttcagcctgctgggagagagactggaaggccagccatgctaggtgacaagcttctgagaggcaaagttcccctccccaagatgtacccagccactattcctgtgtgtgtgtggcggggtggatagcacccttggagctgggcatctggatggtggttggggtgttagggggatgtggcgatccctgcgacagacagcagagtgaggtctgaatctgagaagctctgcctccagatcagataacctatcgcactcccagaggccccctcctcctgaaaggactttagtctttggagctgtcacctgagctgagtgggacaagagctctacagggcaggccacactgcgaaggaaggaggcaacacgggcaagggctgcctgctgcccgctggagaccgcaccatggagccaggcggggcccgtctgcgtctgcagaggacagaagggctgggaggggagcgggagcgccaaccctgtggagatggtgagccgccctcgggggtgcagaaggcacaggcaagtgggggggaggcggggagagatgcgctatggagagaaggctccaactgcctgatgccaatccttcctgctgtccagagaggccaaggaaggtagaccctggcctcagcccagagccacccagctggaagatggaacagaaaagagctatgtcagagctgtggcctggccttatccttctgactgtttagccccagatagtgaatggagtagcttcccattccctgagtgccctgttcccagtaatgtcaccaggccccctgcttgcctatggcctcctcaccactggcaacagcaacttccccttctagtagccccaaccatgatactagatattggctggttggggtgagggcagctgctgagcacacaaagcatttcctgaccacaggatgcctctgggtctgcagaaccccaattcctcctgttgactgtgcctttgatccctcctcacaggaaacactgagacgcacagagccccggacttggtacaatggacccgacacatggaggtgagggatgtcagaggtcagaggtcaagtggacagatccttggtagcaggaagcaggagtgaggcttggtgataaagatgacttttttttttttttttttttgaaacaaagtctcgctctgttgctcaggctggagtgcattggcacaatctcggctcactgcaacctctgcctcccaggttcaagcgagtagctgaactacagatgagtgccaccaggtgtggctaattttttttttatatttttagtagagacggggtttcaccatattggccaggctggtcttgaactcctgacctcaagtgatctacccgcctcggcctcccaaagtgctgggattacaggtgtgagccacggtgcccagcctgatgacttgttcctgagtgcaaagatcggattcgaattaaggatggagatggaggggtttgaagcacaggtcccaaaggtcaccaaaagtcagccagtagatagagtcttcctgctagtgcggctggaggccaggggtgaggagtgacaatcggaggtgaccaggctggaattcagacccagggaggggaagccttgctcctgctgtcactccctgatcctcgctgctgccccaggaagccagaaggagatcaactctgggcagggatcatggcttgttcatctttttaccacagcacttagcactgcggggtcctaccccaccagcagacccatcaccaccccaccaatgcctgcccttccccccgcaggcctgccaccactgaacccccatccctgctgaccccccaggttgtttttttttttaaaaaaagcactgtgcctggcatagacagaaattcagtgaatgtctggtgaatgaaaggatggctgactggagggacagtgggctctaccctggctttgtcccgtaggctgtgaaggcacaattgctggagcaagcgcagggacaactgagggagctgctggatcgggccatgcgggaggctatacaatcctacccatcacaagacaaacctctgcccccacctcccccaggttccttgagcaggtgagtctggggaatggctgcgcgggctcctctgtagcaaggatcatgagctagaaacatcacgttatgtgcccttgccagctttatcaggaccgtgactccagccttccctcttccccccttgtcttcctaacactgacctccatctactgggcctcgctctgccctggccctgaccttctacccggtcctgccctctggccctagccctgacctttccctaccactccccttggctcccaagtattgaccttctgcatggccctgccctctgcccatttactttttcctgaccctgaacaaacatctcaattcaggacccaggagccatccctggggaaacagaaagttttcatcatccgcaagtccctgcttgagtaagtcggggtgatgacaagtaatgggaggaaaagaaagggctttggctaggggtcaaggtacctcatttctcatccccagcctctaggtggtttgtggagaggacttggaaagggtttctaaggtgcaggtcccctatttgccctaggcatggttgtggaagaaaggcctttagctggaagttctggatcgctaggccccatgcctcatgtgtacagtgtctgagctagttcacacaaccctgaggaccctcccacactgactttcgggcccctgtccctctagtgagctgatggaggtgcagcatttccgcaccatctaccacatgttcatcgctggcctgtgtgtcttcatcatcagcaccctggccatcgacttcattgatgagggcaggtaggtccccttcccacctgggacaggcacacctatctgatcagaccctctgggtcctcagtgccccacctgcccttggggcaagaggacacaggttccccctttggttattggacatgtaccaacattgctcccaacaacctttccacctgaaacactctctaggatcccttccttccccagccttggttggccctttgtctgtcctcccagggccggccactctcaaatgcttctcaatgacaccttgccctgaggcagatgtgtgtgtgtgtgcacacatgcacacccatacacactcctttccaagtcagttctattcaagtaacctccattgagcacctcccgagtaccagtcctagtggccagagaaatgaggggggcagaccccactcctgtctgtgaggcactcccagtcttgtggggaagacagacatgtaaccaagtgcctgggtgggtcatttcccccacagagcaccccatccaactgtgaggatgagcctcagagagctgtatacccctgggggtctgtattttcatacctcccactattcccagaccaaactgagggttggggctgctatttctcatggcccaataacgagatgcagatgaactggggaggaagtgagtttttatttctgtaaccagttacagggagaaggcctggaaattatcaccaggccaactaaaaattacaatttccagagcatatataccttctaagctctacatctatgtgtaggtgtgcattcatctaaagacataagtgattaacttcttttaatctataactaaggtctgagtcttgaagaccttcttctggagcctcagtaagtttacttaatctaaatgggtccaagtgctggggtgattacccttctcttatctcctgctaaataacggaggtttggggagtttcttcagacccccagcaaaacttgtttaatcatgctttgaggttcaggaaaggcctaggcaaaactcttggtgggcttttgttacattccagcctttgtataagggcactggtttttaacatttaacttaaccactcagtcagtactgaaacagttgttatggaggtctgcattagtgagacctgcttgtcacagtccccactgtcaatttacacgatttttatcatgcatggatatttatttatcatgagaatcgcagggagatggggagtcgtaatctttctggctacttcctgctgagagggggtcgtcgttatggggcaccaaaagcagcagtggagtggaagaggttgatttgttcgcagtagcactctctgtttcggggccttggaggcagcacctgctgaaacataatagtatgtaacagtacatataaataggctactgctcttttcttctgaagtttaagttgtctagtcttcagtttgcagggctttaagaaagcagagcttaggtttcagtgattaccaattaggaagaatgggggaaaatggaaaagaaagaggaaaaaattgaaaacattattttggagacctgtagccagaaaagttagaatttaatccaaactgcagaaaataataaaaactgaaaaacatcaggcaagactagaatttaacaacagatgtacttttttttttttttttttgagacagagtcttggtccgttgcccaggctggagtgcagtggcgtgatcttggctcactgcaacctccgcctcctgggttcaagcgaatctccaacctcagcctcctgagtagctgggactacaggcacgtgttactgtgttcggctcatttttgtatttttagtagagactgggtttcaccgtgttggccaggctggtctcgaactcctgacctcaggcgatctgcccaccttggcctcccaaagtgctgggattacaggtgtgagccactgagcccagccatagtttttgaaacataatttttctctctccagtttcccatttttattaaaagacagatcatagtaggactggtttgctttattatacttggtttaattatttgtatacagtacagcaagaataattagtttcacataggccttttaaattggctttgatggaacttcgttccatagaaggaatctgagataagtccttttaaagccgagcccagccatggatttgtaccaataaatacctatgagttgggtgaattcctcttctcttgaggttccaagataacttggggttcctggcctgtcagaaaatgacattctttacctaccacagatcagaaaccctggacagggactgtgtacacaaaatatgatgccagttttcaagggctttattggcttcataagtcaagttcgattccttaaaaaagagtacaccattccagtcaaagccttgggaaaataaccactttttccaattatgtcctgttacaaaagaaaacagattcttattgtactatgcaaataactaatattgcaaatagtttccaaattctggagaaatcaggtagagagaaacaaacatgctccaaattttattcataggagtatactttacttaattgttaaaagctattaatagctcaaaagaaaagtttccttgactctgcaaagcaaaacaaaggactagcaacattttaagcaaaaagtgaaaaagatcacttcaatctccttttagttcagtacatgcagttaattcctgtcctgcttcatattaatgaatattttaactcttcaagagccctaaatgtttttcctccattgtgatgtcacaatctacaaagttatcagaaacctgcattcaagagcacctgttagagctttataactgattataaaaccaccttctaaagaggaccaaaacaagaaaacaattgtttatggatgacaaacagttttagggtagccatagttaaagacacaattgacaaggaaatctgttacctctgtagcacacaacaatttaacataacaatggctgggcacagtggctcatgcctgtaatcccagcactttgggaggccgaggtgggtggatcacgaggtccggagttcaaaaccaacctggccaatatggtgaaaccctgtctctactaaaaatacaaaaattagctgagcatggtggtgcatgcctgtagtcctagctacttgagagactcaggcagaagaatcacttgaacctgggaggcagaggttgcagtaagccaagatcacgccactgcactccagcctgggcgacagagcgagactccatctaaataaataaataaataacaattctaattattattgataatgtacactaagatatatcagaattatagcagtctctcataactttggaatacataccaataacatatttatacaaatatagcccaaagaaagtcaaaccccattttatatttggcaatgcttcctgtatgatttttggtaccaaataagccaaatttcacctttatattagtgtactattaatgttaaacccaattatttatttatttatttattttcttttttgagacagagtctcactccgtcacccaggctggagtacagtggcatgatctcggctcactgcaatctctgaatcctggattcaagtgattctcctgcctcagcctcccaagtaattggaattacaggcatacgccaccacacccagctaatttttttgtgtgtattcttagtagagatgggatttcatcatgttggccaggctggtcttgaactcctgacctcaagcgatccacccaccttgacattcccaaagtgctgggatcataggtgtgagccactgcacctggccttaaacctaagtcttaataaaaccttatacacatggtttacccaattttaatgtttgaccataaggtaagatttgtatagactttttcgaaccctttacaatttttgttaaagagcaggttagtgctctaagagaaacccattgtgcttttattttaatgctcaatttacagaagaaactggatgatacccctttaactttagccaatatgtttacacacagaatttcctttacaatcaaccttccacaacttgcttaaacctccatctttatcttacccaacttaaaacaatccttttaccttttaatctagggaaaaatccattattgtcatgccttcttataatctttttaccaaaagtatattttacttttcttatacaccttgcacataaattgtttcttcaacagtgttaaatatatattatactgttaactcttagcaacctttacttttggtgaaaaccttggtaagtttgggattttaattatgtactaggtgtggcgcctaggacctagacaggagtacagataaggtctgacttattccagcgtctaactccatgtgtcctaggacttacctagctgtaaagcaggcaagttgtacagctaagagtcataaagcatttaggaggcctaatcacctttaaattgtataacatttcttgtataaatttcctttaacaaattctttcaggacttccacagacaatctctgacatcccttgactttctgatttgtcctaaacatgtttctctttaaacaaccagttattttactttaggacaagaatttaccatacaagatcctttcttatataaattctcttttctttaatatctttttgcatatctagggggcatggctaatttcacatgtccctagccttatctagaatctaacgctccaaaataaatttaacaatttttaagtcaaagatgcagtttatgacctaaagcatttagcaaacctaatatttgacatccataatttaaaccaaacgtttacatttttgaagatatttttattttaccaataatctttaaaattgtctttatttttataactttttttatgcctctcttatttcctgttttttttaccttgttttatatataacctttaaggtttgaattagacaaaaattagttactctttaaaaaggacacaatttttagaaagaatgttttcctacatttttattggaaaatacccaaataatgaaatatctgttgtttaactttagattctaaattatgacaagtttatgagtatttatcccattacatttatctaattatttattttaatcatttgcctacatttttttttttgagatggagtctcactctgtcacccaggctggagtgcagtggcgtgatctcggctcactgcaagctccgcctcccaggttcacgccattctcctgcctcagcctcctgagtagctgggactacaggcgcccgccaccacgcccggctaatttttttggtatttttagtagagacggggtttcaccgtgttaaccaggatggtctcgatctcctgacctcatgatctgcctgcctcggcctcccaaagtgctgggattacaggtgtgagccaccttgcccaacctatagtgtagctttaaaacagagaatgataacagtcctttcccagaacaaacttccttcatgtctgtggactagactaaggccacaagagtagaagttagggtattttactaaataattcaagatgtcgctatcttcattaaacaatattaatgtttcattcattaaaaatgacatgagcaaagatcattctgttttgggctgagttatagttttgtagcctctatgccaaattttgacaccttatggtatttggcagagataagtatgaaattgcttgatcaataaatgcaaacaaaaatgtatgctggcaactcttaagacatttctagtattactttaccaataatttttaaagctagcttatgtattaaagattttatttaagtcacataaacttgaaaaagcatttgactagtctttccttttttctgttaaagtatttaagtgcttttatttttctttaagccaattaattagaactcttttatatattttcagtagtgaaacatggtatacacaagacataaatacgcagacgtattaggcatgccaatagaagtacattttatagattcctaagacctcctttttcctctcttttaactggatctttgtgctctgggcagatcttacactgaatcctgggttttcaaaaagggagaattattatgaagccagatcatgtgaggcttttacagtgcacttacatttttttttcccaaagacatttctatgtctctcaattacacttcttaaaaaccccagagtagcttctgttgtaatagctattaatcaagaaaacagaattcagtcaactgagaaggaaaaaaacttctgctcaaaaagacaaggtcctggccgggtgtggtggctcacgcctgtaatcccagcactttaggaggctgaggcgggcagatcacctgaggttgggagtttgagaccagcctgaccaatatggagaaatcctgtctctactaaaaataaaaaattagccaggcgtggtagcacatacctgtaatcctagctactcgggaggctgaagcaggagaattgcttgaacccgggaggcggaggttgtggtgagccaagattgcaccattgcactccagcctgggtgacagagcaaaactctgtctcaaaaaaaaaaaaaaaaagacaaggtcctaggagagaaataaaaacaaaaccaaaaacatgaaagccttttaaatacaaacgtgcacacatgcacacatacgtatacacatcttggatgttatcttttaattaagctgactctcaaccattgagcgtctagaagatatttttccttcccagtggcctctcagcaggaatggacccaatacctcccattttcttttttttctttcctttttttttttttttttttaagacagagtcttgctctgtcgcccaggctggagtgcagtggtgcaatctcagctcactgcaacctctgcctcctgggttcaagcaattctctgcctcagcctcccaagtagctgggattacagacgtccgccaccacacctggctaatttttttagtagagatggggtttcaccatcttggccaggctggtctcaaactcctgaactcatgatccagccaccttggcctcccaaagtgctgggattacaggcgtgagccactgcacccagccaatacctcctattttcaagtttacatgctatcaaagggaataagacagatacacaaataagtggagacaaattttggacaacacaagggggagtgcactcaggcaaaacagactcaaaaccaactcaaaacctgattgcaaccaaaatgcaaagcaggcgtatgagtgagccctattgcttccctgggtggtaccggacaaatggcttaacaagcccaataggaaaacaataggctcccggcatatgatctgtttaactcaccctttgagcgtgtctgcttctgatctctgttcttccccagtagtgaaagggacgtgcagttttgcacacgggacagccctcgggagggtccccaggaaaaatctcacgggcagctgcttggaccctcctgaagactgtctcatcgcaagccactggtggctgaacacagcaccatcccggtctctcctggctggcttgccacgttttgttcccaggtcaaactgaaggttgggctgctatttcttgaggcccagtaacgagatgcagatgaactggggaggaagagagtttttatttctgtaaccagttacagggagaaggcctggaaattatcaccaggccaattaaaaattataaagttttccagagcttatataccttctaagctctatgtctatgtgtaggtgtgcattcatctaaagacataagtgattaacttcttttaatctataactaaggtctgagtcttgaagaccttcttctggagcctcagtaagtttacttaatctaaatgggtccaggtgctggggtgattacccttctcttatctcctgctaaatcacagaggtttggggagttccttcagaatcccaataaactcatttgtggaggcctggggagtttcttcagacccccaataaaacttgtttaatcatgctttgaggttcaggaaaggcctaggcaaaactcttggtgggcttttgttacattctggcctttgtataagggcactggcttttaatatttaacttaaccactctatcagtactgaaacagttgttatggaggcctgtattagtgaaacctggcctgccacatcccctctccctatgttgggcttgggaagcaatgaaaaaaacagctccaaggatccacaggctcagcaacagcactgccttttggtaaaatttttgttgttagttatacaagtattaaaaggacaaaatctactgctaggtttgcataagaaaaaaataaattaaaaaaactaaaaatgataaaatctcagtaaaaagctcaaatacatgtttttgtgtaaaggaggtccttcttgaccgcctccttcaatcccacactgctctcggaggattttaaacagtttctggctgggtgcagtggctcacgcctgtaatcccagcactttgggaggccgaggcaggcggatcacttgaggtcagcaattcaagaccagtctggccaatatggtgaaaccctgtctctactgaaaaaaaaaaaattagccagtcgtggtggtgcaagcctgtagtcccagctattcaggaggctgaagcaggataattgtttgaacccgggaggcggaggttgcagtgagcagaaattgtgccactgcactccagcctgggtgacagagcgagactctgtctctaaaaaaaacagtttctgagtttccacccagagcattttccatgcattgacattcagtaccaaagataggtacattgtggaggtttcacgtaaacaagaaactgtacctattattttgtaatttgattttactccctaacaatttattttagggatcttttcatgttagtccattggtttgaaggactgaagaatatggaggtgccagatttgttcacttagtcctttactaatggacacttaggttgttttcagtttttccccttaacaaaccatacactattaacctaggctaacaaaacactgaacaaccggcatcctattacctccaatctacaacaacagacgctccaaaggaataaaactaaggaaagtcagtctagttacctcatatcctaacatgtgttgtatatagagtactgagcccttaccaacaccatgaaatcagagagggctctcaaggtcatttagaatcaaactcatgccatgactgagtctcctggagcaacgccctgtgccacagaggtgccgtcttgaacacctccagagatggggagctcacaacctgatcaagatacctcagttcatcttccaggagctcagactgaagaggaaggggacaagaatgggcttcacttgtctactttgtctctccttccccactccaaggctgctgctggagtttgacctactgatcttcagcttcggacagctgccattggcgctggtgacctgggtgcccatgtttctgtccaccctgttggcgccgtaccaggccctacggctgtgggccaggggcacctggacgcaggcgacgggcctgggctgtgcgctgctagccgcccacgccgtggtgctctgcgcgctgccggtccacgtggccgtggagcatcagctcccgccggcctcccgttgtgtcctggtcttcgagcaggtgagggccgagccctgctgacggacaggaaggaaccagctggtggggccatctcagcagagggggagtcccccaaagagggggcggggcccacgagagggaggcgctggagaaggcattggcaggggcggagctagttaccgggggtggagtccattacgagggatttggggaacctgcaggctggaaggcaaacactgtgacaccgccatcacaggaggttgaccggaagactccgctctggcctcttatcctagcagccttcattcatcccagcatatgttaggctatacggccatccaacaaaaagaaaaagtatgggctctgaccagacagatcttacactctgcctgcctctcagaggtaacccagagcacagagaggttaagcgatttgcttaaagccacacagcaacttttcctccccttccattctgccacaggttaggttcctgatgaaaagctactccttcctgagagaggctgtgcctgggacccttcgtgccagacgaggtgaggccttcatcttgcccggttgtgaactcagtcctcttggctgactgaatgaagccagcaggtgcaggatcctgataaaagtccctgccttcctaagcccgggttgcccaccaggcacagccctggcatccagctgggctctgtgggccttcatcattaggcattctcagcccctgcctctgacagatggcacctctgttacccaggacttctggcactttcctatttcctatttccaggcccagcctgtcacccaggctttgttattccatttatagagcacaggcagagtatatttagcatcattcttaagggccctaaaatttttggaatgacaagttggcactggctccaacttaaagtcaccagctgcattagcccttaacaagagcccttaaagtcaccagctgcaggctgagcacagtggctcacacaggtaatcccagcactctgggacactgagacaggaggatcgtttgagcccaggagttcaagaccagcctgagcaacgtagtgagatggggtctcacttcaaaaaactttttaaaattagccaggtgtggtggctaatgcctgtggtcccagctgtgtggaaggctgaggtgagaagattacttgagtccgggaggtgaaggctgcagtgagccatgactatgtcactgtactccagcctgggcaacagactgagatcccatctcaaaaaaaaaaagtgagagacatgcaactctttctttcactcacttgaacacttaaagaccatttcaacgttattaattggcccaatttcaaatttttttttttttttttgagatggagtcttgccctgtttcccaggctggagtgcagtggcacgatcttggctcactgcagcctccaccttctgggttcaagcgattctcctgcctcagcctcctgagtagctgggattataggtgtgtgtcaccacacccagctaacttttttgtacttttagtagagacagggtttcaccatgttggccagggtggtctcgaactcctgacctccagtgatccacccacctcagcctcccaaagtgctgggattacaggcatgagccaccgcgcccggccaatttttttttttttttttttttttttagagacagggtcttgctatgttgcccaggctggtcttgaactcctgggcttaagcaatcctcctgccttggcctcccaaagtgttgggattacaggagtgagccattgaggctggcccctaatttcaatatcgttgtatctcagcgaataggaaagctcgaggagaacagaagagatgggagaatggccggtcagcagagtagtcagaacacacacagaatttgtcagttaagtttgctctcttatttgggtgtatttcatgatgccctaaaacaattacaattgtaacattaaaaatcactggtcacagtgatttttgccgaggtgagaagttggggtagaagggtggacctgtgactcatggtggtggagaggggacgtttctgggaggcctggggaggcagtgggagggtggtgccaagggaagaggaggccagtgctgggccagaggtccaatgccaccggcagctgccagtgtccctctccagttatgtatccccacaccccctccaggccctgggctgtgtgctctatgcctgtgcaccataccacatataataataagaagaaagaaatatttcaggaattgccaaaatgtgacacagtggcatgaagtgagcacttgccgttggaaaaagtggcactgatagccttgtctcttgcagggttgccacaaactttcaatttgtaaaagaggcaatatctgggaagtgcagtaaaataagatgtgcctgtattaggaagtccagacagaaggggaaggagaatgggttgtcgaacgtgtgggtaccaaatgaagctctggccacagcaggccctgcactggaagatagggtgcctgaaatgacagcagaagagatggtgttaaagagccagttccgctcctgcccagcttagctcccctagcccgcatccaggtcctacgtccagctccttgcttatcccccacccccaccctatccatttctccactcaccaatcccaccacccttccccagcagccccctcacctctgccctctgcccttgcccttactaatccacccctctcattcctccccaggtgaggggatccaggcccccagtttctccagctacctctacttcctcttctgcccaacactcatctacagggagacttaccctaggtaagaccctgcactccttccccaaatgcccaggcccatcaggaaacttacccttctactctcccctccctgaggtcctcaggctcacctcaggcactggccactttctcaggaagcatctcataataaagatgggaaataggtgactggtagactaccctgtctccttgcccggcctatgatgacactagggcaacccactttcctggtttacccaggactgtcctgataatcctacccatcctacacacccttgttgacatccatgcttaaaacccacttgttatctctgttatggaaagttcagagtatcctagaccccaccaccctagataatcctcccaggcctaagcaattaagggaactgaggagagagggccccagaacccgtgcccaggctgaacagagaacaacatgaaagaatgagaaacatattgtccccattgccgctgcaggacgccctatgtcaggtggaattatgtggccaagaactttgcccaggtgagaagatagggtagaagggtggacctgtgactcatggtggtggagaggggacatttctgggaggcctggggaggcagtgggagggtgatgccaagggaagagaaggccagtgctgggccagaggtcaatgccaccggcagctgccagcatccctctccagttatgtgtccccatgccccctccaggccctgggatgtgtgctctatgcctgcttcatcctgggccgcctctgtgttcctgtctttgccaacatgagccgagagcccttcagcacccgtgccctggtgctctctatcctgcatgccacgttgccaggtgagccaactaaggtagggctagagcagctgtgccctggggaaggctaatcagggaaggccttgctagttaccttccctcagtttcaacacgttctccttctgagtctcccctcacatctgtcccctcctatcagggccattgccatggtctcagttcagaccatctgctccccctccacatcagcctcctaacccatctccctggcacccagatctttcctttcccatctacccctaacactgctgcccaggtgaactttcctactgcaactaatcattccctaccctccttcaaaaactctagtgataagtcaatgctggcacttttggatcagatatgaacccttgatgtggcatccaaggctccttcccacacagccccagcctatctgcaacaagctgaagatatgtgcttccatgcctccaggcctttgcccatactggcccctcagcttgaaataccctttcctaattttcagccatggaatctagttgcttcttggaggcccatggttgagatgccccctcctgtgggaagccttccttttgtagccatcaattactatgacccacctgtttctctgtactcacaggcacatcaatgccaccatacttagctcccattacatttgccctggacacatggttggacatctttctgtctctgtctctgtgtgtgtctcacttcaattactctgtgaactcccaatggccctttgagattcatctctatcaccaacatctggcacaaagtgatgccaagtaaatgtacatgaacaaatggatgaataaatgaatgcatgaggccaggcacagtggctcacacctgtaatcacaacactttgggaggccaaaggaggaggaccgcttgaggccaggagttcgagactagactggacaatatagtgagatctcatctctacaaaaaacttaaaaatagccaggcatggtggctcacacctgtaatcccagcactttgggaggctaaggtgggtggatcacgaggtcaggagatcaagaccatcctggctaacacggtgaaaccccatctctaccaaaaatacaaaaaattagccgggcgtggtggcgggcgtctgtagtcccagctactcgggaggctgaggcaggagaatggcatgaacccaggaggcggagcttgcagtgagctgagatcgtgccactgcactccagactgggagagagagactccgtctcaaaaaaataataataataaaaaaaattagctgggagtggtggctcatgtctgtagttccagttacttgggaggctgaggtgggaggatcacttgagtccaggagtttgaggctgcagcgagctatgatcacaccactgcagtccagcctgtctcaaaaaaaaaaaaaaaaaaggaatgcataaatttgtgaattaccaataaatgaatggtaagagttggggccctggtttctgggcaggggctcctcagaacccagatcagggctgcctgtgggtccatgtgggccagcctgacctgcagcctcttgtccccaaccaccaggcatcttcatgctgctgctcatcttctttgccttcctccattgctggctcaacgcctttgccgagatgctacgatttggagacaggatgttctaccgggtggggcctggacctaggccagttggaagctggagatagggagggttagggagggatctggggaagatggtagccaggttgggtgtcacttcagccatgctgttcacctcccataataagaaatgcagtcctctggatgtgcttataatgccacccctccacctcctgacaagccagggctaactgcttttgtgtgcatggtactacagaatcttctcctgagagagggagtaggagggaggacagggcctccgtgacctgaggagggaggtgggagagtgtctgctgtccctgttctgccaggagccagcccttctggaacactgggatagggtgcaggcagagggagcagtggggaggagccggaacccagatgcttgcttacctcctttcccccactctgaccccaccttctccaggactggtggaactcaacgtccttctccaactactaccgcacttggaacgtggtggtccatgactggctgtacagctacgtgtatcaggatgggctgcgggtatgggccctgcagaccccttcagctctcacagttaataggggctctccttccttccctctccttccctcctgctacagtgtggcaactacaccactcacctaagggcctaagggccgttttgatttcatctgtcctcattttctcattttacccaacccaatgggtagaaagtccttgcaatcttaactttcttccatctttatccttaattccaccctgtccacagggcattgtttcccaccttagccttctaaggaacatgcacatagcaattttcagctaccaagggtttttacatacatttaatcagcacagtaaccctgagaaataaatatgattatatcctcattttaaaatggcacctaagtcccaatgggatagtagcatgctttttttttttttttttttttttttttttttgagatggagtccagccttgttgcccaggctggagtagagtggcacgatcttggctcacctgcaacctctgcctcctgggttcaagcgattcttctgcctcagccttttgagtagctgggactacacgcaaatgccaccatgctcagctaatttttgtatttttagtagagacgaggtttcaccatattggccaggctggtcttgaactcctgaccttatgatctgcccatctcagcctcccaaagtgctgggattacagacgtaagtgaccgtgcccagccagcatgctcttaaataagattgatgtcaccccttctgacctcagatcccatattctttccactgcgccacactccccctggcttccttaaggtgggggctcttttttttttttttttttttgaccattgggaggtaaacatcttaaaagcaaattttattctggttacattcattagcagaaatactttcatctgacacagcattaggtcaacaactttaaaccccaaactaccttttttttttttttttattgatcattcttgggtgtttctcgcagagggggatttggcagggtcataggacaatagtggagggaaggtcagcagataagtgaacaaaggtctctggttttcctaggcagaggaccctgcggccttccgcagtgtttgtgtccctgggtacttaagattagggagtggtgatgactcttaaccagcatgctgccttcaagcatctgtttagcaaagcacatcttgcaccgcccttaatccatttaaccctgagtggacacagcacatgtttcagagagcacagggttgggggtaaggtcacagatcaacaggatcccaaggcagaagaatttttcttagtacagaacaaaatgaaaagtctcccatgtctatttctttctacacagacaccgcaaccatccgatttctcaatcctttccccacctttcccccctttctattccacaaaactgccattgtcatcatggcccgttctcaatgagctgttgggtacacctcccagacggggtggtggccgggcagaggggctcctcacttcccagtaggggcggccgggcagaggcgcccctcacctcccggacggggcggctggccgggcggggggctgacccccccacctccctgccggactgggcggctggccgggcggggggctggaggtgggggctctttgtggaggagctcagggagacttactcttcactcctttcctcaccctgccagctccttggtgcccgggcccgaggggtagccatgctgggtgtgttcctggtctccgcagtggcccatgagtatatcttctgcttcgtcctggggttcttctatcccgtcatgctgatactcttccttgtcattggaggtgagctggtctctgtgccactggaagggagccatccagagggaggcctgcatcctgctcctgcagatcccagactgatggtgggaggcctcgcccccaggcctggaggcaaggctgctgagactgagaggtggagtcaagggggtacttggaaagcagggagggaggcagcatttgggaggcagccaagctgtatcctggggcatgtgggaggaggtttctggttggagaggaatatttgaatagatcactcatggaggaagacaaagaggaggaaactgggatgaggctgagaggctcagtatgagattcaggatattgaagtacaaactgaagaatcctggttttacatgggccactttagacctctacgaatttctgcacctgagttcaagatcttctccaatggggccttcttgttccatctcttcccaataccctggaatgggagggaagccagggagacaaggcactcctggagctggaatgacaacctttcctcctgcaccaggaatgttgaacttcatgatgcatgaccagcgcaccggcccggcatggaacgtgctgatgtggaccatgctgtttctaggccagggaatccaggtcagcctgtactgccaggagtggtacgcacggcggcactgccccttaccccaggtaagagaccacaaccctcatccagctccccatccatgaggacacacagaccaacagccagtccctccttgttccccaactcaccggccacagtcaggcaccagggcctggcttgggggtgatggactctcacgtcttggatgcatgggttgagtcaccaggaatgatctcattcacgacttattcttctctggctcaggcaactttctgggggctggtgacacctcgatcttggtcctgccatacctagaggtcgggacagacgacgctacctgcccagacaccaccaagttctctgcctgcaaaacctgggaccaggactcctgtctgcattcccaaatttggctctgagtcgaggcaacctgcacacaagaccccaccaaggaatgtgcaaggactgagatctgcagacttgtgggtaactgatcacagacctcagcatgggggtgaccagggtgactcttcaatccctatccccatgggctgggtacaggatatcctcctaccccatgactgtcttagggagacttggggtaccttatggatttgatgaatgtgggggaactcagaggaactggggccaccaaggttggaaaagggtttggttcttgactttgtattccttccaatacagcaataaactttgtctccctttttattcattcattcattcattcattcattcattcatcatttgtggaaggctcacttggatttttgtagagttgtgtctgcagaggcaagactttgtggtaggatgggtgagaatcttgggtgccccctgccttaccttctctatgccaccaccatctcccagaaacctgacccttcttccacctcttctccagctcatattgaattttctagcccctttaatccttctgctcatggcatgccctagcacattttgagaggacacgtagcaggcctcctttcctttagtagattcaggagaggcatgcctcgtatagacctgaaatgaagcttttaatttcgtgaaccccagtttctacaactataaaagggacattaaaattaggagtgtcccaactgaaggagacagaaggtcaaaatacttctgttcaaaactgtttcagaaaccagactatgtggtctgccctccccacactgattccctgcctgatgtggttctggggagacatctgtgtaagaaaagtggggaacattagtctcaggggggctgaggaccaaaaaatccagggtccctaagagagagagatggggtatttctttttttttttttttttaacacttcaacagtgtgtataagacatctttttttttttttttgagatggagcctcgctgtgtcgctcaggctggagtgcagtggcgcgatctcagctcactacaagctccgcctcctgggttcacgccattctcctgcctcagcctttggagtagctgggaccacaggcgcccgccaccacgcccggctaatttttttttttttttgtattttcagtagagacggggtttcactgtgttagccaggatggtctcgatctcctgacctcgtgatccgcccatctcagcctcccaaagtgctgggattacaggtgtgagccaccgcgcccggcataagacatctttttatgtcaataaatatagatctattttgtcacttttatttatttatttgtttttatttatttatttattttttagacggactctcgctctgtcgcccaggctggagtgcagtggcatgatctctgctcactgcaacctccacctcctgggttcaagcgattctcctccctcagactcccgagtagctgggactacaggcgcctgctaccacgcccagctaatttttgtatttttagtagagacggggtttcaccatgttggtcaggctggtctcaaactcctgacctcatgatccacccgcctcggcctcccaaagtgctgggattacaggcatgagccatcacacccagactcttttctccctctttttatgccttcttttgaataaattattattccacaagtggaatgaatgatacatttttatttcatttctgttatcttattgtatgttctttactcatcccatgatttagctttgtagctcatgttgctattctttcatttcccctaccccattgttattttggatgttctactatatttttccattctcttgttagttaccttcccttccagcaataataataaaacacacattatgattatttgaaaatatgccaattatgtattccatt

SEQ ID NO: 16902 - DNA, 12122 bp, Human
cttttggtattacagctaagaatccattaccaagtccaagattatgaagatttacctatatactttcttctaagaatttatagttttagtagttatatttagggctttgatctcttttcagttaacctttgtatatggtgtgaggtggggagggggtccaacttcattcttttgcatgttgaaagcaccttttattttttgagaaaaagtggtggcgtgtgccactacacccggctaatttttgtatttttagtagagacggggtttcactatgttagccaggctggtcttgaactcctgaccttgtgatctgcctgtctcggcctcccaaagtgttgggattacaaggcatgagccactgtgcccagccccagccccattttttgaagacagtttttctcattgaatggtttggcacccttgttggaaatcaattggccacagaagcatagtttatttctggactctttcaattctattccactgatgtataatatatgtgtatccttatgccagtaccacactgtcttctttttttctttttaagagacagggtttcactctgttgcccagggcaaagtacagtgacacgatcatagctcactgcagcctcaaactactgggttcaagctgtcttctcaccagcactgggattacacgcatgagccactgcgaccagccaatgctgtcttgatcactgtagctttgcagtatcttttttacaagattattttggctatttggggttccgagcaattccatataaattttaggatcagcttttccatttctgcaaaaaaaaaagggccaatgggatttaactttttgacttatgaagcgtggtaaatgaattacctgctcattttaaaaaattaatatgtttttttaaaatcaggaatttgcttggctttcctgaaggtcactcaaggtattaccctgtctccaggctctttcttcaatctagattatctttgtgcaaagtacagaaagtagaaaatttttttgccaacactggcctttctccccttatcccagacctgcagagagttcttgtggtctaatcttcattcctcttgctaccatgtcaaccaagcagaactattcttccttgactctttcacacactccctcatctgctccagctttcttttctttaattcccagtcactgaccctcttctcttatttagaatccaagattgtaaaagccgccaagtatgtcagactatttattcaacttctccactttgcagatgtggaaactaaagcccagagagaaagtctgacttgccccacagccagtgagtgactgcagcagcaccagaatctggtctgtttcctgtttggctcttctaccactacggcttgggatctcggtaaatagaactgggtgcagactttagtgctttcaggctcagtccccaaatcctttagtaggccattttgcccaccttggccacatgaagtctgcacacaggaaggacagatcttctctgaggcccctattttttttttttttaagacagattcttgctttgtcacccaggctggtgtgcagtggtgtgatctcggctcactacaacctccgcctccctggttcaagcaattctcttgcctcagcttcctgagtaactgggattacaggtgcacgccaccatgcctgactaatttttgtatttttagtagagatggggtttcgccatgttgactaggctggtttcgaattcctgagctcaggtgatccacccaccttggcttcctaaagtgctgagataacaggcatgagccaccacgtccggaggcccctacctttgcgtgatacctgctccttcccattattttgaagaaactgctgaatccacaggggaagtgaaactatgaggggagataaagtgttggggcagagttttgagagtgataaccacaagctaagtttagaggactgagagtttgagagtcctccctgaggacccacatgtccccctttatatcctattacagggcatggtggctttgccaatggtccttgttttgctgctggtcctgagcagaggtgagagtgaattggacgccaagatcccatccacaggggatgccacagaatggcggaatcctcacctgtccatgctggggtcctgccagccagccccctcctgccagaagtgcatcctctcacaccccagctgtgcatggtgcaagcaactggtaaagatgggcctatggtctttgaaccatgtgtatgtgtatgtgtatgtgtatatgtatgtgcagcctggatatatgtgtgtgattgtgtgggcacatgtatgattttctgggaacactccacagtctcatgtgtgactgagtttgtgcacataggactcctgtgtgtggatatacgtgtgtgcatacacatgcatgcaagtttcttgtgcacttaggattatgtctgtatccatttgcttgtgtatatatggagagaatttgtgaccatgaattgggagaaagtatgtgcttgtgggaattcatgcttgtgtataggtagagggagctgttgtgtatgtaaacatgggagaaaggtactacccagtgcgggctgccataacaaaataccataagctgggtggtttaagcaacaggaattcatttctcctaatgttggaagctgggaagtccaagatcaaagtgctggctgatttggttcctcagttagggccctcttccttgcttgcagactggctaccttctcgctgtgtcctcacatagtggggatggggttgggggatgggggtgggaactgcctctcttcttgtaagcgcactaattccatcatgagggttccacccttaggccctcatctaagcctaggtacctcccaaaggctccatctccaaataccatcacatggagggttagggcttcaacagaggatggggtgggggtggggaggggtaggggtgcagagttcagtccatagcagcaagtgtgtggttagatttctaagtctgtgttttgggtggaggcattctgttcctgggtgtgtagtagcctatgactggacaggtagaaagggaaggggtggaagcatatgggcttgagggggactggaaaggcttgagctacctaagtggccaagaaggatgctagggagcaggtgtctccctggctcttcaaacaaagctgttgtttgtttatgctttaaagagacagaactcatggagcagcagagcaggaggggtgcccaagctgggatgggggcaggtctgcctctctcagtgtaagatggagggttagatcagtgtgggagcccagataagagatgggggcaaattcacatggaagcagagctacagatgcttagaggacccaggagaaaggcacacagggacccaggagaaaggcacacagtgaatctgactggacaagaagggtagatactgagtctgcacaaggcagagaggcagaggtgccaggctggagctggggagctggcgctcttgagatggtcaggtctgtgtctggcttctccagtctcctgacacctagggccagctgagaagccgctctaaccatttccttcccctgtggcttcccaaccagtcccagggataccagacatattggtggggaggacgcctcctcttctgttcttatcctttcctttccaaggagctgtgggtcttagtctgaccaccttcccattttggtgtgagcttgctggggaggttggcctaggaggcaaggcccctgtttttttgtggtagtgaagtctctaagatctcaacaggaagtctgtgactctattggggaggagaggggtaggtggctggggcaagggggagttgagataggggaggggtgggggactgctataggaagtggggctctgacaaggaagaaaggaccagagttccaccggtggcggttcatgcctgtaatcccagtactttgggaggctggggcaggaggatttcttggggccaggagttcgaaacaagactgggcaaaaaagcaagaccctgtctttacagtaggaaaaaaaaaaaaggcgtggtggttcacgtctgtaatcccagcactttgggaggctgaggtgggcgcacttgaggtcaaaagtttgagaccagcctgacctatatggggaaatcccgtctctactaaaaatacaaaaaacctgggcgtggtggcacatgcctgtagtcccagctaccgggaggctgaggtacgagaatcacttgaacccgggaggtggaggttgcagtgagcggagatagcaccgcagcactccagcctgggtgacagagtgagactccgtctcaaaaacaaaacaaaacaacaaaaaagaccggagttcaagggtagctgtggcgaggaagaggggagggaatcagggactcaaggagtggactggaggtgggggcattagaggtggccgggtttgcagggtgtttttgggagcggggcccagggcctatgcaggaccgggtcccgacgcgccttttcttgctgagcagaacttcaccgcgtcgggagaggcggaggcgcggcgctgcgcccgacgagaggagctgctggctcgaggctgcccgctggaggagctggaggagccccgcggccagcaggaggtgctgcaggaccagccgctcagccagggcgcccgcggagagggtgccacccagctggcgccgcagcgggtccgggtcacgctgcggcctggtgagttaggggaggcggggccaggccagaggtctaggctggcgttccaatgcgctctgctgacccgcccgccgcccaccccctaggggagccccagcagctccaggtccgcttccttcgtgctgagggatacccggtggacctgtactaccttatggacctgagctactccatgaaggacgacctggaacgcgtgcgccagctcgggcacgctctgctggtccggctgcaggaagtcacccattctgtgcgcattggtgagccgagcgctgcctcccgccctgttagcccttgcctattcaaccactgccctagcctctgccaacatcctggactcacaagggccccaacttgccctcccagttgttgacaggcctagccaggccacaggttcgttcctgcatctctccctagacacccatcttctaggtcagagctggagaggactcaagagactatccgttttacaggcctgagacccagcgtctggagagactgtgctcaggcactctctgggcctggacagctgccctgggcctaccaacctggaacctgccctgatgcaagtctccctggacaagacctagatgccactgtccctggctccacattctgtgccaactctcctctattcaaatttccttcctttgcctcatgctgctaccatatcctatacccgggccttcttccgccttctggaagttcccatttgcccaggaagttgtgtcctcctcttaatgtcttctacctgccacttccctgagccagtggtctcactgctttgcttgccagttaccaggtccctgccccctaggtgcaccctctcccatcaccgtcctccccaccccacttcccatagagcgctctcatgggtcctctgttgctgccctgcgacttctggcacaaccttcattcctctcctctcccaggttttggttcctttgtggacaaaacggtgctgccctttgtgagcacagtaccctccaaactgcgccacccctgccccacccggctggagcgctgccagtcaccattcagctttcaccatgtgctgtccctgacgggggacgcacaagccttcgagcgggaggtggggcgccagagtgtgtccggcaatctggactcgcctgaaggtggcttcgatgccattctgcaggctgcactctgccaggtgaggaggtggggcggggatctgagcctggaggtctgtttgggaacaggactgccccttatggttgtgtagtgcacagttctagggggtgccattcataccatagttgctgtagtttgtatatttagcaattacctggtgggttggagtaaaatatcttgaggaggaggcatgtttttcgaattcacaagtaagcctccactagcagcagccttctttagggggctggagagagcagggagaagcaaggtactggaggcaaggggatggacaagctgactcagagtgaggctggccacattcttggctcacagagctggctggggtggctcaagggccatgcccaggtgcatagcctaccacccccactgtaactcaggagcagattggctggagaaatgtgtcccggctgctggtgttcacttcagacgacacattccatacagctggggacgggaagttgggcggcattttcatgcccagtgatgggcactgccacttggacagcaatggcctctacagtcgcagcacagagtttgtgagtccctattgtcaccctgcctctccccatttcagccacacctctttccttccaggactcccactcccagccttacagtcctcaccagtaaccaccctgtagacaccctgccatcttctccagcagttcctcctttcagctgccgagacaggacacctttgtcaccccattccctacctccttcctattccatagcaagcctccagggctcctccagctggtggaaccttggttcctggattccctgggctgagggcaccttgcatgttgtgggggaaacctgtggggctcaccttgtccctgctccctgtcccaggactacccttctgtgggtcaggtagcccaggccctctctgcagcaaatatccagcccatctttgctgtcaccagtgccgcactgcctgtctaccaggtgagagctgtctacatgtcagatcccccagccccatcccaacctttctcaattcccccaaagatacattctccgtcccccatatgccctccttccagacctccgggagcccattttcctagagctgtgacccaccatttcccttaactccccaaaactcaggagctgagtaaactgattcctaagtctgcagttggggagctgagtgaggactccagcaacgtggtacagctcatcatggatgcttataatgtgaggggccaggggaaggggagatggtgagggtgggcactagggaaaggtggaaaggggcccttgggtggggtggcagaactaagaggaaatggtcactttttggtctaacattccacagctcctacctatagtctgcatgtggctgtcattaactgttcaatcttacattcataaatcttaaaacatctgacatgcagacagcatggagctctgctctgggcaagaaaggaaagtttcaatcactgagcttttatttcatgcgcccaccatcctaggtgtacatactgtttgctacttcatttaaccctgccaaaagccttgcttcataactgttaccatccctattttacagatgaggaaacccacacaaggaggctaagtgacttgtccaaggtcacaaagataacaaacagaagggctggcatttgtccccagtcagtctgtacataaacaatgtgagatctggagcctgctttcactaagtttataaataattcagagctattcttcacaagaaccatagaattttacaggtagaaggaaccataaaaattcttagtggtttaggtcttacctctgcaactaggctgtaggcttcttgataacagggagcatctcctaaacctatggcaagaaaatctgagacagtatcaaatttcccaagataaactctgtaatgaatctgccctttagacctggcatgcacccaggttatgtgtcctgatgtggggcttcacaaacatggtctctgtacatttacagcacctggccagcctgtgaccctcagtggcccttgctggcagctgcactgaaatgctgtattagaggcctctggatcctgtatgttctatgcaaggttctcacgggtcctccctccagaaatgcctcgactgggcagaatggaaggagccccaggtggcagagggcagggtgctggcagaattgggaacacctggagaggacataaggtggggttggagtccttttctgccttcacgtggttatccactcgctctcttcccatagagcctgtcttccaccgtgacccttgaacactcttcactccctcctggggtccacatttcttacgaatcccagtgtgagggtcctgagaagagggagggtaaggctgaggatcgaggacagtgcaaccacgtccgaatcaaccagacggtgagagccagcaagcacaggcagaaggcgggcagggggaggtgggagtgggaaattaagcaggcaggaaaagatgggtggcaggtacagggagtgacatgagagcctgaggtagtcctccatccatccttcctggagcagtctgagtggcttcctcaggcatgtttctaggagttgggtgttaacatgaccccatcccttcatttactaaggggtgaggttctggatgattggtgagtttggggtatgtgtgtgtgcatgtgtataaccatggcctgattcctgcctcttctcaggtgactttctgggtttctctccaagccacccactgcctcccagagccccatctcctgaggctccgggcccttggcttctcagaggagctgattgtggagttgcacacgctgtgtgactgtaattgcagtgacacccagccccaggctccccactgcagtgatggccagggacacctacaatgtggtgtatgcaggtgagggcctcctcttcccttcaaccacctggctcccaacaaccaaccaaccctggcccgtattcctccgctgctttccatcccccccacaggagtctcctcgacatcccgactccccactcagtttcatcccttgaagcttcccatgtatgtccaggccctccccctgactggggctccctccactctctcacccctcagtgtttcactatacttaacatcctttcagctgtttgtctgtctccaactcttttgagaacttgggtttagaggttcctgggagagacaagtcaggggtgatcaaaccctctgacctacttctctcctttgccttccccttccagctgtgcccctggccgcctaggtcggctctgtgagtgctctgtggcagagctgtcctccccagacctggaatctgggtgccgggctcccaatggcacagggcccctgtgcagtggaaagggtcactgtcaatgtggacgctgcagctgcagtggacagagctctgggcatctgtgcgagtgtgacgatgccagctgtgagcgacatgagggcatcctctgcggaggtacctggagccttggggagaagggcggggtctgagaggccttcccaaggcacttaggctctgggaatctcctggcatggaaggcaaatatcaaaagattccggtgtatgggttagagggtgtggttggcatacttcaaaaagattggatgcgtgggcttgtcgtgccacatgatggccaactgtgtgtgtggagtatggttgtcaccctctgcatggctctaccccaggctttggtcgctgccaatgtggagtatgtcactgtcatgccaaccgcacgggcagagcatgcgaatgcagtggggacatggacagttgcatcagtcccgagggagggctctgcagtgggcatggacgctgcaaatgcaaccgctgccagtgcttggacggctactatggtgctctatgcgaccaatgcccaggctgcaagacaccatgcgagagacaccggtgaggcctcaggtcttgcatcttgggagcaggggcacagtggggcttgttgagctactcccatctgcctactctccgtcctgcttgtagttgggcaaggggcattgggtgacaactgcccagctggtaacctattggcatctactacacagggactgtgcagagtgtggggccttcaggactggcccactggccaccaactgcagtacagcttgtgcccataccaatgtgaccctggccttggcccctatcttggatgatggctggtgcaaagagcggaccctggacaaccagctgttcttcttcttggtggaggatgacgccagaggcacggtcgtgctcagagtgagaccccaagaaagtaagtgggcagggatgccacaaaccctggaagtttgatgggcagggtctcaactctggggatgcagagtgaagataatgggaaacaggctgggggctgaagcagaactgtgaatccaggacaaaggcagaggcaattgagcaagtggacgaggctaaggccctgggcggtgaggataaccttggacctccctgggttccctttgctttcagtgacagacagggttggacaggctggacacactgtgagcaactgatgatctgtccctatgctccagctcccacaagtgtgtctggtttcttgttcacagagggagcagaccacacgcaggccattgtgctgggctgcgtagggggcatcgtggcagtggggctggggctggtcctggcttaccggctctcggtggaaatctatgaccgccgggaatacagtcgctttgagaaggagcagcaacaactcaactggaagcaggtgaggagacttcctggttaggcccctttttagctgttcccccaccacaagaccagccctgattcctcccactgggttcccccagcccctggcacatgtaaccaacccctctgctaacttccatcagctcctaggattcggctcaaggctggcctcttaggtctagaaaggggacgaggaatcctgggatttttgcttataatctgcaacatctttctccaggacagtaatcctctctacaaaagtgccatcacgaccaccatcaatcctcgctttcaagaggcagacagtcccactctctgaaggagggagggacacttacccaaggctcttctccttggaggacagtgggaactggagggtgagaggaagggtgggtctgtaagaccttggtaggggactaattcactggcgaggtgcggccaccaccctacttcattttcagagtgacacccaagagggctgcttcccatgcctgcaaccttgcatccatctgggctaccccacccaagtatacaataaagtcttacctcagaccacagctgtcactttgctttacctcatcaaggccaaagcagactgtttatagcctgggcctcgggaaagctcttgtccatcctcctcttgccacctgagggcagggagaggtgcccaagcgcgaatgtgcaggaaactcccggggtgcaccctgggacccaggaagccaggtctggaaagggcctatgaattctcaagtgctgcggatgcaggggggtcccaggtcagagacactgcatctgttggtgtctagcctccttccgtcctgctgcgtgtgctttttcgtcttgctcagaactgatgccctgtttttgctcctacttgcttgttcctctgtggagaaggggttttaaaatggcttatagggtgctggaagttgtggggtgattatgtagggagaaaaaaggaaaacaactaaaaccagtatgaaaaagcttccccaaagaggagatagtatgtagaaaagccccattttccttttatttaaatatcctaaatatatcacgaaggaacatacactgcactttaatggtaaaaagatacaagtttataacatcttataaaaactaccatttaaaagtgatcttgtccatttgatattcccctcccccatagcaaaatattatttaaaaaaaaaaaaaacaaaaaacagggtggagaggaggataggaaggggacagttgataaaaccccagggccacagcagaggcaaagggcatctggggagagggttcgaagctgtggcggactccactaatgtaaccctccaatgtcaagccatgggcgtgatcagtagctaagtgatgacaaggctgttgggggtggacggaaaagacttggggcaaagcagactgtttatagcctgagctggtagggcctggtgcagcagcctacccggaactggcactactctttcccaggttccctgactctctatcctggtctctgagagcgtgccctacttccgtttcccccactccaaacacacctgaggcat

SEQ ID NO: 16903 - DNA, 7790 bp, Human
agctgctggagctgacaaacttgaaggccaaacacctaagggttccccccaacacttcattcagcagggatggtcattcagcttcagggggcaggcagcatgaaagcctccctacctccatccttctcacacagaggctggggagagcatcttggaggatgcagtcccctggggccaggcttctaatccagacagcccttacaaggggggacaggggaaggactggcttggagaaaagtcctagaaaagaggggaggggcactggccaccagggctgggtcgctgctatgatggtcctaggagtgcctgcctgtcctctcaggccccatgcgatgtaggacacattacttttatttatttatttatttattttgagtcagagtttcgctctggttgcccaggctggagcgcgacggcacgatcttggctcactgcaacctctgcctcctgggttcaagcgattctcctgcctcagcctcctgagtagctgggattacaggcacacactgtgcctggttaatttttgtatttttagtagagaaggggtgtcaccatgttggtcaggctggtctcaaattttttttttttttttttttttttttgagacagagtcttgctctgttgtctaggctggagtgcagtggcatcgaactcttgacctcaagtgatccacccgcctcggcctcccaaagtgcttggattacaggcatgagccactgtgcccggcgatgtgggacacattatcatctctgtgagagatttttggtctcttttgtcaccgcccttctctcccagctcctagaactgggcctggctcacagtaggtgctgaatgcatactggttgaattgtaaatgctcaggatttgtttaattaaggatgcaggaaaggtgatataccggtgtgcagaagtcaggatgcattccctgtccaaatcacagtgttccactgaggcaaggcccttgggagtgaggtcgggagaggggagggtggtggagggggctcagagactgggtttgttttggggagtctgcacctatttgctgagtgaatgtatgtgtgtgtgcatttgagagcacacctctgtatgattcgggtgtgagtgtgtgtgaggaaacgtgggcaggcgaggagtgtttgggagccaggtgcagctggggtgtgagtgtgtaagcaagcagctatgaggctgggcattgcttctcctcctcttctccagctcccagcctttcttccccgggactcctggggctccaggatgcccccaagatcccctccacaagtggataatttgggctgcaggttaaggacagctagagggactcacaggccattccacccgcacaccaccagacccccaaatttcttttttctttttttttttttttttttttgagacagagtctcactctgtcgccaggctgcagtggcgcgatctcggctcactgcaacctccgcctcccaggttcaagcgattccccttcctcagcctcccaagtagctgagactacaggcgtgcaccatcacgtccggctaattttttgtattttagtagagagggggtttcaccatgttggctaggatggtctcgatctcctgacctcgtgatccgcccacctaggcctcccaaagtgctgagattacaggcgtgagccactgcgcccggtcaagactcccaaatttcaaactcgccagcacctcctccacctgggggagaagagcataataacgtcatttcctgccctgaaagcagcctcgagggccaacaacacctgctgtccgtgtccatgcccggttggccaccccgtttctggggggtgagcggggcttggcagggctgcgcggagggcgcgggggtggggcccggggcggagcggcccggggcggagggcgcgggctccgagccgtccacctgtggctccggcttccgaagcggctccggggcgggggcggggcctcactctgcgatataactcgggtcgcgcggctcgcgcaggccgccaccgtcgtccgcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcaggtaaggggtaggagggacctcaactcccagccttgtctgaccctccaattatacactcctttgcctctttccgtcattccataaccaccccaacccctactccaccgggagggggttgggcatacctggatttccatccgcgcacctagccacagggtccctaagagcagcagctaggcatgggagggctctttcccaggagagagggggaaggggacagggttgagagctttacagaggaagtggacagcatggagggaggtaaggaaaggcctgtaaagaggaggagacactggctctggcggaatggggactattggagggttaagcggatgtggctaaggctgagtcatctaggagtaaacaagaggccttcctttgggaggagccaatccagggtgtagggggcccagagtgaccaggtgcactagggaaaaaatgccaggagagggccaggaagaggacttgttagtagcgactcacttctgggcaggcaggccagccagctagccagcctgctgaggcttcccaagaggggcagagtgctgggatctgggaatccaggaaaggagggaatggggtggggctagatgaaaagggataggtgtccagggagagcctctggctattcctgggaccaggaagttttcactaggatacataacactttttacacactcaccccacccatccctggctttctattcatggaacaacctctctctacaatccctccagatcttcgcaaatactgtggacaatgcccgcatcgttctgcagattgacaatgcccgtcttgctgctgatgactttagagtcaagtaagtttgggggctagagagctgggggtccaggggtggagctaagaaggatctgctccccaggctgggtcagttaggggctcacagtgggatcctgttaggtgtgggtggatgagagtcagggtccatcagtgtattcatttaactgttcatttgtataaccccgtttaagaatactgtcctccaagtgccaagaatggtgctcaggggattaccacctaattgctgactcaagttgctggtttgcaatgggcacagaacttctcttagtaggtggcatgagttgagaaggttctggatcagagataggggcccctctgatcacctccactcctataggtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggcaagcaggggccactggccaggccagggattgaggggccaagagaagtctgggtcggagaatagacaagacaaaccaactgcaagtagccttgctaagacgtttagaaatagcagcctgggctcttcttaaataagaccgttctgatgaagagcattctcagggggtcgagtacaccctggctcacctgaattacaggtcaaaatgatatgggttagaaaatgagatgagaacagaagtagaagcagctaacactaggagctgggggtgataaaggaatgacagcagatggagttggcagcgcttcctaaaagatggtagaaggagcaggtttgtgaaggggagggtggataaaggaacagggtgaagttacagagaaaccatcagtgagtgggtggcatttctacccactggagtagaaaggccagaactggcattgccctgagtgcaagccaaggggttcctcctgtctcttctccaactgtaggcctcctagaagaggcaatcacagaagaaaggccttgttggagctctgaccctgaaccctcctcacttttgcccctgtcacctttaggaagtaaaaggcctacaagcccagattgccagctctgggttgaccgtggaggtagatgcccccaaatctcaggacctcgccaagatcatggcagacatccgggcccaatatgacgagctggctcggaagaaccgagaggagctagacaagtactggtctcagcaggtgcgtgaggggaggggatggctgccaaggtgtgggagggaggcagacggaatgaggggcctgatggactgtccccatcctgcagattgaggagagcaccacagtggtcaccacacagtctgctgaggttggagctgctgagacgacgctcacagagctgagacgtacagtccagtccttggagatcgacctggactccatgagaaatctggtgagtgccttcacatcacctgcccagctcctccttcacttggcctcagacccaaccctgtctcaacccaaatcctatccctcatatcatgagttcctttagctcagaaagagtcagtttcctctttgcatttccctccactcctatcccttatcccagtacttggcacatagcaggtgcccaaaaaagtttccaaaagtgaagggatgagcagtcctgggactctgggctcaccctgcccctcctctctgtgcccctgcagaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaagtgagtggggctctcctacccacacgtgctgggatcaggagatcacttctccccaaagtctgagcttttggaagcaccccatgtgtctgttcactggtatccactgagcactgggccgttgctccgtgggtgctcctgtgtcttcaagggagtaacagttacagaggtctcccccttgaagaaagcaaactaagtattgtccctagctgtacttagtatgcaaatgaagtttggccttgagtttcccttttctggaggaagaggctgagggtgatttggagataaaggtagaggtcaggaggctttttccctctacctttcttgtctcccttctactccacggggctgtttataacttgggcttggtcttctgttacagtcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttcattggatgtcactttgtcttcttttggctgttttcattgtgcacaaatgccctaacccaacagtcccatccctgatccagcagaaaccacctctgacccctgagggtttcatatagattggggtgtagaaggaagagggatctgtattcttggaaacacttctgagagacagaggagggagcagtagatgtgatgggtcacaggctgtggggatccctacaagggaattgtggaatctttgccttgaagcgatctggtgttcaaaaggtccctgactgatcattagcagaaatctgaaccagaggaggaaattaggccaaagacagaggacagaggagacagggagacacatctggccctcccctaccctgctgctttatgcccttggcccactgcccagggcttcccacccacagttttttcctccaaccccaggccatactcatcctccaaacctatggtgccctcaactctgttcattcactcaacggagatatgatttttagggtgctagaggtctggctagaagttgagtaaatgatcatggaagttcccatctaggaaagaggtgcccctgagtaagcacccgtataggtaaggatgggcatcttaaaactaaccgaggctgggcacagtggctcacatccgtaatcccagcagtgccaccacacccggctaatttttgaatttttcatagagttgggatttcactatattgcccaggctggtctggaactcctggcctcaagtgatcctcccgcttgtaccctttggagtgattggatgccactttgtgtcttccttggctgttttcatacttgtgtgaaaatgccctaacccaacatgattacatgtagatattcgttgcagcagttttgccaaaacaaaactactaaagatcaaggcacccatcactcaaagacctaggttaggttaatttttttttttttttttttttttttttttgaggcagagtcttgctctgtcacccaggctggagtgcagtggcgcgatccgggctcactgcaactgcctcctgggttcgagggattcttctgcctcagcctcctgagtagctgggatttcaggggcccgccaccatgcctggctaatttttgtatttttagtagagacggggtgtcaccttgttggccaggctggtctcgaactcctgacctcgtgatccgcccgcctcggcctcccaaaatgctggattacaggcgtgagtcaccacgcccggcctaggttaatttttaaaatgttgggttaaggcaaaaaaaaattttttaatttaaaaattagccaggcatggtgacatgtacctgtagtcccacttaatcaggaggctgaggtggaaggattgcttgagtccaggaagtaaaggttgcagtaagctgtgatcatgccactgcatttcagcctaggtaacagagtgtgactctgtttcacaaaaaaaagctggccgggcacagtggctcacgcctgtaatcccagcaatttgggaggccgaggcgggcagatcacaatgtcaggagattgaggccatcctggctaacatggtgaaactctgtctctattaaaagtacaaaaaattagccaggcagctgggtgtggtggctcatgcctgttatcccagcactttgggaggccaaggcgggcggataacttgaggtcaggagttcgagaccagcctggccaacatggtgaaaccctgtctctactaaaaatacaaaattagctgggtgtggtggcacatgcctataatcccagctacttgggaagttgaggcaggagaatcgcttgaacccaggaggtggaggttgcaataagccgagatcatgccattgcactccagcctgggcaacaagagcgaaactctgtctcaaaaaaaaatatatatataatatatatatgtgtgtgtatgtatatatgtgtgtatatatgtatatatgagtatatgtgtatatatgtgtatatgtgtatatacatatgtgcatatatatgtgtgtat

SEQ ID NO: 16904 - DNA, 11835 bp, Human
tttctggaagggacttcaatgtgtggggtgtgtgtgtgtgtgtgtgtgtatgcacgcgtgcattgtgaagagagcttgtctgtgtgtctgtctttttaagtttgtctgtcctccaaggagggggcttctgggtctctctgtccttctgggtaggggtcctatgtgcctgtctttctgtgagcctgggtgtctctcctagagaaggatggggaagaaactgtacatctgtcctcccagtaggtggtcacccccttccctgggtcagggctatgtcacctgtccctctcctcaaggggatctggctgtcatctgttggtcctctgagttcagtttcatccagtccccacatcacaccctgcagtatcttccagagaacccagccccagccatcaggtaattgcaggtggaatctctgccttggggacctaaacctcctgccttccacccacagcatgccctgcctggccccacccaggcctggggtgccttgctcagctccccaatctccaacctcccacaggtgcgtgctacgtcccaacctgccctcctgactcactttgataatgggagacaggtgcagggactcttcctctatttcctctggcccgttgggagcctgggtaaagcaggagggtccaggtagcaccacgagtgccacaccactccactgtaccccctgccgtcctgtctcacttcccatgattcactcactgggagcaatgggagtgactcccgcaaagagcaagaactatgaagtccctgacatagctcccatctcctcttgccccccccaacccctgcgttctctgccttctagccctgttcatcattctctaggcccttcagtgaggcctacagtgttcacctggcccaggggatcctaggatcttggaaggagaggaagcccctgggttatgttcaggaaaagtgctgtgttggatctcgctcttttttttctttgagatggaatctcgctctgtcgcccaggctggagtgcagtggcacgatctcagctcactgcaacctctgcctcccgggttcaagtgattctcctgcctcagcctcctgagtagctgggattacaccatggccagctaatttttgtatttttagtagagatggggtttcaccatgttggtcaggcttgtcttgaactcctgacctcgtgatccgcctacctcagcctcccaaagtgctgggattacaggcgtgagccaccgtgcctggccttggatctctttttatcttgcaccttcagatgtagagggacgacagccactgtgtgtgtatgtgtatgtgtgtgtgtgtgtgtgtgtgtgcgcgtgtgatgtttattcactcatttatttattcattcattcattccacaaatatctacccagaccctcttggcactgcaccaggtgctaggggtagaacagtaacctggaaagatgaggcaaatggttgatttcagattcaaggctttggactccagctgttctgtcatccagctcaggcaggccctcataatcgcttcaatcagggagaacacaggagagtttctctggggtgtcggcagctcagaggagacccaaatactaggagacccctttttcccatgcttcccagtcctccagtttatttcccccaggagggagggagacaagacccaggagtcagggttgtagtggctgggcggcccaggcaagtctgcttgttacaggcacttgtgccaggacaggatttcttccagtttcatattcactgaactgccttttcctgggtttctgggggtggtgctggagtgggctccagggttggaacgggcccttgggtggcggcagctctctgctgcccccacctgagtcctgcccggaggtggcaggtgacgggttaggcccagccccctctgggcctagccactcaggtacgaggcctttcccccccatcccccggggctgggatctcttttataaaaggccattcctgagagctctcctcaccaagaagcagcttctccgctccttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtgagggtcccccctgcgtggctgactgtgcccgcagcccctttctcctggtagtcccggtccctatgcacatctccagcccccagctggcgtcctgctgggcctcacccgccctggcgacactctcccttccatcctccgactcacccctcccgtgcaccttggtttgggctgggtgagggtggggagagggtctggacagccgggatgaatcctggggcttccttcttcccttttaaactggagggtcttggaagagagagacaacttaagggtacagcctagttcccaccacccctctctacaaatcccgttcttcctcaggtcattctgtccccaaattataaaaaataatagcggttattgttctcaccccaacccgagttctgaccgtcttttaagctatcgccctgcggcagtcccagctgttcggggactaccctcctccaggttcgcctcttcgccagcactaccccaagggctccccagtggtgcctttgtgattttttttctttcttttcttttttttacataggggtttggtgtgattctagcattctaggagaaggaagtgggtgtctcggttcaaacgggcaaatattgattgaggcctttggcgcccggaggcctgagtgcgggggtcacagaatgagtcataccccggcccctgcgccggcagcgtgggcggggccgagggcggggtgaggggctgcgggcagcagtctcgggacgctctcctccacctggcggagctcggcgtcgggggcggtgtgggtggggtggggtggggtggggtgggctggggtggggtggaggaggcgccagggcctggcctcggaaagcccatgcaggattcaaagtctgcgggcgtgggacgccccgcccggggtttacgtcctgttaagtttatggcttcagataacgcggtcgcccaccaacgcccctcgcccattcagcccgtgtccctttctcgcgtcctgtccctgctccgccccagcggcctggctccactttcacacagcaggagccaggccgggttttgcagccctgggactccgctgcctgaggggccccgggcccccggcggccccgaggattgggcccttcacgctgactggctcctgggaggcattgtgggaacgggaggagggaaatcctggggcagagtaagccgggaggaaccggagccccaggaacccagtggtcgggggcccttggcgctccaagcgcctggacttgacttgttgactgcgttttgctagccctggggtccttatagagagcagctaagcataggctttggaatctgaattcttggttcgcactgctctgccggttcctggttatggactcccttgccaagtcttatttcctcatctataaaatgaatatgagagcccctaaatccatataggcaaaagtttttgcctattcaaacttacatatgtaaagagttcagcagtgcttggcccacattccattaggataagatgttataatcacttttttttaaaaaataattttggggcagaatgacctggggaagaaagcgatttgcagagagtggtggagggaactaggctgtacccttaaaagatttctgtcccctccagtttagaaggagttacaagtttttttgtttgtttgagacagagttactctgtgcccaggctggagtgcagtggtgtgatctcagctcactgcaacgctccgcttcctgggttcaagcgattctcctgcctcagccaccgagtagctgggactacaagtgcgtgcacagcccggttaattttgtaattattgtaggcaaggttcaatatgttggcaggctggtctcgaactctgacttcagaaatccgcctgccttgaccacccaaagtgctggaattacagcgtgagcctccacgcccggcctctttttcaatcttaacatctttagaaaggttggctatttttggccgggcgcggggcttacgcctataatcccagcactttgggaggccaaggcgggccaatcacaaggtcaggagttcgagaccatcctgcctaagacggtgaaaccctgtctctactaaaaatacaaaaaaattagtggggcgtggtggcaggcaggtgcctgtagccccagctactcgggaggctgaggcaggggcaggagaatggcatgaacttgggaggcggagcttgcagtgagctgagatcttgccactgcactccagcctgggcgccggagactcccaaagaaagcttggctatttttattgatgtgtaatatacaacctatgtaaatgaagttaggcctattggtttgcaaatgcagctttaacataattaccttacctgtctccttcccctacccaatgctgagggacattgctccccacctcaccatcatgccatgctttctccccctggtcataggtgatctttccagaacagctaaccaggtgcctggggtctggagaccttactgcttgaggagtgaattaagagaaaagactgcttgctttcctccagactttgagccctggcctgatgtagacctttttgctctctcctccttcgtataggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtgagcaactcccaccctccacccaactgaagtcaccgtgctctcctccaccccttgggaccttgggactaagtccccatggccctctgttgtgggaagtgcagtcctatctaattagggtgaccacctgatgaggtttgctcggaacagtctgtgtttatgcccaggttcctagcacaattgttgatagtacccaccccctttcaatctcaactgtctggatttgaagaacaaattatgtgtcaatgttgacatggtaaacctgagacgggagagataggcagcctgtgggcctcacttttgtacttaacattctggcccctctttagtcttgacccttgacctctagcaaactctagaaagttctgtctgaggtctcatgtcaggccctgctgttaacactctcaaggtgtccaatccgatgtgtattcatggatttggagagagatttcctgcttcccacgggctaagggaggggtgagggtggagagggcagctggggaaggcagaaggaccagccttctcatatcctgcatctctgtgaactgaattttcctgattttcacaacgcccctgtctcccaaaagaccaagggcaacctcccttttgccttcatcctctaattgtaagtcttttcctcacaggtatgaggatgagatcaataagcgtacagagatggagaacgaatttgtcctcatcaagaaggtgagggagtctcccttctcctatctggacactggaggctggggctcagagactcagaccaagaagctttctgggttttgtccctaaatattcctaagtagtgggacaaactcatttatgtaaacatttgggtgcacagaaaggtagacaaggatggagtggtaggtgcatttggacagaactcttgacatcggtgttgggacatggttcagaaaacagagcagtagaactggagatctggctctagaaggctccctagagaaggaggtggaagagggtgtgttgcaggaagcagaggtgaaggtgtgtgggctgagaatgcacatgtgatgggcagaggctgggctggaagatcaatccacaaagtgggcaactagaaagtcctgtgaccaggccattgggtggaccttgggagccccttggttggggttgggtgtggaaacccagctcaggctcccctctcctcatcccccaggatgtggatgaagcttacatgaacaaggtagagctggagtctcgcctggaagggctgaccgacgagatcaacttcctcaggcagctatatgaagaggtatgttcctggtcgcaggagagtgagggtcccccagccttgtcagcgcctccaccctgagactcaaccagaggctcctcccagcccccagcacactaataagacaaaggcccactgctgactaattacagccaccaatatttgctcggctagtatttattgggtctatatgttctgtccctcgcatgagggatgagtcattaccccatttcacagacgagaaagtgggctcagagaagtgaaataacgtatccaaggtcatcatagggtgtggtgattcagcagcaactctgtccccaaagcccttgttcctaatctttgagctgcattggatccctctgtgcacctagtattggtgcacccagttcctttttcaggaactttgccctctccctgaccctgactcccacctgctcctctcctctgctgcccctgtcttataccctaagaaaggctgttgtggaaaagggggctccctgtgtgcagagacagggcctcaccacttgccctcttcccccacaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccaggtatgggccgggttgggggtgggaggggttccttggacacatcctggtgagaggagataatgtaggaagagtgaagtttctgggagtcggggaaggaatcctagaccagggttcaggagttggaggggcagccacagttcagcttctcagtctgcttctgagaagcaaagggatgcagggaaggtcccttgggccaggacagaggtgaaaggggactggggcaggtatgttggggctcgtgatacatgctcccaagcctgctttaatcagtcatatgcatcagggtaaggttgagctctgctgctttaaggaaagtctagaacccagggatctagtccagttagggtagggggaccttacagtgtcgcaggtgagaagggtgtggaggggaagcacctggaaactgctcatgtctccctgatctgcttccttagtctcgtttatttatttatttatttttgagacagagtcttgctctgtcgcccaggctggagtgcagtggcgtgatctcggctcactgcaagctccgcctcctgggttcacactattctcctgactcagcctcctgagtagctgggactacaggcgcccgccaccaggctggctaattttttttgtatttttactagagacggggtttcactgtgttagccaggatggcctcgatctcctgaccttgtgatctgcccgcctcggcctcccaaagtgctgggattacaggcatgagccactgtgcccggcccttagtctcatttaatttgagctggggggagtcagcctaggtggtggtggggaggaccctgagggagggtgggagcacgggagaagagaaggcatacccaacctgacctacttacctgtcccctaccccacagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggtgggtgtgggtacctctgaccggacctgcttccctatccctgggacctggggtggggacggtgggagccccctgaagccccttgggacttggggtcctgttgttctgggccaagaagggctaggagttggtcctgacaccccatttgtctgggtacaggctggagtctgggatgcagaacatgagtattcatacgaagaccaccagcggctatgcaggtgggtgtcccagggccctgggatgagggcgggaggcagggcccagggaggcctcagctccagggagggggctgtgctcagtcgctcacagtgacctcagcctgagcactcatgttcttgggagaatcctagggtggggaggcacatattcaggaccccagtaataactttattacttagtaactttactattagaaagcacccaaataaaccatagctgtgtgccaggcactgtgctaagtatcctacaggttttatgtgatttattttatttattaatttaatttaatttttttgagacgaagtctcgctctgtcacccaagctggagtgcagtggcgtgatctcagctcactgtaacctccacctcctgggttcaagagattctcctgcctcaggcctcccaagtagctgggactacaggcgcataccaccatgcccagctaatttttgtatttttagtagagacggggtttcactgtgttgggcaggctggtctcgaactcctgaccttgtgatcagtgctgggattacaggcatgagacactgggcctggctgtaatttattttttatatgacacctgtaaacgtcttcagttgaggaagctgaggtgcagctaaatgtccaaggtcacacagctatatatatggcagctgttttccaccctgctcctggttttccctgacagttctggagtagtgaaccatgcaatcactgatcaggcagagctgggttaacctcccatccctggggctatgttgggaatgagcagggagaaggggcatggagcctgccatggggtgggcttctgtactcatgtggctacctctgtccctcaccaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaatgtccttgcttgtgtgtgcatctgatgtccactggggtgggagggaggtggtcaggaggcctcttcttgggactgagaagctgggaggggtccaggaagcagggggtgcacagcgggaaagtctgaccccctcagctgttcctaaagaggctcctttattgaaacctggttgaaaccttgcttgttgccatagatatctacacctgtataatagtcattgacctgtgcacagtgctttctggtttacagtgtgctttcaaatcccaaggttcatgtgatctgtgcagcaaggctcaagaggcaggcagagcaagtttttgagggcattatcagcagagagcttagtgtgcttcccctacaccttggcatcaggactatctgcatataaggaaagccaggctcagagaagccaagtagttggctcatctagaaactagcagatttggcattggaacccagagctgtccagctctcaggcttgtactcctccttggccaggcacatggcctttccttgtggccagacatgtctttttatcaccttcaatctttgcagtcagggactaaggcatcctggcttttccatcccctcagaggttcagagtctattctcagccattgggtgtgtcatacccacaatttctagaagctagaaattgtgggacttggcccttccccactccactcagtcacagccaccacccccttcctatcctttttacaagctgtgtgtatgatataaagggcgtgtgtgcattctgtgtttgcatgtggagggtgtactgtgtgtgcatgggtgtgcacagtgtgtgaaggggtctgcctgactcttgagacaacctccaaggttcagggcaggaggggttaggacacagctgggtggggcagtgcatccccacagtcctgctccactgccacaagcacagagttccaggcagccaccctgtccattcagcattgggctaagtgcacaagcccttagcacgactgagatgggggcatttccagactttctgaaacaccaatggagattagacagagacaggcagagggtactgtgagtggggacaggctggtgcaggaagctcctgtcaggctctgctgtgcggtctctctccagggctcctgtctctgggtcctcagcttcccagcccctgggctcccctctgagggccccatctctgcacctccctaactaccacacagtgcctccctagctacccacatcgatggagctgggcttccagactgagcccaggaaccccccactgccaacccctcccactcagccccagggccaggcccagggatttgcacactgtcaccttagaggatctcactctttggtagtactcattaacagcaccattatccagagcaggggatctattttggcagtggtccacagtaagaaattcattttatcaccacctgcaaatatgtatatatacatatatataactgaaacaaaaatttcatgaaacaataccaaccttctgccttctgctcacatgtagcctggccctcagcaagaatcaggtgggtggtgtaagagcccagcgcagtcacagcacccagtgagaaggatctcttaccatgggtgccctaagtcaatattttcaattgtgcccctcccaatcctccctgaagccagtcacctgtcttatctggccctgttcccagaagcaggcatgctgggggcagccgggggccccaccagatagtctcctgggagtttccacgccctgggtgtttgctcagggaaaggcaggatggctccagggagaattccctttccctccctccctgcttgctccttccaggttctggtgcatctaccatgggatcaaggtcacccagcattaaggggacaccatccctcccatttatctttcagaaactacacagacagaagagctggaaatccaatggtcatttagatgaggaaacttaggaaggacaggagctgacatttcttaaatatccatttcacctgcttgt

SEQ ID NO: 16905 - DNA, 11613 bp, Human
aaattggtgaatgggtctagaaggagaagatgttcagtggagagagtggggagggagaccagggtgtgagggcagaattaaaatgcagtaaaacatgcagattgggtgcctagcacaaatctggctcaatttccttcatagaggcattaagacccccctgaagctgccatagtgtgagcacagtcatggtggagtaagggacgactagggcattgctcagatatctgtagataatgacacattttgctttggattgagactgtctccaaagctgttagcttcatgatttgtttgcatgattataattatgcaaaccagattggaaaaaataattgaggagacatgtagctttgtttccttcagcattcttttactgcaaattaaataccttgaatagtagttaagacaggattggaaacttggcggggaagatgcagaagggtgaatagcatttattgagtttctgctatgaactaggaactgtgtttagcacatgtgtgtattgttctgttttcacagtagccatattcttattattcttgttcactttttatagatgaggaaactgaggcttgaagaggattatggattatctgaggtcatttaactaagatacaagaaaattgggatttgacctcaaacttatgttttttacattattttgtgataacttggtactaggatctgaaccacctggttctgtaatttatgatgcctgtggagagtgcatgttcatagtagccagaagacagtaacatggcaagggggaaaggaaaaggaattatctttgtctcaccccaaacaataatgatactgacattttattgtgcacggtggttttcaaaacacttcatacgaatttcccattttatagctgggaccacagagcctcagggtttcattcaaggcctcacagccaataaatagcaaaactgggactcaaacccagaatttctgactaaattcagttttattactccaagaacctctcccacatagttggccacatggacagaggaagtggttgagtttaagtgtgagtgctctgtgcaggctggatggtcttcttatcctcaagcatctgtggatgtcattgaagagcctgacttcctaatcacttcccaggatcaccaggcaatacgtgattactgactgactgaatcaatatacacttggatcttggtttgcaaactttcacttggtgtcccgcatcacacaggtccagaaacagcgaaacttttctcatacctctcaacctctgggtgttcatgtagacaagggacagttgatggttatacaaaccatcatggttataaaaaatctctattcggtgcctagttattgtgtatttttggtgtggcatgggaagaaaagagccaagatattttgaaaatcgacacctcttttgcagtatccgaggccaattactttctgtaagaggaggtcgatttccaattagcatttaaggtcatttaagacctttgcagtctcccctgcactagttggggctctttctgggaaagagggaaactacaagagaactacaaggctggcattgaggggctcttgcagtctctaaacccaccatccctttcattgttgaactggggtggtgagcctgcacaagcatgggtggtagctgacttcccttgggcaggtccagaacagggagcagcattctgcagaaggtccttttccagattgagaaacccaaaccctgatctcctcttttgatgattttacaaaaatcaaattgcatgacagatgcccagataaacagaagtttgcaatcaaagcaagttctgggatggagctgattagtagatttttaatggctattagcttgataatcacgcaccaggaatagctcccaggcagaccaaacccacgtataagtggatccacacccatgtacacaacacctagttggcaggtatataaggggaccctgaaagcctcccagcagcacagttgagtctccagccttgactcttctcaagagcctgtgactttcctccctggacaaaggcatcatgagttgtcagatctcttgcaaatctcgaggaagaggaggaggtggaggaggattccggggcttcagcagcggctcagctgtggtgtctggtggaagccggagatcaacttccagcttctcctgcttgagccgccatggtggtggtggcgggggcttcggtggaggcggctttggcagtcggagtcttgttggccttggagggaccaagagcatctccattagtgtggctggaggaggtggtggctttggcgccgctggtggatttggtggcagaggaggtggttttggaggcggcagcagctttggaggtggcagcggcttcagtggtggtggtttcggtggaggcggctttggtggaggccgctttggaggttttgggggccctggtggtgttggaggtttagggggtcctggtggctttgggcctggaggataccctggtggcatccacgaagtctctgtcaaccagagcctcctgcagcctctcaacgtgaaagttgacccagagatccagaatgtgaaggcccaagagcgtgagcagatcaaaactctcaacaacaaatttgcctccttcattgacaaggtgactctggagaagacggctcccactgatgctcaggccacttcacttccagagccaaccaaaaagaaaatggcacagatttgtatttcttaggagccagtggtgtaccgcagtagcctgggtcatttgcggtttccagatggaaaagacgccagctttgtgggttacatttcccataacagcctgcacttaggaagcatttgtccctttgaccttattgttacagtccatataaataatatttatggaaaattctgaaaaccataaaaaatggatataggcaagtattgaactgatccttgggacaggccactggagcagcaggttttggaagccatcgtcttctgagatagtgtttccttccttagcagtgattactaaactctgggaagctgaacctgaaatatctgcttgggaatgcaggaaattcctgccttcaagagaagcgttctcagttttgtgatccataaagtctttattggtgtcacttcggagtgttactggcttttctcctatttcaaggcagacgaacctgtcttggtttatctgccttgaaataggcagggatttacaaggctcttaaaaatcaggctgaggagccctgccctctgggactctcatactcagcacccttgcgagcagtgccagcagatggctgctttcggttttccccagaatttatgggatcttggctggaaattcaaccaggatgcggggagggaaatggtctagagtattgggagcagctgcaaacaaaccagtgagcagtgaagcagcaaagagtctcctctgcgtggagagagccggatgtagcattaggagtctgtgggactttccaggggcgaaagcagggagctcagaagctctgccagtcatgactcggcatccagcctcagacacttctcgaggtcctgaagcagcacctgagctgcccctggccagcgtggcttgcttggtgtgaaggatgatctagaactcatgtgctctccttctggtcatggcaggtgcggttcttggagcagcagaaccaggtgttacagaccaaatgggagctgctacaacaaatgaatgttggcacccgccccatcaacctggagcccatcttccaggggtatatcgacagcctcaagagatatctggatgggctcactgcagaaagaacatcacagaattcagagctgaataacatgcaggatcttgtggaggattataagaagaagtaggtggcagagtgaaacgctgagtggagataaacattgcactgagccatttgatcactccctggaaagccattcatctcccagttgcatttgtggtggtaatggggagaggcatatgtatctttgttgattatttgtgaggaagacagtgagactttagagatcatttttgtcttttgtatgtttgagagttagtttataaaaatatatctttagtttggaaatcttagtttcaatttagatatttaaaaagtgtgtaatattcccagagaatggggcatttggggtgaatccagtataaaaggaaaagaaaaaaaatgaaggggaactaatctaactgctgtaacatctgtgtcccaataggtatgaggatgaaatcaataagcgcacagctgctgagaatgattttgtgacgcttaaaaaggtgagcgagagaatgtcttggctgggggtggggataggagtgcttcacagccccattgtgtataagcagccagtttggaaatcaactgtgagtgcaaaagcagcagccagagaaaggagtgagacccatggcacattctcttgcaaacaaaattgtctctgtaggtcaagcttctggatacagttttcaaagctgttctgcatttttggtagagtgcttcccagtagtaacccacttaaagcctctactgaatcatgataaatgcaaacacaaaaatctctttgtattctccttctaaagagctgaggaaggaatgggacttcccttagaatgcctgcttaaagttgctgttggttgtgctgacaaaggtttgaggttgtaggccaaaagcaagggttctcctgctgggtcctgcagggcctttggtgtatattctggggaaatttcggagaggtgagatggacagacgggatgagagagctgaggactgtggaaacccacaaagaacatcgtatcctgttgtagaaacacacagtgtctcaagcaggagagaggggctggttggcaaagcttggtcatctcgaggctctgatggtcctgagggctgtgagccatggacgtaggcatgaagtccctggcagaggtgtatggtaaactgcacgacaaaagaagtcccatggggacagggatcaggttggggagcctgggattttagagaggagccagcagggactgagtagaggggagtggcagagagaggaagaggcctgtacagggaaccatacaccagaggcctcaacctttcttgcaggacgtggacaatgcctacatgataaaggtggagttgcagtccaaggtggacctgctgaaccaggaaattgagtttctgaaagttctctatgatgcggtaaggaggctgctccgggacagtcccttacttcccacccttctcaccaaatgaaagtcctttctgcttggtgaaaaagtggcagaagtggggtttatggaccagctgacttcaatctgccatcattccaggccactgggggggctttcatagcataggtcttgtgggtgaggaattttctcctccgatgttatgggaataaggttcaggaaacaccaggacagcttcccctccctccattccccagatgtccatttcccctggggaagagacaagccctgtgcccattcctgtgcctactgtacttcagaggtcaaaatgcatttgtctcctatccccctccccaacccaagggtgcacagatgatttctgaaacaggaagtccatttaaggtatttgccatggacaagcttctgtctgggggcacttaccataactggcttaagtgctgaatgttaactaggaggctcagaaatacaggtgcctctcactacaattctcaggacaaccttgggagaggcccaggagtagacggttacatgattttcatcccacctagtgtatgcttagtctgagggtctgcgtttcccttatgctgggagacagaggcctcctgtctgcctgtagctatggcaggatgtcatgaccagaccttcctgtgtgttgtaggagatatcccagatacatcagagtgtcactgacaccaacgtcatcctctccatggacaacagccgcaacctggacttggatagcatcatcgccgaggtcaaggcccagtatgaggagatcgcccagaggagcaaggaagaagcggaggccctgtaccacagcaaggcaagtagagggaatgtaggaagagccacagctccctgccatgagctgggttgcacccccagctggaaagtgtacagtaaggttattggttttttgtttaatggtagttgggcaccattcccaagaaaggatgttgagaatggcaccaagtccttttgggcatgtgagacagtccctacctctcatgaatgcagccatgacatttagctgggttgaccctccctggaccagtaaccagctctccttcactccagtcagtctggaatgtgagccaggctggaacttccttgcaaactgtcctcttctccccatatcagtatgaggagctccaggtgactgtcgggagacatggagacagcctgaaagagatcaagatagagatcagcgagctgaaccgcgtgatccagaggctgcagggggagatcgcacatgtgaagaagcaggtgaggcccagccctgtccagcgaggggcgggaggttgtctctgggtgtgcgtgagagtgtggttgtgtgtgagtgtgcatgtgagagatgagagacactgagatattgcactctagcatgtatcgatcccaaattccccagcttaacataatttatggcttattataacaattcttagagtgctctaatagacattccaaagtaaggattatcgaagggaaagaattgtgctcacttgtttatatgaggaaaagggagtcataacaaatagagcaaacgttagtttgattgatttgctgcagattgccgatggagcttcccgtttgtgctcagcacaggccctgagcaccagccgactggtttcatagaggggcagtgagtattgagggcagctggcctggggctggacgttagctttggaatagaaaaggtagaggcagagagtggattccatcagcagcagaagctttgccaagcagaccatttcaaatgttttcatttccatctgtaaaatgggatcatgattcaggccctgtgatgtgaggatcaaagggcactatggggaaagccaaagggtgtcatcaacggtgacatgggaagaagatgtgccagagacagcggcaagtcttagcacagttgtttgcgactaaactccagaggggacctaacactcccagggccagtggttctggcttcctgcacttcgaacacctctgctctctgtccgcctccgtcaggcagaatccattctctgtccttctgtcatagtgtaagaatgtgcaagatgccatcgcagatgccgagcagcgtggggagcatgccctcaaggatgccaggaacaagttgaatgacctggaggaggccctgcagcaggccaaggaggacttggcgcggctgctgcgtgactaccaggagctgatgaacgtgaagctggccctagatgtggagatcgccacctaccgcaaactgctggagggcgaggagtgcaggtgagggcactgggaagggagaaggggaccctggcccttcctctcatctctcccagagccagggctggaggcaaagacagggaaagcagagaatggggcaggccctcctgacaactgagaactgacattctctgtgttccccaagcagaaactcaggacataaagcatgattggagagttacacatttatcaacatgaaatgatgcataaggcacattaaattaaactaagcagtaagttaaacatcctggtcttttctgaaagtgaaaacaaaatcatgggaaaacaggttagtcctagacagtctgaaactttggtctctaggtccatagggtgagtggcttctgtgccctccaccgggtgacccagaatgggggagatgatgtctcggaatgtgctgactggtggggacgtgctgaccggagcaggtgccagccccagttctttgcaggtttctggagtgacaaatggaaccatttgctaactttcaaagaggcaccctttgcttcctctgtagtctgagacctttgtccgtattatcagcatcttgggtgacttaatctggctgaagcaattggaaggggaaaagctaccccaggccatcagcaagccagcatgacaaacagggagtggctttcttcaggaggttgctctgtccctgtctagaggcaatgcctcctatgcccagcttgtaagaggaagtgggaaagttttcagttgaagctgaagagggtgggaagaagagaggaatggggaggctctacagagtcacagttctttctgaactgaatgttcacaggcagcctcattgtataatttctgatgtggcatggattctgaataacagactctccaagatggatttaaatacacaaatgggttgcaaagtaggaagtgaatttgcttttcagtgaccttggatcaaccacgcaactgttcattttttatcagagcaaaaattgagagggattgacatgcaaggttgtgcataaatggaagggggtctgtcgtcattgtgtgacctggcagcatagaagaaagtggggtgtgtaagccctggtggctgcttagagaggctaaactgcacatttgcgggtggaagtggtaaaacaacatgcatacagaacctaagtgttccaccacaacttgttttttctctctcccttacaggatgtctggagacctcagcagcaatgtgactgtgtgtaagtaatggggtgtggtcctgttccatggggtgttgtgtcaggtggaggcagggagaggcagtcataatctctgtggtaacaccacctctctctgcagctgtgacaagcagcaccatttcatcaaatgtggcatccaaggctgcctttggaggttctggaggtagagggtccagttccggaggaggatacagctctggaagcagcagttatggctctggaggccgacagtctggctccagaggcggtagtggaggaggaggttctatctctggaggaggatatggctctggcggtggttctggaggaagatacggatctggtggtggctctaagggagggtccatctctggaggaggatatggctctggaggtggaaaacacagctctggaggtggctctagaggaggctccagctctggaggaggatatggctctggaggtgggggttctagctctgtaaagggtagctcaggtgaagcttttggttccagcgtgaccttctcttttagataaagatgagcccccaccaccaccgactctcccaacccagactctcccactccagaatgtagaagcctgtctctgtacctctaactggcagcaagttaaatttttgtcatttatctctgatggcactttgagggaaaagaatgtccacatacagtttttgaaagatcttctctccaaaccagttagttagagccagtgacgcctctgtgttctggggcggaatctgtgctgtctaggtttgtgcttctagccatgcccattcccgcccccaccatgcctctttgcattgcccattttccagatgtgtattctgttgaggacccaggcccatccagggatttcatctctaagcctggcagtgctggggggaaatgtgtttctgtgtatatagctcctcttgtccactctgctttcggaagtgctgtggtctgggggtcttcataataaacctcatttgcaattcatatcatgtgctgtctgcgtgatgtcaaaccttggtggaagtgggcagccatggacaagggaggtttgggcattaaggaggggctcctgggtgaggagcgtgcctccctgagggaagcccaggcgccagcctctggatgaatgggagcctggggatgggtgtgtggttctcagaaagtatttaccagacttgagggccatggcattgccgggaggtggacaggtagatttgtggaagagtctcttttctagaaaaacccattcttcctgagcatttcccacagactgccctctcccttttccacaaaggctttggcccgggatcacttctcctcagggcaaaaccgctgagcccctggcaccatcgtggtgagtttccaagctccgagcttccaaggcagaccttcctcagcctgatgtaggtcctggcctctgtctctgcgggggctctgagcaagcctggaggaggatacctgggaagagtctggaggactctaaagtggcctccaaaacagccacttctattttcacaggacacccctcctgtcagcggagtcccaccacactcagcaaacaagcccttctctcctctctcaccgcagcccccggggcctgtcgcatggatgttgccatcaggttggccttctcctgtgggtgtgaagatgccttcagccccttcctcaggaaggccatgtcacctgagcagggcttccagggagttcaggaatggttgggcaggtgggattgggcatgcttggggttggtgttagacaggccagagttgcccaaatgggagttggtggctcaggctaggtcagcttagctttctgtatgtggcgtttggttatagtagctgtggcttaaagccactcagaaccactcctggagggtccttttttctcccactccaccccagctttaaaaccttggagagtccttagttgagtctgtgaccgtcttcctgttcccagaggttgcagggacggctctaatagagaacagatgcattcacttgcctccagaccagccaggacccaggtatgagggtgctgcaggaacagctctgaaggctgcaggtggcaaggtggcaagactccaggctgagcattctaaagtgatccgctgatcagagaaggtccctgagaaccacccaggcctcagtcgtggggagaggtctgtggggagagggtgcaggttgggaagaagtggtgtgaggagctggctgttttcgggtatgtacatagtgtagacatgaacacaacctttaacagggacttggtcccagacatttgaggctggacaggagctttggtaatcagtgtatttgaacttttcacttaggtgaggaaaaaggtaaggcccagggtggacacagaaaccaggtctcccactcccaatttattcattttttaaaaggctttgggaatagcaatccattctaataactttctgaggggaaaagaggtgaggcaggtaaggtggcagatttattcccaggggagccttaattctattttttttttttttgagatggagtctcactctgttgcccaggctggagtgcagtggcatgatctcagctcactgcaaactccgcctcccggctcaagtgattctcatgcctcagcctcccgagtagctgggattacagacatgcaccaccatgcctatctaatttttgtatttttggtagagacggggttttaccatgttgcccaggctggtctcgaattcctgacctcaagtgatctgcctgcctcagccttccaaagtgctgggatcacaggcgtgagccactgcacccggccttaattcttgagactttcagtggtctgaacctctagctccttctatcgtttccagttccccatcccttccccacctgagacacagcccttctggtttccagatcatatatatgctactttcttgctggactccagtagtaaaattagccttgtacattaactcagagggacccaggcctgaggcgtgac

SEQ ID NO: 16906 - DNA, 9494 bp, Human
tgaagcctcacaatagcactttgaggccggtgctatgttcactcccagtttacaggtgtaaaaacaaggcacaaagggtttaagaaagtgcagagggacacccaggtgcttggtcatgaacctgagccctctgtctccaaagtccatgctcttaaccaggggttggcaaatgttttctttaaagggacaaatagtgactattttaggctttgcagggcatacaatctctgttgtaactactcagctctgtctttgtagtgtgaaagcagccgtggacattggacattgacacagacataggacactgggtaaatgcatatagctcccacctgaattgccaacccttcttacccatcctagcatcattcatgccaagcctaaagcctctatcccaagagagtagagtgggtcggagcacataccagaaggaacacttctttcccagaactgggtggaagcacattcttggtcaaccattgtgcaaccagggtggagggaggggagctgcttccgttgtcttgagaaggtatctcgttcttgccagacgctgagttagcacctcctttagacagggaacaccctgttctcctggatgctgtgtccccccctccaaatgttggagaaatgggactgcttttaaaatagtaacaagagctttcctgaggctcttcttagcatgggagtttgttcttcctcctgcggttgctcatttatccataggttctcacagaacaatattgcccaggattgctctccattctcctcatgcacagtgcttaatgcatggactggagaagtgaagctcattcctctgtaaaccaagcacactcacctttgtcagcctgcccaccctcccagaaggtgtatatggatttgagatttcaagcactgagatcagaaattaaaatgtggaattgacatgttacatcatcacacttgtaagggcacaattttatgattcacagcttccatatgccccttgactttccctacacacccaattaaactgtctgactcttgattcttaagaaatgtcaaaatctgtgggaataaaaatccagtgaattccttaatgatttttatatcactcattttccgttgtttaaattaagctctatgtaaatgctccaaaacagcagggagaaggtgtctataaatttcaactggaaaggcagatttacatgagactaagctcaataggaaagcaagcactggagagagaggtgcagatatggaaagaaactcctggcagaagtcaggtctctgagcaccctgggcaatgtctgctcccttcattttaggtaaacggcatgtgggcaggtgatcacacagtacacagaacaaatgttgctcctacagtgtaaagactcaactcctctgtccctcttgcctgacaaaggagggttagatccccaaagcagaccccgttcctatgtccaggacacaagggaggacagccaggagctccagaagaactggtccaaatgcagtggaaaaaacacaacaggctacttcttgctcaggccatcgggcaaatgcccatacgccctcaggaaggatcccactcagagggtgaggctggtgcaagtggagtagaaaacctgtgtgggaagggggcacacagggagtgtctgatgaagaagaaggaggggacaattatcacagatcagctccttgtctcctttgtttgaggacatgactaactcatgacttcagtgaatgtatacccgggcttattgtgttaggatcaagtcaaggctggaaggcaggagaatttctctatgactaaaggaagccaaaaagcaatcttcatatttcatacctttctagaaactgggtgtgatctcactgttggtaaagcccagcccttcccaacctgcaagctcaccttccaggactgggcccagcccatgctctccatatataagctgctgccccgagcctgattcctagtcctgcttctcttccctctctcctccagcctctcacactctcctcagctctctcatctcctggaaccatggccagcacatccaccaccatcaggagccacagcagcagccgccggggtttcagtgccaactcagccaggctccctggggtcagccgctctggcttcagcagcgtctccgtgtcccgctccaggggcagtggtggcctgggtggtgcatgtggaggagctggctttggcagccgcagtctgtatggcctggggggctccaagaggatctccattggagggggcagctgtgccatcagtggcggctatggcagcagagccggaggcagctatggctttggtggcgccgggagtggatttggtttcggtggtggagccggcattggctttggtctgggtggtggagccggccttgctggtggctttgggggccctggcttccctgtgtgcccccctggaggcatccaagaggtcaccgtcaaccagagtctcctgactcccctcaacctgcaaatcgatcccaccatccagcgggtgcgggctgaggagcgtgaacagatcaagaccctcaacaacaagtttgcctccttcatcgacaaggtgagccagtgccatgccctccatggggcacttcagggtccccagaccagaggagcaacaccttcctgccagggagacctaggagggagggagaagaggactcagcccagctctgcagagagtgcagatggctgctggtgcccagcaagcagcagggatgggcatcactcccccatgggatctctggagtggccctcactcctgcctagggagaaccataacttttcataaccctgaagcacagatgaggccatcagagaatggagtaggttaactcttccctttgaagcgtcaaagaaaatgccaggagtacacgggctggtaaattacactctggggtctggataagaggaaaaaatattggaaacaaaagaaaggatattttggctagattaagaaaaaaaagacttaaaacgtttatacgttatgtggaaatgttaattaatcctcaaaacaaagaatgaccataacatcaggatgttttagaggagagacttgcacaaatgggaaataagacgggaatcaaatcattgggcaacatttaacatctcttctaactgaggtcctatcagtaataaaaactgtgtaaaatttatcagatgaatactattttataactatgtttgtaattttggctgggaaaagaaggaaaagacatgttgaaactcattaatatgtccaataacttagagagtgagaacacctgaatggtccgtgggacaattcctctagtgagattggtggggtacaaaggagaaggggttgggggagcagagctcagcctgagcctctctacatgcactgtagtagcccagcaccatgggaacctcccggacctgccaggaaaccggataccagacactttttcttccttcccttgcctggaaaatgatcatcttgtctctctttcaggtgcggttcctggagcagcagaacaaggttctggaaacaaagtggaccctgctgcaggagcagggcaccaagactgtgaggcagaacctggagccgttgttcgagcagtacatcaacaacctcaggaggcagctggacagcattgtcggggaacggggccgcctggactcagagctcagaggcatgcaggacctggtggaggacttcaagaacaagtgagttaaacaggagaaatggactcagtttcctgcagcacacacttcaagactattgggtgaccagggccagaagggggtaatattcctaacaacccatgtccatggaaatgaagagcacaaattagtccctaggagcaaacctgcaagaaccacagatggttatgggaggatggggagattaaagaagtggcaaatttagcagaagcaaaaatcgtctcttaggctctctgtggcaggaaagcccaattagaatatattccattcgggaaaatgttgaatcccaggctgcttttctgtttcatcctacccactggctcaaatgtgtcccatgcctttcttcctgtagatatgaggatgaaatcaacaagcgcacagcagcagagaatgaatttgtgactctgaagaaggtgagcagatgaagccgggggttcaaattcatttagaaggagagaagtggctttgtgtcctcgctcccctgggagaggagaattggcatggagactagaagatgggtagattggaaaggtgagctcaggtaactccaggttgttggctctttccccaggatgtggatgctgcctacatgaacaaggttgaactgcaagccaaggcagacactctcacagacgagatcaacttcctgagagccttgtatgatgcagtaagcatctccaccatccttctgtttactctgatggggtctgcaaaggggagaagatgtatagggttgggtatctctgtaaatgtcagaagtgaagttgatcttatgaccttctgttctgcaggagctgtcccagatgcagacccacatctcagacacatctgtggtgctatccatggacaacaaccgcaacctggacctggacagcatcatcgctgaggtcaaggcccaatatgaggagattgctcagagaagccgggctgaggctgagtcctggtaccagaccaaggtgagcagggagtgggcagccgctgaggaatccctgtgtccatccctgaataccagaggactgcagacttcactggggacatcccctgacaggaagctggggtcctctcacaggacatgcactctgcactattagagtagacatttgcagaacttatgcccaagtcaagaaggaaaaagaacccaatgcaggaggaaagctaccatagacaaggacatagtcatctctgcatttagcttcaccctgattgctggcttttagaaattggtacagaacatttctactccctaaagaaactaggcaggcagtggtgccataatgaggatggtctgtgactccagtgtttagtatccaccaaccacataatatcaacttttcctcaagtttcttgaggagaagcctttaggtccacttcatgacacgcatgatacacaagtgaaagtcatcgctcccaggtaagaacccgtagacactgtctctctctccacctctgggctgcagtacgaggagctgcaggtcacagcaggcagacatggggacgacctgcgcaacaccaagcaggagattgctgagatcaaccgcatgatccagaggctgagatctgagatcgaccacgtcaagaagcaggtatggtgagggacaatggaggagagaagcatttccttgtcaggtcgtcaggcagccatcaaccattatattagggaaaatcccctggaacttatcaaaaccagggagaggaggctatcatttcctacccttagtgggtacctgctgcttaggagacatagatcctacctatggcatgacacaaacacatgagagaaccagtcacgatgctcagagctgcaaaaacatggtttagagcaggagtgtccaatattttggcttccctggaccacagtggaacaagaagaactatcttgggccacacataaaatacactaatacaaacaatagctgataagctaaaacaaaacaaaacaaaacatacagccttgtccagtggctcatgcctgtaatcccagcactttgggaggctgaggctagtggatcatgaggtcaggagtgagagacaagcctgaccaacatggtgaaacgccgcctctattaaaaatacataaaaattagccgggcatggtggagcgtgcctgtagtcccagctactcaggagactgaagcaggagaatcgcttgagcctgggaggtggaggttgcagtgagtcgataccgcgccactgcactccagcctgggtgacagagcaaaactctgtctcaaaaagaaaaagaaaaagaaaaaaccctcataatgtattcagaaagtttaagaatttgtgttgggctgcatttaaagccatcctgggctgcatgtggcctgtgggctgtaggttggacaagcttggtctagaggaattggatttatttccataggaagactgacttggaaactgcaaaggaacaaattgaaaaagaaaagggcagataagaaagcacaaggaacattgtttcaaatctgctcaagactcaaggtgaaagagagagtagaggaagggcaaaggacaaagaacagtagatgagagattctgagggggaggaaggcaaggtctcagcagtctcatgtgaagactcatcacctcacttcaggatggtcttaattttgtgtatgttagtgtggcatctatatgaggtaatcataagtggtcttgatttgactgtggagacaacactccaaacaaaccagcaggtacatttcttccagtgtatgtgtccactgcagtgtctcccattagtaaatatccacattctcccacagagtggttcacaaaaagggttatgagtttttgtcaaatgaaccagactggacaaaaactgcaaaataaaaaaaaaaaacaatagataggaagagtcagagctcattcaccatcaattctgggctcctggccccttcttcactaggaaataaccagccaggtttagtctcctctggaagaccggatgacaagtttcttctattcctttcctcttccagtgcgccaacctgcaggccgccattgctgatgctgagcagcgtggggagatggccctcaaggatgccaagaacaagctggaagggctggaggatgccctgcagaaggccaagcaggacctggcccggctgctgaaggagtaccaggagctgatgaatgtcaagctggccctggacgtggagatcgccacctaccgcaagctgctggagggtgaggagtgcaggtgggtaactgacacgaactccttcaacagctgagtccatcttcaaggttcctggcactgagcacaactttaaggtgcactgcccatggccataattgctcttcctgagagaaaactaaaagagcagtttcccatggactcttccacccaccgaggctgcccacgctggtccagggaaggaagagctctctgaggtctcaccctccctgtgttcctctccacaggctgaatggcgaaggcgttggacaagtcaacatctgtaagtacctttgcttgccttcctcccctgccctcgcactcttctgactgggctcaggctgacaggatgagctcaccatggcttcttgtgtccttgtcccctccccatcacagctgtggtgcagtccaccgtctccagtggctatggcggtgccagtggtgtcggcagtggcttaggcctgggtggaggaagcagctactcctatggcagtggtcttggcgttggaggtggcttcagttccagcagtggcagagccattgggggtggcctcagctctgttggaggcggcagttccaccatcaagtacaccaccacctcctcctccagcaggaagagctataagcactaaagtgcgtctgctagctctcggtcccacagtcctcaggcccctctctggctgcagagccctctcctcaggttgcctgtcctctcctggcctccagtctcccctgctgtcccaggtagagctggggatgaatgcttagtgccctcacttcttctctctctctctataccatctgagcacccattgctcaccatcagatcaacctctgattttacatcatgatgtaatcaccactggagcttcactgttactaaattattaatttcttgcctccagtgttctatctctgaggctgagcattataagaaaatgacctctgctccttttcattgcagaaaattgccaggggcttatttcagaacaacttccacttactttccactggctctcaaactctctaacttataagtgttgtgaacccccacccaggcagtatccatgaaagcacaagtgactagtcctatgatgtacaaagcctgtatctctgtgatgatttctgtgctcttcgctctttgcaattgctaaataaagcagatttataatacaatatattcttttactttgccttgctttggggccaaagttttgggcttaaacttttttatctgataagtgaatagttgtttttaaaagataatctattctttatacacataactcccctcctttagagaggttcatcaaacttcagcttggtatcatgacattcagagtgtatttctagatcaaattccatatgaacttttggcaaatggagtgggaggcatctggtccaccagcattgtccactccgttttaactgaccataccaggaactagcatcccattccctctgccttggtttccaggaccacttttccccttacgccagggctcagcctaattgtccagttaagaaacatattctcggccaactagagcaagttatttgacaaaagaatcagatatgtgattaatcattataattgccctcataagcaagaaacttgcctgacaacatgtatcaagcacaattaaaatgtgcatacactgaaccgtaattatacttctagaaatatatcctgaggaaatagaacaaattcagaaaggtgtatgcacacagatgtgcatcacaagaatcttcacaacagggaaaagttggagacattcgagttggtcaaattaagagctcaaagactcaggccaaaactcagatgcttattccttgaagagtgaagacagtagaagaaaaaaatgtcctccttctcataggagaaggctctgttagagatccacagatagcaagcctaaggctctgatagagatccaaagaaaccaaatccatgttgctcagaagagatggtcctattcttctctttggtgtgaactgtcctggtttaacttctatgaatggagaagggaaaactcagaataaggttcaaggttggtctattgacttgtcctgtccccaggccacttcagtacttgttacctccatgagtgacaattatcttcctaactctaagattctcgtatcactgaagaaattttcttggattatactggtgtttctggatcctgctgtattggtatccaactgtgttcatctccaaaagttcccccagcaatatgggaagtttctcacattggcacttcctcacattctccccagaactttcctgacagcagaaaggtgaagactgacttccaaaatctaagcaatcttaccgcatatatatgtacccttgagaaataatgaaaaagaaaataattgataagaaaaattatctagaatataacaatacagcaaaaggaggttaaaaattatccatataggtttaaataaaattaaaatcttatggttcatgggcattaaaaatgtaacaaagaaatactacaaacaactctattggaaatttgatagcttagtttgagaagaattgttactaattcttctgtacatgttgagtagaattcagtagtaaggttatctgctcctagatttttctttgttggaatacttt

SEQ ID NO: 16907 - DNA, 8910 bp, Human
gcactttgggaggccaacgcgggtggatcacgaggtcaggagttcaagatcagcccggccaacatgctaaaaccccatctctcctaaaaatacaaaaattagccgggcatggtggcaggtacctgtagtcccagctacttgggaggctgaggcatgagaatcacttgaacctgggaggcggaggttgcagtgagccgagatcatgccattgcactccagcctgggtgacagagcaagactctgtgtaaaaaaaaaaaagaaaagaaaaaagaaatgaagcccaaattgaaagcggcataaggaggaaagacattggtaaacagacagtaatggacatttgggagaaatgtcctcgaataactgggaaaagcaaacagctatgaaaaagagactagagactgttaaaaagagaatcagaaaacatagatgtgggagacaaagcagacacaacacaatcacaattgaaaaagacaatatttttatgttttgtacatatgaatacatgaaatattttatatacataaaacacactcaaacacatacacacaaaacattcatgtatttatttatatacctttctacaatgcaggctccctctctatatatgccaactccctccacctcttcctcacccatacaaacacacgttgacacaaacacatatgcacagacatgtcacccatggcccaggaaaagcacaggaaaatatccaagtaaagatacaaggatacacaaggaactgctaacattacttcctccatagataggaattgggtaactggggaatggccttgagctatattattttgttgtttagcatgttttacaaaaaattttttaaaacatgtatcatgtattcaatttgtaaacatgtaaataattgtgcaaatagtactattcaaaatttaaatgggcaatctactacatttacttctagaatgtttaaatatagacagaatcttaataagtttctaattttaatatgaaatatgaaggttagagtctcatattaaaggaaacaataggggtatgcaattagaaaaatcccaagaatgaaaaagtacaatgaacagttaacctgttttatttaacaaataaaagtaagaaatgaagggagatttttaaatttcaatgatttaaaggatatatcactcaaatacaacgtttatagagcttattttgactctgatgggacaccaaaatataagaaatatatatcaaaaataggactgcttgaagactaaatagacacttgttcattttaattagtatgtaaatttttaagatataaaaatagtgttttgattttttaaaggacctattatttagatattaatattgaattatttattgaagacataatatgacttctggaatttcctttcaaacaatctagaatggaagaggaaatagggttgaagtatgaaagaaatcaggctggccatgagatgatcatcatggaagcaggtgacaggtatatacaggcccattgcagtgttctgcttctctacctgtttaaaattgcacctaaaaggtgaaacaattatggggaaattgtaatatttctgttaaggaattcacaatacagtgcctgtgatctccaacagcaaggctggaagaaagtcagactgggaagaggagggcactcagggcatgtcgataaacagcctagcatgcagaacctttgctgaagacagtgactaattccaacttcatgaattgagaatactcttattgtgctgagatctcgagtcaaagctggaggcaggaacattttgcctgactaaaggaagcgaaaaatgcaatctcggtatttcataacttttgtaataatgcaggtgtgatctcactatttgtaaagcccagcccttcccaacctgcaagctcaccttccaggactgggcccagcccatgctctccatatataagctgctactggagtccgattcctcgtcctgcttctcctccctctcgcctccagcctctcacactctcctaagccctctcatctcctggaaccatggccagcacatccaccaccatcaggagccacagcagcagccgccggggtttcagtgccagctcagccaggctccctggggtcagccgctctggcttcagcagcatctccgtgtcccgctccaggggcagtggtggcctgggtggcgcatgtggaggagctggctttggcagccgcagtctgtatggcctggggggctccaagaggatctccattggagggggcagctgtgccatcagtggcggctatggcagcagagccggaggcagctatggctttggtggcgccgggagtggatttggtttcggtggtggagccggcattggctttggtctgggtggtggagccggccttgctggtggctttgggggccctggcttccctgtgtgcccccctggaggcatccaagaggtcactgtcaaccagagtctcctgactcccctcaacctgcaaattgaccccgccatccagcgggtgcgggccgaggagcgtgagcagatcaagaccctcaacaacaagtttgcctccttcatcgacaaggtgagccagtgccatgccctccatcgggcacttcagggtccccagaccagaagagcaacaccttcctgccggagagaccctaggagggagggagaaggggactcagcccagctctgcagagagtgcaggtggctctcggtgcacaggaggcagcacagatgggcatcactcccccatgggatctctggagtggccctcactcctgcctagggagagccgtaacttttcataaccctgaagcacagatgaggccatcagagagtggagtaggttaattctcccctctgaagtgtttaagagattacaaagcaaatgccaggagtatatgggctggtaaattacactctggggtctgggtaagaggaaaaagatttagaaagaaaaggaaaagataatctggctggattaagaaaaaaagggacatagaaacaactgtaaaacatggataaatgctaattaattttaaaaacagagaatgaccataacatcagaatatttgagaggagacactaaatgggaaagtagactgaaatgtaatcatgagtcaacatataatatccctcctaactaagatcctctcggtaaaaaaaactgtgtacaatatatcaggtaattagtatttttaaactagatttgtgattgtgcttggaaaaagaaaagaagaaatgttgaaactcactgatgatcaatagcttacagtgcgagaacacctcagtggtccgtgggacaatttctctagtgagactggtggggtgcaaaggagaaggagttgggggagcagagctcagcctgagcctctctacatgcactgtagtagcccagcaccatggggacctcccagacctgccaggaaactggataccagacactttctctgccttccttttcctggaaaatgaccattttgcttcccctccaggtgcggttcctagagcagcagaacaaggttctggacaccaagtggaccctgctgcaggagcagggcaccaagactgtgaggcagaacctggagccgttgttcgagcagtacatcaacaacctcaggaggcagctggacagcatcgtgggggaacggggccgcctggactcggagctgagaaacatgcaggacctggtggaggacctcaagaacaagtgaggactccatttcctgcagcacacacttcaagactattgggtgaccagggccagatgtgtgtaggattcctaacaacccatgtccatggaaatgaaaagcacaaattagtccctaggagcaaacctgcaagaaccacagatggttatgggaggatggggagattaaagaagtggcaaatttagtagaagcaaaaatcatctctttggctctctgtggcaggaaagctcaattagaatatattccattcaggaaaatgttgaatcccaagctgcttttctgtttcatcctacccactggctcaaatgtgtcccatgcctttcttcctgtagatatgaggatgaaatcaacaagcgcacagcagcagagaatgaatttgtgactctgaagaaggtgagcagatgaagccgggggttcaaattcatttagaaggagagaagtggctctgtgtcctcgctcccctgggagaggagaattggcaggaggactagaagatgggtagattggaaaggtgagctcaggtaactccaggttgttggctctttccccaggatgtggatgctgcctacatgaacaaggttgaactgcaagccaaggcagacactctcacagatgagatcaacttcctgagagccttgtatgatgcagtaagcatctccaccatccttctgtttactctgatggggtctgcaaaggggagaagatgtatagggttgggtatctctgtaaatgtcagaagtgaagttgatcttatgaccttctgttctgcaggagctgtcccagatgcagacccacatctcagacacatctgtggtgctatccatggacaacaaccgcaacctggacctggacagcatcatcgctgaggtcaaggcccaatatgaggagattgctcagagaagccgggctgaggctgagtcctggtaccagaccaaggtgagcagggagtgggcagccgctgaggaatccctgtgtccatccctgaataccagaggactgcagacttcactggggacatcccctgacaggaagctggggtcctctcacaggacatgcactctgcactattagagtagacatttgcggaacttatgcccaagtcaaggaggaaaaagaacccaatgcaggaggaaagctaccatagacaaggacatagtcatctctgcatttagcttcaccctgattgctgacttttagaaattggtacagaacatttctactccctaagaaaactaggcaggcagtggtgccataataaggatggtctgtgactccagtgtttagtatccacccaccacataacatcaacttttcctcaagtttcttggggagaagccattaggtccacttcatgacatgcatgatacacaagtgaaagtcatcgctcccaggtaagaacccgtagacactgtctctctctccacctctgggctgcagtacgaggagctgcaggtcacagcaggcagacatggggacgacctgcgcaacaccaagcaggagattgctgagatcaaccgcatgatccagaggctgagatctgagatcgaccacgtcaagaagcaggtatggtgaggggcaatggaggagaaaagcatcattttttttattaggtcatgaggcagtagtcacccatcatttagtaaaattctttgggaattgattgataagcagagaaggaaagacatgcagttcctaggctcagtgagaacactctggctcagagacatggatcacacccaaggatatgaaacaatcacctgggcagaagcactctcagctggtcaaagctgtaaaagtatagtctagaggcattggaagggcttatgtaagaagactgattgactttggaattgcaaaggaccaagttgggcaagatgtcaggtcagaaagcatcagtaacattgctgcaaatctgctcaaggttcacggtgaaaaagcaagtgaaaccagggctatgaggaaggaaaacgtggcccaagcgggtgagaggatgtgaggcaggaggaaggcaaggtcacaacagcctcatgtgaaaactcatcacctcagttgacaacgtttgcaaattattgtggcatccatgtaaggtcatcaaaaatggttttggtttttttgctttggagccaacacttaatgtccttggtcttgtgtccactgtggcatcttccattggtcatcacccacatctttaggcagtggagttaacagaaagggcacaggattttatcatgtgactccagacgtaaaaactttgaagacagtaaaaaggctagacaggaagagtcagagctcatttaccatcagttctgggttcctggtgccttcttcactggaaaagaaccagccaggtttattcttctctggaagaccagatgacaagttctttctcttcctttgccctcctagtgtgccaacctacaggctgccattgctgatgctgagcagcgtggggagatggccctcaaggatgctaagaacaagctggaagggctggaggatgccctgcagaaggccaagcaggacctggcccggctgctgaaggagtaccaggagctgatgaacgtcaagctggccctggatgtggagatcgccacctaccgcaagctgctggagggcgaggagtgcaggtgggtaactgacgcgacttcctccaacagctgagtccatcttcaaggttctggcactgagcacaactttaaggtgcactgcccaaggccataattgctcttcttgggagaaaactaaaagttttcccatggactttcccacccactgaggcttcccatgctcgtccagggaaggtctcaccctccctgtgttcctctccacaggctgaatggcgaaggcgttggacaagtcaacatctgtaagtacctttgtttgccttcctcccctgcccttgcactctcctgactgggctcaggccggcaggatgaactcattgtggcttcttgtgtccttgtcccctccccaccacagctgtagtgcagtccaccgtctccagtggctatggcggtgccagcggtgtcggcagtggcttaggcctgggtggaggaagcagctactcctatggcagtggtcttggcgttggaggcggctttagttccagcagcggcagagccactgggggtggcctcagctctgttggaggcggcagttccaccatcaagtacaccaccacctcctcctccagcaggaagagctacaagcactgaagtgctgccgccagctctcagtcccacagctctcaggcccctctctggcagcagagccctctcctcaggttgcttgtcctcccctggcctccagtctcccctgccctcccgggtagagctgggatgccctcacttttcttctcatcaatacctgttccactgagctcctgttgcttaccatcaagtcaacagttatcagcactcagacatgcgaatgtcctttttagttcccgtattattacaggtatctgagtctgccataattctgagaagaaaatgacctatatccccataagaactgaaactcagtctaggtccagctgcagatgaggagtcctctctttaattgctaaccatcctgcccattatagctacactcaggagttctcatctgacaagtcagttgtcctgatcttctcttgcagtgtccctgaatggcaagtgatgtaccttctgatgcagtctgcattcctgcactgctttctctgctctctttgccttcttttgttctgttgaataaagcatattgagaatgtgaacatgttgtgttagattgtattgctgaccacttcctggtttagaaacattcgcaccccacaaatggtttcttatctttggggaactgctgctctccccactgaccagtcatcatggaggatgagtcgggagctccccctccacagcctactccatcagtcaacattatgtgattctgtcggacactccggtggacaatcaccaactactcagccctcaccacttgggaatttttccacaaatggagtcttttataaagcatcagaacaaaaagggaagctaattcctggaatctggatcagcataatctgataactaagattcatttatattttttatttttcagccccatcatttggtggcttgaccccacactgatctctgagactccctctctccccggctccccaccaccagggaaatattgcactgaccctgcagatcagaaacacttggtaagaagcaggtgcttgccctgactctatgattattaagacttttgccaccaatgcttgctctgatataaacttctaaaatccatcattcaaactaatagatacagtaaaggagcatcctcaaatctcagtgtatggatttaaagccatgcagtgccatatgttttggaatggttttgacacaactcaaagatacatgggctgaacttaagaacttatcctggggccggacttggtggctcacacctgttaatcccagcactttgggaggtcgaggcaggtggatcacttaaggccaggtgtttgagaccagcctggtcaacaagaagaaaccccgtctttactaaaaatacaaaaattagctgggcatggtgttatgcacctgtaattccagctactcaggaggctgaggcacaagaatcacttgagtctgggaggtggaggttgcagtgagccaagataatgccactgcactccagcctgggcaacagagcaagaactccatctaaaaaaaaaaagaaaaaaagaacttatcttgggaaaggctggttagaatgtttatgactgtacacctaaaaacagtgactttgactgtctgtacattatacctcaacaacccttagaaaaagtgaagttgtaaaaaaagataaaataaattcataaaatttctttataaaattagagagtttgttttgaggtgctgctggcaaagatgacatggtccatgagacaacatggtccacgctgacagacgacactcagatcaacatggggactgagcacagcggctcatgactgtaatcccaacactttgggaggccaaggcaggaatcacttgagcttaggagtgtgacaccagcctgggcaacatagccagaccctgtctgtacaaaaaaactaaaaaattagttgggcatggtggtgcacacctgtagttttagctacttaggaagccgaagcaggaggatcacttgagccaaggtgtctgaagtggcagtgagttatgat

SEQ ID NO: 16908 - DNA, 8677 bp, Human
tgtggcggggtaggggctaggggagggagagcatcaggtcaaatagctaatgtatgcgggacttaatacctaggtgttgggttgacgggcagcaaaccacatggcacatgtttacctatgtaacaaacctgcacattctgcacatgtatcccagaacttaaaataaaataaaataaaatttaaatttaaaaaagagccacactgggatcctgcaagagcacagccatctctttccccttcccaacttcccacaggctttccatcttattcaggagcaccaacccgaagtccaggagaaagaccctaagaccctagccagaaccatgtgtaggacaaaataaatagtgataaagggtgtgcagcaggaccccagtactctggaacccatctctgacagccttggttccagggagcttggtcagagcttgtggcagggggttgaagagccttggtggaaggggtgctttctctcacccctttcccaattttgcccttcctctcctctgccctggtctacttctcccatcagcagtagcttctcccatcagctgccccacaaccctctcctccctgcctctccagtctgcatcagtatctcagggaaacaggaaaacaccattctccaaacacatgtcctagggtcccagggttgcatggcgaagcgggctgtgctgacaatgaggttcgtattatttctatttacctaaaagttcaagaaggccttgctgacattgttgcttggggcccagcatttaaacttagtcactgcccagagcccttgttttaggaaagaatgagatggtccctgttgcataacccagagttgggtgggtgtgggttgccgaaggaaacaatccctcttcctctctcttgtgaggcctggctaggagtgcctgggatgggcgggacactgcctggggaaggcgggtggggagcggtggaacccgacccttggagcgaaggcggacaagtaggcaggcaaagatgctgagtagtccctccccaaagtcccctgggcacaagacagtctgatgaatctagaaaaccccatggatgactgggagggaaggaaacggattctgggagaggagaggaatggaggagcgagcttacctgaaggacggggatggggaggggggtggggtctgctctctggccactgtccccaagagcatcccgaatacgagttcctttaattctctccctctctagtttcaacctgccaatttccccctttccctgcctcccagccagttctcaccctgcacacagccctctccaatccttccagactccgcatgcgcccaccacaatgctagggtctcctacggttcattcaagttgtatccctccctgcctcccggcccttcccccattggcttaccccagtctggttcccctcgggccccttttctccatagtcttacctcaagggtgctttctcttactcctttcccaattttgcccttcctctcctctgccctgttctacttctcccatcagcagtagaatttcccaagaccccgttatccaccctctccatcttttctctgtccctccacatttgcccactcctcttgtgatccacacacaccatctcttctcagttccctttcagcccccgtcttctcactccccaccgggtccctgcatgcccctcgtcgtcctacacatacacactaagtggattgcactcccgtcctccccttcttccgctcctccccaccctccagtccctccagccagctgtacagctcccaaattccgggccgagattcccgggaacaaagcaagaaaaatcagagcaatttgggaagtaaacagaaactggaaagggagagggaaagaagagtggggaggacccaggttgggggggccctctccagtcccacccagtttagggaatgcccctgccctctcccccaccccccttcacctggctcttaaagggcccggcccctggccggcggctacttaagacagaggggcggcggcgggcagcagctgcgctgcgactgctctggaaggagaggacggggcacaaaccctgaccatgaccccccacaggctgctgccaccgctgctgctgctgctagctctgctgctcgctgccagcccaggaggcgccttggcgcggtgcccaggctgcgggcaaggggtgcaggcgggttgtccagggggctgcgtggaggaggaggatggggggtcgccagccgagggctgcgcggaagctgagggctgtctcaggagggaggggcaggagtgcggggtctacacccctaactgcgccccaggactgcagtgccatccgcccaaggacgacgaggcgcctttgcgggcgctgctgctcggccgaggccgctgccttccggcccgcgcgcctgctggtgagtccgcgccccgcccctgccccgcccacgtgagacccgcgtcctccaggcagggtcctggggagacgggagtgggtggcccggcaagcctttccgccctggcccttgacgcttccgactttggggggcacatttgtgtgggggagaaggggcaagtgcaggaagctgaggtgcagccaggggacctggtgatacagcagaaggtgtctgcgctctcggccttcttttttgctccatttattttcccttgatggagtgtgcgtgcaggtgggaacttgggggaggcagggggagaaatgggagggttttagggccatcccatgggctccagcaggcccagctcctacaaccctagacggccaagctggggaaaggacccaaatgttgttctcagcttccacttggagaaaaggggaggggaaccccagactctgaaattctgcacacactgagaaatgactcctttcctcctaataccggtgttcgaagcacctaaacaggaggcgtctagaaccgaagaggccccaaatccagggttgtattagacttgagtagggactgagggcaggctagggcgtaggttaggggagaggggagaaagagtaggggaaagagggaatctgccaaatcagggttatgatttaaacctgctcagaatcgttcacccatcctaccccaccctgctccagggaggagagcagaagctgagtcactgggtgggtgggacagaagtgaatcagccgtgaaaacatggggggcagcggggagatggggagggcaggaaatgcaaactgcgcatcccagaggctctgggttccttccacgggaggggatggagaattcacttggagtttctttcagttccaaatgcccgagtgcaggcttctgggcgtcctcctaaaaggtggtctgggtggatgagaggaggcagtttggaactaaatggttgggtgctaaatgtagggaatgaaggagaaggtctggggaggggtgggcatcctgaggaagaaggatcagactcaggattgcaggggaaatgtctcctgggttgtgagtggtagttagctgggagcttgtctttaggcacagaggaagaggatcccttcaggggttctgatatctgattagatgttaggcaaattccaagcagtcagtacatgctcccctttctgccttttcctgtccctgacttatttcctcaccccttcccagtcctgagctctccccggaccctccggaaactttctccagagccaggagcaacctgcaggttggaagcccctcattccttgcaccttcttaatctgccctcagcctatcttggttaagggttgaatccatgtgctcctgggaccactggggttgagctggcctgggtcacagggtaccagaagggagaggttcccactgcagtgccccagaagtaaccacatctcaggcctgggaggggtgggttgagtcatagcaaggtcacagcagggacacacattccttttgggtccctgttggcccccctcctacatccgttgctcttctgccccagctctccggcttcgtgcgcccccttctggcctctggtggaacagccaggtcttttcacccaaagcccaaagccccaaatagtcctttgaatttgttctccattttttcatttattttattatttattgtaattaattgattgatttttaaattagttaattttttaaaattaagtaattagttaattttttaaaattaagtaattaattaattttttaaaattaagtagttaattttttttaattaagtaattaattaattttaaaaagtatttatttattttgagacaaagtctcactctgttgcccaggctggagtacagtggtccagcgtctcactgcaacctccgcccccccgagttcaagcgattctcctgtctcagcctccggagtagctgggactacaggagcctgataccatgccaggctaatttttgtatttttagtggagacggggtttcaccatgttggccaggctggtctcgaacgcctgacctcaagtgatctgcccaccttggcctcccaaagtgctgggatgacaggcatgagccactgcgcccagccaataatttatttatttttgagacagggtctcactcggttgtccaggctgaagtgcagtagcacaatcatggctcactgcagtcttgacttctggggctcaagcagtcctcctgcctcagcctctcaagtagctgggactgcaggtgcacgccaccacacctcggtaattttataaattatttgtagagatgaggttctcattatgttgcccaggctggtctcaaactcctgggctcgagcaatcctcccacctctgcttctcaaagttctgggattacaggcgtgagccattgcacccatcctcattttccatttttgctttccaaaattcatctcctttataagccttaaaaatcagtatgggaaatactggggaatattgtcaggaaaagtaatataactatttgtcagagaaagaaactagggccagcatcatgcaacagcggggcataaggccctcccttccttacttcagcaggtgatgtgggcaaggcccttctccacatggctctgcctgatttctgacctctccttctcctattcctcctccagttgcagaggagaatcctaaggagagtaaaccccaagcaggcactgcccgcccacaggatgtgaaccgcagagaccaacagaggaatccaggcacctctaccacgccctcccagcccaattctgcgggtgtccaagacactgagatggtgcgtttggagctggtagggagcaggaggggtgggaagccctggagacttccatctgagactgctcccttgggcttggagacgtctccattgtctgtcctgggtgcttgcctggtgggccagaaggttggaatggggagctgggctggagcggttctaagctgcctactctcccttccccagggcccatgccgtagacatctggactcagtgctgcagcaactccagactgaggtctaccgaggggctcaaacactctacgtgcccaattgtgaccatcgaggcttctaccggaagcggcaggtgagactatttttcttctcctcctgctccagcagaaggctcctgccagggagtgggggcggtgctgcttacaaagctgcataaataagacactgccccatctttaaggatcttccaactttaggagaacatagagaatataatttattaaacaaacttagagaataatcaaccacacactgtgagagaaaacccacttaaggaatgccctaactcagtggctcttgaacttgaggcatcagaatcctccggagggcttatgccacacagatagctgagccccaccggcagccttcctgattcaggaggtgtggggtggggcctgacaatatgcatttctaacatgttccctcgtgatccggatttgggaacgtcactttgaaaactactgttccaggctagcagaatgcacacaatttattggttgaagagggggaactaaagagagggaacactgggccgggtgcggtgtctcatgcctgtaatcccagcactttgggaggccaaggctggtggatcacgaggtcaggagttcaagatcagcctgaacaacctggtgaaaccccatctgttttaaaaattacaaaaattagccagatgtggtggcatgcacctgtaatcccagctactcaggaggctgaggcaagagaattgcttgaacctgggaggtggaggttgcagtgagcagagatcatgccaatgcattccagccagggcgacagagcgagactccatctcaaaaaaaaaaaaaaaaaaaaaaaaaagagagggaacccccgaggagacgctcaggtgtttttacatcctcagactcagatgtcccctctcattctcctgctggaagcctctggcctcactcctgacctgtgtgcctctctctccagtgccgctcctcccaggggcagcgccgaggtccctgctggtgtgtggatcggatgggcaagtccctgccagggtctccagatggcaatggaagctcctcctgccccactgggagtagcggctaaagctgggggatagaggggctgcagggccactggaaggaacatggagctgtcatcactcaacaaaaaaccgaggccctcaatccaccttcaggccccgccccatgggcccctcaccgctggttggaaagagtgttggtgttggctggggtgtcaataaagctgtgcttggggtcgctggcttgtgtctctgtgtctgcctctcacaattctggaatccctggccctctctttaccccactacagctcactcacagcatttctcctttcctgtggatacctttagtccttcctgtgacagccaggcagaagcttcaagccatcaagcctcacagagctgcccaccaggagttgggagtgggaaggggagacactgagatcatggccttaatctgaagttgtgaccttgtttctaacactgatctttggacacaaagggaggggaaggattaatagttaatcccagcaggaacccagcaaagaggaactctcaaagcacatacccttctgttacttcctactaaaaaaagaaggaaattattactaatatatgagctcatcccatggccctgaaccatgtgattttacctggacaacctcattttgagcttacgataaccttgtgatatagggatttttacccctatttttcagaggaggaaactggcttaaaatttggggtcacttgcctgaaattatatagctggtaaatgacagagggaggtttgcatccggttcttccatatgtgacaatacctggtattccctaggtgctgaatacgtgtttgtttagtctcctttctgcctacatgctcacccaagcaggtgtcaggaagcggccctgtcagttcaggggccctgacactcagcctttcctggaggggccccagttccgtgagtagcacagtgccaaccccatcagaatattaccacatgtgtcaatcacacaccttgtggtgaaagcgagctgaacgcactgatacatgaagacatttctgactcctccctgaccttcagcctgctgggagagagactggaaggccagccatgctaggtgacaagcttctgagaggcaaagttcccctccccaagatgtacccagccactattcctgtgtgtgtgtggcggggtggatagcacccttggagctgggcatctggatggtggttggggtgttagggggatgtggcgatccctgcgacagacagcagagtgaggtctgaatctgagaagctctgcctccagatcagataacctatcgcactcccagaggccccctcctcctgaaaggactttagtctttggagctgtcacctgagctgagtgggacaagagctctacagggcaggccacactgcgaaggaaggaggcaacacgggcaagggctgcctgctgcccgctggagaccgcaccatggagccaggcggggcccgtctgcgtctgcagaggacagaagggctgggaggggagcgggagcgccaaccctgtggagatggtgagccgccctcgggggtgcagaaggcacaggcaagtgggggggaggcggggagagatgcgctatggagagaaggctccaactgcctgatgccaatccttcctgctgtccagagaggccaaggaaggtagaccctggcctcagcccagagccacccagctggaagatggaacagaaaagagctatgtcagagctgtggcctggccttatccttctgactgtttagccccagatagtgaatggagtagcttcccattccctgagtgccctgttcccagtaatgtcaccaggccccctgcttgcctatggcctcctcaccactggcaacagcaacttccccttctagtagccccaaccatgatactagatattggctggttggggtgagggcagctgctgagcacacaaagcatttcctgaccacaggatgcctctgggtctgcagaaccccaattcctcctgttgactgtgcctttgatccctcctcacaggaaacactgagacgcacagagccccggacttggtacaatggacccgacacatggaggtgagggatgtcagaggtcagaggtcaagtggacagatccttggtagcaggaagcaggagtgaggcttggtgataaagatgacttttttttttttttttttttgaaacaaagtctcgctctgttgctcaggctgg

SEQ ID NO: 16909 - DNA, 17750 bp, Human
gaagtgactgtcccaaatccaattcaagctttttatcttcttttttcaggcccttcctgtaaaacctggctgacacacaaacctagctggggtgaggctccaggtgtgatgaaagtttggagttgccccatgaatgggactgaggctgatgtgggggtgagaaggcggaaggacagagcatgtgaagggagaaaggcaggctggggcaagagagcagggtgtgactctggcgagggtgggggaaagggggtgatttgaccatgtgtcaggaagtgtttctctccaccctcccctggggagagccttgaccccaaggtggctttgttttggggaagcaggtggccaggcagctgctgagggagggcaaagtcatggcttgggcggtgaccatgcactgaggtcctaggcccgatactcatcacccaaaaggataatctaacagtggctcttagccaaataggtgacaggtgagcttctgtctgaaaccagcccaactatatcataaagcctcagatatggcctaggggaaggcaagcgatctagagaagtgagagaaaagaggcctctaaggaaatagagtggtcaagtgcttagtgattattattaacagcaacaataataatgggtcacatttattgagagcttatagtgtgcctggcactatactaactacttttatgtgttcccgcattcatttctcaaaaagctccctacaaagtagtcattattattattgttattattttttccatttgagagacgtcaaaactgaggctcagtgaaattaagtttcttgtccaaggtcacacagtaagtagcaaaggcaggattcaaactcaggtctgtagtgattccagtgcactatggaaacctaggcctaggttactggagcaagttaagagggcagggccagattgacccctgcaaaggtggggatagggagggacagtgggatagactgtgtataaatagcaggcctgtttttatccctacacacaggcagaatccggcaagtgctctatctggcacaatttcagggctctgaaagccaacccagccctgtgtcaaacaactctctccccagcacgtccctggaaactgaaatacctactgagacactcatttctttgggtcaggacagtgactccagaagacccctgcaaaagcacatgggttggaagagaaacacctagtgtctgtgaaacagcaatctaggttagccagctgggtcctatgggagggtggctcattttttatgttgaggaaaaaggtggcagtcaaaggcaaggaaaagaataaggcttgtttcacaacctgtgtctctccaatctcagaagcctgggaattacaacccatagttcaaaaatcctaatgtcccctgagggaagatgggaggaagccactccagagactaagagagtactaacttcctttgcttttgctggattgatactaagtgcctgcaacttcaactctggttatctcgggtttatgagaacggctggcattcacgtgtctaatttttaaatgatagatgaattaattattatttgatacttgccgtgttggtaggccaaaaggtgggcttctgaaacttagagggtgacagggatggagacccctggtatggggcttagatgaagcaagaggccaggcccggaacagaactcagctcagcagtcagtcacaaggctgcagagtgacaggcgtttggggaaaggtaggaaccgctctccgccacctgccggtcagtagccctacccacaatcaggccgcggctgcctcggcctggtcccaaaaattgtgaacgccgccctctcctcccgcccagtcctccgccgcgcccgcggggtcgggggctgcgctgccggcgccgcgagccgggcgagcttcccagcacgggaggagggagggggcggcgccgggcggggcggagcttccgcgcctcctggagccttattcccggccgcgagccgggcagcgctcattcggccgaaggagctacgcgggccacgctgctggctggcctgacctaggcgcgcggggtcgggcggccgcgcgggcgggctgagtgagcaagacaagacactcaagaagagcgagctgcgcctgggtcccggccaggcttgcacgcagaggcgggcggcagacggtgcccggcggaatctcctgagctccgccgcccagctctggtgccagcgcccagtggccgccgcttcgaaagtgactggtgcctcgccgcctcctctcggtgcgggaccatgaagctgctgccgtcggtggtgctgaagctctttctggctgcaggtaagagggctgccgacgcccccggagatcggggggatgggggcgttgtgctgggggcatgggggaaggtcgccgcagcgcacccggcacgggccacttggtggggcccttgcgctctggcggacgggcgtcggcatcggtgcgtgttggtcaggggtctgggcgggtgtctgatgcggcctggcctctcgcccgcagttctctcggcactggtgactggcgagagcctggagcggcttcggagagggctagctgctggaaccagcaacccggaccctcccactgtatccacggaccagctgctacccctaggaggcggccgggaccggaaagtccgtgacttgcaagaggcagatctggaccttttgagaggtgggtgtggaggccccccatccttggaccttggtgggctgttgaagaataagcagatccaagattcttgctgtttgggcaatactgtgggttgagggtattcatggagaacctcggggaaaagctgatcggcctgatgggcactgggggatcctggaatataggtcccactctctctctcttgtcattgcctcacctgctgggttgctgcccttctgggtactccggggcaaattgaatcagacgtgttgtctggggttgttacgttcttcttaggtaagctgggtgataggaacaaggaatggttgagatgctttccctagagctactatgtaaaaatgggcgccagttctaattcccatatcaaatgactattatatataaaatagaggtaacacatgcggagatgcccaggcacatctctagaaagtgtgcagtgttggcctcctccatccacctgtctccagattggggaaacagaggggaatgaggagctcttggccgccctagatgaggctgtgaatggtgagcactgagcccctagggggctgtattaaaatgctggatatctgtgaatgctaccggaaacctgcagcttactgagcaccttgcattcctgaggagactccaaatggggagggctgtgtaggatcctccaaccagcctctttggctgtggccaagtacaggtacagggcagagtccagagcctgccagctctcctgcctccaaacctgaggagattatccagagtagagcaaggactcagcactgtaccctggaatgactatatttggttggacagatgcccacctgttctagttccacctgctcctcagctgcccttctccctcattcccaggagctttccttggatactctctctactttgtataaatcaagcacatactccaaaactgagcctgggctcccatacttcatcctctcccagtggccctctggggttgcccatgacctgaacagcctggattctcctggccctctcctcctaggctgggcagggctgggctgtgactcaccccacccccaccccccacccacacggctgctcctcttacctctgcagacctgactcactgctccctgtccatggcaggagcctggctgtcaccctgcaccttctccctcccctttctgattggcttggcccccctgccttgctctccccgaagctctggtcactgggttcctctgaccacctgtatcaccttctgagctctgagggggcctgggactggatgagaggaaatgaaagactgtgggggctgctggcacctacttctcttcccttcttttggctttgctgggcaaggactatttttcaggtctggggatcctaccacctaaaataaatgactgctaccatttattaaattcctactgtgttctaggcacttgatatgttatcctggctaatgtaacacttatagcaaccttttgagatagttactttggctatccacattttactgagaacctgaggttcagaggagttaagtgactgcccacagtaaatagctgaaattggagcacaggtctatggacttcagagcccattcatgcctggatcagcatctcaggtgctctagacttgtgagagggaggagatgggagtgtgtgaggcagcttggtgtggtgaggaaggacattggagtgaagtccagagaacacagttctaatcccaatcctgcatgaccttgagtaagtcactctgcctgccatgagttttttctttttttcttttttttttttttaaacatagtctcactctgtcacccaggctggagtgcaatggcacgatctcagctcactgcaatctctgcctcccaggttcaagtgattctcctgcctcagcctcctgagtagctgcgataacaggcacacaccaccacgcccggctaatttttgtattttttgtagagatgagatttttgccatgttggcaaggctggtctcgaactcccgacctcaggtgatccacctgcctcagcctcccaaagtgttgggattacaggcgtgagccaccgtgcctggccacatggtattctttgaagtccctctagcttgagactctaagtctctagtctaacgtatcatgcttacccttctgtaagacacatggctgtagccatggatgtgggcacctttttcctgatgggggataaaagggtgggattgggctgataggcatagtccctggtcaatcccagctggatatctgggtgaggctgtttttcccccagtctctctgaagcatggaaagaaggagggagtcatcattgttccagttccttctggacagttccttactttccatttttctatcccttgtacaccctgtaccccccaatccagagagctataaacaggacattgggggttaaatatgaatgaatctttgagaaagtgggtgagctgtaaagggtatgcaagttaaatattttgcttgaagttgaaaaagcaaggccgtgaccagggctggcctgcttgctgttcctgagccaggctctgccctgggctcatagtactaaggggtgccccagaagagaccacctgaacacatggacactgttcttatattaggagccctccaaccccagaacctccaagtaccttctctagaagcaatttttgtgtgtgacactgtctttctgcaagtggttcactgagtacagcatcaggaaatgaggctgattgaaggccaaaatagaatgaagtgggtgtgggggagtaggagatgggggtgtaaggtggacagtggggtggaggtgaggttggtagaattgcccagttactcaacaaaagcattctgagaatgaggctcttacacagagactgtgaaatgccttccttgggacccaccctagcttctacttcctaccgaggttccctctttctggtggttctgcccaatcttcctgctcttccttctgcctcttaggaggcactgagctaaggggccttcccagatctctgacttcaggtggaatcaaagcatatatactcctttcaagcactatgctcttctgattttcttcccaaagagtcagactttaacagagtgcttttctcctacagtcactttatcctccaagccacaagcactggccacaccaaacaaggaggagcacgggaaaagaaagaagaaaggcaaggggctagggaagaagagggacccatgtcttcggaaatacaaggacttctgcatccatggagaatgcaaatatgtgaaggagctccgggctccctcctgcatgtaagtgccccttccccagggctgaatctcatcagcacactttgtcagccacgtggctgttcctcgttgtcactgttccttgaattcataatttcacccagtttcttctcaacctctgggcggaagttgggaggaggggaaatatatttttagtcagcggaagccccctcccccctataggatgcaatttcctgtggtatggttttgtgacgtgctttaatccttggggacatttcctgcttgcccagaaatgagcatgtggctaggacagctggcacctgaaggcaggcccttaattcttgcctgatgccctactctgggagggagaagccagtaggaaacatggcagagtgggcttccagggcagagtagagctcctgtgggaaggtaggaagtgcatttggatgcatgatgtataggtatgtgtgtatttgggtttatgtgcatgtaagtgtgcaaatgtggattgactgtgaggcatggcaggactgtacagagagggatcatcatggcggcaggttgaggcctctctttcttcttccttatcccagcaaggacgaggaggtgggagacatggagagtactggcctttggccacgttgtgagagaacaattcctttgtgcagggttcacaggaaatggaacctgacccattaggcatcagcccccggtcaggcaacatcaccccttccctgggtaggtgtgtgggtggaggggctgtgggttccttagcctctctcctaagccaaacccagcaaacggctgccttggcaacccctcagggatgacagcactgccatgctctctggcaggcataatgttgccactgtgcctgaggccaacaccctgcgtcaggctgcaaacatccattcccttccctgtggggagggaggctctgggggccttagtgggagactctggacagggccaagagactgttgtatgcacactgcctccagcctgtcaagaaggcggcgtgcctggcatcccttctactggtgattggtgcagatcccttagctttttaaagcttccttgttttgtctgatcacacacagcagagctgccctgtatttggcagttggcagacagacccatcactccccaccatgtccacagtcacttgtgcatcctttcctataacatccttgtcaggagcttggtattagagggagttgtttaagagtggcatagaaagcccccatattatccttcccaaggtcttgggacagggtgggaaatgttcatcttaaatttgtaaaatggcatcattagtacagggtgaagaaggtgactcaagtagtcaaggtggattgaggtcaggaatctgtctataccagattggtcctgggcattttggtggatggatgtggggcttgcactgtgtggttgagaggccttataaggttgccctcctggagagctggactcggatgaccacctaaacccagagaacctgatatgggtgcccaggccaccttcccagtggtccctagggatagtgataactataatgatgtcatatctcctttgtcccagagtttcagtgtttatatataatatgagttgagcccaagtatgttgagcccctatttggtggcagacactactttaggagctggagagatatagtttcctgggatttttcaaaagccctctgctgagtaggcaggacttggtacctctacttgaaaggtgatgaaactggagccagaaaataggaagtaatttgcctgaggtcaatagctaaataagtagttggaaataagacagagtctcagtacctgactcctagtccaacatgcttttcatgccctcaagctgtactgggtgttggctttcatctttctttcctgtatctgtccttatagagttggagcagcattttatagagggcagagggcagctgttgtcctagaggtctcttattcttttactagtctaacagcacagcaatctgatttgaaaactttacattaacttcttgggcagaattttctttttctttgttcttttctttctttctttctttttttttttttttttttttttgagacagagtctcactctgtctcccatgctggggtgcagtggtgtgatctcagctcactgcaacctctgcctcctgggttcaagcaattctcctgcctcagcctcctaagtggctgggactacaggcacctgccaccatgccgaattaataatttttatatttttagtagagacgtagttttgccgtgttggccaggctggtcttgaactcttgacctcaggtgatccgcctgcctcagcctcccaaagtgctgggattacaggcatgagccaccatatctagccttttttttttttgagatggaatctcgctctgtcacccaggctggagtgcagtgacacaatctcggctctctgcagcctccgcctcccagattaaagtgattttcctgcttcagcctcctgagcagctggtattacaggcacatgcccccacatctggctaatttttaaatttttgtggagatggggtttcaccatgttggccaggctggtcttgaactcctaacctcaagtaatcagcctgccttggactcccaaagtgctgggattacaggcgtgggccaccacttcctgggcagattttcagggggttgattgcatgtctggactggccccctactgcctcctgcccttgctactcagggcagaaagcagcaagaagacagaaatcctggtttgggggaatgtgacatctgtgcacgttcatctggggatctttgtggctcttgtttgactccagacccaggaaccactagccagggtgtgtccaggctgctgtggtgagcctgaggctagctggcttcctaaactagccctctgcagccaccatgaacaggaaaaccctttttgtgtcaccagccaaaagttgccctcaaagagtagtttctgctgggcacagtggctcacacctgtaatcacagcactttgggaggccgaggcacgtgggtcgcctgaggtcaggagttcgagaccagcctggccaacatagagaaacccccgtctctactaaaaatacaaaaattagctgggtgttgtggcgggcgcctgtaatctcagctactagagaggctgaggcaggagaatctctcaaacccaggaggcagaacttgcagtgagccgagatagtgccattgcactccagcctaggcaacaagagcaaaactccatctcaaaaaaataataataataaataaataaaagagtagtttcctgggattcctgactagttgcctacccagaaattggctgcagagtttcctgtggctggaggaaaactggggacacttgggctgaggaggactcagagctggaggagagacaggctagggggctctacttggcctcactgcccaggtgctaagaaggaatggtgatcccgcttctcttgtctccatctgacttgggtgccccattcctcaggccatgggcagtaacctctggagtctgattatgtaataactcacacaatgtgggacttggcctttataaagccctttcatttgtattacctcattttatcttttcacaatactctagtgaagtaggcatttcttatccctgtgttttacatgaggaaaccaatgtttagaaaggtaacgtgacttgcccaaaattacctggctagaaatagcagcagaaccagtctggaactcatgcactcagtctcctccatccagacgtgtcccctccacctcctggggtaaaggtggagaaatccagtttggaagatgtctctggaccctagagggttcttgcatctgttgtaatacaagttctgaaatgggtcacagacgtgggtgggaagaatgtgtcctagtctggtgggtggctggctctggacaagacacaaaattttgcccctaccctgggatgcttggaatgtactcatcccccctccttctctggggaagccaggagttgtctgcaaagggagggggaggtaggtaatattaggatgtttacattattatccttttgactcagggtgggggtggagggattatgtaactgaattgcgggactctgaggccaaactttatttctatcttctgagtaactacctgtggagtttgaatgatggactggaagtgaaaaacagactcaacttcagcttccctcctcccaggaaagcaaagtctctgaagtcatccagactgctgttgaatcctggctctacgactcactagctttgtaaccttgggcgaggtgtttaacaaaagctaagcctcagtccatctttaaaatggggctagtaacttctccttcacagagctggctttaaatgaaataattcttgtaaagcagttagcacaaagtacttggctcatggtaagccttcaatgattgctaattattattctttattattcaagttatgagtaataaataataataacatagtcagagagaagggtcagactgccccccaggagcctatcagatatgcttccttggagttacctgcgctatcctgcattgttcaaagtggaaggaatgatgaatttggaatctgccaagacttgttcctagtcttagccctgctgcttcctagttgtgccacttttggtgaatcacttaatttctctgacccttaatcttagcttttccatctgtaatatggggttgtacctgcctaccagaatgttaggaggctcagttgagctagtagataaggctagtggcttgtgaatggtaaactgctgtgcacaagtgattttccaggggtgcttgtgcaagtgtcctctatgtcctggcaggataggggtcgcttttaggcctacatgggctgatgggacagatacatggagaggctgggcaaggaactgtggactgtgctatacgtatagtgggcctgacctacatttatcctgctgtgaggtggtttctcgaagtacccaggaggaactagggcagggagaggctcagggcaggaaagcaagaatgcagtaccacccagcctggcccctctgccactgctggttgtggacaagtctgtctcttggagcttccctggtgctctgtccgcaggaagaagggattccttgttctgaggtaccagagaaagcacctccttcccagagaaagcacagctcagaaaagagggccaccaggttcttggtgcttccttcagcagctggtggtctaaagtcctcaggcagacagtgccactgtgccccctggctggatggtaggcagttgtcaggtgtgagtgggcagcacactgagctcagagtcagacaatctacatctacatcttcatttctgtcttactgtgtgaccttgggaaaaccactccacctttctgtaaaacagggctcctacttatatcaaaggatctctgggatgctcagataaaggaaaggatgtgaatgtgcttcttcaactgtaagcacgtctgagtctttctaagagcttcaaggaaatgctttgtgttagaaaaggcagttgccagcccggtgtggtggctcatgcctgtaatccttgcacattgggaggcagaggcgggtggatcacctgaggtcaggagttcgagaccagcctagttaacatggtgaaactccgtctcttctaaaaaattacaaaaattagctgggcgtggtggcgggcacctgtaatcccagctacttgggaggctggggcaggagaatcacttgaatccggaggtaggggttgcagtgagccaagattgcgccactgcactccagcctgggagacagagcaagactctgtctcaaaaaaaaaaaaaaaaaaagaaaaagaaaaagaaaaggcagttgccatgtgatttatttcttgagtgagaagagccaagggattgtttctgacagtcttccatgctctggcagggcagctgggcagaaagatgtttcttgatttgtttggtttgtcctgtgatgaaagaggcctggtagctcagcgtgcagaggccaaaggccagagttgagctcccaagttgggccctgcacccagggggagctggagttaaatgaaggaaacttgagaaaaacgactcctggcagaggcacagggcctattaataggctggacagcagtggagagggactggacgctggaagcacgatggggaaggctgggtttatttctgggtcagaatgttgaggggcctcactggagggagtgatacgaattccctcaatttagcctaccagctcttgtgcccaagccctcataagtggcttaaacagaacgcctgaacacacatgtcataaatcagccacacgtggaacatatctagctgaggccttcaagtcctcccttgctttttccatgcctagaacaggattctcagcccagagaaccagaggaaatggaaaaggggagggtgtcaagtgagagaggaatgctacagagctttcagaggggctttaaagagttttctactagaggagaaggatggaggatgggcagggatcgtggtcagggattgacaggctgagggtatgaggaatggggtttggcttatgcaggtgggccattgccaagagaggccaaagcactaactccatctccttcttgttctgtcttgaactagctgccacccgggttaccatggagagaggtgtcatgggctgagcctcccagtggaaaatcgcttatatacctatgaccacacaaccatcctggccgtggtggctgtggtgctgtcatctgtctgtctgctggtcatcgtggggcttctcatgtttaggtgagtgttggggtcccctgcaggctgtttctgcaaatcactccctttcttcctcctcctgggccctctccttgatggtcacatgcacttccctcaatctttccaaatcatgggctagctccggggtgtagattctccaaaaacctggtatttctggcatgacatgagtcctgtgtctagagcccagggtcaaatttgcgaggccatagcaggttctgctcctcacaggagttcttttcctgcctccatgacccagctacccactcatggagtcactttgtcacacatttctttctcctggctgttctttgatggcattagtatgtggtttggtagtcaaggtgtgggtggtgctagtggtatatccttccacttctgaggcgtctggacctcaggccctgctttctaatccaggtatgctctagcttgggagacccaccaagcactctatgcctgttttctttctttctttttttttttttttttttgagacagagtcttgctctgtcgcccaggctggagtgcagtggtgtgatctcggctcactgcaaactccgcctcctgggttcacgccattctcctgcctcagcctcctgagtagctgggactacaggcacccaccaccacacccagctaattttttctattttttagtagagacggggtttcaccatgttagccaggatggtctcgatctcctgacctcgtgatctgcccgcctcggcctcccaaagtgctgggattacaggcatgagccaccgtgcctggctctatgcctgttttcaagcagtgtaactcatctgtcatgagacctggaacaagttactgtctttctgaggattgtaaccttgtagtgattgtaatgtttgtccatctacctcataaggatgttatgaggatcacgtaaatgaggtgaaagctatttgtaaattgcatcctgctattagagacaggagttcctcggggcagttgggcctttgaccagagtttgggctgccctactgcctgggcttttccaagtagtagaggaaaccaccatggcagagttctttggaaggacctgctctggacctgcactttgtcatagcaggcagggcttattcacaaaacttatcttcctcaggtaccataggagaggaggttatgatgtggaaaatgaagagaaagtgaagttgggcatgactaattcccactgagagagacttgtgctcaaggtaacgctccatcctttgccccatgacatgattatcctttgtcccctttcctggctgtgcttcagtgggtgctgaattcttcatataggggttgggggccaggctactgtgacattaatatcccattgcagaattattttcaaaaagactcagtgcttcacttaaggtaaaagttgctagagagacacctaagagagatgcctgagaggacagcttctcccaccctcatcccctcccttcccctcccctctcctcccctgggagacagagtgaaaccctgtctcaaaaagtttaaaaataaaaaagactggaccaggaaaatcttaagacttctttagactggacctggctttacatgccttccttttgtgctttaggaatcggctggggactgctacctctgagaagacacaaggtgatttcagactgcagaggggaaagacttccatctagtcacaaagactccttcgtccccagttgccgtctaggattgggcctcccataattgctttgccaaaataccagagccttcaagtgccaaacagagtatgtccgatggtatctgggtaagaagaaagcaaaagcaagggaccttcatgcccttctgattcccctccaccaaaccccacttcccctcataagtttgtttaaacacttatcttctggattagaatgccggttaaattccatatgctccaggatctttgactgaaaaaaaaaaagaagaagaagaaggagagcaagaaggaaagatttgtgaactggaagaaagcaacaaagattgagaagccatgtactcaagtaccaccaagggatctgccattgggaccctccagtgctggatttgatgagttaactgtgaaataccacaagcctgagaactgaattttgggacttctacccagatggaaaaataacaactatttttgttgttgttgtttgtaaatgcctcttaaattatatatttattttattctatgtatgttaatttatttagtttttaacaatctaacaataatatttcaagtgcctagactgttactttggcaatttcctggccctccactcctcatccccacaatctggcttagtgccacccacctttgccacaaagctaggatggttctgtgacccatctgtagtaatttattgtctgtctacatttctgcagatcttccgtggtcagagtgccactgcgggagctctgtatggtcaggatgtaggggttaacttggtcagagccactctatgagttggacttcagtcttgcctaggcgattttgtctaccatttgtgttttgaaagcccaaggtgctgatgtcaaagtgtaacagatatcagtgtctccccgtgtcctctccctgccaagtctcagaagaggttgggcttccatgcctgtagctttcctggtccctcacccccatggccccaggcccacagcgtgggaactcactttcccttgtgtcaagacatttctctaactcctgccattcttctggtgctactccatgcaggggtcagtgcagcagaggacagtctggagaaggtattagcaaagcaaaaggctgagaaggaacagggaacattggagctgactgttcttggtaactgattacctgccaattgctaccgagaaggttggaggtggggaaggctttgtataatcccacccacctcaccaaaacgatgaaggtatgctgtcatggtcctttctggaagtttctggtgccatttctgaactgttacaacttgtatttccaaacctggttcatatttatactttgcaatccaaataaagataacccttattccatagccttttgtctgtttgttttaaccgggaactggtttaacttagttatttcctaagccctgacttggtggtaggctctataccaggcctatttatgtatactaccacaacaattctgcgatgcaggtactattactgtcccatttttccagaaggggaaactgaggctcaaagtggttgtgtaacttgcttgaggatacacagctagtaaatgacagagctgggactagtagtctggctccaattattttgtcttagtacttataccatgctatctctgagataagaaagaacagatctttcgcacagcatgtttagctggctgtaatcagggaagatatccacccattcagtcaacaggccctggactcaggatctactcctatgctgcacatatgagcaggcattgcttctggcaagaacaagatgtctttgactaccctatcttgctccacagccaatccatcagcaaatcttgtcagccctacctttagaatacatgctgtatgcaaccacttctcatcactgccactaccatcacccagtccaatttcgcatcatctcatgcctgcacttttgtgatggcctctgcctttctagttccatcttgcttccatataacatatttccagtgtaatagccagagtgatcatgtctttcagatcttgtctgctctgcaggccttccctgaccaccgtattaaacaacagcacattccttctcccatcctactcttactcttcttacattgctttttatcaccactaacatattcctatttgtttatagtccatctcctcctatgaaaatgttagctccatgagggtaggggtgtgtacattgctcctctcctagattctaagacaatgcaattgagtggtaggcactcaatatttgttacctggatgaatgaatgtaggaaatacaattcagtccaatgccagcaagtggacagacatgcaatccaatgctgccctgaaagtgtgattggattagagaggggtctctgttggggaatgtggatggtggtgacaaaatgaaagtggaatttggggcatgtcatgtgtcctggtggattggacagtccatcaagtggactggggcagtgcagtagcactggacaagtgccactgggctgccccttcctcatcctcttcccttgcagagttgtgatattctgaagtttctccaggagcccacacggagatcttgtatatacttggaacatcctttcaagactttaggcactagtaactattgaagctgaacatatgcataccccaggagtaattccactcctggggattcaagagaaatgagtgcatatgttcaccagaagatatgcacaagaggctgggcactctggctcacgcctgtaatcccagcactttaggtggccgagacaggtggatcatgaggtcaggagttcgagaccagcctggccagcatggtgagaccccgtctctattaaaaatacaaaaacttagccagtcatggtgatatgtggctgtagtcccagctactttggaggctgaggcaggagaattgcttgaacctggcaggtggaggttgcagtgagtggagatcgcgccattgcactccagcctgggcgacagagtgagactccttctcaaaaaaaaaaaaaaaaaaaagatatgcacaacattaatccaagcattatttataataactaaaaactggaaaccatccaaatacccatcagtatttgatgataaaaatgaataaattggggatatatctatacagtgaagtactaaatagcaataggaatgagttgcaaaacatattgctcagtgaaagaagccagattcacaaaaaagtatatactgcgtgattccatttacttaaaatttaaaaacaggcaaaactatggtgaaaaaaaatcaggaaaaagactcccattgtgatcagtaaagactggaagagagggacttctggtgttctgataagttgtgccatggttgggatgcgggctacacgagcg

SEQ ID NO: 16910 - DNA, 59479 bp, Human
  misc_feature (1)...(59479): n = A,T,C or G
gcaatatctacagttcggaaaaccaagcattgtagcagcaatgttcatttcaggattttgccccccctccacttcttttgaaggactcgtcaaacaaaacaaaacaaaacctccttcttttgaaggaattgtcaaaaacaaaacaaaaccagtaaagttttccaaataaaaccggtatcggaaggaattgggtttcctgttttcctcagttgcttataaatgtgttgttattcagatttttgctatctaagaatgatcagcattctaacaccactaatgaccccaaaccagtatgctttgtgcggtggggtggattggaaaggaccctagaatttatctattttaaatctacttttctggaaaaggaaccagtgccagaaaagtctgtcagaagttgggactagaatccagtattctctgccttatctcacacttttttgaccactattttgagttcttcagatgagcaacatcttagttaagactgcctgtggtcaacttgtgtaaaagaaataggacagccgaaatagctgttgcttctaacaaatgaagcttttgttagtgttgtgaggatattatgtgtttgtgtcttgcttttgttcttcttgtcttgaatcttgtaaatttagctcttaggtggagtctctaatctttaacagtatactagctcatctttaatggtatactagcttccttagcaagctgtatagagcagtcagatgatacctggaattttacatttcaaaacaaaattgtgcattctaaaaatttaccttttcttctgttaaaagtaccgatttaaatcagggtttagtgaatggatttgcctcccggtacttttgaatttattgctacatttgaaacttgcgggcggtgaatgcaaactaagaaaatgattacaaacttaaaatgaataattttgataaccaattaattaaaaaacttgtttaaaggttttatcttctaatgtttttacagggtcctttttttgggtggagacaaataggaaatttcaggcccctccccttccccaaagtaaatctttcaaaaccttactagtaggtgaaaacaaggtcacaataaaaattatgtagtagcctttgctgtgcattgcagtcacagatgttattaaggcacaaatttaacagcatgtgaaagtcattccaggcacttcaacaaaagtatccaagaactgtttatcttccagttaagtaagtgtacgcaagggtcaaatttggcctggtatctgtggatgaagatcatgatgcaattcttttgccagtgctttgcattttttctcactctctttcttggtcttcctcttaaaaatgttcatattatgaatattactatagacagtggaatggaaagattgctgaactaaggggttagaagaaatggatttaaataacacctgccttccccccagtagttgttcaaccttgtgcaagccacttttatctcttaactcatttggttacttaatttgtaaattgtggatgatgagactgccaatgctaactcatggaattactgagaggcataaatgagatatttattatatttcctcattaatattcttatattaatattcccatgttaatatttcaaactaatgtgagaaagtgctttgaaacctaattgtgcaatacaaatgtagtgagttattacttttatggttcttgttttgaatctctggatttcatccttgactattgcatttatttcttttactactccttgagtacttgctacttaatatggttattacttaatatgcatttgatttgcttcacactgattgtatcttctgatgattgtaaattcagtatttagtatggtgacttgattgtttacagttatgttgacttttattgatgtttggtaaatttcacagctttgtctctggctagcatattttgttttaatatatttggatttgaggtaaatgtttcctgtaaaatgttttacctactaaatcatggacttgtttttattaggccttcacagagcttcaagccaaagttattgacactcaacagaaggtgaagctcgcagacatacagattgaacagctaaacagaacgaaaaagcatgcacatcttacagatacagagatcatgactttggtagatgagactaacatgtatgaaggtgtaggaagaatgtaagtaaaatgtgtccttaatggagttattttgggagtgcttttgtccgagttaaatagaatttgttcatcttaaaacttgggttaggccaggagtggtggctcatgcctgtaatcctggcactttgggaggtcgaggcgagtggatcacttgagggcagcctgttggccagtatggtggaaccctgtatctaccacaaatacaaagattagctgagcatggtggcacttgcctgtagtcttggctacttgggaggctgaggcaggagagtcgcttgaaccccggaggtggaggttgcagtgagccgaaatcatgccactgcactccagcctgggcagcagagctagactctgtctcaaaacaaaagaaactttggtttaaagtaagtatctttttctttttgagacggagttttcgctatatcgcccaggctggagtgcaatggcccgatcttggctcactgcaatctccgtctcctgggttcaagcgattcccctgcttcagcctcctgagtgactgggattacgggcgcttgccaccacgccctgctaatttttgtgtttttagtagagacggggttttaccatatttgccaggatggtctggaactcctgacctcctgatccgcccacctcagcctcccaaagtgctggattacagatatgagtcaccacacccggcaggttaaagtatcttagaaataactttaaagattatctaattaaatgctttctttttttaaaatgaggagctgaacttcaggtagattaattaaagtgtttaagtttagactttaaagtacattttttttttttttttgagacagagtctcgctctgttgccaggctagagtgcagtggtgtgattctggctcactgcaacctccgcctcttgggttcaaacaattctgcctcagcctcctgagtagctgggactacaggcgcatgctaccacgcccggctaatttttgtatttttagtagaaatggggttttaccgtgttggccaggatggtctcaatctctcctcttgatccgcccgccttggcctcccacagtgctgggattacaggcgtgagccaccgcccctggcctcaaagtacatttcttaagtgcttactttcctgttctgtctatgattaggtacttaagtgtaagttcagtaataaaaatgatttgtcatggaaaatgtttatagcaatattatattgtatgtgaagaagatttatttaagtaggtgcagttttaacctcctcttccctgcttaatttattaggagtgatacaaatcataaatctttcagatgtctgatcagtgttgtaaaataaaaataaaaattcaattgtcatttaaatacactcattctggccaggcatagtggctcatgcctgtaatctcagcactgcaggaggccaaggtgggtggatcccctgaggttaggggtttgagaccagcctggccaacatggtgaaaccccatctctactaaaaatacaaaaattagcgaggcatggtggcgcacacctgtaatcccagttacgagactgaggcaggagaactgctcgaacccaggaggtggaggttgcagtgagccgagattgcgccattacactccagcctgggcaacaagagtgaaactctgcctcaaaaaaaaaaaaagtaaaaaatacactcattctaagtgtcatgcattgttctaacaggaggacaactcacatgtgagaaatctagtaaattattttacttttgtttgttctaattaatacattattaacttcgtacatttcacctttttttcttttaaaagcatattgcccttgtgagagagaataggtctgcttcatattctgtaagcagaaaaaaaggaatggaaaagcccttaagtacaggtcacattccattacagtgagctaaaaggagaagactgattttttttttttttaagttggggggaggtacaggaggagggtttttctggaatttggtctttgagtattacttagtaagtagaccattacttcagatttggagatcttttagttagaatggaatttgacctcagtctcgggatgacttgttttgtgattgatttgaagaaagaataacatgtgtaaaatttaataatgactttggaatgacatcatgagaagtagacctgctcatcactgactaatccatatctttatggttcagaattagattatgttaaattgttcatctgatttgctttctcagaatgaataatgtagcacaagtaaattttatgtccaagctcatatatttcattttagtttaagaggataaggatcccaatttgagagtttgttactgggacacaaaagaattggaacaaagtagaacccttgaatatgtgtctgtgtagtatgaaatgcattgttggcattcactacaggataattttatccttaatgtgaatatccttaggtcttaaaacagtaatgccagctttattaacatgttgtacttggatttcacatcactgcgctagcctttgtttgcaatagctaaagaattcctttttcaaaatagaaaaaacgttttactccctttgggcttttgagctacagtgaagttttaatttttaattagaatagtttcatttattaaacgttctgcagaagtgttaggagagttgttttttgtacatattttccaaagtgctacagataagttgttttccataccaagaattttggagtttaaaggctaggatatgaattaataaatagtagaatggtattatttccagaaggtttatttcatataaattacgtttcttaaaagaagtgtggagttttaaatgtttggataaagttgagcttctacatgatttcagacttctgttttaaatttgactttagtgctgtctgcatctcaccgggagtatgagtttgaccctgtattgtaggggcatgtaaggtgaatagcgtttgttgtttggctagcgtattagtgccctgagaggaagaaaagacttgctgagtattagtctggtcatgaggatgttctctttcttgatgctaaacctgagatatctatttctgaatttatagtcgagtaattttgggtatcattgtgattcacttctttaattctagtctttaccttactttgttttttcttttccattttgagtgttatttgggaattctgactagaatattactttttcccaaattttcattttaaaaccgtaataaaatggttataataaaatccaaaacttcatttttcttttagaacatgcagtagattttcccattgctgaaattcaggtctcattgcttcttgcctggacttttatgatagcatcttaactgttctttcttcctgccttcattctgtctgtccaaatccattcttcacatatctttcagaattaatcacatcaatattcttcctaaagtcctttgttcatcctctgttgtccacaggataaaatctaaacttgttggccttgcattcatggttattcataatctgttcttaatttaccctttgcctcaagtcccaccactttctttttccagggttaggatagcatgtatatttcatctcatggacctacctccttctactagtttgtgttatatgttgagaagaattttgagatgtcaaatgggttttaaacatgctttaattgattagtgatgtctgttacacagtgagggtagaagagtagtagcacatgtactagaaattgttatcctacccttgccacataggtttcctcacacatgttatgtttttgtgcttttttgcttttgctcagtctttggcgaataacattgtccttggctggcaatattcctcttttccttgtgaaattcttatccttcaagacatagctctactcttactttgcctctgaagattttttcagcccctggggcagactcattcactctttccttggcgatagtagggcttttgttcctacagctagtaaagcacattgagtgtgtaggtgtgtttaaatgggtcggtcttcccagccagattgtcagctctgggagaccatgtatatatattatctttgtttcctcattctcagtataatgtctggcacaaaatagctattaaatgtgtattgatttgaattgaatctgattcttttttctggcctaaaataacttttttcttttggtttcttagaaaaaaaagtattttagaaagtgttagagacttaagaatgagtttattatcctattttaatatatgatccatgtaagatgaaattataaaagtaacatatattttgactaaggtcaaaaaaattatatctgaccaaaatcacgtcctctgatctgacaggattaattcttcattaaatatattgagaaggttgtctaattctaaataccagccagttgaagagacactcagaactaaaaatatagaaaacccaaaccttaaagattatgcttgagggtagtataatccttagagaataaaggctattttatgcataataatatcaatgtatttttatccattttaccttcctcatcttcacacagaatgtaagtcagattttttttttttagggtatgtatttagttaaacaaatcattgcagacccagatatctttcatttcataagtatggacacattttgtagtgttaaatacctcttatacatggctatttttggtttaaaacaaggaaagtcaagctacaggataagagatgatgaattgctatatactgtaagctctgagtatttgttgctcaaagctatattccatccagtcttttggcgtgttgccagcacattttagttctcttacttcatcttctttagagaggctgttatgtagcctgatactactaccaccaatttctagttttgctacttaagctgtttgtgagctgacctcaccatactgctttgagaactatgatgaaagttacaactggggaatgatctgtctgagtatttggaagtgtttgtctttgcatctttctagcatgcaaggagggaatagacaaatcttaaatgttatgtgaatatttcttgtatatattttttcatggataaaaatgtttataattgcttgtgggggttttcttccttttctactttgcatagtagaggataggagtatttttaaaataagaattatatttgaaagtgcatataaatgacatttaaccatactagtgtttgaaaggaccatcattagaataaatgtcaaacttacttttatgaacaataagtatgatcctaaccctgatttgatgtcagatctattatttgaacaccctttttgcttgagcattacataaataacatttcttttttccaaaagagacaaattaactttttttttaatatgaggaacttgagtagattagcctttaaaaagaacaattagtgcctttttaaaacttgaacctaactaaaaataactttgtaccatatttaaactaatttagaggtatgctaccattctgtgggtattttttacatttaaggaactaagaatgaacaatggtataaatctgccaactagataagtgtctagcaatgcaaaaattgctgtttgggagcggtgttactatttctacttgttgaagtaatttaatggttgatctctaacggttgaaagatccagaagtgtaaaacttaagataaatgtggcataagtagaaagtgaaacagtaggtgtattcctgataggtaacaattaaaaaaaatctaaatagttaagcagtttttcaactgtttaggttgtagaaatctgaactctttatgacagcttggctgaactgccctttgtttagaatgttatgttggttttgttgtgattgtatttcttagtttggatgttgacctataatttgaatcgtggcatttagtaaaggtgggatgaaatatatgcagcttcccttagttatgttaaatgttaatagaaaggggtatgctcatactgcttcaagttttgcagcccttttacaatttcatgtagctatagagttggtcttccagtcaatttcaggtaattttaaaactgaagaaatggtcatactatattttattgctaagagattaggaaatgaaatttaaaaaatcttagtatagtaaatattattgatattgttgataaatactgttgatattacagtgaaaatagtttatattgttgctctcagcagaatcaaatttggatattttatttagtgcatactacaggggaaaaaataatgtgtgagattacttttggtgtgagagtcacattgcaaatgccaatttataaattcattttataccctctttaaaggtattaatctgtattttagagaaagtgaagcaaagatagttgtcaaaagtaagatgagattactttttagattttacttgaagaaagagaagttcttggtgttcagctgcttttactaatagaacatgacccacccttcttgtgtttttatacagagccatttaaagtcatggctttcattgcccagagttctaagggaaaacaacaacatcttttcctgttgtgcagggaaaaatgacttaagttttgttgacgctgaatatgtatataaccccagatgggcacacattcctcttgcacagatttagtactctggggagaggagatttttaagtcatattcttaatttccttaagttgtcagtgatttaaaaacttgatgttcattataactctgctctactgctgtctagaatgacatcactgtttttgtgccagagggagttaacaaacatttgcgtaagaattacatagtcctgtttcttctgcagacgagtactttttaataattatttccctgcttcccctcccatatgccccagtctaaagattctcaccaaaacacaggaaattaattttgaaaatgttatgctaattagatgtctattgttaaagaagggaaaagtctgttatcttggagagtacaaacatactaaaataaacttgctatggggttacttattttaggctttggacctgttttaaaaacataaatgtaattgattcatttagctacttggtggactttgcttgcttctgcatttcctgacatcaaaagacctggcctttttttttttttttaactgacaaaggattaaacaaaatcagcctttgttgtatgaaaagtagcagtcatttgcgggatactacagtgttttccagtcaatgataagcaactgagcgaaaggtgaaaagtaccatttgcttgctgttcctatgtaaaaatattaaggtagcagcagtcttgaactgttaactttgtcactgaggaattgtgtgctgtaactgacttaattagctgaatttctctgaaaacagtcaattttaagccataccaagaattttctgattttagctgccacttatctcatagtgcaaagttaggaataacttactatctaatctgagagagaggactgaaatgttcatgtcaaggaacataatctgcttaatgaaatatccaagaaggagctcagaaaaatattgacttagaaggtgagtcagttcatatatatgaacacgcacttggtaatgccttttgtcattcttttttatttataatatcagaaattgctgttaactgcaaatatactttactctgatgaaatacttaggattactagtgtgttacatgtaccattagtgcccatgcttttgtgaagagtgtatccttatttcatttatataatttaagttcaaatggacctgtctgggagaatgttacttcattgtcctggccaggaactcttattaccaactcttgttttgcagtagatcagttgtcttgaaatgaactacattacttggaagctactatgcttttcactttgaagaggacttgaagtattctgataccaaaattggtacagcaacaggagtctagtatcaaaaatgtatctttaaatagataagagcatgactgccctaagcccaacctttacactggctcagagtaaaaagatttggatcacaatatgcatcctgtatgtgtgtgtctgactgagactttggcatttgtgccaaagtatatttatatttctctatgacattctgcttttgtacaaggagtactctgctctctgtctgtcttctaatactcattggatagtaattttaaaatattttatctattgctatattttaacttactagtaaaataaagatcatatcttggaaaaagttatggaataactcactgcctatacgtggaatgtttggggtttgatgaagccagagtaaaagtggtaaacatcagaggtgcttacttaccagaatacttagaataccaaatagtaacccgaaataaacatcatgtttaaaatagattaacatactactgcttccatttcaggagtaatagttttgatttaaaaataggcagtaatttttaattagtaaaaattgaacatagcagtgtgtgttactctactagaacaaggaacgcttgtatgggattgggttctggaagggacagtgattctccagtaattccagtgagttctcagtcctcatcttatttgacctatcagtaccatttggtcctgttgacctttcttccttgaagcacgttcttaccttggcttgcaggacaccacttcttgatattcctcccacctcactgtccattccttttcagcttcctttactgtcttcatttcttttgcatttgtaaatattaaatttactttgtccttagcccttggattttttttttctttttttggtctatatgtactcagtctcttaataatctcatccaggagtatctctaaatgcatttttatatactgacaactcccagattttttatctttaacttagaccccttctctgaactccagacttgtatattcagctgcctactttacatcttcatgtgatggtctaataggcatctcagaattagcttggccaaaataaaatttttgctgtttataaacaaaccatctcctctctcagtattactaagtggcttttccacacttcaaattcttccaaatcttggagtcacccttggcccctctctttcaatcttatattcagctgattagcaaatactgttgactctatctttaaattttgttcagaatctgaagacttctacttaccaccaccctggtctaatttaccattggtttatggcagttgcttcctaactaggctccttgcttctgtccttaaccctttatagtctgttttaaactgatcagccagagtaatcctttgaaaatgtaagtcaagatcactgtagtcaaatggcctcccatttcatcagtgaaaaagacaaagtcttttgcacttgccagtttctctgcctgaagccttcttccaggtgtctccatggcttaccctttctcttcctacaggttgtttctaaagaggcaatgaggcctttcatgaccatcctatttaaaagtatacacctaaccagcacccacacttatttgccccttgttggctttatttttcttcatcgtacctcaccatctggggacaatgatactaattgtctttcattttttcccttcttctaccctctatggtatcagatgtctttcttaaagaatcagcattattgagttataacttatatagaataaaatgcattcattttaggagtacagttgggtgaattttgacaaatgtaaccaccaccccagtcacgataaagaacattttcatcactctaaaataatttcttcttgctcttcaactgaatcnnnnnnnnnnnnnnnnnnnnctccaggctgctgctaatgtgatttctatgaccgtaaattaattttttctgttttagaactttatatagatgcaatatataaatggagtcattatagtatgtactttcactgagtgtaatgcttctgagatttactcatgtcatataggtcaggcctcctcaggggccgtatgctgggcttcatttcgacttatttcggtacgctggccctgcccttctccctgtgtttgctagctttgtcatcagcttggctacaggaattccagggattttattgaggcatgacaacaaccagagtgagaaagtgccatgttttctggtgtcaccttcatgggagcacctttccagaagtcttctaatggtctcccacttatatttcatgacagaaactgagtcacatgcttaggcttaaatcttgggggatgcaactgcaatgattgggtaaggccaatcaagattcagcctagaactcaattctctgatttacttgggaaaatagagagtaccgaaacaaaattggggctcaatcaacaaagaaaaggaaatggatatgggataaacaataatgtctgccaaagtcatcaacagtcattatagtgatcaataactgagggctagctatatgaaaaccgttgatatatttaggatgaattaggcagagtttagtctgggagcataggcaggcaggaagctattcaggaggttagtaataagagcataaattaaggtggtggaagtggaatagtgaggtgaagggtcagtatgagagaaagtgataaattagaaatataaggaggatatctgccgttttgggacttgcatgtggtgatattgatggaagctgaagttgagatggtgaaactacttatagggaatgttggtatgggttgataaaatgagtttaatttgggccatgttgaatttgaggtgatatggaacatacaagtagaagtgatcatagatgctgaacatgcatggtgcaggtgatagtggttgatattattttgagggttattagctaagttgaggccttgaaaataaatgagttctcctagggactttgggtagagattgtttagcagagagccttgcatagtgcttgtagtatgggcactggagaagaaagaggaaggagggatttatggatacagtagttaatgagggaaacatggatagcatagtacagagatgaagcagcagcatccctcagagttagatttgagcatacagtgatctgtagattgcttttgtctaggtatgacagggtctaggtgctgtatgtctgttataatctagtactacattatttattttgttgctcaaataattctgctttgaccattgggagctctttgagatttactcctttttttttttttccttctcccagtctagaaatgcagtagtgtgattgtggcttactgcacccttgacctcctgggctcaagcagttctctacctcagcctcccaaatagttgggattacaggcatgtgccaccaaacccagctaatttaaaaatttttttgtatagatgggagtttgtcatgttgcccatgctggtcttgaactcctggactcaagtgatcccctcacctcagcctcccaaagtgctgggattacaggcgtgagccactgtgcctggcaactattattattattttttgagacagagtctccctctgtcgcctaggctggagtgcagtggtgtgatctcggctcactgcaaactccgccttctgggttcaagcaattctttgcctcagcctcccgagtacctggaactacaggtacccgccaccatgtctggctcattttttttatttttagtagagacggagttttgtcatgttgtccaggctggtgtcgaactacagacctcaggtgatctgcccgccttggcctccccaagtgctgggattacaggcatgagccaccgtgcacggccagcaactttatttttttatagtagttttagtagtacggaaaaattgagcagaaagaacagcaagctctcactccctttccactctctcccacactgtttcttctcttattaacatctggcattagtgtggtacatttgttacaattgatgaaaacatattgataaattattgttaactaagatccatagtttacattaggggtcactctttgtgttatcatacagtatagtttcactgtcccccaaattccttgtgctccacctgttcttctcttcttccccttccttccccactgtcttccctggtgaccactgacctttttactgtttctatatatagttttgcgttttctgaaatctcatatagttggaatgatgcaatatatagcctttcatactatactggtttcttcgacttagcaatatgcatttaaggctcctctgtgtctttgtgacttgatacctcatttcgttttgtcgtcgaataatattctattgtatggatgtactgacagtttatccattcacttattgaagaatattttggttggttccaagttttggcggttacaaatgaagcagctgtaaacatttgcacatgtgcatggaagttttcaactcatttggataatggactgcatttgattgatcatctgttaagctttgtaagaagctgccaaactgtcttccaaagtgggctgtaccatttttgcattcccaccatcagtggatgagagtttctgttgcttcacagcttcatcggcatatggtgttctcagtgtttgggattttatccattatactaggtgtgtggcagtatctcataattttattttatagttccctaataacatatgatgttgaatatcttttcacttgcttatttgccatctgtgttatctttggtgaggtgtctgtcagatcttttgcctgttttaaatatggtcgtttgttttcttattgttgaattttaagagttctttgcataatttagatgcaaatcctttatcagatatgtgttttgcaaatattttcttccatctgtggcttgtcttttctttagctttttgtttttactgtacttcctgaccttctcatactgcagtatgctccaggttcatcttgtattttccctgccgagccctatagttagtcatttttccaagaagctgtggttcctgattccttttattggagagtggttatttagaaatctatatctggtcactgggtttatttgttactactgaggtgttaccgtttctaggccctctggtgactagcaatagataatatgtgtatatatgctactaattcatgtgtatgtacatatctacagttgtttctgtgtctgttcatcactgtacacatactaagctgaatgtgagtttatactgatatctccgactcttcgataccacagggttcattttagccttcctttcttgcgtatctgtaacttctctctcatatgagaaacccggctcctaccatccagtgtccatttacttatttatttatccccatacacatataaagcaatttcagaattgtttgcctgtatctcctgtgagaaacaaatttaaccaactagttaatccaaggttgattggattatttgtatacatatattcacatacacacatatttataataacttacattagagccactataatatggtacgaaaaagaccgagtgttctaatctaatacatacaagctgggcaaggtatttaacctgactaggtcttatttttgtacttggtaattttttacatacttagaaaactttggccgggcatggtggctcactcctatatataatcccagctctttgggaggctgaggcggttggatcacctgaggtcaggagttcgagactagcctggacaacatggtaaactcctatcactactaaaatacaaaaattaactgggtgtggtggcaggcacccataatcctagctactccagaggctgaggcacgagaattgcttgataccctggaggcgtagtttgcagtgagctgaggtggcatcactgtactccagcctgggcaacagagcaagactgtctcccccgcccccccccccacccctccgcaaaaaaaattgaggattcaagaggaaacatttttcgagcaatgaattttaaaaagctctctctttcttttccagtcccatttcatctttgtgtaaatccttttttattttacatattttttcatcttgaaaatggaatgacatgctgatttttcttttttcttttcttttttttttttttttttgagacagagtctcactctgtcacccaggctggagtgcaatggtacgatcttggctcactgcaacctccgtctcatgggttcaagtgattttcctgtctcagcctctcgagtagctgggattacaggcacccgccaccacaccggctaatttttttgtatttttagtagagatggggtttcaccatgttggccaggcgggtctctaactcctgaactcaagtgacccacccacctcggcctcctaaagtgcagggattgcaggtgtgaaccaccacgcctggctgacgtgctaattttttaaacttgagtttttacttacttactaacttactatattgacatctttacatgtcaataaaaaaaatatttttttttaaatttcggtttggttttttatttaattagtcattcttttttaaaaaaatttatttattttttagacatggggcattgctatgttgcctgggctggacttgaactcttggatttaagcaatcctcacacctcagctttctgagtagctaggactacaggtgcatgccattatgcctggctgcccccttggttttatctcctgttttgtatcctatttctgtgccagtgtggatacttaaggtctccaggattcagcataaactctcaggatgaaagccaatttactgctgtcttacattcctgaattcccagtttcacttcactttggacctttgtggaatccttccttttgtgttagttcaacaaaatgttaaaaaaaaatttttttttcctttgtttctaatcaggagtgttcagggtatctactcttcattatgccaataacagaagtctgtaactcactgagcagtccacaatgtggatgtgccataaagttttaatcacttccttactaaggaagtgattaaagtaagaaataaattcaatttaaaaaaattttaaaaaaagaagttcaatttatttctacttgcttccacgctaaaaattacgacgtaaaaattcagtaactttcctcaccagtggagttaggcaaagaagcaagataggctcattcttttttttttttttttgagatggagtctcgctctgttgcccaggctggagtgcagtggcgcgatctcggctcactgcaaactccacctcccgggttcacgccattctcctgaagataggctcattcttatgtcttttctatgctgcttaatttgtgaataccctgaaacctaaatgctaataggatacgtttttagacaccctctaaaaatttcccacccaaagtgaactcgtcataagcattttgttgtttctgaatagcatatgtctaggtgaccatactttggaaattgtgtccaaaatgcagcagtgcaagtgatctgggattgtgttttgggcaggtgaacaatggttttgattcatactgagttataagaaagtggaagttgtaccaaactgcaggatgatttagaaaacggagtctgatgtttctcaaataatcaaaaccgaaagtctcagaattatgttttcagatggcataattacaaataaatgaggaagtgaaatagcaggttacaagtccttgagagtggacagtgcagaggcacatggcactgatttccaggtcaaagaagaggccttttgcaaagcatcaactcgaattcaggttatataatcctgagtattttaagcatgttatctgcatattatttgtcatgagagaatactttccctcttcatggtttatttttccttattggtacattttgaactccagaattctttatttactatttggctttccataaacaatcaggcagaatgactatgagattctctacattgagcaactgtgtacataatatttgcttatgataagacttatattatcatgataaatcctttctcttcacatagtatctgataatccaatgcccttttaaacaataagaaagatgttttccaaagactttttttcagaaatcagatgtttcttggagccttttccagtcttcatacaatatatctttgccattttttaaattgaggactaaaccaaactttccataagtttttgtgtttgaatttttactgtgtaactactctttgaggtagacatttgcatttacccaacattcatccttgttaaaacttgcgtggctgagatgtccttaggtttgtagtagtaagttggccagcttcggtggaatctctctggcctttgaagttggcacagtccagtatagctacctcaaaggatatgtggtcatggaaaaacgtgtttttgttgttgagtgttcttgctttctagtaattttattttctgctcaagagatttagtatctgttcagatactttatttttaaaggccacataagtaatgacttgacctctaatcttagctttgaaattttcccagacactaataaagatgatgtctgatgaccttttatttgagaatagtactcattggccagctatcagtgctacttaaaaatgtatattttactcaaaaaattatttccatggctaaaagactttctcagtaaaatcacacatgtcatgacataatttggtgactcttgcaccttgttttagaatagtttttacataacattactgagacttagtactgttcaaaacaactcttctcttcaaatacaaatatgagttagttctgagaaaaatattctgtaaaccataatcttatctgaaatagcacccatctcttggatccagtaagaatattttagacatgaagggttctatagtaaaagacctggaattaatccttgttttgcatgaatgtgggctctctttcctgtaaatatacagtaaggttttacaaagaatcaagttactactgaagactaagatcatcagttgggctgggctgggcgtggtggctcatgcctgtaatcccagcactttgggaggccgaggcgggcagatcacgaggtcaggaaatcgagaccatcctggctaacatggtgaaaccctgtctctactaaaaaatagaaaaaattagccaggcgtggtggtgggcgcctgtagtcccagctactcgggaggctgaggcaggagaatggcatgaacccgggaggtggagcttgcagtgagccaagatcatgccactgcactccagcctgggcaacagagcgagactccgtctcaaaaaaaaaaattatctgggctggccgcattaggatataagcttaataattagtggagtaaaagaagttcttcagattttattaatatgtgtggtaaggcttagttatgaagaagaggggacaaggcagtttccttccaggtgttggggcatagctaattgccctttttggtctgtttttacttgtcttatatctataataacggactctcttgataagaacccacctaggcacaatgatgtttttgtggggttggcagaggaaactgcatgttgctaccttgatgtgttttctcgtttgactttttgttaagagatgatgtttagttctttgttgctgaactctgttagtgcaaagagaagaaaaatcttgcttaattaattgcaatattaaattgaaatatattttagcttccttagacagtcctgaaagagatttgcataactggggtcttcccttggttccagtggaggggaaatatttcagttcacttacttggggctataaaagtttgttcttcctttccctgaagcaagaattgtgaacataaagtcataaaacagtttcagtgttaatttttaaaacttctccatatttccaccctcatcagtggtaaataatgtgcctgatgtaaaatggaaaaagttgaaaatttccacttgtacattttgagcttttcagaggtactatatacactctggaaataataataaaagatactaaggcttatacagtgctttttgtttgaggaactcatataaacactaatgcattgatcctaacacagtgcttgattgtgactttaaaaggtcatgagttactgctgttacaaaaaaaaaaaaaaaatggaggggcgctccactttacaaatatagtttaaaaaatatctagataaaaattgaaacagataactgaaaaaacaaaacttatagggtatttgtttgtatgttgacttttctcttagcgtatgatatatttttattcctttattattttttcttttacatatgaatctacttgaagcctgattttcttttcttttttttttttttttaatgtttttaagacaggatcttgctctgttacccaagctggagtgcagtagcacaatcatggctcactacagctttgatatctcagtctcaattgatcctcccacctcagcctccctagtagctgggactacaggcgtgtgccactgtgcctgactaatattttaaatttattttttgtagagatgggtctcatcatgttgcctgggctagtcttgaactcccaggctcaagcagtcctcctgcctcggcctctcagagtgctgggattacaggtgtgagccactgtgcccaactcccgcaacccccccgcttttttttttaatgagacagggtcttgctatgttgcccagactagactcagacacctgggctcaaacaatcctcccacctcagcctcctgagtatctgggactgtaggcccacaccactgttccctgcctgattcctatattaaataagaaagcagaatctacttttaagcctttattccttctcagccaagaaggtttaaacttctggtggtttcctgagcttgacgtattatgttaatatgcatttgtccttttaatttgctcagtttaatatttgtagtatgtagctattgatttcgatgaattcaatagtcatgtggcttaattttcaactttcttgtgtttcataggtttattcttcagtccaaggaagcaattcacagtcagctgttagagaagcagaaaatagcagaagaaaaaattaaagaactagaagtaagtttttattggcaataggagttaacttttgggagaaagtagtaatcttattgtgtcatattaaatgaaaatgtatgcctgcctgccaaagtaatgtcatattatttttattttctataattacgttggagccgtgaagctgtcatattcatattcatagcgcatataagaccaaaacaaaaaaaaaagaatagtctcttctttggaactgcagagaattttgatgagatggttttaacctgaatgtattttgttcattgcccttgaatgtgtttattctttaaaaaaaacaaaaccataaacaaaatgtaatgtatatttaaacaacacttgtgtagtggattgtggtggatgggcaggagagtgggtaataatgataaattttagaggatcttggtatagggtcttttttacacattgtaatttctttaacctaaattaggttctatataaggacaaagtagcaagctataaccaattaactatctgaaggatggtgctccaatgagaacaattttttctttttagctagggaaaaagatgataggtaacagtaagcaaatctttggaaatattactttattatttttattattataatttatttatacattaagacctttagtgagatattcttcttgggctttggtgaaaggcccatcctgtgtatagtaaaagttagactggacaaaaagctggttatttcttagggaccaagatttcccaacatgtgggtggatacattgacttcataggtcatttcatctaatttctgtaagtactatttgaggcagaggatcagaatctaactcagccctctgctgaatttgggagctacaacttgtagcctcctgaggatttcttaggggcactgaattggcctggcctgggagtatgcagtatcttaggttacttaggcttatttttaactactgatagttgaaacaaacttgataatagatttgcagcttagaaaagtgtattgtaaaaacaagacaaaaaagcaaaaaaaccaagtaaagaaaaaacagcctgtgataaccagattgttgttgtgtcctattttaacattttaatcagctcaactgttctaagaggttcaatttgatatctgtgttttcactcataagaaacaaaagtatctttaaaaacccaaacagaatcatttcatgtagataaaacaaaaatgcatttttgcaactgtaggtaaatatatttaaaattatcctaatgaataataagtagcaaggtaatatgtatataattctctttatgaaaacaaaaaacaaacatttgtgtatgaatattgaagatgatatgtaaggatatatattaaattgttaatactgtttaccctaaagaaattagatgggacgtagggataaatgattttttctttttctttctttcttttcttttcttttctttttttgttttttttttttttttttgagacggagtttcgctcttgttgcccaggctgaagtgcaatggtgtgatctcggctcactgctacctccgcctcctggcttcaagcgattctcctgtctcagcttcccaagtagctgggattacaggcatgcgccaccacgccctgctaattttgtgtttttagtagagatgggatttctccttgttggtcaggctggtctcgaactcccgacctcagatgatctgcctgcctcggcctcccaagtgctgggaatcataggccaccgcgcctggccttgatttttttcttacaatctctgtaataataaattataacaagtatacattaactttttttgttgttaactttcatgattaaaaaattagcagagtgggcacagtggcaaatgcttgtagtcccagctacgggaggctgaagcgggaggactgcctgaggcattccagcctgcgcaacataacaagaccttgtctctttagggaaaaaaaaaaacacaaaaaccccaattatcaaggtgaaattgccacaggtgatgattttatcaataccgtactgctgagttctggtgaatattaagaaatttactttctgcaagtttccttttgttgagtgtctcaaatactggtagaatgttttatcttttaggaagttcttttttcttttttaatttttcattttacatgttacttacattataaaagcaatagaagtacaccataaataaaatataaaacaaatgattaaacaatgaaaatattactttgtttttccaccctcggtacatccaaatgtcacctctacggtttctgtatcattccaaacttctatatttatatcaagacattcatacatgcatatatatacacaacctttttttaaaataggaattatgctatatatactgttttccatcatttgacagtttatcttgctactttagtaatataactccagtttatatacaatttctttttttgattcccatcatcatgggctccttaccatgagccttatttcagcatttaatatgttctccagtacttccctaatctgtgcttttaacagtatcacccagtgtatactcccctctcttctctgaaacaatcctatacttttccactgctacaactttatggttttattacttcagcacacccccacatgtgcacttatgcacatatacactgttaattgtgatgttcaaattttgtgtgtatcttactgaattatcatctgcttattcatttagttactgagagatgtgatgaatcttcctctatgacagtgtttatcaatttctccttaatctgtcagtttagtgggcagtgatatttagagaatacagtgttgggggggcaagtgctcattattactgtatacgaagtttggagcttatgttttgttttttgttttttttttttttttttttttttttttttgagacagagtctcattctgtcccaggctggagtccagtggtgtgtcttggctcactgccacctctgccccaaaggttcaagcgattcttctgcctcagcctcctgagtacctgggactacaggcccaccatgcctggctaatttttgtatttttagtagagatggggtttcaccatgttgcccagactggtctcgaactcctgaccttgtgatccacccaccttggcctcccaaagtgctgggattacaggtgtgagccaccatgcctgactggggcgtatgtcttattttgttttatgttaggaatttctcagctcttctgtttatatttatttattttttattgttttgagatggcatcttgctctgttgtccaggctggagtgcagtggcatgatcttggctcactgcagcctccgccttctgggttcaagcgattcttctgcatcagcctcctgagtagctgggattacagccaccatgcctggctactttttgtatctttagtagagacggggtttgggtttcaccatgttggccaggctggtcttgaactcctgacctccagtgatctccccacctcagcctcccaaagtgctgggattacaggtgtgagccacagcacctgacctgtcagctcttttaaagataaccattctactgacttgtggcttccactgttgctgttaagaagtcatctgttagtctaattgttgttaatttgtcttttctctttacctgtttttacttgtctatgtctttcatgctttgtagtttctctgggatgtgtttaggtgtcgatttattccttttctttttttttttaatttgagatggggtctcactctgtcactcaggttggcttgtagttgggtgatctcagctcactgcagcctccacctcccaggcttaagcaatcctcccacctcagcctcccaagtagctgagaccacaggcatgctaccacgcgtggctaatatttttttctttatcttagttagaatttgttgggtttcctgaatctgaggattagtgttttttttttaataaattctggaaaatttgtatttctgaagattacttcttccttattttgtttattaatgatatttccttttggaatttttccccacctttgaactggctgccaccaccatctgcagtaggatattaactgattttaccatatccagccttctctcgttcagttctttttataacatatttaagttagaatgacctttctaaaatgttaaatctgatcatattactctctcatgtaaaaccaatagttgttcttagggttaagttcaaactttttttttttttttgagacggagttttgatcttgttgcccaggctgtagtgcaatggcatgatcttggctcactgcaacctccacctcctgggtacaagtgattctcctgcctgcctcagcctcctgagtagctgggactacaggcatgtgccactatgcccagctaatttttttgtatttttagtagagacggggtttcaacattttggccagcctggtctcgaactcctgacctcgggtgatctgcccgccttggcctcccaaagtgctaggattataggtgtgagtgagccactgtgcccaaccagttcaaactttttaacataccttgaaggcctttaaagatatgatttctgtttatttctctcatccctctcatttcctctgccttctgttatactgtatgctttagccatgcaaaaatactctcagtcttttttttttttttttttttttttgagacggtgtctcactctgtcacccaggttggagtgcagtggcgctatcttggctcacagcaacctctgcctcctgggttggaacaattctcctgcctcagcaggagatcccttctgggattacaggtgtgtgccaccacgcccagctaatttttgtatttttagtagagacagggttttgcatgttggccagactggtcttgaactcctgacctcagatgatccacccacctctgcctcccagagtgctgggattacaggcatgagccaccacacttggccaatactctcagtctttggagcttgctcttttttcattctgctagatcttcgaaaagtagttatctccacttgggaacttcctccctctgcctttatcaattccatctactaatccttcagatcttagcatagaattacttctcctgagaaccattttctgattcctcagtcttaagttagctgcttctttcttgtgttctctggttactctgttagtttcttagcacattgtagggatttggaaatataaactctcaccagttgagtaaatcataaatatggtttcctattactttggaagcttgatacagatttagagctctaaatgattttccccaagtccttggtgttgctcctgttttcaaatctgcagtctcttcttctagacctagtatttcttgtcagtctaatctacttcattttaatcctctgtaattatcatcatcatcatcatcatcatcatcatcatcatcatcatcatcaatttctcttctgagataccctgtattaagttggggaggcacaatttatacccaactctgtagacaaaggccatgctatttctatttatcatgttttcatctctgaaagagtaaggttcatattggttggggtcagagttccagtttttgataaaagctgttaacttgttttactgatttggcccaccgagtatgcttccccaccctctacccacagtttgtgtagatggcaggagggacaaaccttttccatgacataggtgctggtctgattcaggttctctaacctgataccccattttcattagtatttgctaggttcccttttacccagctttgttctttctgtttctttatacttgccctctcctgatttcttttttctgatcttatttatgagtgcaaagcttacctagactttgtttagctttttgtagctttgtcatgttgtgccctatgtcatcagccagccaagtggcctcatctactggcccttgtctcttataggcaggggtgggggtactacttgccctcatgttaatcttgatagggagtcatattccttattagcagaataaacacaagcactgtcttttttttttttttttgagacagagtctcgttctgtctcccaggctggagtgcagtggcgcaatctcggctcactgcaggctccgcctcccaggttcacaccattctcctgcttcagcctcccgagtagctgggactacaggcacaccccgccatgcccagctaattttttttgtatttttagtgagacagggtttcaccgtgttagccaggatggtctcaatcttctgacctcgtgatctgcctgccttggcctcccaaagtgctgggattacaggtgtgagccaccgcgcctggcacaagcagtgtcttaatggtgggaagatagtcttactgtcttttttttccttagaacttctttgttgaacctatgaattgtacaaagaataaagaaaacaaaagaacttccttttacttttttttttttttttttgagatgaagtcttgctttgttacccaggctggggtgcagtatcacaatctcggctcactgcaatctccatgtcccaggtttaagtgattcccctgcctcagcctcccaagtagctgggattacaggtgcctgggctaatttttgtatttttagtagagactgtgtttcaccatgttggccaggctggtcttgaactcctgggtgatccacctgcctcagcctcctaaagtgctaggattacaagcgtgagccgctgtgctctgcctctttttacattttaatacccctatgttagactgttcttcaggccatcatcactgtaatgggattaattgggaagtattttcataacagactcacggtttatgtagatttaatctttcgttataaaggtgatagatcaaattctggaagagaatacatcctaactgtgattagtagaccagtgatgctgatcctattcacgagaaaatacaaaatcgtggctttagtatgatagagtaaccatgttatttttgtcattttttgaggaaattttctatttttaaaaaatactgataataactttctaaagaaggtactgagtgcataatacctaatacagtatttgttgttatttgaaaagtacccaagcataattttagaaaatagcatgattacaactgtgatttggaattatgacatgtctcatttgtctttgtaaaataattttctttttataatgtataacattggtactaagagaaagtagaagtcttttttgacaaaattcagttttaaagttgagttaaaactgttgatagattgagatctatatcttctaaagagtgggaaattcatcctctggttttgctaacttttttggaggtaagcaggaaataattaatgggcctcttttgcagttaggaaaatttaagtcagcattcagatgatctagagatgagctcctgaccttctgaatctcaactattaggaatccttgaggtaaatgtaaactttcaatgatacatttgaacacatttttgccaccattgccttatgttttttttgttccaggtggaggccagttactgcttcaacctaaagtcagccttcaacctaaagtctgttatattttaggcacatgcatatacaggttaaccagcttccttcccctctgtctccaacatggttaccacccctttcaccaccctggttagctcagcaataacagaataagaataaggaaacctaggacagtctggcgtgcttagcgccacttctgatgcagaatgttgcaatcccagggctgttgaaataactccccagcccatatcatatgtaaaaaaaaaaaactgttaaagtcttgacgtttaaagtcccaactcttccacaaaaatgacagttttggtcagacagtggttcctgaaataaataggaagaatggcggcgagagaacaggataggaggtgcctgtgacactctgcagttggcttaggtttgatactctgatgagaacatgctttggagggattcccatgattgaggaaattttactctgcctgttgagaatcattttttccatcgcatgggtggtgactggtaggcacttggatggatgtccagttttgccctaagtactgcatttttgagctggtactattggtgtatataataggagcccccatttggaggtgatgtcaggtggactctactgtatgatagtcactgattcttacctctgtttttctctttttttttttttttttgagatggagtcttgctctgttgcccaggctagagtgcagtggcacgatctcggctcactgcaacctccgcctcctgggttcaagcgattcttctgcctcaacctcctgagtagctgggactacaggtgcatgccaccatgcccggctaatttttgtatcattagtagagatggggtttcaccatattggccagacttggtcttacctctgtttttcaatgaagaaaggagggcaggggatagcagagccaatgatagaatgtttttaaaacattaaacaagacatatgcccagcagttcatctgcttgcatagctctaagtttataatccattaaaaatttagtcattaattttttattgaaatgtagcatttaagaaatgtgttaaataacatttatagcttaatcattataaagcaaacacgtcagttatccaggccagtaaatcaaatgttgtcaggaaaccagaaccctccttgttgtttatcactgcctaatcatgtgccatccctgcctgcctctcccatcaagtaactacttccctaacttttgtgataattatttcctttttcaaaaatacagttttacagccgggcatggtggctcatgcctgtaatcccagcactttgggaggctgaggcgggtagatcatgaggtcaggagttcaagaccagcctggccaagatggtgaaaccccgtctctactaaaactacaaaaattagccgggcgtggtggtgggcgcctgtaatcctagctacttgggaggctgaggtcgagaattgcttgaacccgggaggtggaggttgcagtgagccgagatcatgccactgcactccagcctgggtgacagagcaagactctgtctcaaaaaaaaaaaaaaaatggttttaccacctatggatgtatctctaaaataatataatttaggctgggcgtggtggctcacgcctgtaatcccagcactttgggaggctgaggcgggcagatcacctgaggtcaggagttcaaggccagcctggccaatatggtgaaatcctgtctctactaaaaatacaaaaattagctgggcctggtggcacgcgtctgtagccccagctactcgggaggctggggcaggagaatcgcttgaaccctggtggtggaggttgcagtgagccaagattacgctattgcactccggcctgggcgtcacagtgagactccatctcaaaagacaacaacaacaaatatattttatgtgtataaatatatcttatgtatataaatatatatcttatgtatataaatatatatattatgtatatatgtattttatgtatatatatgtgtgtgtatatatataatttagtttagcttgtttctgaactttacatgaacaaaatcactatttttttgcctcacttctttctctccacgttgtgtttgtgaagtatatctgtgttatctcttgagattgtgagttgttcatttcattgctgcatagtatcccgtcatatagaagtaccacaatttatctatctagacagtccatttttattcttaacaagtgaaggtattctcatggagtatttttacagtttatcttagcatcttgctaagataattttcagaaaccaccctccacccacactccaggagagcttgcatcctgggaagaagtataaaacgtttacactcctgatgattaaaattagcttgatgatttcctactttccatagtagctagatagctagacacttatggatgtctttttaaaatttttatcttagaaatcaatgcaagatgtaaaattaatctctttcctacgttgttttgacttggagagtcttgggtgaagtgatttctcttattgtgcatatattgggatttcaaacatgagtacttatctctttatagagctcatttgcattcttaacatttataaaaatgtatgtttgttttaaaatagttttcggttatttaggacttcagtctaagagagcctgctggttggaaaccccagagtttatcatgaactatatatatagtctctatgtcctgatgtcttagggcttaatgtagctgcagaatcctcctttgtggctttcagagaagagttggtataggtctgaaaaagcccaccatatatgctctttttctgtttgagcattttttcttattaatattgtcaatgccttgttcattgtatatgttatgatccaagtgctaaaatttgcccaaatataaagcatctgtgatgcattttatttccttcatagaagtattgtagatccaatgagaacttagatgtaagcagttcaaatagattggttctttttttttgagacggagtcttgctctgtcacccaggctggagtgcagtggcgcaatcttggctcactgcaagctccacctcccaggttcacaccattctcctacctcagcctcccaagtagctgggactacaggcgcccgccaccacgcccggctaatttttttgtatttttagaagagacagggtttcaccatgttagccaggatggtcttgatctcctgaccccgttatccgcccgcctcggcctcccaaagtgctgggattacaggcataagccatcgtgcctggcccatagattggttcttttaattggatagccttccttatttatcttgaaatatatattacagatatttaacacacacattgatatacccttgatttgatctgtttcctggtggcgcatcttcattttatgattaagataagagacttaagataattggatttgcattccaattagcccagagttcagctttttgcatcttgtttcagttattattttcttcttggatacattgggtgccttgttgctctccttggaatacttatctgtccccatacccaactatccctttgaatgctttagggagttgttgacctcagccttcattgttacatgctttatatggtctatactcttctctgtctaaccatatgtccttagtctccaccctcccatgcctggattcctcaaatcattttcaggctgcctagagaatgatttcttttaatgagttagactttggattttctttcatgtcattacatacttccttgccaagaatccttatcctagattcttactctgatcagtttctgttcttacatcacaggtgtcctccaacctgaggtaatagatactagccataaaaagcaagttcaatacttcatgtggggaaggccacacctttattaataagcatgctacacatcagctcagaaaaagatccaaagaaaggttgacatttcagccataaatagaaatttccaagtctactagatttacaacagagcgttcattaccctaaattcctaattttaaaagccttatgttaatttaggagttcttcattctaactcttgctgtacgctaagcctcagtttcctcacataaaatgagaatattggattagaagatctctagggtcactccagtcacttctattaagtttattgttataaccttggtctttttctgagtttccattttaggagcaaaaatgcccccttaaaatgaaaagatggaggaaagcaaaacaaaacaaaaacaatttcctttgtccagatcattgtcttaatttaaaaagttaaaggtgggtcacggtggctcacgcctataatcccagcattttgggaggccaaggcgggcagatgatctgaggtcaggagttcgagaccagcctgaccaacatggagagacccccatctctactaaaaatacaaaattagccgggcgtggtggcgcatgcctgtaatcccagctactggggaggctgaggcaggagaatcgcttgaacccgggagatggaggttgcggtgagcagagatcatgccattgcactccagcctgggcaataagagcgaagctccatctcaaaaaaaaaaaaaaaagttataaggctgggtgctgtggctcatgcctataatcccagcactttgggagtctgaggcaggcagatcttttgagccctggagttcgagaccagcctgggcaacaaagtgagacctcatctctacaaataattaaaaaactatctgggcatggtggtgcatgcctgtggtcccagctactgcagaggctgaggtgggaggattgcttgagcccaggtgattgaggctgcagtgagccttgatagcaccactgtactccagcctgggtgacagagcgagccccccatctcaaaaaatacataaaaaataaaaagttaattggaatcctattttgaagctaaaatgaagctagttgtctacctatatctaaaatgtaattcaaggtgatggcatctcctttgatatctttgcagtcatttaaatcacagagatgtccatgtaatggcttaaaggtaaactacattaggcatcaccttgttttagaaatatattttcagatagagctgaatagtttaactccacatatgtaattgacatacccaggaagacatcactttattcatttatagtgctttatcctgtcttataaaatatatgatacttagaatagtagcatgcatgttcctgtgtttagattccttgagtatttatgaacttttttttgttgttgttgttgagatggagtcttactctgtcacccaggctggagtgcagtggtgcattcttggctcactgcagcctctgactcccagattcaaaagatttcctgcctcagcctcccgagtagctgggattacagggtgcgccaccataaccggctaatttttgtattttagtagagatggggtttcaccacgttggccaggctgatcttgaactcctggcctcaagcggtccaccttggcctcccaaagtgctgggattacaggtgtgagccactgtgcccatcccgtttatgaactttttaatgaattgtatcttatttattttaataactttttttgtgaattttagtttatctgctgatgcaaacagttacaccattttcatagggcttttaccatttttatcttaccgttttattcatttttcaaatgatttttgcatattacttcatttataaatagaatgactagggacaatgctgttttgctaattatgtctaatttgaggtttctcccagctcactttgtcttgctttcagtctcttacctgctgccagcataatcgaaatatttgaattccatcactattcacgaagctattcttttggttacatagtcatcttgtgaggaagtttttccagaatggacacagatgcattgtattcctaacctttgtgtaaaacaatttagttcgtttgactctgcttttgtttttaagaaaacacatgtaggggtggaacaatacttccaggtcaggaaacgttatcagtttccactgatgttttatacatagtctgtttttatatgaaactctaaaggctcaaactctgtgatgctataaagacacggaaaatgattctttcttagggttggaggaagtgatgactagcgtttttttttttgctggtagtatttgataatcccccgtccctttagctattctaggcctgtttagttgtcgggcgttgtcggactgaattgctaaaaataacaaataagcgggaggtggttctaaggccagccctggctactgtctgtaatctgtttaatttagttcctggggagaaagggcaaaaagaacatggtgccattctcattgaatggattttttgtttaaagtgctcatgagagcattgtttgagctctcccttttctcaaaccccacagggctcaggtacccacattcccttagtgtggagccagagcctgggggctgaaagagcatgctcggattcagcggttgtgctagagattaaccaggcaactgtggtcttctgctgatctttaaatgtggcttttgacaatggaaatgtgcatttagcttttaagagagggagagtgagtgtggtggttagaagtgggggagttagtgtgtgaataagaatctttctatttactattctcccctaactcagtgttcagagtcaggtggtttgataaaatataaccgcatgtgtgattccagtgcacctgcatttaactgtaacccacaccgcagcatgtgtgattccagtgcacctgcatgtaactgtaacctacaccgcagcatgtgtgattccagtacacctgcatgtaactgtaacccgcaccgcagcaagtgtgattccagtacacctgcatttaactttaacccacactgcagcatgtgtgattccagtacacctgcatttaactttaacccacaccgcagcatgtgtgattccagtacacctgcatgtaactgtaacccacactgcagcataaagctctgctttgatttgactcttgtcctctctgtgccttaacttcttcataataatagaagcagctctctatagagacagcagtctagtacttgcttgtaaagctgttgatgatcactgaaggaatgatttaaatgcctttcctatcccttgctgtgtacagttttctagtggtggaatgtgtgaaaactaggagcaaatttttaggtgtgtgtgtgtgttccacattctgtgttgactcacctgagggcttattgatttttgtattctgaagtttattgattttcgtagtctgaaatctcatccaaaaccctttcctttgcagttcttattttggggaagggggtgggtgtctaaacctgattactttaataccacaggtaaaaaaggattgtttttattagagatcctgggggtttgttgtggggaggtgccatgcaaatatcttgggaaagcatacattagtgaagatcgacgtatttacccatagctttgggatctgagcagttagacattgcaggctttgaaatgcctgcttttagatatttctcaagtcacaaaccagtgttactccctagtttaatgataggctgctgcattatccaggtgagagatgatggtaggttggaccaggatggtgacagtggaggtgatcagactctggatgtattttaaggtagaaccaaggtgactgggtataggagtaaaagaagagagttggaaaaactgaagttttgggcctgtgattaaggcccaaatcctccctgtcttcttcctcttccttccccatatgtcactcattctccacaagagatctggaatgggttcatgggagaggggcgggcatttcacctgggctttgaaggtcagctagaagtttgctaggtggggctagggcagaggagagggcatttcaaatcaaggaatagtgtggacaaaagtctggaagtggagtggtggttgcagtggtgtaaccctccattgggaagtgagtgagtgggaagtgaggctggaaagatctaagggaaaggaattaaagtgaatgaaattagcattgcttctactcactttttctaagtactgcttgttctgtgcaagtagctgttctaagtcccaatgctattcattcagtgtggtttctactcagcattccgtatgtcctgggctccacagagggatcgtcctgctgcagacattccaggtcctgctgcaggtttataggaacaaatgtgctactgcttattcatagatcaatgtttcctagtcagttttcaagttttgaaactaaatttttttttcccccaaaactaattttaaaaggaaactgaaagtttggtttgggcctttacctttgagattactattagacacccaagtagagatgttgaatagacagttggatatatgaatctggaactctggactagcgaaataaaatggagaattgtctacaaattgccagtttatagatggcgtttcaagtcatagaactagcttgggtcaactaagggaaaagtatagctggagaagggacagggtttgtggactgagccctgggtcactgtagcaggaccacagaggtgtggacggcgtccattttgagtccaaataaccaagtgaatacccacatgggcaaccctctgctgatacagggccaggctgaagggttgctctcaactcccttggtggtaaggggactgctttttcatgggctgtccaagcagaggctggcagcagaagtggtcagttctgttagacctgagtcgcaagtgctctgtatgtggacaacactgcagggaggggatgcccgaacacagtccttttaaagtatagcagataaaaggtctgccatggatctgtggaatcctgagtaaaatttgagggaggtgggtactaacatgggcagaagcaaagatgcctgcgagttttgaactagttttgaaggttaaaaagtccctaagaggattttatgttaatacctttactgttccctatatatactcacatattatgtacacacacattgctaccctctttaaaatgaattttaaattttattttattttttggagatgagcttttgctttgtcacccaggctggagtgcagtggcgtgatcatagctcagtgcagcctggaactcctgggctcaggtgttcctcctacttcagtctcctcagtagctgagactataggcacaggctaccatgctcagataattaattctgtgtttttttttttgtaaagacagggtctccctatgttgcccaggctggtctcaaacttggccttgagcagtcctcccacttcagcctcccaaagtgttgggattacaggcatgacccaccatgcctagtcccctctgtgagattcaaatatatactaagaaaagcttcaacccttagaatattttttaagttcatctttaagattcttagcaagtaaaagatactgcttgtctttgctctgatatgcatagcataatgccttggcatagtaattaagaatatgaactctggaattagatgaatatgaatttgaaccctgactgccacttaatatcatcttggataaatgacatacttagtgtttggtatggtttggatgtttgtctcctccaaatctcatgttgaaatgtgatccccagtgttggaggtggggtctggtgggaggtgattggatcatgagggcagatccctcatgaatggcatagcacaatccccttggtgatgagtgagttctcagttcagttcactcaaaatctggttgtttaaatgtctggaacttcccactcactctcttttgcctcgctttcaccatgtgacgtgctggctccccattgccttctaccgtgatttttttttttttttgagatggagtctcactctgacccccaggctggagtgcagtggcgcaatctcggctcactgcaagctccacctcccgggttcacgccattctcctgcttcagcctcctgagtagctgggactacaggcgcccgccaccacaccgggctaattttttgtatttttagtagagacggggtttcactgtgttagtcaggatggtctcgatctcctgacctcgtgatctgcccacctcagcctcccaaagtgctgggattacaggcatgagccaccacgcccggctccttctaccatgattgtaagcctcctgaggtcctcaccagacactgagcagatgttggtgctatgcctgtacagcctgtggaaccgtgagccaattaaacttcttttctttataaattacccagtgtcaggtattcctttatagtaatgcaaaaatagactgatacggtgtttttaagcctaaatacactcgtccgtaaaatggcaaaagcaagtgttaggatgaagggagacaataagtaacttttatttctggcccaagagtggaaccaattgaaagacagatggatataaaaattccatctttttatatattttacctttaatattagtaaagattaggttgaaggatgtggctttggtatgcagcagtcatgggtttttaatattgatccagatttaggcatacagatagatgaacttaccctgcaaatctctataagtgtgggacaaccacaggtctttctctgcagaggcaggcagagtctgtctgttaaacttacaagagccttctgcaagcaagcagcttctggcagagcagaaggggccgagcccctttgttcttccaaacaagcccatcagaaaagccaccagtcttccctggactagatggaggaggccgggactataactaattaaagctggaggtgaggataaacatttatcccttatgaaaagtacctgccttgtaacataatacagatcacttagcactgtgcctgacacagtaaatacttaatgcgggattttattatttgcctctggtggatgcttatcagctgtttactgattgagcatattgccagcaagtacttataagataaaaggtgttttttttttaatttggaaaataatgtatgaaagctaatttaacaaacacctgtgcatttatcattcagaattaacaaatggtagcattttgtaatatttacctttttggtttttttttttacacaaatgatgctaatgaaattgaggtcatctgtgttccctcccacaccttccccagtctcattcccattcaccagaagcaacagctatcaaggatttggtccgtatcttttcattccgtgtttgatatacatcctgtattcaataggtaacaccgtgttgtttatatctttcaacaacttgtttttttcattccatatgaagcacaaacattgccattggtagggctggtcagtggactcaacagtcgagtgccagcaggtcagtttgatctgctgctcttattttctaatagccatggattctgtgtgaagccatctcatgaacttggtggcttctgcccatgatttagaaatggaggtcacgtgttcttcatggagccagaaccagaatcagtcagggaaagagagggacatcagagtggtaacctgggattccagattctagactccaaaccctttaccattcacttttactctgaaagaaatggggattccttatgctgtagttggatactctgagtaggtaggcattctaaaatttgtggtccttttcttataaaatgataacccccgaataccagctctgagtaaagagataagtggcttctaagtggcctggcatctggaaattgaagcaagggcaaaaggaaaaccaccctttgagtcatgtttgcaaagagaagtatgccaagggctcttttattactccagtgtcattaaaaatttaattggtgttatgtcagctattagatcagagctattagcatattaaattctctctgtttaccccagttctatggtaacttagtgggtgtggagttggggacaagtggcagctgggcggctgtgacgtttgttctgtagagtgatttcatcatgatctgagccctgcatcaccctggatggagaagtgtcactgggtgatgtggacctgacctctcaatacccctcagaacaccgagagctatgagcaaagatcctgggttgcttgtcttacctagaagtttaactttgagttggaggacagcattttcttgggtgatattgacaggtgtcactatgaatttccttttctcttccttagtgaaaagacagccaaggtttttggaaagctttataaatagccctttgatattgtagtatatttgtagtcctccagttctgccctctgctgacccatacaaatcagccgaggaggtgcctatgagtcatgtagctgtgcctgccgtggctttgagctcttgcttgttttcactgtctcccggtccttttatgggtttccggttgccgtatctctatttttttagttgtgtacatttgttacttgattggaaagtagtgatatgatcacatagaagtttactcttgtttgtccattggctctactacagtaccttattaactcattaaatgcttagtgcttttgcttacagcattaaagttaatttttaacaattaatatggcagtttattttaccccaacccgtttgtatgtgtaaatttttgggtggagtacagactgatttgctggtgaaaatcattactttccatgcctgttttcagacacagagatttaatgtcctgtctttttttaaaatatcctttcttttttttttttttttttttgagatggagtcttactgtgtcatccaggctggagtgcagtggtgtgatctcggctcattgtaacttccgcctcctgagttcaagcgattcacctgccttagcctcctgagtagctgggattacagttgtgcaccatcaggcccagctaatttttgtatttttagtagagacggggtttcaccatgttggccaggctggtctccagctcctgacctcaagtgatctacctgcctcggcctcccaaagtgctggaattacaggcatgagccactgtgcccggcccgtgtcctgtcttctccccttgtggtgcagcattttgagaataaaaggagatatatattttttaaagtgaggtaaaattcacataacataaaatacacaatgttgtataatcatcaccactgtctaattctagaacatttttattgcccccaaaagaaacttaactattaagcagtgagactgcccattccctcagtacctggcaaccatgaatctgttttctatctgtctctgcagatttgcctgttttgggtgtttataaatggatcatctagtatgtagctttctgtgtctggcttctttcacttagcttaatgtctcaaggttcattcatgttatagcatgtatcagtacttctctcgtttttatgtctgaataatattccattgtatggatgtaccacattttgtttatccatttatcagttgatggacatttaggttgttttcccctttttggctgttgtaaataatgctgctatgaacaagtttttgtttgtatgtcacagtggattagctggctcatatggtaattttatgttttaattgaagtacctgccaaacttttctgtagcagctgccccattttaaatcaccagcaatatatgagggttccagtttctccacatctttgccagcacttgtttttttctgttttttattttattttattttattttttgtttttatatttttagtagagacggaggtcttgctatgttgcccaggctggtttcaaattcctgagctcaaatgatcctcccatgttggccttccaaagtgctgggattacaggtgtgcaacactgcatctggccggtttttgattatagccatcctagttggtatagtctatcattgtgattttttaaatttgcatttttgtaatgataataatgttgaacagcttttcatgtgctttttggccaataatacgtcttctttgaagaaacacctgtacaaatcctttgcttattttaaaattggttcgtctttgttgttgttgacttgaaagaaaataggaattctggagctgaaagaaaataggaattgcttggagcagacagcaggatcaggattgactttaggctctagccacacacacctgcatgttaatcttaccccacagttgcgtcagttacacctccacttccaagaatgcaaggtgtcacccttacttcctctctcagcaggcacacccttattcacctacccctttaccatgcctacaggccaaactccactgtaaacactgttgatttgatctcttgctcctgtaagaatgggacaaactgaggacaaactgaaatattggcacttactgttttttgttgttgtttttgctcatttggaagacttgtagggttttaacagttcctctagtccgtcttattgaagagcacttgactttttgatgttggcaaaacagaagaaaagtaatgtatattgggaaactgtaatcgtttccttgggcataattatattgatgcttctacaacccttgtgttggacctacacaaaacccaatgtctcattgaagataggagttaacgttatttgtcctgacactgcattacatgttcttgaggctcatctgtaacagttaaaatgtctgctagctttccttcatggagttagggtcaggtctcaactttttaaagttgtaagatatcctacaggccacttgatgtagcgctcccctttctagcccccaaccatttctgacgtgttgtcactcttcctatttgaacatatccaatgatttttagtgacctcattctttttcctgaactactctccttttggtttctatgacacacatttccctcctttttagttttatttactggttcctgctcttcattccagacttaaaatgttgaatttcttgaaggctaagtcctcttattgtatgttctttacctaggaatttcatccattctcacgacttcaagtaccacgtctatgcaaaattatatctctagcccagatttcttccatgaactccagagccaatctagtttttcacatctcatttggatgtctcacaggtaccttaaacccaaaacgaagctcagaatcttcccttccaaaccaggtcctcctcctgcatttcttctctcagtgaaaggcagcaccctcaagccagtatgcaagccccaactgggcatcctgggagtcattcctgacatcttcctcctcagcttctgatgtctaatgaaggttatgatgaagggagtggtgaagtcctcttgttgattttcctcctgaatatttcagaaatctatctgctcttcttcatctccattgtcaccactaagatactgtcatctctttccaagacgattgcagtggcctcctaataggtttccaacattcacgcgtgtattctctaatccagtgcttcccaggcttttttttttttttttttttaacagtacagctctcagaaaattgtatttgcacaattcactggggtaaccggacaaaggtgctcaaagctggaggcaactgctcaggggggttttggctgccctggaccacccagccactccagggactgagggatcaatatcctgggcacatctgttacccattcatgactcataggacgtttttgggaagctctgttctcattcattctgtatgcttcagctgagtgagattgtttttaatggaaatttgacttttgctctcctgcttaaaacccagtggcattccattgccttcaagataaattccagaactttaatatggcttaagaccccacacgatctgactcagcctcaccagcctcatctctgtattctcaccctttctgtctctgtgcttcagtctccctggttgacattcagttctcccaacttgccggactccatttatctggaattactctctccccactctcacctctcctcttgttaattcctgctcatccttcagagctgagttctcaagtccctctgtgagttccttgattccatcagatgtttcctccatcgaagaccatggtttccctcagatcccttattacaatggtagctaaatgtctgtgtggcctgcaacagtataatctccagggataagtgtgtgctttgttcgcttctctactgttggtgctctttggagtgctgagtgcccaatacctgttggttagatgaattatgtgccagttcttggtgctagggttatagcattaatcaaatcagacatgatccctactctttggagcttacactgagatacagacaataaagaaataaacaagaaaccatcatgtagtaagggtgatgttttagagagttactggagaccttctttagttgaataattggggaagggctttctgaaaaagtgaaatttcagctaagatgtgaatgaaaagaagcagacagccacctaaaagtatctcaaggaagaacattccaggtggaggtcacagagaaatattacacagagagatattcctgtcttaagacagaaataagtctgctggagctgtttaagcaagtgaaagggggacagagtagtaatgaagtggaggggttggcaggagtgaggccatgtggagcctgagcaccttggttaaagagtctggcttgttttctaagtgtgaggtgaaaccattagaggcttttttttttttttttgagatggagttttgctcttgttgcccaggctggagtgcagtggcgtgatctcggctcactgcaacctccacctcccgggctcaagcgattctcctgcctcagcctcctgagtagctgggattacaggcgtgtgccaccatgcccagctaattttttttatttttagtagagacagggtttttatcatgttgtccaggctggtctcaaaactcctgacctcaggtgatccacctgcctcaacctcccgaagtgcagggattacaggtgtgagccaccacgcctggcccattagaggttttttgagcagaggctaacttgattcagtgtgagagtgtccacgacacacctccaggcaagagatgatggaggcttggactaggacgagggcagtggtgctagatagaaagaagagtagagtttgggaatatatttggaagtaagctaataagatttgccgatggattggatggaaggtgtggggattgaggaaaagaaaaaaatcagggatgtgccatgtagggtcattcttgaaaaacatagcttttttttttttttttttttttttgtcattttttgttttttacattgagcagttggatgagtgccattcactgagatggggaagtcagggaggggtaggggtgggggtgaccataaatcagttgtgtttgttttaaacatattaaagtctgggtttgacatcaaagaggatatgttttataaataattggatatgttaaatctggaattaaggggatatagggttggagatacaaattaggagtcatataatgtttaaagctatgagatgagagtattggttttgttgttgttgttgttgtttgagatggaggcttgctctgtcacccacgctggagtacagtggcttgatctcagctcactgcaacatctgcctcctgggttcaagcgattctcatgcctcagcttcccaaagtgctgagattacaggtgtgagccaccacacctggccgagatgagagtttctaagagggagtgcagatggggagaagaggaggagttccaggacagcttcttgggaaatgcagcattcggaagctgagcagaggaggggtagtcagcaaaggagaacttagaaagagtagccagttatgtcggaggagaatagaagtgtggtgtcatgaaagctagaaggagaaagtgttccaagaactgtgttgaacactgttgagaggttgagtaagatgacagagaagcacccatagagatcattggacttgaatcacagccaattcattagaggaggtagaagtgtgattggagaggtctgaggagcagataggagggaagacaggggaggcagctgccttagaaaaccgattcaagaagttttgcagaaaaaaggcagtactttcaggggactgagaggtaaagaaagggttttttaatggtttgcctcaccaagaaggatcttgcagagtaagaaatagaagattaagaagaaaggaaggttaatggtaagagtgaagtttctgagaaggtatgtggggatgaaatcattgtctaagtggaagggttgtgtgtgtgtttttgttttgttttgagacagggccttgctctgtcacccaggcttgagtgcagtggcatgatcacggctcactgcatgcagtctcaacctcctggactcaagtgatcctcctgccttagccttctgagtagctggggctacagacatgcaccaccatgcccagctgatttttttatttttgtagagatgggggtctcgctgtagagatagggtctcactaataggtgggtgatattctcggccagggttctgtaaattacagcccaagggccagctggtctcaaactccttccctcaagtgatcctcccacctcagccttccaaagtgcagggttgtattttgattcctttaaaaacacagtacagggatgctatcaattttaacagtagagaaagaagagactatacatacaggtgtaggtcgattagtagatttggtagagggaagatagagttcttatgagatttattttctcagctgagaggagggagaataggcgatttgaggagacaagacaaagcatgaaatagttattttggagagcagacaatgaacatataaaggaggtttaatagaatttccatagtgcccatttgggattcatggctctgaatttaaagtgagaccattcagcacagtttagcattttcctccagcaacattcagccactcaggtgaggcatggagtgggtagatggttgagtttaatctgggttggcattttcccaggtaagtgcaacagagggagagagggacataggtgaaagggtaaatataaggagaataaatataaatgatggactatataagcaaagctgggtaggaagggaaaagcccatggaagcataatggaaaatgaacaagttgttgcgtgacgaggttgaagaaatgctggagcgagagtatcagaagtgacctggaagaatatgaggtagtggtggtgaaatggacacttcagaggtgtgcagcttctagtgttgacaagacctagggcatgaccatggaccaggtggctgaggtgggataactgtaaaattgtgaggagagaggaggctgtggtattgggtgggtcatctacattcttgttgaagtcaccttgaatggtacagctgtggtggagagggagacagggagccactgatgatgacggatagtgcccaggatactggaagattgaagcaacaaggaggggggagtccggtggctaagcatgatgccatgaacttcaaggaccagggtttatgaaggataaaggaggggaaatggtttggcagtgagctgaatgagtggatggaaggatggacagatggaaatgtaggcttttattaggcagctttcagtgaaagttaaaaatctctaactgctggactcagtcctaccctttaaagccccatctttttaaggaacagacactggcaaaccaccgcctgccccgtccagcccactgcctgtttctgtgctttcgaaacatagccgtgcccattcatctgcaccacacccatttgtttacacattgtctgactgcttttgtgctacaatggcagagctgagtagttgtaacagagataaccccacagtgaaagcctgaaatatttattatctggccctttatagaaaaagtttgctgactcctgatttagaacaaaaagtttgagtctcaaacttcagtgtgggtcacagccacccgggagggattgtgaaaacacagattgctgtagtccatccccagggtttctggttcagttggtctgggtcgaggcataagaatatgcccttctaataagttcgcaggtgatcccgatgctgctgggagaggactgcacttggagagccattgctttctatagttaaggtagtgatagattccttcttcccttaatcttctctgaaccaaaagtccccaccgacttcagctgcccatcgcttgaccccatcacttgacgtgatttgctggcttgtcatcatcccttttacacctggtgcctgcagatggtagtgattctttggctgaggcttgatcagcaccatattgcattaggacagttgccgctcctggctctgtgcttcactctgagctttctatctggtcattcccaggttatctggtaggctgggctttctctgggactcacatgaagctgatgtgttagggagggcagcagtaggtagaactcacctaaacctcagggggaccgagcggctaaacactgttgtttgaagaagaattttttcccctcgtgtatatctgctgtaaagtgcttgagtggtgtaggggttcgggttcgtcttggcagactgaattgggggtgctagccagcatgtgatcataggtggggtttgggagtctgaccccatatggtagcagtgtcagtctgtcggcaggtaaaagcacacctgggaggaaaacaggtcagcgcttagctgaagcaagtcttttgtccctgtccttcagcagaaagacctctgaagggtcttttctgtctttcttttctgaaggatatttctaaagtagtatctagaagatgcagggacagtaactccttccgagatttctctttattctcctgctccatgcctaagattgctttatctttctttgatttgtctcccagcggtgtagctcagtggttaccatatcgcctagctgtgtcctctggtgaagtggatgcacccagatgagtttacaagtgggcatatccgtggaccgcttagacctgtctctcaggtgtggggttttgcctgcctctgttggccctcctcacccatccaggctggcggctcagggcacatgtgccctcagggctctgccctgcccctgcctgctgcagccgtggccatgctgtcccattttccatcctgccttctctgattgtgtcctcttgttgcctttttttctgtttttgtcttgtttcccctgccttctaccaaccttgtcccccatcaaaacatgcttcttcagccctcagtgagttcttggcctcttgccaaacatccccattgtgggcagttggtaccctctgaccattttacagatctgccagtgagcgaacacgagaattagtgaggctttgggtttttaatttggaagtcatggtagagacagcgaaaagatggccattgccttcagtttttttgattaatagtagagcttgaagttggtggtggtgtccaggagctggaagctgtggattttacacaagagagaagtatgtgaccaaggcaggtcacactcagggtcagaaaccgtgactcccagcagagggtctctgaggacttagctctcacagaatatcaggaacagaagggaacctaagtctgccttgtgtgttgcctccgatgcctggattggagggcaggagatgagccagcagggctatttttattcagataaaagtacatatccgtatacatccatagtatgtctcccctctcctctgagctccatttaacctgttttgtttgtttagtctttaaggcaagagttcatgtgaagaaagtgtcgtgtggctaaagtagaaatgggagtggggtgggggtggagggatgcactggtattgcccaaatcctcatcttacaaatgggaaaatagagggacagagaggagaaaactcttttcaataccccaaggcaggataaacaggaaagaaagaaagaaagaaaaaaaaaactaatttagagaaggagagctggagacaaagttcctaagaaaagaaaaaagtctgtagtgatagcgtcacaagatgtattacctcaggagtctatttgagagattgtgtcatgtcagaaaagttctagggactggagcctctttccttggtaagaggatgagaatgaaacaccagcccctcagtctgactcctggaaaaaagaacctcaggccgatgagcaataactccaacaatgtcatttccctggccatgctgagccccacaggaaatctcagagtttgtcatcacggcaagggcccacaagaatgtcgctgcacccagagctttgtggtttgatgccactagagacttcccttgtgaaagcattctgagggaaattgctcggcaagacagaaagatgctacagtgagatcagcagatgccctcccaggactgctggtagtaagtgtggatttcaaatgtcactcctagcagccctgaggctgacatcggatagagcagttcctcaaggatttcagagtccaggacatgggaaattggggtggtttgttttttagttttgcaagttgacctgataaagcattaaggcctgttagggcgtgttctgtttgtggaagcaaggccagatccaaagcccccactgggatctgtaacgtttgagttttattatttatttattttattataaatcagtaattcataattgtataaatttatggggtaaaagtattatgatttataaatataatgtgggctgggtgcagtagttcacatctgtaatcccagcactttgggaggctgaggcaggtggatcatttgaggccaggagttcgagaccagcctggccaacatggtgaaaccccgtctctactaaagatagaaaaattagctgggtgtggtggtactcacctgtaatcctcagctactcgggaggctgagatgggagaattgcttaaacctgggaggcagagtttgcagtgagcctagatcatgccattgcactctaccttaggcaacagagcaagaccctgtttcaaaaaaaaataaaaagaatataatgtagaataattaaatcaagctagttaacatattcattacctcaaatacttgacattgtttgtagtgataggttggagttttaaatctgtgtatatccaggggcagggggtgagagggcaatgccgaaagctgaaaaccaccttgaaggaaaatggtcattttctgcctttgcttcttctgttgggcgttccttgattattcaagttgggagggaaaactaaaaagtgtgtgtacatcagtaaggcgtcatttcccacactaaagcactttattcaacaaacattaaattcctattatgtgccagccattcttctagacggtaggaccgtatcaggtgacagaacaaagtcctgcccttgtggacctttccgtctcataagggaagccagacagtttctccttcctgtggtggaaagagctctggagaagagtcaaggtgaggagaatagggagtattgggcagcatgtactcaagaaggcctcgcagataaggtaacatttgagaaagccctgaaggaagtgaggggatgagtaatgtgaatatctggggaagagaacttctacatggagagcacagcgaagggcaaaggccaggcaggaacatacctggtggattggaggagcagcatgggaggcctgtgtgactggagctgaaggagtgacggggaagagttgttggaggtgaggtcggagatttagctgaaaccaagaccatgcatgcatggcttcttggaagttgaaaagtactgtggtgtgaatagttgtttctccctaaagtctttgttgaaatcctaactcctgagatgatggtgttaggaggtgtggccatttgggagatgagtaggtcatgagggcagagccctttaaatggggttagtgcccttacccaagagcacagcaccgcactggaaatgaaggatgcccctgctgtggtgtgcatagggtttctttgccccctggcaggtctcatgttgaaatttggtacccccagacccccccaacccccgcaaaaaaatttgatccccagtgttgaaggtggggcctggtgggagatgtttggattatgggggcgggtttcttgtgtatggcttggtaccattctcatgggagtgagttctcatgctttgtttcttcactgactggctgttgaaaagagcctggcacctcctctctcatttcctctctggccacatgatttctgtacaggtggctccccttcgccttccaccacgaatgcaagcagccagaaaccctctccagaagcagatgctgcaccatgcttgtatagcctgcagacctgtgggccaaacaaacctcttttcttcataaattacccagcctcaggtattcctttagagcaacacaaacagactaagacacccgtggagacagaggcctcccaaggttcttctgcactcacaggaccaatcctgccacgcctctgaccatactgaattgcagaggcctgggtaactgcccttaaaactttataagctaggatcatacttatccccaaataattgtggtagaattggtgtctgggggcatccctcatttcaggtattgtgttggttttctacttggttttctacttgtatttgaagctaccacgaattggtcttcacagcatcttgtttggacactaatgattggattcagggcccaccctaatataatatgatctcatcttaacttagttacatctgcaaagatcctctttccaaattaccagagattagaacttcagcatatctttttgtcaaattcagttcaacccacaacaggtgccttgttctgggtttgattatgatgagagtcttctgggcttaaatatgcttggggactgagacaggaattattgaaatacagttagaaaggtccactatgttagggatgtcctgtcctgttggaattttttcttttaagaaatgtctactacgtttatttaaactaattaaaaatttaaagatgaaggcagtatcgtggcacatgcctctaaggcaagaggattgctggagcccaggagtttgaggccagcctgggcaatataacaagaccccatttctagaaacaaaacaaaaatatagatagatatgttaatttgcatcattgtttggaaacctgaagactttaggatatgcagtggtaaaattcatcaaagtgttagaaagcagagattttacagaagaaggaatttttaaagctgagaggtatagcctgagtttggctggggagtctgggtgggagggcagaagagctcttgctgatgttccaagttgatggttttgccagctgtggcagcaagttggcagagattgaatgcaacagaccagagtccctgggccctggctgacttttgtaggaggagaagtgggcttattccattcgcctttcccctgcattcacatggggtccacagggtgcccaggtggtgtatggcaccgagctattgctcccctctttgtgacacccagtggacatacattctttagtgtgtgtcagggcttactagtatttgccttttttcagctcaccacagttaaagtctaagagttgtttatcggcctggcacggtggctcacccctgtaatcccaacactttgggaggccgaggcgggcagatcacgaggtcaggagtttgagaccagcttggctaacacagtgaaaccccatctctactaaaaatagaaaaaattagccagcgtggtggtgtgtgcctgtaatcccaactacttgggaggctgaggcgggagaatcgtgtgaacccgggaggcggaggttgcagtgagccgagatggcgccattgcactccagcctgggcaacagtgcgagattccgtctcaaaaaaaaaaaaaagagttgtttatcaaaggaagtttaaattcccactctgatatcacagtgataggactgtatttggtttagcaatgtaattaaaattccttagcagcagtatgcatttgcaggcattggattgaatggttatcatggtcaccatgagttggagttttgctcttgttgcccaggctggagtgcgatggcatggccttggctcactgcagcctccgcctcctgggttcaagtgattctcctgcctcagcccctaagtagctgggattacaggtgcccccaccacacctgtctaatttttttgtagagacagggttttgccatgttggccaggctggtcttaaactcctggcctcaggtgatctgcccgccttggcctcccaaagtgttgggattataggcatgagccactgtgtctggccatgagtttttatggagctcctgttgtgttccaaggaattctctgcaacttaggacagatgggagatgagtaaagagggttctttctagccttaaggaaatttgaagcaaggagaggacagacaggaatcagaggttcacggaagaactgataaagatttgtgtatgccacatttggcttctgtaggaaaaagcctctatatgtatcatttaataaatagctaagcgcggtggctcacgcctgtaatgccagcactttgggagaccgaggagggaggatcgcttgggtccaggagtttgagatcagcctgggcaatacaaaaaataaaaaattgaagtttctcatttctacaaaaaaaaaaaaaaaattagccgggcatggtggtacacatctatagtcccagtgcacctagagtcccagctacttgggctgaggtgggaggtagaggctacagtgaaccgtgattgcaccattgcactctgagctgagaccttgtctcaaaaataaataaaacatacaaacaactaattaattggacagagagctcacttgtcctctgccctaaactctccctgcttccctgagtcctgtgggcactttaatgggtggaacagaatcaacaggtgcttgggtgaaaggggtggaggtgagagaagggcctgggctgcctggtgactgtattactggttccagtgtggctcagtcacatatgccctgggaggtgataattttgagtattccctcaggacatgaatagtattcctctaaaacggaggcttcatttcatgtctgttaactgggaatacagccacaactatgtcctcggggcaaggaccactggtaaaaccaccatacttctggggtgagcacagggcaaataatgtacagacatcatttcctttgactaatctttgaaatcttggctcctgaaagtagtgaaagttctttgtctaagccgagatttttaatttaggacccagatggagtagaaggtaagcctccaaaaggtctgctttcctcagtgttttagtgtcccagattcctggcaggcagcagtctcattagaaaagcagattgccttctgactcacccactcagtgcgatgcgagacagccccacagccctcacagcagcccatattcctgctggacagggcagagcgtgcaccatccattttatagctgcagtggctacagacgcctggcccaggccatggaaaaccttgagaggagatagtctgttacggacaggagctttgtcctggaatttcctggcctttgtctgtctgggataacttcatgtactgagacgcctgttttttagagtcttcttccttctgggggaagagtgctactgcctgtcctccacagagcacttttgcttctaccaaagccatcttctccctgctgcctgcccgtgatcacccatggttcggaggtgaggggagcactgtgggcaggtgtgtgtacctggcttgcagtatactcctgaaagttgcctgtcacaaaggaaaagccataaccattggacatcaaagctgtgtcttccagcccggcccattcactctggtcctaacctttgtctgtctctcatattgcagcagaaaaagtcctacctggagcgaagcgttaaggaagctgaggacaacatccgggagatgctgatggcacgaagggcccagtagggagcctctctgggaagctcttcctcctgcccctcccattcctggtgggggcagaggagtgtctgcagggaaacagcttctcctctgccccgatggatgctttatttggatggcctggcaacatcacattttctgcatcaccctgagccccatttgcttcccagccctggagtttttacccggctttgcctgccacctctgcccaggacactcttccctctcgggatgtgtgatgaactcccaggagagggaagatgggagccagggcaagataggaagctctgcctgagctttccactaggcacgccaagccagaccaataaaaagcgtctgtcccactctgctaagcctggttttcttgagcagagggatggaacagagggtgagagaggcagtggccgtctccacctcagctcctgctccctctgcatcagagcccttcctttcttgggggatgggccttgccctcttctcttttcccttcctgtacctttgactaacgctcagcttccgggcctgcatgcagtagacagaagaggaagaaagaacagatgttcacagctgaatctcagtgaacagaatagcagtccctggatggcagtctgcctaaagattcctttccctgccttctcccatacattccaaaaggaagttcaacagtaagcagcacctccaagactgtctccttttggccaatatcataagatggacgccataatcctgaggcctcctagaggctgagggggcaacggtgtgatccagctggctcatcccagcccaggtgggccaattattcaattttcaagaattttgttgcaagccagttgtcaaacacagccattataattatgtaaatttgcaaattatgttaaaaacaaggacaataaatattcaaaatgcatccctaattactacatttgaccacgatctgtgctctatctgtgcactgactgtgatctgtgaggttggctctgttgtgtctgggtggtagaaatcccacatgatgtcaggtcctgtgctgcccttcccagctccagtcagtgacatcacattggtaacttgaaatcagccatggcatggtgagaacacgtacaccacagaaataagacacaggacatcagaaataagacacaggacatgcaacaaaacatggctttttttttttttttaaagagagcaccggtaaacatttatcagcacgtccactgcttcggagggaaggcagagtcggcagggagctagctgtcagctgcggcttctcgggctggctgggctgggcgggccagctgatggaggaaaatcggacttgctgctatggcagcctggcgccaccctgtggccaaatatgagatgagtggcacggctgacgagctggggtgaggggtgaggggacatccagaagggaaaacttcagccaggagcggtggctcacgcctgtaatcccagcattttgggaggccgaggcgggcagatcaactgaggttgggagttcgcaaccagactgaccaacatggagaaaccctgtctctactaaaaatacaaaattagcccggcctggtggtacatgcctgtaatcccagctactcaggaggctgaggcaggagaattgcttgaacccaggagggggaggttgtggtgagccgagatcacgccattgtcctccagcctgggcaacaagagtgaaactccatcatctcaaaaaaaaaaaaaaaaaaaaaaaaaaggaaaacctcttggctggccccatgtaattgtaggttcctgggtttccagggagcaggcctggaagccactccaggggcagcccctggttaccaaaaggccctttcctaggctctgggtaaaggcaggtgcaagatgtggcaaatgctcctccctgagcctatctctgagtgggactacggggagagtagcttggccgggagcccatgacccagctggagaacacctggccctcagaactggccgcctttgtagcaccctcactgtttgcatcaccaccagaataaaaaggtagattggctgctggtcatacattggatggtggccactagctgagatagatacccacattttataagcctcagtgagcagatgagtagttagttagacatggtaacagtccaggagacaagcacagactccaggtagcttagcttaggcctggaatcatttagacagacagttgagctttggacaaatttattgaaacatacaggcggctgttagcagagaaatcattccatgattgatgtgttacatttggccactaccttgaatgtataatttaaaaattatatttttcacaactaagcctttggccaaaaaagtcatttagcacatctttaaagatcaataagaaatggattttggacattaaaaagatcaagtcactgaattaaacagtagcaacccccattaatctagaatcccatagtgctgaaggtagaggtgtctgtgcaaagctagtcatttgttaacagcaatcagaagagatgggggcaggcacacctgtcagaggtggcagcagagctggcaggacaggacggctgggctggtctggtcaggtgagcatgtcccagagacagcagcaacagagagccgtccagcaggctgtgaggcaggtggatggtcctagctcatctcttctttggtcttctaccacatacactggagggagaagagggaagagggtgagaatggactggtgcaaaccccaggccctgcaaagttagcctcccaggaccacaggaaggctacaccaggggaaaactattgagcagactggtgaaaccgtgttcctgccattgctgctgctgaatggaaggagggtggctcagctcagctgctttctccctcctgccactccagactcaggacgccctcaccctcacagggacaagta

SEQ ID NO: 16911 - DNA, 44393 bp, Human; identical to SEQ ID NO: 14944
  misc_feature (1)...(44393): n = A,T,C or G

SEQ ID NO: 16912 - DNA, 15223 bp, Human
cggtgacacaagcctgtaataccagcactttgagaggccaaggagggagaatcgatgtagcccaggagttcaaccagtctgagcaacacagtgagactcccatctctaaaaacaaataaaaataaaataaaataaaaaattatccaggcaggccgggtgtggtggctcacgcctgtaatcccagcactttgggaggccaaggcgggtggatcacgaggtcaggagttcgagaccagcctggccaacatggtgaaaccctgtatctactaaaaatacaaaaattagctgggtgtagtggcagcgcctgtaatcccagctactcaggagcctgaggcaggagaatcgttggaacccaggattcggaggttgcagtgagccaagatcgtgccactgcactccagcctgggtgacagagcaaaactccgtctcaaaaaaaaaaaaaaaaaaaaaattatccaggcatgactgtggcacacttgtagtcccagctactagggaggctaaaggggaggatcacctgagctcaggagactgacgctacagtgagccacgactgcagcactgcactccagcctgggcgacagagaagaccctattaaaaaaaaaaaaaaaaaaaaaaaaaacagaaatagaaagcctaaatagccccatatccttaaaacaaggttccaaatgatcttttttttttttttttgaaaagtctcactctgttgcacaggttggagtgcagtggtgcaatctcggtttactgcaacctccgcctcccgggttcaagcagttctcctgcctcagcctcctaagtagctgggattacaggcacgtgccaccacacccaggtaatttttgtatttttagtagagatgggggtttcaccatgttggtcaggctggtcttgaactcctgaccgcgtaatccacccgcctcagcctcccaaagtgctgggattacaggtgtgagccaccgcgcccggaccaaatgatctttaggagaaaaaagaaggaaatactgggggaggcacagtaggagatcacagcaggggcccacctccggaacctcaagtaaggacttgagagagaaggtagagtcagagtaacagagacacaggcgggttagccagctctgcatggaaaaggctgagtcgtgatgatgtcatggttctccccaaatctcaaagtcactgatcaaacaactcagtttacactgaagacgatggatgagactctaattttgtgcccacagcttgacacacctttgggaatttggtttaactttctttgccggtacacagatctgtgagaacatatgatcaatccagatctttatagatctatatcctccctggacaaacctaaatgcagacacttttagcacccgtaggagttaggtaggattaaataaaaacattccctcccacttgggggcacattcactgggaatcccagagcgatgtcgcctgcccacacctgctaagtgcgctcacagggcatctagttccctctcttgagttccttttaagcaagcaaggcaacctatgtccagagaagcagttactgtgtctaagtaagtcactgcatcttaggaaaaagcaaacattcgcattttgcagtgcatgatgggcgcacacccaagaaaattactcagcacttgtttttctcactttggggttttcccaaaataatttcttcagtccagttgccaagaatctggagcccccgactgacccatcaaggtccgatttggcttcggacacctcgcagatcaccccgcggctcagagcccggatcctgaagggcgcagcgtgggcagggggcgggcccgggagttggaacagagggcacagacggcccctcctcggaggggagggaccggagccggggcctttttctttaagactcgcagcactggatcccagaacttagtctgcgcggcggcattgacactagctgggctcctcggggcgcgccccaggtggtccgaagcccggtccgccctccacgcaggtgccccgcgctccccgctcagccatgtcgtcctgcagccgcgtggcgctggtgaccggggccaacaggggcatcggcttggccatcgcgcgcgaactgtgccgacagttctctggggatgtggtgctcaccgcgcgggacgtggcgcggggccaggcggccgtgcagcagctgcaggcggagggcctgagcccgcgcttccaccaactggacatcgacgacttgcagagcatccgcgccctgcgcgacttcctgcgcaaggagtacggggggctcaacgtactggtcaacaacgcggccgtcgccttcaagagtaggtgcagggcttgggttggggccccctggagcgctccgagggtgcggaggtggccagccgcaggctccccacccgtccacttgagtgaccgaggagggtggcgccgacccctagggatgcgctcagcccacgcctcccgcgaggcggttttcgctttccgtgattcgctgagccccaggcgggcccgggcgacaaacagcgcgccccgcccgccggcctgtgagggcctgtgcgcggcccggggccctccccgaactgtcagccgctgttgtgtgcaggaaaactggcctcctgggagggggcaacgccctgctagagttcatcagctttccttccaacgcgagaaacattttctctgcaaagaaacggtctccgctcgctttgggctttcgctttccttgaaagggcgcattcatagatgcccggaggcatttgctcgggaaaggaaatgaatcgctaaaacaggattagcgcgcgcttgcccttggtggacttgacaatttgtgtaatgcagagctttgataggctctggcaaaaaggaagcgagccttctcgttcccccacccccgcccggggagcttatgtttgttataaaatacgtgcgtgtggtcttaaaagcatcttccttaaggagaggggcggggatcaagagattgcttattctaactactactgaagaaaattacaggagggcgcagtggctcacgcctgtaatgccagcactttgggaggccgaggcaggagaaacgcttgaacctgggaggcagtgagccgagatcgcgccactgcactccagactgggagacagagcgagactccgtatgaaaaaaaaaaaaaagttactacggagaaataaacaggccggcttcacctccaacctagtggggaaaaaaagcctaagagggagtgaaatgaaggatgggggagcagaagtctccacccctccctttggccctaggcactccgcattgttgtgcatggggacctgagactttctttgacccgcacgggcaactcagcctgccggctttctgagagctggggtgcaggagtggggattaacaccccctaatgcagccctcagccatgggctgagagattggtggataaatacccggcttcctggacgacaggcggagggacttccccttgcctttcaaggtatggggaatggaccaccagcagctgcaaacctgggcgctcatggcaaggcagaatctcccgccttgccccacacctgctgaatcaaaatctgcgtttccgctgggcgcggtggctcatgcctgtaatcccagcactttgggaggctgaggcaggcagataacctgaggtcaggagttcaagaccagcccgggaaacatggtgaaacaccaactctactaaaaatacaaaaattagctgggcatggtggctcactcctgtaatcccagctactcgggaggctcaggcacaagaaccgcttgaacccaggaggcagaggttgcaggaagaggagattgcacccctgcactgcagcctgggcgacagagcgagactctgcctcaaaaaaaaaaaaaaaaaaaaaaaaaaatctgcatttcaacagaatccccagctccctcctacgcacctttaagtttaagaagtggtagtcaaagccaagtgttctcaaggtgtggctggagaccagtagctgtcacatcatctgggaacctagaaatgcaaactcaggccaggtgcgatggctcacgcctgtaatcccagcactttgggaagccgaggcgggtggatcacatgaggtcaggagttggggaccagcctggccaacatggcgaaaccctgtctctgcaaaaagtaaaaaaattagctgggtgtggtggcatgtgcctgtaatcccagctactccagaggctgaggcaggagaatcacttgaacccaggaggtggaggttgcagtgagccgagatcgcgccactgcactccagcctgggtgacagaggaagaaaagaaagagaaagaaagaaagaaaagaaaagaaagaaagaaaggaaggaaggaaggaaggaaggaaggaaggaaggaaggaaggaaggaaagaaaatgcaaattctggagcccttactccagccctttgcaatcagaaactccaatggtgaggcccaggaagctgtgttttaacaggctctacaagtgattcggatgcagactaaagtttgagaatcaccgacctcgttcttaaaaattgttttaaaattaacttgtttttcctttagttgttaggagttaggatccactttgtcatgtgagtttcagggggaaaaatatgactttctttttgtttctttctctttttgaaaggtgatgatccaatgccctttgacattaaagctgagatgacactgaagacaaatttttttgccactagaaacatgtgcaacgagttactgccgataatgaaacctcatggtaagcccaacgtgtggacagtcgggttgcatccctcagtaagaagtgggctacaggcttcccggagcagggctaccctgcagaaatcactcaggggtgctatttctctgaagggggaaaaatagaaaattgcttcattttcccacagtgtttggcttctcactccaacattttagtttagtttagtttagtttagtttagttttgttttgtttggcagtggggtgggtggtgggaagaaattttgctcttgttgtgcaggctgtagtgcaatggtgtgatcttggctcactgcaacctccacctcccggggtcaagcaattctcctgcctcagcctcccgagtagctgagattacaggcacccactaccacacccggctaattttttatatttttagtagagacgtggtttcaccatgttggccaggctagtcctgaactcctgaccttcaggtgatccacccaccttggcctcccaaagtgttagaattacaggcgtgagccactatgcccagccttagctttaagttccaaagataagtgtgacatatcacaatgcttttgggatccatgtcatgaactcaatcctagaatgatagaatgctgtgagtccccaaaggccgcttgcctctggtcaatctcatgagtcctccagccctccaaggtgatgggcccacatctagctcatctctggaccttggtatctgttttagcattacaacttttcctatattcctttcttcttataccatactttctcaagttgattcagaaaacccaaaagaaattttcttttctttttttttcttttctttttttttttttttttttgagacagagtctcgctctgtcatccaggctagagtacagtggcacaatttcggctcactgtagtctccgcctcccaggttcaagcgattctcctgtctcagcctctggagtagctgggattacaggtgtgcaccaccacgcccagctcattttgtatttttagtacagatgggatttcactatgttggccaggctggtctcaaactcctgacctcaagtgatccacccacctctgcctcccaaaatgctgggattacaggtgtgagccaccatgcccgaacgagaaattttctttattaggaaatgtcttgcctatacctgcaggtattcaataaatgttactattatacttttcctacaaacattggagtgcctgccatattccaggcattatgctgggatctgggtgtgcaatggtgagcattatagacagggaccatctcattggtggagctgaaactctagtgggggagatatccattagcaaagaatctgaagtgtgaaatgacagctgtgctggggtacagggaagcttgcttccttgaggattttattccccaagaagttaactgtggattcttagaactgtggtttttattaaaaatgtgcttgctttttctttttttttttttttttttgacagagtttcgctctgttgcccaggctggagtgcagtgacaggatctcagctcactgcaacctccaccttctgggttcaagggattctcctgccttagcctcctgagtagctgggactacaggcgtgtgccgctacgcccggctaatttttatatttttagtagagacagggctttgccatgttggccaggctggtctcgaactcctgacctcaagtgattcatctgcctcagcctcccaaagtgctgggattacaggtgtgagctactgcacctggccagaagtgtgcttttcttaatttaacatttcgaatatggattattggccgggtgtggtggctcatgcctgtaatctcagcactttgggaggttgaggcaggaggatcacttgagcccacgagtttaagaccaggctgaaaaatatggcaagaccctcatcactttaaacaaacaaacaaaattatctctggatgcaaaacctttttttttttttttttttttttctgagacagagtctccctccgtcgcccagactggagtgcagtggcatgagctcagctcgctgcaacctccgcctctcaggtacgagagattctccgccccagcctctcaagtagctgggtttacaggcgagcaccaccacgcccagctaatttttttgtatttctagtagagacagggtttcaccatgttggccagcttgatctcgaattcctgacctcaggtgatccacccgccttggcctcccaaaatgctaggattacaggcttgagccaccgcactcagacgcaaaaagttcttaacctaagaaggtgaatggtgagagttgcacttgtactctgtcagtttctgagtgggatgagatcatagaaagcctgcagggagaactgcaggtgctttgaaggggatggagtttctaaatgcaaatctgagccaatataaacgcacattttaaaaactctcctttttacacagaaggtaacatttcatacaatgtttgccactttgctttttttactccttatgtctggggctctctccaggtttggtcagaaagcttttatcttttttgtggctatatagggacgcagccattatagggatgtcttttacccagtgttgggaagttttctcccgataaatttttgaatgggaacttgagagctgcaaggtattaagacacctttaaaactccatccccttccagagcacctgcagttctccctgcaggctttctctgatcccatcccactaaaaaactgagcaagtacaagagtacaagtgcaattctcaccattcacctttttaggttaagaagtttttgtggccgggcacagtggctcacacctgtaatcctagcactttgggaggccaaggcaggcagaccacgaggtcaggagatcgagaccatcctggctaacacggtgaaaccccatctctactaaaaatacaaaaaaattagccaggcatggtggtgggcacctgtagtcccagctagtcgggaggctgaggcaggagaatggcatgaacccgggaggcggaacttgcagtgagcccagatcgcgccactgcactccagcctgggcgacagagccacactccatctcaaaaaaaaaaaaaaaaaaagaaagaaagaaagaaaagaaaatatcataagaatggacttaatcctgagcaacatatggagaccccagctctacacaaaaaatgaaaattaaaaattagctgggcatagtggcatgttccagcttctcgagagactgaggtgggaggatcgcttgggcccaggaggttgaggctgcagtgagctatgattgtgccactgtactctagcctgggcgacagagcaagtccttgtctcaaaaaaaaaaaaaaatgcatttaacgcatctgacctaccaaacaccataggtcagcctcgtctagcttcaaggtgctttgaacgcttacattagcctatagtctggcaaagtcatctaacacaaagcctattttatcataaaatgttgagtatcttatgtaatttattgaatctgtactgaaagtgaaatgcagaatggttgtatggggcctccaagtacagattctgcagaatgcatatcgcttcctcatccatcagtgaagtcagtaagtcctaagtggaaccatcagagggcagggaccatctatctgtatttgacttgcttatttgttcaaggttctgagtcaataggacaagcaactactaagccactagagggcgcaacttgcctactctttctagagtaaggcagcaggtgtttcgggaccggtggggccacctggacctcagtggagggtggtgtgggtgcagcccttcccagggctgatgacgcatctggctgacgaggctgactgtcagcctctggcctctctcccagaggtgtgccctcagatcaaagaggacacctcctccccttaagaggatttatttcctcgaaggcacagcttctatgatctgtgtttttctttcttcctttcccattcacatttaattccttgtagccgccaagtttctgagaacaaagctgtttagaaagcaatgaagaacacaacatcactgatgtagtattcctggccaaaatattgatgtgactctcatcatgagaacagaccaattcactttgagagaaatactacaaaataatggtctacagtcttcaaaaaagtcattgccaactaccttacattaaaatatatgaaagagatgtgacaattaaatgcaatccatgggccaggtgcggtgactcacgcctgtaatcccagcactttgggagaccaaggcgggcggatcatgaggtcaggagattgagactatcctcgctaacacggtgaaaccccgtctctactaaaaatacaagaaattagccaggcatggtggcaggcgcctgtagtcccagctacttgggagactgaggcaggagaatggcatgaacccgggaggtggagcttgcagtgagccgagatcacgccactgcactccagcctaggtgacagagcgagactccatctcaaaaaaaaaaaaaaaaaaaaaaaaaacgcaatccatgatcctactttggaccctggattaaagcaaacaaaaactgtaaaagaacattactgggacaatttggacacatttgaatatgggctgtattttagataatagtgttgtataatgataaatgcctggcatgtggtcataactgtagtaatgtaggggaatgcccttgctaccatatataatactaaagtgtttaagatgaaggtttatgatatcagcaacttggagagaaaaagggacagagagggaaaaagcaaacacagcaaaatgttaacaattagtgaacttaggtgatgggcatagggtatttatcgaactattcttgtaacttctctgtaacaggaaagaaatacatacatacacttcatctttgaaagtgagagagagaaggaaggaaagaaatactgaatagtactaggtacctggggggatgagtgaggtgctagtttccaaggacagagtgagggtatctcttgtgggattggggtccacaagaatgtgcagctcccttgcaatgggaacttgtggggaatgccattcagaaaatgaaataaaatctacagatccggccaggtgcggtggctcatgcgtgcaaccccagcactttgggaggccgaggaaggcagagcacctgaggtcaggagtttgagaccagcctggccaacatggtgaaaccccatctctcctaaaaatacaaaaattagctgggcatggtggcgcacacctgtaatcccagctacttgggaggctgaggcaggagaatcacttaaacccgagatagaggttgcagtgagctgagatcgcgccactgcactccagcctggacaacagagcaagactcatctcaaagaaaaaaaaaaagaccctattggacacagagaatatgcattcagaataatacataataaaagaactcactaaaattagtggggtttgatgctgatgaaatgtgtaaattaacacatttactggtttttggatttccaccagtacttcaaattgtaaaatttttggcctacatatttgtttctatgggcacaattgtctctttagtagctgtgaatcatgatcaacatgaatattaattcataatttaatgaatattaatattatcaaatagggactaaaaagtaatgaaatcaggccggatgcagtggctcacgcctataatcctagcactttgggaggccaaggcaggcagatctcctgagctcaggagtttgcgaccagcccggccaacatggagaaaccccgtttctacgaaaaatacaaaaattatttgagtgcagtggtgtgtgcctgtgggcccagttatttgtggggctgagacaggaggatcacttgagtctgggaagtggaggctacagtgagccgagatcatgccactgcactccagcttggctggcagagtgagattctgtctcaaaaaaaaaaaaaaaaaaagtgatgagataaaaaccaggatggaaaaacagcccattccacacgtgaagtgtccataatgaaggacagacagagtcatccccagggattccttactgctggttgtggcactaaggaattggggtggctgcccactgtcctaggacattgggtgtgcctaggaaattgagagctttagtccttagggtgagagcactgtccctcagaaagcaggtttataagtacttggagtgtgtatgctggggaggagcagttttataaaactgccagcgggctgggcacacggtggctcacacctgtaatcctagcactttgggaggccaaagcgggcggatctcttgaggtcaggagttcaagcccagtatggccaacatggtgaaacctcatctctactaaaaaaatacaaaaattagctgggcatggtggcacacaccttcatcccagctacttgggaggctgaagcagtagaatcacttgatcctgggaggcggaggttgcagtgagccgagattgtgccactgcactgcagcctaggcaacaaaacaagactgtctcacaaaacaaaataaaaaatttttaggccgggtgtagtggctcacgcctgtaattccagcactttgggaggctgaagcagtagaatcacttgatcctgggaggcggaggttgcagtgagccgagattgtgccactgcactgcagcctaggcaacaaaacaagactctgtctcacaaaacaaaataaaaaaattttaggccaggtgtagtggctcacgcctgtaattccagcactttgggaggccgaggtgggcagatcacttcaggtcaggagttcaataccagcctggccaacatggcaaaaccccatctctactaaaattacaaaaattagctgggcgtggtggtgggcacctgtagtcccagctacttgggaggctgatgcaggagaattgcttgaacccggaagtcggaggttgcagtgagccaagattgtgccactgcactccagcctgcgtgatagagcaagactgcgtcttaaaaaataaataaataaatttaagtaaaagtaaaaataaaactgcctggggaatctacaaatttactacctcacccatctctcagcgaatccctgagaaagggagccccccctgtcactgatggaggtgtgttcttccccttgggagaatagggccaaaaaaattaaatcccatgggtgcatagattttatgccttctatagtcacatttttaatctttttttaaatttgattattactttttgagaaagggtctcattcgtgtcacccaggctggagtgtagtggagtgtagtggtgtgatcatggctcactgcaatctctacttcctggattcaggtgatcctcttacctcagcttcctgagtagctgagaccacaggcacacgccaccacacccagctaatttttctattgttagtagagacagagttttgccacgttgcccaggctggtcttgaactcctgggttcaagtgatccactcctctcagcctcccaaagtgctgggattacagatataagccacagcatccagccacttttttgtttttaatcagcaattaaacctacacaatggccaggtgcggtggctcacacctgtaatctcagcattttgggaagctgaggcaggaagatcacttgatgtcaggagttcaagaccagcctggccaacatggtgagaccctgtctctactaaaaatacaaaaattagccagaatatggtggctcacgcctgtaattccagctactcaggaggctgaggcaggagaattgcttgaacctgggaggtggagtttgcagtgggccgagatggcaccagtgcactctagcctgggcaacagggcgagactctgtctcaaaaaaaaaaaaaaaaaaaaaacctgcaccaagactcaatcatatgtttggtatattattcaaccagtggttgtacctctgtgatatgctttcatatatttatcattctgtttcagggagagtggtgaatatcagtagtttgcagtgtttaagggcttttgaaaactgcagtgaagatctgcaggaaaggttccacagtgagacactcacagaaggagacctggtggatctcatgaaaaagtttgtggaggacacaaaaaatgaggtgcatgagagggaaggctggcccaactcaccttatggggtgtccaagttgggggtcacggtcttatcgaggatcctggccaggcgtctggatgagaagaggaaagctgacaggattctggtgaatgcgtgctgcccaggaccagtgaagacagacatggatgggaaagacagcatcaggactgtggaggagggggctgagacccctgtctacttggccctcttgcctccagatgccactgagccacaaggccagttggtccatgacaaagttgtgcaaaactggtaaacgtctgcttcggagcttgctgcttaataaatgttggtggaatgaatgaatgaattgatgctgtggtttgattatttctgttctttttttttttgagacggagtctcgctcttgttgcccaggctggagtgcagtggcatgatctcagctcactgcaacctctgccacctgggttcaagctgttctcctgcctcagcctcctgagtagctgggattaccaggcatctgccatcatgcctggctaatttttgtaattttagtagagacggtatttcaccatgttggccaggctggtctcgaactcctgacctcaggtgatctgcccaacttggcctcccaaagttctgggatttcaggcatgagccactgcacccggcctttttttctctttcttttctctctctctctcttttttttttttttttgagatggagtttcgctcttgttgcccaggctggagtgcaatggcatgatcttggctcaccgcaacctccgcctcccaggttcgaatgattctcctgcctcagcctcctgagcagctgggattacaggcatgtgccaccacacctggctaattttgtatttttagtagagatggggtttctctatgttggtcaggctggtctcgaactcctgacctcaggtgatccacccgcctcagcctcccaaagtgctgggattacaggcatgagccaccacgcctggcctctttctgttcttgaaaaggaatgttcataagaatctccctgggagaaacgtgtctagttctggaatctggagctgaacaacattgctatgcccaactcttcagcctgagagggagaagaacatagtctcaaattttagtgggcatcgggaccacctggagggctgattaagccagattgccggttccactccccacaccaattcacttcatttctaacaagttctcaggtggtgctgacactgctggtgctgggactgcacttagaaccactggtgtagcaagtggtttcagaactatggagccattttctagctgttccttgctgtttccagttttttgattctgtaagggtgatgctttatcctctatttccttagctctgcaagctttctttgcatctcattctgttttgagtatatttttattggttgttttactttttttttgcttgagacagaatctcactctgtcgcccaggctagagtgcagtggcacaatctcagctcactgcaacctctgcctcctgggttcaagcaattcttctgcctcagcctcccaaatagctgggactacaggcgcccaccaccatgcccagctaatattttgtatttttagtagagatggggtttcaccatgttggccaggctggtctcaaactcctggcctcaagtgatccgcccaccccagcctcacaaagtgctgggattacaagcatgagccaccacacccggctggttcttatacttacaaagtagcagagcttgaaggactcaggaggaatatcttctttaactgggacatgatttcttctagatttttcagctgggttttgcattctgcattccttcccagaatgtttacgaggttgcccagccaccgcaactgtatctctttactgaaactcatgcagatgtcttctccttaacctatgcacactccctgtgaactacagcccagggtgattcttcagtaactccctaagcctttttttttttttttaatttgagacagtgtcttgctttgttgcccaggctagagtgcagtggcacgatcatgggttactgcagcctcgacctccagggcaagagacttccatgactaaaacctcaagtgatcctcccacctcagcctcctaagtagctgggactacaggcatgtgccatcatgcccaaataatttaatttttggtagagacagggtctcactatgttgcccaggttggtctagcactcctgaactaaagtgatcctcgctcctttgcctctcaaaacgctgggattccagacatgagccaccgcacccaccctctttcataatttttttttttttttcagac

SEQ ID NO: 16913 - DNA, 7143 bp, Human
gagtgaaactgagtaaagggtaaggaatctctgtattatttcttacaactgcatgtgactctataattagctcgacaaaaatttcagttgaaaaaaagcaagggtctttccttgattattaacttgttttaaagcaactgattggaaacctaccttgaaattgcaatgtaattgcaatctatttaaagcagtggtgttcaacagacctttctgcaaggatggaaatatcctaaatctgtactgcccaatacagtgaccactaacacatgcacatattgagcactggagatgtggctagtgcaactaaaaaactgaattacaaattttgcttaatttgaatttatgtttaaatggccacctgtgatagtggcaacctatgggacagcacagaaatgaaacttgaccttattcccaattcccttgtaagtaggaaggaggaacactcactttgaaaccatgcaattgtcccataggacagatgtttatggtctctttttttttccttttttttttttttgagagggagtcactctgttgcccaggctggagtgcagtggcatgatctcggctcactgcaacctccgcctctggggttcaagcaagcaattctctgcttcagcctcccaagtagctgggattacaggcgcctgccaccacacccagctaatttttgtattttttttttttttttttttttttagtagagatggggtttcaccatcttggccaggctggtcttgaactcctgacctcatgatccacccacctcagcctcccaaagtgctgagattacaggcgtgagccaccgcgccaggcctggtctcttttgaataaacaaattgaccctcccagtctaaaaacttgagaaatttacatttgtcttatctgagttcctttctcagggaactagccatcagtcctcccagatagcaccaaggaactgaaacttatcggatcaccacatctggaaaatcagacaccagacccctcacctgcaacaattgcctgatgcctgttgacccactcctcttcatctctccctaactcctgctattttcccacatgcagttacatttcttccctgctatatcctaattttaatcagttgagaagatggatttgagactgatctctcccccctaggctgtagcacccaaataatgccttcttccctgacaataatggggtctcagtgactggctttctgtgctgtgaaccaccagacctagaccaaactcctggcatttctctaacaatttcccaccactgaactaagttataaattctgaggatggatccctgtttcttcattttaagatggggattaaaaggtacatcctagagtgttattgtccgtgtaaaatagggctgtgaaaccccctacacctatgcacagataaactgatggccctgcaaatgcccagagaagtaaccttataaagatttagtgaatgtttcccaccattattggaaaatctggctaagtcagtagctttgttttcatatacttagggggaaaatcaacaaaaacttgatgccctgttatttccttccagtttcttctgcaactctagctccaaagactgcagttcctgcagtatttttttttttagaacaccaggaaaaaaagaaaaaaaaaccatgcaaatgtactatttcttcaaacacaactaggaatgattgaacagctgggagaatatgaagaaaacccctcagagaaccaagggcaagcagtgagttcagatctaggcacatggccactaggaatggttcttcactgccacgtgggcagccaacagccagtagctagagaccagcctcggtcttcggcctgcgggttctgcaaagtcaggctagctggctctccgcctgctccgcaccccggcgaggttccggtggggaggggtagggatggttcagccccgccccgctagggcggggcctgcgcctgcgcgctcagcggccgggcgtgtaacccacgggtgcgcgcccacgaccgccagactcgagcagtctctggaacacgctgcggggctcccgggcctgagccaggtctgttctccacgcaggtgttccgcgcgccccgttcagccatgtcgtccggcatccatgtagcgctggtgactggaggcaacaagggcatcggcttggccatcgtgcgcgacctgtgccggctgttctcgggggacgtggtgctcacggcgcgggacgtgacgcggggccaggcggccgtacagcagctgcaggcggagggcctgagcccgcgcttccaccagctggacatcgacgatctgcagagcatccgcgccctgcgcgacttcctgcgcaaggagtacgggggcctggacgtgctggtcaacaacgcgggcatcgccttcaagggtatggggaggggacgtggcctccccgaagaagaaccgatgcactggggctcctggcgtctgcggggtccataacgcctccctagggaggagagggaggagctaggagatgcagggagtgcagaaaccttggagaaagtgagagttttccagccaaagggaactttgtgtttccctggctgggactcttggggatctttttcaggttttctgcagtttttctgaattgagctttaaggcaactggatggattttgaactgattttaaaataaacgacaaattgcaaaaagaaaaaatggttatgccaagatccagtgtgtgcacccttcatcctccttcccccaatggtgccatcttacaaaaatactagaacatgatcaaaccaggagattgacattggcacaatactgtaaccagatacagacttactttaggcagagggcactaagtttttttttttttttttttttttttttagtatcattgtatagaattttaccccatgggtacaatgtattaactatgttctctttctctcctaaaagttgctgatcccacaccctttcatattcaagctgaagtgacgatgaaaacaaatttctttggtacccgagatgtgtgcacagaattactccctctaataaaaccccaaggtgagtctgatgggaaacagcgcaccttctctttggggcttgatttggcccctgcttgcctgggatttctcctgcaggctcctgcttcctctccatgctgcacgtgcactgacctctgtgctttttctcctgccagctgatatgtgccattttgcctcaggactttgtcctcacttctcccactcccatggccattcgtcctccctgtcgcactggtctttgcacacctggctgactctcatccttcaggtcttagctcaaacgtctcctgagagatgctctttatttgctccattcccctccgcgtgggagtccatcctgtaccctttctctgctctttcagagagatcttattcaggctggtggaggctttactaccaccagttcattaggcccttctaatacctgtcacctgtctgaaacactccttaagctcccaaccacatggttgtcttgctgcctttccatctcttcctgatgcctttccccacaatctaagatatttccagaggatccctatccttttccctaagtcgtttgggacacagaccccaccacccacccaccaggatcctgcaggtcaccatgccccacccctcataatcatttactaggtcctaggagttgtgcccactgagttcctcctgaatccgtctcattgcagctctacagcaggccctcacctgtccctctggacaattgcaaaccctcacaaggcacctctggtcttgagtcttttcctcttttcctttcccagcatcctgcgtactgtctgcatggtcatgcctctcccaaaatccttcaggaggaaagtccaagcccttagcatggttcacagagatgtccataatctgccgctgcttaactctgggcccattttaactccccttcaacgtgctgaaggtgctggacatgactatcacatgtctttggttgtaaactgctgtgatagttaccctaagtaatgggacaggagatgaacccacccattaaataacacagcaattaagcagccacttttagaaaaatttaaatgtgtggcttcgagttgggtacttgcatgtacagcttactctcagcttttatcctgtttccctgtcctgtcgtcctgttaagttgtgctacttctaaggctctggttcaccaggacctcaaagggcagctcttccaaatctcacctgactctactcagccaaaattcgaaggcaggaatgaacttcttcatgcaactaccaccacactttctatgcgtattcctcttagaactcataccagtaactgtctctcatatgaaaattttctgctccaaaatccctgcaaatttggcattcacctctctacgggattgttgcacacctttctacataatgctttgtggtgtatcttagggagagtggtgaacgtatctagcatcatgagcgtcagagcccttaaaagctgcagcccagagctgcagcagaagttccgcagtgagaccatcactgaggaggagctggtggggctcatgaacaagtttgtggaggatacaaagaagggagtgcaccagaaggagggctggcccagcagcgcatacggggtgacgaagattggcgtcaccgttctgtccaggatccacgccaggaaactgagtgagcagaggaaaggggacaagatcctcctgaatgcctgctgcccagggtgggtgagaactgacatggcgggacccaaggccaccaagagcccagaagaaggtgcagagacccctgtgtacttggcccttttgcccccagatgctgagggtccccatggacaatttgtttcagagaagagagttgaacagtggtgagctgggctcacagctccatccatgggccccattttgtaccttgtcctgagttggtccaaagggcatttacaatgtcataaatatccttatataagaaaaaaaatgatctcttatcaattagcactcactaatgtactactaattgagcaacctacgcactcagttgactacgtaaatctgtcaggtcttttgtgatttcctctgatgcaggagaggaaaaattgtaattgatgaaaataatgaatgaaaatcaacagatgaataaatggttctttataagtgtccatttgtacagattgtttagatgctaaataagctttgtctcaagtacaatcaacctaaaaggtcaagggaagggacagtacaacttgggggtgagcaaacccagaaagtaaagaaagagccagttagtcaatattttcaatgttgtaggtcaaacaatgcattggaactccccaaatccacattatgtaacaaaagctgacagcatgtaagcctgtgagcatagctggctctggcccttcccagcctctaggaaaacaaatagtaccacaacggcaaaggcagctgacctggtctctttaaaaaagccaaagtcattggggaaaaacaaccagttgctatgtgtgaaacgtgagtgtgcacttgtgtgaaacaccgagctgatgagggacctatcagatctccataggaatgtgttatttatgtagggatgaagtgtcatgaggtgtacaacatatgccccaggtgtacaacatgtgtttcagcaaagtatacaaagactgatgaacaggtaaggcaaaaaaaaaacaacttttctgtttgttgaaagctttcaaaacctgggggttggcagtggaaacttctggctctgcccactgaattcctgacctcaggcagaatactgtatctggctttgtctctgtttcctcaactgtcaaattgggatgacagtcataggattatatgtattgagataaagtgttgagaacaaattagctgggtgtgatggtgggcgcctgtaatcccagctactcaggaggctgaggcaggagaatcgcttgaacccagggggtggaggttgcagtgagccaagattgcactactgcactccagcctgggcgacagagtgagacttcatctcaaaaaaaaaaaaaaaaatagtgttgagaacagcccctgctgtcattagttcctgtaaatgggcctgacgctgtccctgctggtaatgagaagtgtgtgtttactgtctaacacccagtaaatgcccaggccattctgtttcttccacagaatcacagtgttgtgatctctcacacttcaccagtgagaattaaggcttacagaaacaaaaagcgatcacccgtgaaaagaaggagaggccccttattttatttttatctatttattttttaattctccaaactgcttcggaagagtcccttattttatttatttatttatttatttgtttgtttgtttgtttgtttattgagacagagtctcaatcttggttcagtgcaacctctgcctcctgggttcaagtgattctcctgcctcagcctcctgagtagctgggattacaggcgcccgccaccatgcatggctaacttttgtatttttagtagagacagggtttcgccatgttggccaagctgatctcgaacttctggcctcaagtgatccacccgcctcggcctcccaaagtactgggattacagacatgagccactgcacccagcctagtcccttaggttaaaagtgaggtttactttgacaagtttcacctttcagtagggctgttcatttcttcctagtttttgtacacagacaccagaaaacaatcacgtctgcagcaaaactggtattctcaagtgctagtttagaaatttgtacctgtattgcaaagatatttttcccttaataccttaaaaataacacctaacttctttaagagatttagagaaagcattgttccaaattcaagtacctgcttacctctgagggtgaggggaggaggacatacgtggttccgtctttattgctaaggatttctttcttataccaggtgataggtacatggtgctaaaatacaattttcagaaaaaggtaaaatcatgactgtcatacagatgtaaaaataatagtcaaaaaaatgtattttactcataagggaaccagggaaatgttataactggttcaaaggaaaagctaaaaggaaaagctaacagattatatggaatcaacaaatgttgagctgaattgcaaatgacgacaaaactg

SEQ ID NO: 16914 - DNA, 45842 bp, Human
tgttgattgagaatgacttgactcagaaataccatttgatccagcaatctcattactggttatatacccaaaggaatataaatcattctattataaagatgcatgcacacttgtgtacattgcagcactattcacaatagcaaagacatggaatgaacccaaatgcccatcaacagtagactggataaagaaaatgtggaacatatccaccatggaatactatgcagccatgaaaaggaacaagatcatgtcctttgcagggacatggatggagctggaagccattatcctcagcaaactaatgcaggaacagaaaacgaaagactgcatgctctcagttctaagtgggagccgaaggatgagaacacatggacacatggaggggagcaacacacaccagggcctgcttgggggaggtggggaggtagagcatcaggaagaacagctaaatggttgctgggcttaatacctaggtgatgggttgatttgtgcagcaaaccaccatggcacatatttacctctgtaacaagcctgcacatgtaccctggaactgaaaataaaagttaatttaaaaaaaaaatgacttgactagcagtatcacataatatgctttcaattagcctcttacctaaaaaatactatgaagctttcttattttagaaaataaaggaactaacctaactaaatgtccagacatgatatatcatagaggaaagcaagaaatttcaaaaaataagttatgtttccatcattccaaaaccacaaatgactgagaataaaaacaaggattttttttctccagtcttcttcatgtatatcaagttagatattacttttttgagcctccaacacagatggtgctataattagaattattgacagcatcttcccgtgatggcatcttgaaatgaaaccctctgtaaatcactggtggtgagcagcatctccacttgctcaatttgtaatagaaaatgaagtaaagaccctccagctttggtatatttaatcttcttcatatatgtattttcagtggagatttgtgaggtggtaattccagcacctcatctttctcttgacagctgagaaggtttttgttaataagacaaaccagaaatggtacaatcacaaaaatgaatgctatccataagtcatccagtgtgcaatgtggataaaaaatggtgcaggtttttatattttttttcttttctgatttccctttattgttcttaactgatgcaagaattgctagctacagggcacgaagatgaaaacaattgcttttatgagctgaatttctttttcttttcagagtgttaaaaggtgattctttgttgcttacctatttaatgtcaattcacccacattgaattgtactatattttactaaaatatgtcaatttcagcacagtaaaaatttggctgggttgccgtggtatggaaatgcctaaaacgatccttctgtattacaaatttggaccaaacaaatttatcttactgtttaatactctatcttttaatttgaggcttaacaaggagatcttacttaactgcttgttttcagctttgcctttcttttactttttttttttttttttgagacagtgtctcattctcttgcgcaggctggtatgcagtggtgctaatcgcggctcactgcagccttgacctcccgggttcaagcgctccttccgcctcagcttcctgagtagctgggaccacaggcatgcaccaccctgcccagctaattttttaaattttgtagagacagggtttcactatgttgcccaggctgtcctcaaactcctgagctcaagatatctgccagcctcagccttgcaaagtgctgggattgcagacatgagccaccatgcccctccacccccgttttcagcttttctatctataaaaagcaatgcttcacgtgttgaccatgtagtcattacatgtccaaagatgttagttttgtggagtcatatgatgtgtctttgtactgggatttcagatccatctgccccaccagcaccggctaacctccggctggccaactccaccgtcaacagtgatgggagtgtgaccgtcactatagtttgggatctccccgaggagccggacatccctgtgcatcattacaaggtcttttggagctggatggtcagcagtaagtctcttgtcccaacaaagaagaagcggagaaagactacggatggggtgagtgggaactggaggaaggattgttattcccacagagggtatttcaactcaaggcaactggcctgaaaagaggcctctgctaaactgagagatgccatggatgcaggaaagcttccctcccattcatttctaccgaggaagttcacagaatgcaggggcatgccggctgttttgccttttatattttaggcagaagcatttgcatttagaccattgacctactcctatctaaatgtcagtcagaactctggaaatcaaaggaacagtttaaatgatccccatcttacctgtctggccatagaaaatgatattatgcaaaatgtactttacttttaagttttttttttttttttttgagagagagagatccttgtaaatggaagagtggatgttcatggcttttctgttgcgaagtgtttccgtctgtaatctaatcactgagcagtaacagcttaggaaggccacgtctcacaatatgttcttctcattgattaaaaggatctggagtggtttatccgtcagatgccaagaaataaaatcttcattgaaccattttctgcaatgagattcttatgataacaagcatcttgtattatttgaaatgcttactgcataaaaatagttatttggattccttttagtatacattcctttatcttgtcataaaatttacataaataccttttcctatcacttataaagttgaattccataaataaatgtttagaaatgaaaagatagcaaggctaaagatttcaatatctgtgctcttcagaattataaaacatgcctcaaaaagttggtatcattgatatttagccattatactattttaactttatttatttatttttgagagggagtctcgctctgtctctcagactggagtgcagtggagcaatctcggctcactgcaagctccgcctcccgggttcacgccattctcctgcctcagcctcccgagtagctgggactacaggcgcccgccaccacacccagctaattttttgtatttttagtagagacagggtttcaccatgttagccaggatgatctctatctcctgacctcgtgatccgcccaccttggcctcccaaagtgctgggattacaggcgtgagccaccacgcccagccccactttatttttatgaaattttatgacagttccattttttatattgaaggattttgctacaaatgataatggtagtgcacacttattgcatgagctggaagagctgaaattggggaatcacttaggaatctagagcaaaaagtgacatgatgaaatgctgacaggtcccaccctccagccccctgcccaatacattatgacagaaaataatgaagcaccttgaagcattttgtcaagttaatttttcttttgtatagcttttggtggaaatttgctcctagaaaatttagaacagatatcaaagaattgcaattagtgccaattcataatttttccatgtatgtggcaacatagatctctgttactttattataaacagctccctttccttcgagaggtggtgtctcagagtggcgagggctcagaatgatttatttccatggtatctgagaccaataattggtttagaaacagtatttcaaaatacatttggcctttctatgaagtttatttttattttttatttcattatattttttgagacagggtctcactctgttgcccaggctggagtgcagtggtgcgatcacagctcactgcagccacaacctcctgggttcaatcttctcacctcagcctcctgagtagctggaactacaagtgcacaccaccatgcccaattaattttttttgtagagacagtcttgctatgttgcccaggtagtctcaaactcctgggctcaagcgatcctcccacctcgggctcccaaagtgctgggattgcagtcaggagccaccgcacctggcctgaagtttattttgatcagtagtaaaactgaattttcagatcccaaagatatagaaaagttggtaaaagaaatcagaagttggcatgcttcataatgacacacgagattttgcaatgaagatgagagacgtggaaggtttgtaacgcattttgggtatattctcttaatttctagtttcaaaattctgtgatcctggagaaactccagccagactgtgactatgttgtggaattgcaagccataacgtactggggacagacacggctgaagagtgcaaaggtgtcccttcacttcacatcgacacatgcaaccaacaacagtaagtgactgtgtcatgtttttcaagatgattgtgacatgatgggcgccatatcacaacaaggcacaatggagggagagtgagtttttgatttggaataattatatggcaaatcttcttacccacatgcatgtgactaaagtatttaaactacgacatacgaaacagtttgacttttgaattctttcttatggtttttatctattgtaggtgcaattttggtgttgtaatggaaatttaagaaaacttattgtgtctcattttaacagattgactgtttttatgtttacatgacgtgcacatatgcattctgcatacttgtttttcaggagattacgtacagttaaactgttataacttgatgttatttctgcttccactgtttctgtaattgttgttgttgttgttttgttttgttttgttttgtttggtatttttgagacagagtctagctctgtcacccaggctggagtgcaatggcgtgatctcagctcactgcaacctttgcctcccgggttcaagcggttctcctgcctcagtctcctgagtagctgggattacaggcgtgcaccaccatgcctggctaatttctgtatttttagtagagacagggtttcaccatgttggccaggctggcctcgagctcctgacctcaggtggtccacctgcctcggcctcccaaagtgctgggattacagtgtttctctagttctgtatacaatacacttatttttgtgcaattgttttacatatttatctcccaaatcaaagttgggcacttttgaaggcagagaccaaaataaatcatagtactgagaataatgtgtttgtatgtacgcgagtggatagggggcacaaaaagtggtgtggcatgcctgtttttcctagtactacacagtggtcataattactgcttgaaaggttacttaatactccattgagtgaagttactaaatcattctcatattgcttttccttgtttctttttttcttacctagtatgttagtatgtttgctgggaactgagcaaaacaatagaagagtctttcttatatgacactcatatcttagagaataagttacttgatgtttctggctttgttcaaacgtcgataccggttagaactgccatgcaggggctcctagcaaggtttcaggaaactgggacaaattaaatgagagtaggagggaggaggcgtttgtcgcaggggctcctccgatgttgattttttaggctagcaggaccccgtcatcatagctgcctttgatcaggacagtgggccttgttcagaaggagaagaagaatgtgttaaacatttgtctgaatttaggaaaggcaatgctggtcctgcagagtgagacacaggggttgctcataattaccttccacccctgggaaaacgtaggatccaaatgggcaggtttgtttgaaataatgcttcaaaaaatggtccagaaacagagatttctatctgtttgagaaatagtctctttggagattaaatggacttgaaatggtcaatttttatgtgagtctcggtacaatataaattttacctaaaagttctcatggaaatatgtttagtaacctcattcatttttaatccattcatccatctacccatcgcattgaaattgtgtgcctatgaattatgacatcactgtgtctaatgccaggaatactatattatatatacactatatactgtaatacactatatacactatatatacgtactgtatagcaatatgttccataattttctataaatagtatgcacataggtatatatgtacacatatgcatacatatacacatgtgtctacaaatatacacaaacacgcacataactatacacacatacatactcatacacacacacacacacacatatatacacacacatacattattcctagcacgatgatgtattttggtttctgccttaaaagtgcctaattttgaatttgggagataaatatgtaaaataataacaaagatctgtgtgttgcatacagacagaactacaggaaacagtggaagcagaaatgaccaacatggagttggggaatgagagtcacatcatccctcatgaagtcctgaagagtgagcgatctgcaggcccacaaggaatggacatcattccacacaaacgcagcagcgtggatgagtgtagagagttagagaagcgcattgcatgggcagagaactcagcgtgaggaaagaatgaaggtggatgggccactggtctctcccctggaggtctcattgagttgcaaggatttaaccaccatctgtgtgctaatgactccctgccctcccaccctgaccactctttgaactccagagtcctgcattcagccacccacttagcacctccccttggatggcttgcagatatttcaaataaaacgttcaaacacaagctctggattttcgcccatacctgttcctctcctgggctcgcctatctcagtaaatggcaccaacattcacccttttgctcaagccaaacatgcagaagtcattcttcatttttctctgttttttctctccagaaattcaattcttcagaaagtccttttgtctctaattttaaattccatatggaatctgtccagttctttcgcttgttcacgctattgtcttttctttcctataaattgaaatagtctcctaattagtattatgtttctgctctttcttaaatatctattctttgtaaagagcagtcaaagttttctttagaaaatatcagcgtagttacagatctctctctttttggagttccactctcaagacagctacctagttatcttcaattctctctttccccaaaacttcatccttcactatattcttctatattccttaccaacccccttctcaggccaaaatcctttaaacttcagcttcatgcaagagctgtctttctctactggtggtggagatttcatctattgtataaaataagcatgtcttttagtctcctggttcttccaataaacaacattctttccccattagaaactggtatgggattgcaaattcccataatttaatatctgttaatttccagaaccaaaagcaaggagaaaaaaagtccgacttcaacttgtccttgttgaggttacattatctagagccttgtcatggtccagcccacagacaaaacttttatggaaccctggatctctgtagcatatccacagcttcttcacccttcctggggcatccccacacaaccctgtaactcagggagatattctttaattagcttcttctgctaccctctcaagtatgattataaacctttttctctcctttgagccacattgcacatggagtgcacagtccctaaatcccttcctgtcagtaagccatgcggttccccataaatataaacatatctattacatggagtacacagtctagtctaaatcccttcctctcagtaagccatgcggttccccataaatataaacatatctattcttatgtccatgtttatcttctcctgtcttctgtattctaaggtggaggcacccttccttctgcatgtggtggacttcaccatgcagtttctagacccattcctccccaactcagatacctgcatccactgaagtcaaatctcatctacgtcagagaccatggattatctacatatgtggtcacagtatccgtcataatccctggcatataaacacggcaacaaaaatatttttgaaaccaagttaattagttattccctcatttgcctacaacctcagcctattcctctccactggcttgatctgctcagcttccagttctaaagcaaacctttcattgatgctggtttcattctagctaccatcttatctttctcctttccacattttttctcaagtttctgcaatctatttttcaatctcacttttccaccaaatctgcccctgctaatttctaagtctgatggatgttttccattgtaattttattgaccatttctgatgagtttgtccttgtttaactacactttccccattgttacatcttgacccttgtatgtttgactcccagatgtcttaatttttctcatacctcagtttccttgtaggatctcctgcctccatccggctcttggacattggagctctccagggttctaccttatctgctctgacaacttagtcactacctactcatggtccattctcaatgactcagctccagccttgatttctccactaataccagatgtctgtagcctgtcattccctgtatctgaatgtcacacaggcatctcaacctcaacatactccacattgaactcactccctccacttacaaagctcgatgttctcatgtatctctggtctccattgaggttactactgaccagaaacttgggagacttccttttaccactttctgttcacttcagtttgtttctaggtcctgcaattatttcaggacccacaggtttcttgaattttccaggaacatagtaagagctcagtaaattgactgcaactcagctgaatgcaactgtctttccattcaaccagctctgtgccacactctaacacgacagctttcttaagctttcatctgctacggtcataaatactaaaggggaagagagaaagaaatggcttttggtgtcatcttggaacaaccaaggttggacatcttttacaagccatttgcatattttaactgtgtcctccaagagtttgtgttttcacttggttgactattccaaaggaattatctttaccagtgagagtttttagccaggtggggagacactagaattatggcagttaaatgaacaaaacaggcagttaaatgaaagaaatctatttgaccggttgattccctgtgttaaggtcctttgctaattatcttttaaaactaggtaatactttagctgaccaattaaaagatagggtagttaattaagagatatggtagttaacctatcaaagaccactttattctcaggactgattcctcttacatagattagaaaaggaataaaagaaaagtaagaaaaaagaagtcatagtgcaaagtacctatagtaacacacattgtttgggtctcaggtgattccacagaagagattgacttttcaacggattatgtaggatacagttgaatgtttgtcaggattttatatcccagtgttgatatataatctcataaacactagtctgtgacttttataagaacattatatatttcatcatgaaccaactagaagtaaagaataattacaacgttacagtataagcaagggaaattacattttataggaaggagagtagtaaatgtcactatataaattactttttgaattatatttttccaggtctgcaggctgctaggtgttttaatgataaacatttctattcaagtgaaggctgaatgttcatgcagttttatgaaacaatcccttgaaggaagtatgatataacattgtctttaatggaaaggtagcttgcttctttgaaggcaggaggaatattttcaagtttgacaggttccaaatgttttatagttgcctcatggaactggaattattttctggctctccagaacaagaatagatgggagagaaaatactctgaatctcttgatgatctataaaattaatcaaaacttggatctttgaaaaatagtgtacatattttattttcttaatttctatgactatcgagtgtaaatcagacatcataactttttcagaatattgtagatatgatattattccatttttgcttattactgaaagtggaggagacattcttataaagtcagggtcatactgctagcattgtagtatgcaccttatctgttttttacccatggcgtgtgtcagcaacactaattgttggtggatttctcttcttgaatcattttaataaagcaacaatggttcaatcttaagatatataaaaatatgtttttacatctataattaaatactaaagtttgcctagggctgggcgcggtagctcacgcctgtaatcccagcactttgggaggccaagatgggcagatcacttgaggtcaggagttcaagaccagcctggccaacatggtaaaaccccatctctactaaaaatacaaaaattagccggccatggtgatgcgtgcctgtagtcccagctactcaggaggctgaggcacgagaatggcttgaacccgggaggcggaggttgcagtgagccgagatcatgccagtgcactccactacagcttgggcgacagagtgagactctgtttaaaaaacaaaaaaaagaaagaaagaaagaaaaagtttgcctaggatataaagcaagtaggaagacaagattgacattgagcttaaacctagtatctaaacacagtatctatctaaactgattatctgtcctagttatctgctggtgagttctcaatattatcacagattattagaaacataaatgggtttgtgaaactcttagatcctggctgggcacagtagctcatgcctataatcccagcaatttgggaggtcaaggtgggaggattgcttgaggccaggagttggaaaccagcctgggcaacatagtgagactgtgtctcttaaaaaaaattagccggctgggcgcggtggctcacgcctgtaatcccagcactttgggaggccgagtcgggtggatcacaaggtcaggagatcgagaccatcctggctaacatggtgaaaccccatctctactaaaaatacaaaaaaaaaaaaaaaaaaaaaattagccgggcatggtggtgagcgcctgtagtcccagctactctggaggctgaggcaggagaatggcatgaactcgggaggcagagcttgcagtgagccgagatcgcaccactgcactcgagcctgggtgacaaagcgagactccgtctcaaaaaaaattaaaataaaataaaataaaataaatgattctcagttatccacacattgatttgaactctttaagctaaaatagcctaaatgcgaatctaacaaatgtgcgtttttattttcctttcatctggtccgttggatagacaattcattgggcatgccagtgtcaggaaaaattgagttgatgtagattatcttctggggtccacagctttccttgactgatcttgtcttaccgcaggttgggcatgttctctccatctcatctttctgtcttcctctcacctgcccaagaatgcaaacctcactgcttttattagaagagtttcgataacacattgtttataggcataaaatcaacacagcttacccttttatctctcagagggctatttgaaattcagaaagcagaaaagtcttgcatcaaagggcagaatttctatgtatgcaacctctaaattcagtgagtggatgagggagaaatttggggcctaaggaaatttttggtgtcttaattattaaaccatataaatgggtgctctgtaagactcagtacatggtgatggaaacagaagtttggcatgggatggccctgggattaaatttcaccttcactctttgaattatgtgaaactggatacaattcttagtatttttgagcgctggttttttcgtcttcagtgtataccaattcctctttctcaggggtctgcaaactatggcccacaggccaaatccagccccctcctggttttgtaaataagactttattggcacagggtcacatttgcttacatgtcatttatatatcatgtccggctgtttggggggtacaacagtaattgagtagttgggagagagaccagtctgcaaaaccaaaatcatttaccatatgatgcacagaaccaaaaatatttactatctggccatttaagaaaagtttagtttactgacccctgcttaatttcataggatggctctatgaatataaattagtgtcaaaattcaccaccccaaccaagccccccaggaacacacctggagtcaaaagtgaggtttagtggcatgtacctatactgctaactacttagggggctcaggtgggaggatcacttgagccagaagtttgagaccaatctgggcaatggtgggaaaccctgtttccaaagaaaaacaaatattaggtttattgccctttctgcaacatgtttgaatctcatgttaaaggattactgtattgacgtaaataaaacaccccgaatagccccaggcaaatgagcatttggtaatatatttggtataaacagccatcaattcataattttatttatttcatttcatccaatacatattaggcagctaccatgtgcgtgtttctgagctaggcagttgccatccaaggaagattaggatgagctctgttttgtagaggacttctgggttgagtttgaggaacaaattaaagaagaaaaaaattacttaaaactgaaaaaatacaggaacacaaaagagtggtgtgttttgattcactctggaaaatcttcaccagggagagcctctgagaagttttcatgggcaaagaaggttgacagaaacaagtagtgctggtccattctgagctaaagcaatcagaattatagatacaaagaaaaccagcaggtttggggaattaggaatggcacaagagagaaagatacagctaaattaaaacaaaataataaaaagcaaactaaaactggagtcagatcatgactctacacaacaacacagtaagaaatgacctaggctaagaatgaaatcttgaactacctgattcaaagatatatttaatggtgttttgatttatagtagcatatctctatcttccactggatatgggatacgtagggcttggaatccttcttgttcagttttgtggtgtcctacgttgcaacgaatatgtgttgaatacacttttaaatggacaatagggaaaaaaaagttcatgcttttaataatgaacatgtgaacatactctcgcctcatctttcatgaagtgtcctggtttcttcacaaaataccacgtcacatggcaccagttatattcccatggctccattcctcagaaaacttgtggccactttttcgaagaacagaaacagtggctggtcagactgatgctcttctactgggcagatgcctttggtcaagctcactgccggtgcaccatcattagagcagatttgcctggtggtatttcaggagtccctcaggtacaaaaactttatctctgcaactcctagctcaatgcctggctcttgggaagtgctcagaattgctgacagaaagagctaattactgccagaaagagctaattactgaatgggttcttgtattccattacccaacctgatgtactgttgcctttgcatttcatttcatttactggatattttaaagtttcatttcaatgtctgtcagaatttggatgtctgtcactaatctgaatggcacacagattggttgctgagtgatgaagctgaagttggcattgtcaactgagtaggtgcaatttgctccttactatttatttgacaaagctgaaccgtatttccgtttagagccctgcaccaagtattgatgtataatgctcatacttccacattacgtataggttttccacgaaaacctatctacttttttcacgaaatggtattgtaatattattttattttcctcataactataaaaaatctataatgagaaatattattcatacttattatttacattggagcatctttcaagcctggtgaatatatgttacttaccaaattaaatactggggattatatgtaatatacttttagtattccagtggattttgaagggggggttcattaacttgaacatgaaagaacatgcggttacaccaccttttacttaaaaaaaaaacagacagttaatatgactaaataacaggatgaaatgaagtacactgggactaatatcaggttatataataatgaagttgtgggatacatgtgcagaacatgcaggtttgttaacataggtatacatgtgccatggtggtgtgctgcacccatcaactcgtcatctacattaggtatttctcctaacactgtccctccccttgccccccacccccaacaggccctggtgtgtgatgttcccctccctgtgctcatgtgttctcattgttcaactcccacttatgagtgagaacattcggtgtttagttttctgttcctgcgttagtttgctgagaattgtggtttccagcttcatccatgtccctgcaaaagacatgaactcattcctttatatggctacatagtattccatggtgtgtatgccacattttctttatccagtctatcattgatgggaatttgggttggcaccaagtctttgctattgtgaatagtgctgcaataaacatatgtgtgcatgtgttttatagtagaatgatttaaaatcctttgggtatacatccaataatgagattgctgggtcaaatggtatttctagttctagatccttgaggaattgccacactgtcttccacaatggttgaactaatttacactcccaccaacagtgcaaaagccttcctatttctccatatcctctccagcatctgttgtttcctgacttttgaatgatcgccattctaactggcatgagatggtatctaattgtggttttgatttgcatttctctaatgaccagtgatggtgagctttttttcatacgtttattggccgcataaatgtcttcttttgagaagtgtctgttcatatcctttgcccactttttgatggagttgtttgtttttttcttgtaaatttatttgtttcctgtagattctggatattattagccctttgacagatggatagattgcaaaaattttctcccattctgtagttgcctgttcactctgatgctagtttcttttgctgtgcagaagctctttagtttaattagatcccatttgtcaactttggcttttgttgcaattgcttttggtgttttagtcatgaagtctttgcccatgcctatgtcctgaatggtattgcctaggttttcttctagtgtttttatggttttaggtctaacatttaaatctttaatccatcttgagttaagttttgtataaggtgaaaggaagggacccagtttcagttttctgcatatggctagtcagttttcccagcaccgtttattaaatagggaatcctttccttattgcttttgtcaggtttgtcaaagatcagatggttgtagatgtgtggtgttatttactgaggcctctgttctgttccattggtctatatatctgttttgttaccagtaccatgctgtgttggttactgtagccttgtagtgtagtttgaaatcaggtagcatgatgcctccagctttgttctttttgcttaggattgtcttggctatatggactcttttttggttccatataaaatttaaagtagttttttctaattctgtaaagaaagtcaatggtagcttgatgggaatagcattgaatctataaattactttgggtagtatgtccattttcacgatattgattcttcctatccatgtgcatggaatgtttttccatttgtttgtgtcctctcttatttccttgagcagtggtttgtagttctccttgaagaggtccttcacagcccttgtaagttggattcctaggtattttattgtctttgtagcaactgtgaatgggagttcactcatgatttggctctctgtctgttattggtgtataggaatgcttgtgatttttgcacattgattttgtatcctgagactttgctgaagttgcttatcagcttaaggagattttgggctgagatgatagggttttctaaatatacaatcatgtcatctgcaaacagagacaatttgacttcctctcttcctatttgaatacctttatttctttctcttgcctgattgccctggccagaacttccaatactatgttgaataggagtggtgagagagggcatccttgtcttgtgccagttttcaaagggaatgcttctggcttttccccattcagtatgatattggctgtgggtttgtcatcaatagctcttattattttgagatacgttccatcaatacctagtttattgagagtttttaggcatgaagcggtgctgaattttattgaaggccttttctgcatctattgagataatcatgtgttttttgtcattggttctgtttatgtgatggattgtgtatgttgaaccagccttgcatcccagggatgaagccaacttgatcgtgatggataaactttctgatgtgctgctggattcggtttgccagtattttattgaggattttcacatcaatgttcatcagggatatcggcctgaaattttctttttttgttgtatctctgccaggttttggtatcagcatgatgctgacctcataaaatgagttagggaggagtccctctttttctattgtttggaatagttttagaaggaatgataccagctcctgtttgtatctctggtacaattcagctgtgaatctgtctggtcctgggctttttttggttggtaggctattattcagagattcaacttcttcctggtttagtcttgggagggtgtatgtgtccaggagtttatccatttcttctagattttctagtttatttgcatagaggtgtttgtagtattctctgatggtagtttgtacttctgtgggatcattagtgatatcccctttatcatttaatattgtgtctatttgattcttctctcttttcttctttattagtctggctagtagtctatctgttttgttaatgttttcaaaaaaccagcttctggattcattgatttttggaagggttttttgtgtctctatctccttcagttctcctctgatcttagttatttcttgtcttctgctggcttttgaatttgtttgctcttgcttctccagttcttttaattgtgatgttagggtgtcgattttagatcttccccgctttctcctgtgggcatttcgtgctataaatttccctctaaacgctgctttagctgtgtcccagtgattctggtacattgtgtctttgttctcattggtttcaaaaaacttatttatttctgcctgaatttcattatttacccagtagtcattcaggagcatattgttcagtttccatgtagttgtatggttttgagtggctttcttaatcctgagttctaatttgattgcactgtggtctgagagactgtttgttatgatttccattcttttgcatttgctgaggaatattttacttccaattacatggtcaattttagaataagtgctatatggtgctgagaagaatgtatattctgttgatttgtggtggagagttctgtagatgtctattaggtgcacttggtccagagctgagttcaagtcctgaatgttcttgttaattttctgtctcattgatctgtctaatattgacaatggagtgttaaaacctcccactattattgtgtgggagtctaagtgtctttgtaggtctctaagaacacgctttatgaatcgggatgctcctgtattggtggcatatatatttattttagctcttcttgttgcattgaaccctttaccattatatattccccttctttgtctcttttgatctttgttgggcgacagagcgagactccatctaaaacaacaacaacaacaaaaaaaaaaaaaaaaaaaaaaaaaaaactcctgtagccagctctgtgtctgcccaaatggcctcccagttttgcacttgaaactcaggggcctggcggtgtaggcacccgagggaatctcctggtctgccaattgcgaagacagtgggaaaagcgtagttatctgtgctggatagcactgtccctcactcacggcttcccttggctaggggagggagttctccaaccacttgtgcttcctgggtgaggcaacgccccaccctgcttctgctcgccctccatgggctgcacccactgtctaaccagtcctaatgagatgagccggtacctccgttggaaatagagaaatcacccgccttctgtgttgttctcgctggaagctgcataatggagctgttcctatttggccatcttgcccaggaatctataattacttttaacaagtaacttagaatgttgtactttgttgtagaagaacagcttgtgaaaactagaaaaggtggaattcaaacacaactcccttttcaaagacgacgacccactcgcccgctggaagtcggagctcccttctatcaggatggccaactgcaagttaaagtctactggaagaagacagaaggtacataaacattacttacttatttcttacttgctttaaacagcacagtaatatagagatagttttgaagaagtaaatgtcaagccacagtatcaatactaaggcaaacggttgttgaacacaagtctgaatgagttgacggttatctcacatcttgaaatctacaacagtcaattgcttaaatattttcctttcagggatattagcttgtcttcatttctttcccagagggctgattggctgatgttatatccaaaacactcaaaatattcattattttgagctgtaatttttgttataaattattaattattattttttaaagatccataatacaaataatttagaaagtagggggggaaagtcacctattatctcaatatcatttcctgaaacagcactttggtgggtttcctttcagaaattttctatgcatctgtctttcactcagttagggtgtgtgtgtgtgagtgtgtttttaaaacatacacacatatttctgtgtaacattgtttgagctgctatattgtcatgcatttttcataacattctataaatgctactttgtatgggtatatcttaatatcataatacatgtcattattccagtacaatgaaacatttcagttctttagaatttctgttttctaattaaggctgcaatacatttatccttaggatagattcatttcatttgtttgaacatttatctttagcataaattctttttgtttatttttttttttagtcttagaatatttgtttttctgttatcaaggtggtacttttagaatttattcaacatacagtcttttatctttatcactcttatgcctcttaaaaacataagcagaatagattgtttcaagagttaggtttttaaaattctcctcactcctctgaaattcacttttactcaaggtattgatgggccatgtgccataagcaatattggtgttggagtggttcctattccaggattttctttcaagctgctgaaatccattctgcaagtaaaataatattattattaatattaacatattttatttctataatgttaattaaagtttattcaacatttattgcattaagattatattatgtctatattacagttaataattttataaatattaaataagaaaagtatttgatctattatattgattaattaaaatatcaacatattcatatttaaaaaataacattttattaatattaaaattttaaacataatgtaataaaatgaaaatgtaaacatctactattgaaaaagtaaatatctcaagcatacaagagtaaccaccaccatcctgacttttaaaactcaatatttgttttgcctgtatttgaaatttatcagaatggaatcactcaatttctatttgtatttggcttcttgccatgagcattttatgagaaaccaatgcattctgttgcatgaaacaattcattcatttatattgctgcctggatgtccttagtatacatcaatctgtgtatcctttcagctgtggatggagatttacttattcagatgtggagctattaagaatagtaccagtgtgaatgccccacgaacacatgttgtttgacgcatattcttccatagaggtgggattcttaggccgtagagtatgtcaagctttagaaaacattaatagttttccaaaatggttgtaccaatttacattctcaccagtagggcatgattatggttccaggtgctccacattctctctgtcatgtggtattttccatctttgtaagtttaccctttctggtatgttcatagtgatacctcattgttatttgaattcgcatttttctgatgtccaagaagttgagcacctttttgtaattttactgacaattggatttctcttttttgaaggactctttcaactctttagctactctgtcctgcatgagtgcttttaatatagtatatacaagtcatttggtgtttgtttgttgagacacagtcttgatctgtcgcccagtctggggtgcagtggcacgatctcagctcactgcaacctccgcctcccaggttcaagcgattctcccgcctcagcctcctgaatagctgggattataggcgtgtgccaccatgcccagctaatttttgtatttttagtagatatggggtttcaccatgttggccaggctggtcttgaactcctgatctcaagtgatctgcctgccttggcctcccaaagtgctaggattataggcgtgagccactgtatccagccatcatttgttttcatgtaagtattttcttccactctgatccactcttgcatttttaactttcttcttagtgggtttttttttttttgatggagtttcactcttgttgcccaggctggtccgcatcctgggttcaagcgattctcctatcttagcctccagagtagctgcgattaaaggtggctgccgccatgcccggctaattttttgtattttcagtagagacagggtttcaccatgttgaccaggctggtcttgaactcctgacctcaggtgatctccctgcctcagcctcccaaaatgctgggattacaggcgcactgctcccagcccttagtggttcttaattttagagataagcaattcatcattttgtttcctttaggtttagtattctctatgtcctggttaggaaatcctttttcatacaaaggtcacaaagatattctcctttcttgtcttcttgtccactgtttcatcttttgtattagtccactttcatactgctatgaatacctgagactgggtaatttataaggaaaaagaggtttaatggacacacagttccacatggctggggagacctcacaatcattgcggaaggtgaaggaggagcaaaggcataccttacgtggtggtaggcaaaagagcatgtccaggagaactgcaatttataaaaccatcagatctcatgagacttactcactatcatgagaacaacatgggaaaacctcgtccccatgattcagttacctcccaccaggttcctcccatgacatgtggggattatgggagctacaattcaagatgagatttgggtggggacatagccaaatcatatcaccttttattcttaagctcttttacccagaattgatttttgttgtagagggtcagtgttcttttttttttttccttctgatctccttctctgatacatcatgatatattttttaaatgactattttccccaaagctctacagtgcctcatttgccctaaataatgcatatatgtgcaagttaatttttggactttctatagagtctttgacatatttttgcaatgttgtgacaataccttactgtcttaactactatagatttataaatatttctaatgatagtcctctagtttttatttctttatcaaattgtctcaactattcctggccttttgcatttttatatacatatttgaattaatttttcgatttccacaaaaacttcctgagatatttatggagattgaattcatccacgtgtcaatgattttgaagaattcgcatcttaaaaatactgagtgttccaatctacaaacatggtatgccactgtattcaggtttaaaatttttgtctcaacaatgttttataatatattggatagaaagtatgatactttttaatatgatttttccaaggtatttgtgtttatttttatcctattatagatggcatactttttcctcaattatactttctgatttttgttgttggtatattataaatatattttatattcatatattgactgtgaatccagcaatattgttttagcactttgttaattataacattttctctgatgatttgtttgcattttttctacaaaaaccatcatctagtttgtaaataatgagaattttatattttcctttccatatctttgatgttttagttttcccttgccttaaaactggctgagagtttcagtacaatggtgactaaaagtgatactattaggcatgatgtttaagtgtaaggtttttgaagacatccctggtcagattaatacaatcccctactcttcttacttgcaaagtttttgttgttaatggatactggtttttatcaaatattcttacttcatctagtgaaatgatcatacatttttcttctttgttctattaacatgatgaactagaggaaacattatagatcacctcctaggtctgttgtgtggaataaatgagattacacatccagattggttggaccggtgcctggcacaaaggagacaccttaggtgtttcagtgtgaggattcttacggcactgcttatagtgcagagagaggacaggatgtcaggacagacgtaaagagcctctgagcccagccttttaaggcttggtgttgctttaggactgactctcaatgttttctcctttgtgaacaacaaagagcagtgctttaagacatgatttaattgtccaatttgcaatacaagtgctacaaaacttaggcatcttattaaatttggcagaagaaaagagattcaccttcactgcactgtatcagcaagcagtaatatgaccaatattcccatacaataatgatttcagtgcatgacaaataggaaacatggttgttggcatagatatgtacacatatacacacatgtacacatatatacacacgtattactttgaataactcaaagttagaaataaatgtgaagaatatcagtggttttctcaaatactgaaatctttaaagaaaccataagcagagaattgtctcaatatttattaatcaatattagagtccatagtattatccagtttacgatgcatgaaattgtggacttgatgataaagggacaagatccaaaggcaaggagtgaccttgatttgggttccaaaagtgatgctgacttgattgatgtttagtgacttggaccctgggccacaaaggagaagctgggagtgatgagctcatgtgacggaggtaaactagcctctatttgtcagtaatgatttgtttcactaatggaaatgcctcgcagtcagttagtgttcaaactgttttcttcatacccatttccagcctctgaaatgagttaacctccaggaatgctacctactacagaccaacattaagccatcatctaataagtacatatccatgctggccagagaacactctttgtggctggccaaaaccttgattccaaagatataactgatttcaaatatatttctaaaagagaatgttctgtgcagtggccttcaacagttgacagtgtagcctccagtcaaaactattgtggttacagtgttactgcttactcaagagacagagattcattctacatctttagtgacatgtcaggatttgttctgtggatttttttgtagaccatgcatctgctccttgccatttcaactcatgccctctctatatattcacgctaaaactttctttgaagtgacaggaagttcttgaaaacacttggtatggattcccttcaaaagaatggcaaaaatatggaatttggcattttgcttttaccttgtttaggaagatcctcccaaacagtttggaatctaaaaagaacattgtgtaaaaatatctagacagaatacttatgactctactgagtacgctaagccctttaccaaaataatagggtgtaaaaacaaatagagcttaattttcctacacaaatcctgtgtctgacagctggtggcagaatcttttcattttcaattaaagtgacaaaggaaatatagaaaaaaaagaacgggaagaaaggtctggttgttcttttaagttaatcctttagatatatagtaaacattgcaaacagtaataagagtctttagatgagtattttaatacatccaaaaatggtatgttcaactttcatttgaaaatgtgaagttttaaaactttgaattggccaggcgcggtggctcacgcctgtaatcccagcactttgggaggccaaggcgggcggatcatgaggttaggaatttgagaccagtctggccaatatggtgaaaccccgtctctactaaaaatacaaaaattagccgggcatgggggtgcatgcctgtagtcccagctacttgggagaccgaggcaggagattcgcttgaacccgggaggcagaggttgcagtgagccgagaccgcgccactgactccagcctgggtgacagagcgagacaccgtcaaaaaaaaacacctttgaattaacttagatatcaatgaatgcatttccattcactttttgtcttcttttgcaaatggacacaaattaccgactttatgccaggctgtgtgccacgtgatgggaatacaataacggataagagagatttcctacctttaaggaacctgcagttctgaggcttaggcagttaggcagttgccacataataagacattattcttcatagcagtctggataaacagctgaagtagttgagagcagagagattttgacgttgtgtgcagaggaattttcacagaggaggtaaagtttaaggtacattttaaaggctggattactttttttggccagggaagatgaacacttctggcccaggacatgaagaggtgcagctgggagaaagatcgggaatgtcaagtattggtgagattgaggaagtgactgtgtgaggctggagagacagatcaatgtcaagtgatggagaagcttatatggtatgccaggaagcttggattttgttctacatggaggagagggatgtgaagtagcaggggaaattctgagcaggacttagagatgttagcaaaagcaagtgtgcaaggaatatggattggaaaagttcagagagagcacgtcggttaatttcagtagccaagacaagaaataatcagatcatgaattagagacagcagtaggaggaggaaggttggcgagttatgtaagagtattacacaagtgaccacataatttattgtctgaactgggatttatttgagaataaaaggaggcatttgtaaacattattccccaccaacagacatagactgtaactctcccaggaaagccaggatgtatggccacttggatattaagacctgcctgaagagaaaaagagaaatggatctaaatggagtgtttatcttctagcttgaatgactaacagtacttcgactaacaaagattgtgagcagtagaattatgatatgtttcatgggatatgtctccatgatatggagaatttggttttggtgtgtcgaatttgagataactacatgattgccagaaaatgtcataggcagtcagaaatacatacttgtagctcaggaggcagctctgtgatagcatcgtggatttgactggagctatggtcaatccactgactatactgtcaggggatctgcaaatgttagttgatttccactggatcacacacacacttactattaggagctgagaacagctcatgctctaattagagtttcgtattttccaaaaagtcctttttcttaaattttatccattcccacttcccttgttattttaaatctgaaagccaaatgaacatataaattgtagcagagctcatgatgttgaacacatgatagaagggagtggtagaaagctttgggaagtccaaagaacaatgaagaggaaagtatgtgtttcaaacttattccacatttttcctccttacagaaaccttttatgtactcaccacatgatctacagaatcccaaaccaaagtttccccagacattcataaaacatgctcttattcataattatcacacatgtaggaaaggagacctttgaaatggactcagtattactagcataggagcactgtacggaatgtgaatatcagcacagtttctgtcatgggaaaggacactttggctggattttctggatttttttgactttgtaaaatgagaaattatctcctctgtatgaaactcaatagacccatctaaagtggtttcaaactccttgacaagtagctgaatatttttgaatgataatttatttccaattgtggacacactgagttgaaaacctaaaaagacttaatgcttttggcaaataagggaagaaaagaatcttgctcattaatcaaaactcaatcataaacagaaatgggttcttatgtcacatttcctaaaagtgatggtgggcaaaatattgcttttggacttggagttagggacctaaaagcccaaatctattcatttcactcaaaatttttcagagacagtttcagttattaggatgtagcatgtagtttcatagataaatgaattaaacgtcaaatattagctttctttacttaatacacatagtagttgggttataatagtgaatgctctgggagaaaataaatattttcaacattgcatttgtagaacaaacattattttaaaacaattccacttagctaattttgttagtaattttattactccattgatattagttcatttttactgtgtaataatagaataaacaattgttttaagctttctggcctgcctgcctgcctgcctgccttccttccttccttccttccttccttccctttcctttcctttcttcctccctccctccctctctctttcttctcctctcctcttttcctttcctttcccttcctttcctttcctttctctctctctctttctttctttctttttttttttttgtcatagagacagggtcttgctctgtcacccaggctggagtgcagtggcatgatcatggctcactgcaacttcaaactcctggcctcaagcaatcctcctgcctcagcctcacaagaagctggaactacagacatgcaccaccatgcccagctaattttcttttctcttcttttcttttttttttttttttttttttggagtttctctcttgttgcccaggctggagtgcaatgtcgcaatctcggctcaccacaacctctgccttccgggtttgagtgattctcctgtctcagcctcccaggtagctgggattacaggcaggcaccaccacgcttggctaattttgtatttttagtagagacggggtttctccatgttggtcaggccggtctcgaactcccaacctcaggagatccacccacctcagcctcccaaagtgctgggattacaggcgtgacccacagtgcctggccgcccagctaattttttaaaaaatatattttttgtagagatgcggtcttgctatgttgcccaggatggtctcaaactcctggcctcaggtgatccttcagcctcagactcccaaaacgctggggttgaaggcatgagccactgcatcttgatggttttctggctctagactttgtgtctctacaacgtaaatgtgaaaagttagctcagacatagaggaaacattcatgcttctattttaagtagaaatgcctatgtgatactcaaaaattcttattttagttgtacatcagaaagttctgtttcaccagatcatgtttacagatagagtatgaggcattgatccatgagaggacttcattcaactaacctttactgagcacctactgtatgcaatgcaccatttccgatgctaaaacactgcaaagaggcagacagaaatccctaccctgatggaattggcgttctgtgacacctctctaagtgtgtgcccccttccctagtgctgtgacttacaattctttttaaagcaattattattctggagaacccaaggattgcctctttctcagagctctaatgtcaataaccctatcattctttgtcattagacttttgcgaactgaggaattcacatttaatgaaaaattttagagccctttgtttatgccagacactgtgagttacatctatttgaaaagaaaattagacccatctaatttttgaaccatagttgaagcatattacaggtaaattttttatcacttaaaaatacttttcaggtactttctttgtaatgtcatttgtttgtggaaggaattaagctaaggaaccagatcaattgggtatttagcacagaattttcagatacaccctttcaggaagtgtttggctatttattttattttattattatttttttaagacagagttttactgttgttgcccaggctggagtgcaatggcatgatctcagctcactgcaacatccacttcccgggttcaagcgattctcctgcctcagcctcccgagtagctgggattacaagcatgtgccaccatacctggctaatttttgtatttttagtagcgacagggtttcaccatgctggccaggctgctcttgagctcctgacctcagacaatccacccacctcagcctcccaaagtgctgggattacaggcatgagccaccacgcccggcctgaactatgctatttttaatattctagttacagattgagacctgcagtcataacctaaaatacaagctcttaggattttagtcattggcaagataaagctaaggacatgatgtttgtataaatgacttccatcaaagcaaatatctatgaattgatctgttaaaattgagctcaactcacataaatgagtgtgggcattgttagtccccatactggtcatttgggggtgccatttacaatactttcagggcatttttaatctaagtttaatttatattttactttctcagattgcttttaaataccttatgtaatatcatgtcttttcacactttcttccatgtcttagattataaggaattattttcactgttgccagaatgagtagagaaataaaagtgaatttgaactggtatacctttgttcacttatttattcattaaatgtttactgtctgtttatcacctgccaggcaccatgctcatctttgtttatgcaacagtgacagcaaataggcattatctttatagttatggagctctaaccaaatggggttgacagggattcatgaagtaaccacagaatcaaacaaaacattgggaacgagaggagtgtctgcatgagatgaatatgtagaggcagtggagacctggaagccaggctgagtattagtgtctttattcagagggcagagaaaagccattcaatgactcaaagccaaccttgagatggggatattacccttaattatttgggtggaaacgaatacaatcacaaaagtccttaaaagtagaatagggaagcagagtgcaagaatcagagagatggcatggtgcgaaggactcagcccagtgttgttgactttgaagctggtggaagggcaccaccagccaaagaattccagaagcctctagaaacctgaaaagtcatgaaaatacattcttccctggagcctccagaaaggagtacaggcctgccttgattttagaccagtgacacccatttcagacctccagaagagaagacatttatattgttttaagcatctacactcaaggtaatttgtcacagcagctgtagaaaaccagtacatgaactgatttaaaacacaccaaacctattgcattggctgaattagtatccttattctcagatacagtgaatgaggctcactgaggctgttggagttgcttgctgaagcccaccttcctcgaaggttatgtgtggggtcaaaattctgcatcctacagccagaaagaaaagtgtgaatgcaaggagcagttgaggtgcagaaatcaacatggtagctacagcaaagttgagtttggaaagcctccacatgggagaggaaggagggagcatcagctcttcaagggactagctcaggtgaaagtagacatttgggagctgtcagcagaaaaatttttcaaaccatgggaatcaatgaagtgattcatggaggtgacacagagagaagatgaaagtgcagtgaactcagacatggcaagatttagggctaacaaaagggagggaacccaaaaggagtgccccatgtgtcactcttgatgctgcctcctatgaaaatataattgcattgtaaaatatgtaaaggatttttaggatatggaggatccccagggcagccaagcctccttgtattgctgtaatgtagccaccccaagtcccctgactgctcttcaccaaagaccttcagtcatccgtcatgctccgttctcatgtcagcactttggcacgtgctgtgtattccctgctggtagagcatttaagctgcccaatattgtaaccatggccatcttcagctgtttaaatttaaattaattaaaatgaaacagaataaagaattaaattcctctgttaaacagaggacatgtgaaatgctttataggcacaggtgactagtgtttaccacagacagaacatttccatcacacccgccagttctgttggacagggctggctgagaacaccctcccacaggtctctgcagtgccactacccactgctacaccttcttcaagtcctgactcagaattgaacacacgccagccgccttatataaaatcagcactttttgtcaatccaccctactgcccttaccttctggttttttttttgttttatttttttgtttttttgtttttgggggggggtggtgggagacggagttttgctcttattgcccaggctggagtgcagtggcgtgatctcggctcactgaaacatccgccttccggtttcaagagattctctggcctcagcctcccgagtagctgggattacaggcgcctgccaccacgcctggctaatttttgtattgttagtagagagggggtttcaccatgttggccaggctggtctcaaactcctgacctagtgatctgcctgcctcggcctcccaaagtgctgggattacaggcgtgaaccaccgtgcccagccaccttctgtatttatatgtggacttactacgttctaacataatatctatcttatctatgtattgtatttattctctgttattattggccccattactatgtaaaattcaggagggcagcagccactcctgtgtgattatttcattgctgttgaatggaagaacatgaacacactcagtgattgacttcagcgttgtgcatagcctataattctttttttaaaaaataaactcttgatgtctgctatgtaaaaattaaaacctctagtacatgatttctcttttagctaaatgcccggagtgcccacttttatatctgtttgctttctcggatttaaagttcttcttttctggttccaaagtgctcaaagcgaagttcccactagatcaacccaatttcatcaaagagttttctcctctgaaaacccccatcaaacacttggcatgatgttgggggacaagatgttaaatcacctgcaaaatggtgccatttggtgccatttcacactcctcggacacactggggtgattaataaacccgagactgtcaaggtctgctttcccacactcattgagttgcttgccgctattttatcttttttccccccactttattgtccaaagtaaagaaatgtacagaaaatattcctcttgccctgggaataaacgtgttcaaagggtcagtcttctggcctgtgtttgagaacaccaagtcatatttcagtagggatcagccatacagaaatgccacgatgcgcttggttaagggagagtgggaagcatacgtccctatcctttggacaaaagaacttctttatggcaatacataacaggaaataaacgtggatagccaattctgcaagtgtgaagggaatgtttttgttcttgtgtggattcaatagtatctcatctttatcaaaaaaaaaggtaggattgagaaacttctgatgattctcttttgcaacaggaattacgagagctgttgctaggtgttgcctttcattgtagggctttgcttactgtaaaaaccatggctaggttattctcaagacatctttggaatcattttgctatgaatttactaatttttttttctacttagtacttgcacttcaacacaggttttcccttggcagtatattacttttttcccttactttgttcttaatgattaagtattcagaattactaattattataattattaagtaatcagaatctcacctcctttggctcactgtgcatttattggtcacctgtagagtttcatttcctctccttttctcctctcaagttcaagaaccccaggctacctggaatgtaacatccagcctattatttttgtttgcgtgttttggcattatagatcccactgtcaaccgatatcatgtgcggtggtttcctgaagcgtgtgcccacaacagaacaaccggatcagaggcatcatctggcatgacccacgtaaggacatgatctctaggccaacttgatctgtgaacataattagacaggaggatgtacaaactagacatgtcaaacagataactcattctcacaaatcagctattgagtaatgacttgatagaagcggaaagcagaatggtcattatattcactcattcttttatccattcacaccattgcactgggagcttactctgttatccacatggagcaaaacctaaagtgcagagactaaagacacagttcttaaagaactcccatatttcagggggaaatatgtctgagtatgtgtgtgcttcatcttaactggacaaaagctttgaattattttctgaattttgacatgtcaccgtgatctaaaggtgtaatggtacaagtggatttctatgtgactctatcattgagcaccatgtccctaactgccatcagctcagttagtgaaataatctccctgtcctgtatagcatgcaccaatattttgactttcaactttaagagaacattaaactctctgaggatagcaactctgtcaatattgcccaaaatgttattccaaatattttggggttcattcatgaattatagattagaatcaacaaactaacacaaaatatttaagaggtcattttattatacagtgtataatacactttgatggcagtttatatgtgatacctcaggacagtttaaaaaatccaaaaacatggccccaaacatagaatgttttggtttgtgatatgtaactagaatatttttgttttgaacattttctaaagcaagcacgatattttaagaaccatacctgctggcataattttaagagagtgagataaaacaagtcactggattttcagaaatacacagattctttttcttttttactggacttaatttgtctcatgttcagcaatgtttctccttgtatttatccttaaattagctccaatgtttgtgaccttcagtaaaataattaaacagacattctaaataaggaagtcgatttgaaaagcagagaaagcaataaacagaagctggaattattaatatttttgtgggcagaggggtgaggtttttgttttacttatatgtgtgtgcctcagaaccttacagaactgggcttatgtcaatgcaattccccaatcctaggcttatcatctttaggaactctgaaagtggtaacaactatttgctgagcagatgtaatgtatctggtagaaataaaaatcaaactcctgaaaaattatccttctaggggtttagaacttatctgtatttagttttaaacctttagatccaattattataatttgtttttatgctacaatggagcatccactaattcacttactgctgcagatgtctgtctcctatgcaatatgaaaacaatcttgaaatatctgtgaaacaggatccttaatagctaaccttggattccagtatagtcccatgtaaagagcagatttatttccaaagaaaagcaattcagactcccaaagaaacatggaggccttggcttgggcttgggttgggcttgggttggtcttgcgttgtccagattgatttgtttcctattcactgtttgtgctaactggctgcagagttgggtgcaccccatctcctgtcaccatctggatgaagggccagcacacctggaggtcactcccggtctcttttgaacattcagtgctctgtcacctgcagccacttccactcctcacttaagtaaatcactcaagcctcagttttgattttaattcttgtctcatgtttttcccgtcaacgctgctgctttctagcaagatcccctacccatcatccaatgagtgccagagatattccatctgtactttttttcctctcttaaaaaataattacacacacacacacacacacacacacacacacacataaaaaccatggagtctcactatgttgaccaagctcatcacaaactcctgagttcaagcaatcctcccacctcagcctctcaagtagctaggactatgacacgagtcaccatgcccagctatccatctgcacttttatacatatacattaagaattggtaaatacaaaacagaatggataagtgccatttagccaaatatgaaagaaacagagatacacacctgttatcacaggaaatgtcatcttttgacattatcataaagttatattcttagcccgtgactccttaccatttagcctctttcttttatttatatttaatcacaacattatggcagaaaacagtaacagcactccaaaaaagggaaaaattatattgctaaagaatatcatcattttttaacagaaaaacttacatataaactaattctatgtctcagagaagcctgcgttagttttttttaactgaaaaaagttagatttgtatttacagctttacaccactacctgcactgctaccaactcaaaaatgctgattgcgaccttagaagtagcctgctttgatgaggaattattatgatactgtttaattctagaaggcatatcccgcagccatgggagtgtttcacaattgtcattaatcaaaatgtggacagtatgtgctttgtactttttataaaagccatattgcacacactatataggaaaacatccttgttggatggaatatgatttcaattcttgccagtgttttttaatccctaatgagatttattgctagcataattctctttctcttgctctaggaaaattacataattcttcaagatctgtcattttcctgcaagtataaggtgactgtccaaccaatacggccaaaaagtcactccaaggcagaagctgttttcttcactactccaccatgctctgctcttaaggggaagagccacaagcctgttggctgcctgggcgaagcaggtacgttttcacctgaaggacttctacatctaggtctacggtgtcagcagcgctttgcaaaccttgtcaaactgcgtttcacaagaccgtgaataccaaaagtgcctctctttctaagttgtgttatgttggcccaatgtggagggaagagatgtaggaatgaatgtgttactttaaagcctaacagccttggaaagatgtcctttgatagcaatgttatccctttggaaatgaaggcaaacatttagatactgcttgtgttttgggaaagtttgatataattatttcatttttccccacccttttgctgtgtgggttatactcacacaccttccatgccaacctagcaaacctcacatctgtaccttccatcccctctcctagccaaagtccctgtcttgcagtgggagaaactcttttaaatgcactggatttggccaggcatagtagctcatgcctgaaatcccagtactttgagaggctgagatgggagaatcacttgagccctggagttccagaccagcatgggcaacatagcaagatctcacctctaaaaaaaaaacaaaaaacaaaaaacaaaacaaaacaaaaaaaaccttcggatttaataactcttctaacagctttaatatttaccttctcactgcagtcaatgctattctttaagaaatagttaagtcttgccagggtctaaactgctctcctgcctccatcttcaaaagagcattctaaaaatgatccccaaaagactggaagaagcatttagtacaaagttggagtgaggagattcctactcaacctatccccatatgtcaaaggggtgattgtctgaacccatgtttaaagaacaaggtcacattgcttctattaatatcatcccatagactggccgctgaaaattcctacaatggatcccttgggcacaccttctccagtcgcctaatcctggttttccttcttgcattgctgcaggtcatgttctttctaaggtgctagctaagcctgagaacctttctgcttcattcatcgtccaggatgtgaacatcaccggtcacttttcttggaagatggccaaggccaatctctatcagcccatgactgggtttcaagtgacttgggctgaggtcactacggaaagcagacagaacagcctacccaacagcattatttcacagtcccagattctgccttccgtaggtcccacctcttgtactatgtctgtgtcattggtatctactgctcctttttactgaccttcagaggtggctacctctgtcattctgtgtgctgcactattgagtcttatttttgcattttcttcttctgagtgtatcttttgcaagcattaacacatcacaaatgtgactgcatagctaagaagtagcataagctgccatctagataaagtttgatggctagagccaactcatgaaaagaccttaccctatcttgtatataagtgattgagccattttcttctatctttgttaacctcatgtctctctggtccaagtgaacatgccctgtttgaagtgttgaattgggaagggcaggaatagctaaaagaagcttgttgtttgtccgtcttccccgcaacttcaaatttggctcgaggctgtaatgagttggcctgtcttccaggccacttaattccttggcttcaaaaaaaaaaaaaaaaaatcatgtgtgggattttaccctctctgaaaatgcccttagaatagccaactaccgttacaaaatccaaaaagaggggcagagagggaaagaaacacaacttaaatctcagaaggaaaaattccatggaattagagagtagttattctataaatgtactaggttttattgagttttgagaagaatatgttggcataaaaataaacattttcagttatgggcattgacagatactgtgttttaagaaaaacagttggctcattcactgaaatttggactatcaagagttcacatcacaagatgtgcagctgaagactttaaaccatgggaaagttttacgttaaggaattaaaaaaataaataaaatcccaggagtgagccctgagaactggcacctcagcatattttaactctgccaagtgtcttaggctgccaagaattgagtgaggtgctaagaaaccatatggcagagaacccccacaaatgagaaatagtctataaattaaactatgcctttacaaagcaaccaaacttgcctgtgtatgatattctccagtgggggaaaaactgttctaggctctctgtgcattgcatgttgtctctgaaaggttgtcggtgagcatgctcttttatgttgtccccttaggatcattatgtcctaacagtgcccaatctgagaccatctactctttaccgactggaagtgcaagtgctgaccccaggaggggaggggccggccaccatcaagacgttccggacgccggagctcccaccctcttcagcacacagtgagtggggtgccagggcattaagccatcctgtcaggtcttgtggacatagagaaaaatcttgctggaaaatgaaaacaaataaatacactagtacaggtttctatgagatagggaaattgtcatcatctgaaattctttctccctgtttgtaccgacttactagattctattccaggcacctgtagtatacattgcatagttgatgcttaattgttctttttctccctccctccctcttccccgcttttctccctttctttgctccttccttgtttcctttctccatcctctctccctccctccttcattcttccctctcttttctcctttcctctatccttcctttgttttttttttccttccttgcattttcccctatgtaatgcatgcttttttccttgtcttttaaaccataaatacatatgggaaaaaaatctgtagtctcatatctgaaatatttttaaatcaagattttcatatatcacaatataggaaataatattttgctaaggaacttatcttcttgttacatagatattactgtaataaatattatgaattttcttcatgatatgacccaagtccacctacttcatttattgctaaatcaagtaaaatttaaaaagaaaattgtcacctagattttcaaaacagcctcttgctgatttttaaattatgtacttcgtttactttattttctagcttaaattttttaaaaaagtgtctgatgactagtgtgtggacaaaacattgagaattagtcatagttttaactctgatttttttaaatgatagattggtatgcttataattgataacttggtatgcttataatttgaagaaaaacaaaaactatcacaatgggagagcttgatagcctctaaaatttttgtcagataaatgcttttctgatattccttcatagaaattccttttaacagaagtatttgataatttttaaacttctttgagcaaataaaaaaggattatggtttgattggataagtgtgagcttaaggaaaggagcttgtcttctttttcttgttattttatagtttgggaagacatcaaagaggaagagaaaaacaggaaaaggagagaaagagtgtggttgtacattcagattcagaataggaaagacatggtcataggaaggaacatttgccagggtctcgtgctttttctacaaataaaggtaattctatcatttatttgatacatacaaatggatgtgactgacatattttgtcactttttaggatctcatcttaagcatcgtcatccacatcattacaagccttctccagaaagatactaaactgttcaaaaagattttgtgaaattgcacagatgtgtaagcttgttgaacttcggccacgagacatgcacacttccagaggcagtgggaactgctcagaggcccggactctcctatgtgactttagtgcaggaagaacttctgtcaatcatggacgcatctggagacaagtgagaaacagtagattggtgaagacagacaccagttccctacaagcatggagaaaatgaagaataggcctgtttaatgctaaattttgttttcatgtatggtgtcgctcatttctattgaattacaacagaactcagttttccctgaatttggagcaccaaactccgccccaaaaagtagagtaacaaatacacaattcactcataatgctaagcataaatctaatcaataaaatatattttgactaaattattgatacgatatgaaaaatcaactaagattatacagctttgtttattcaaatctttcctaagatcatttttatcttaggtgatttttaaatgaaaatgtgtaatctaaaatataccagtgaatttaaatctaaaaacgctcctactttaagtaccttatgctgctctttatgcaaaggtaaatcaaagttccctctataaattgtgatttacaaaagacagccaagccaaaggaactcaatgaaataagccgctaaccagattttaccttggagaaatgaaaattatttcttgaggatgccttttaatatttgattccattatgtgagagattttcctgatatgttatcttatttatattttcccgtattttcctcaatgctgctaatagcttttgctgcacttttgtttcaccatctgaaaattcacaaaacttcttgcttcaaatgaaaaaatcccaactattgagcatgtttaaatctttgcagagatttgccttttcttaatcaaagaaaggtctttgtgtgctagaatattattggtaatgttttaaaaattcctttgattgatagagaaggacagttatttgcatttaattcacccatatgctttcaaatctagtatatcttactttttggaaatgttttatgctacaaattagtgccttgtagcatgaacttaagtcaaaacgtgttatcaatatagagtgttgcagtgtatattgtaacaacctaaaacgcagagaagtttaatttaatactgttttttttcttgaaggaatactcacatacatggtttgaaatgtgcatagatatgcatgtctatataattataaatgcatgtgtatatatatgcaaatatatgtacatatacatgtatatacacacagacacatgcatatacatgaatataccttgagcatgaatccctggagaaatcgttttcgtagctcaccaatggtgagtaaagatacagctcttttaaaggtcataaggataatatattttccccatcaatgctgattctgagaaaagagcaatttatcaaaattaaacactgtaaaagaaaggtgtccatatgtctttacctacctaagtaaaacaggaagaaaatcagtaacattatccttaggttttgacaatggtacttgcttcttgttgttttattgtttcctgaattcatgcagatgcctggccattcctgggaagagtggataactcagaagtcactgtactccacagagcctcactgcagtgtctaaaggtagatgcaaattaaaatgcagggaaaataacttttctgatgttgatgcatgtctttgggaaacacatttataaacatggatacctgataatagatattgaaacccatttcctgtgtgttaaaatatttaaaaagtggatattccaggaatgttttgcagctttgtacaagtaacataaattggacacctcagaatgaaagttcatgttggttctgaatggttcactgcagctcctgtcacaagctgggatggatttatcacattgagttatgaaattacctggttctaagaatttttgagtggcaaaaatagaaaacaatcttcatttgaaaacatccctaagcttgaataaatggataccatagatagcttctcttttttattctggtgtcattaccagcatctgaatttcaagttcttaaaatttcaaaaattaaaatttttcattattagctatccatttatcttttacatgaacttgtcatgaacaaattcaaatgtttatgccagcaaatttttgtactgttgcatagttaaaaatgctgggagtctctgcatagatacaaaatattattaaattattacataaatttaattttataaaatttaatcatgcttcttttgtctgggtaatagacattggacagatatttttagttcagatggtgattctgaagcttacatctcccttaaaaaaatctaaagcagctcttatgggcttctaattttaatataaataaataatttaaattttattggtgttattggaagaaaaatgctattaatgggctaataaaaaacatgtgtttctcttatggattttaataagctccagtattattcaaatgatcaaaaatatagttataattttttgaattttaaaaatgtgattgctctaataaagaataaaatctatgctttttaacaaacatagttttggtgcctaattctgtaatatgttttattgaaattagattcatttctctaatgtgagaaaaatatatccagtaatagtattgactgtttaaaaaattgagctcatcaaaaatattgtcatcaaatacaggtggttaatctgacatacattgcagttacatgcattatttttatttacaacatttgctccttaatgatgaatttatctgtgttaccctgtttttctacctggaactccatagaatgatgtttgcaaaccaacatgtgctcttttcagtcattcactgttttaatatgacatggtagagaagataaggtttatggcaggtaattttttgtaatgtgtattaaacgaagttcaaagattagaaatacatctgtgtcctgaaaaccttagatacatagccgactgtatacagaggttcatctcaacctcaacactattgacttttggggctggatagttctctgttgtgggggtttgtcttgtgcactgtaggtttttagtagcatccacactttctcctcaccagatgccagttgcaccctcccccaagttgagacaaccaaaaatgtctccagatattgccagctaccccttgagggatggtacctctggttgagaaccattgctagagaatgatctttactgaatttgccctttataagaaacccagtgaatttctagagcaagtcccaaaaactaagggacagctaagaagttattatggttgacttcaaaggcctaaactgtgttttttatgtccactaaacaacttgattaaaagacggaattttgactcgtgtctgtatcatacaagtacaaatactaattttgccctatgtatccgtaaatgtcatttgtgattttgacttatttatttaatgccctttcttatgccgtgggttttcaagtttactcatttctatggttgcaaataactctaaaacttattatataaactttcatattataggcagaacacaatggctaaatatctgttgcatgtactttaaagtttattataaaatataaacagatatataaagatgttgactcttacctgtgattttgcatggtcagactcggtgtcaggtacggagaggattctcatgactgtcttacctctactgaatattctagtgagttatatgatttacggagtgattaacagaggtctatataaagttacttttcccctttacttaattatattgtagtgtgcagataacaaaactgctaccttctcatccaagtggtctgtagaattcatgtcccttacagtggtcatttaaagtcaatatttatttatgtatgtaataaaaaaagttggatttttgtgtatgtctgtcacattatttagagagaagtaatcttgtaaaaatgttttgtaaaaaacaaaaaagtattgtaaatagtcttgatattctgtgactcattattttcatgttagagtttgtacatactggttcaataataaagtatccttaaaccagaccaaggagtcgactcatttatttcttaaagaaacatttttgctgggcacagtggcatgcacctgtagtctcagctactcgggaggctgaatctgaaggatcacttgagtcctgaatgtttgagaccagcctgggcaacatagcaaggccctgtctccaaacttaaaaaaaaaaaagaaaagaaactttattgaatttaagaggaaaaatggacagttcctgctgccaaggagattcaaaagctctctttccatgtcagtgttaatggaatttgaggtctggtaaatgttaacaagacagcacttcatcctaatgaaagtatattggagtttgacaaccaacacttcagatttctatcatcatgtttacaattgtaactcctgatggttttagtggtatattaagtcaaggatatacaattttaagctgtttttcttttgccaccaatatttactcctaaaattgtagatatatgcaatgccaataagcattcacctgtatttcaatactactcaattgtttttcaatactacgtactatactataagcctttaaatctccattatctaagtagagttttgagaggcttgtacatccccactttgacatgcaattgacccataattgctgatgaattggaaaaaatgcctaagaaaaaaaagcataagaaataaaggcttttagggcattcaccaaaataatatatattgtacccattaagtaatttctctttactcccactctcccaccctctgaccctcccacctcttccaagtgtttattgtcaattattctacattctatgtacatgtgtacacattatttagttcccaattataaatgagaatatgtggcatttgtctttttgtgtcagcgtcatttcaattaagataatggcctccattccatccatgttgctgcaaaagacatgattgcattcttgtttatggctgaataatactccattatgtacatagggaccacttatatgctgttggtcataatgtaaattaacatgacctctatgtaaaacagtatggagatttctcaaagcactaaaaatagaactaccatttgacctagcagtcccactactgggtatctacccagagaaaaagtaatcattatatgaaaaagatacatgtttatcacagcactattcacaatagtagaggtatggaaacagcctatcaaggctatcagtggaggattgcttgacgcttttatgccatcttgaagttacagaaagaatgggggctcggatcttggcaacacaatttatgggagggagagaagagaagtcctgactagcaaaggtggtcttgttacgcagatgaaacctcccaggtcgcagcctttagagagaatagatggtgactgtttctttcagaccttaaaggtgttaggcttttagttaatttttcctagatccagacacgggggcagggagtgggtgtcagagaaagcctggctgcagcaatgcatcaatgcagattttctctacatctacagatgccaatttcccccacaaaagacagctttgtagggctgttattttcaggccctctgaacagccatctctaaatatgtcaaagaagggttatttgggggtgaaatattttgatttctttcaatggctgctgccgccaccctacagcatgagcacccatgccagtggccccaggcttgaccctccccagtccctgaggcctgaatttcctgggagttttcctgggagttcttatccactcattctctgaggcttcacccagccaatcagctgcacagcttgggcacctcacactggtctccaacctccattcttcatcaaagatcagagaggctggggctactgacccagagatcgggcttgaaggctgcaataagaatccaacttccttcacattcttttacttcttgagctacaccacagggtaagcaggttcttagggccagtggagtgtcttggcagggaccgaaaacccaagaaatatttttagt

SEQ ID NO: 16915 - DNA, 263694 bp, Human
atatatttgaacatttattgagcctctataatatcacaaccattctctgagtattggtaaattatgaataaaaataggacccaggaaagtcatgtagaccctgcccaagttttccagagaggtttctggaaaggaggaaggaatttaacaatttaaggtggagactgtgaggaaacatattttaaagagcttaaacagcataattaccagggttttatttatttattttttttggtaaatattttgttgcttcctcctgttctttattacacattttatttctttaaatactttcaatgtagttgtgttatattcttagtctaaaaattatgttagttgaaatctcatgggtttatttctcctatttgctgtttcagctgactcctgcttacaggccttatttcaccatgtgttttataatgtcagactacacccccagattgaagacagcctcatttatacaactattggccagtatgagcctatgatatggttcttctgaatggtttttgtgattgcttttgccacttagctgtgagccctacacgtgagactgctttttagtttttccaggttgaagttttccaaagaacacgtttataattaaaatcccaaacatgggatatggcaaaacttctggtttatctaatgagaaacattttcccccttcccagcttgggggaggcaagtttccttgtaatctcccttcaccattgggttgactgattttataccctcctttgatggtaaatcttattccagtccagtgttatctggtgttcttttttgtttttgttttctgagacagagtttcactcttgttgccaggctggattgcagtcgtgcgatctcggctcactgcaacctccgccttccagtttcaagcaattctcctgcctcaggctcccgagtagctgggattacaggcttctgccaccacacccagctaatttttgcatttttagtagagacggggtttcaccatgtttgccaggctggtctcaaactcctgaccttgtgatctgccggccttggcctcccaaagtgctgggattacaggcgtggtcgttatctggtgttctatcacagcctgttgttctgggaaaacttggatcctatctgtgtgtagtctgtgttcactgaaataagcattttggttactatgatcaataaattcccagtgcaggttcgtactctagtttcagatcttccttgattgacctcttgcagctttgtcactttaccaaaagctcaagtacgtgcatttgagcacgtggaaggtgagacggagtttggaaagtggtcatgctctcttttctaccatattgttagaaatatgtcaattcatattaaaataacactttgcttatcttctaaacttctagatattcaagtattttatttcaaatttcacaaaaaaattatttaaaatatcaggcatctcctctcttttattgtcctgggtccttcacttaactttctgatcttgtgaaaatcagtgctgcttcatcttactctgtgcagtgctttctttcctttgtatgcctgccttcacagacaatttttagtaggtgtctacatgtagttaatttgcgtgtgtgtgtgtgtgtgtgtagttgttgtaatgataatataggatttatacaactgttgggcaaacatcttttttttagctattgcccaatgtggtcacacatataagacctaatctctgaataaggaacagattgtctgagtgtgaatttgttcatttacttgactaacagaatttcagactatcagcttgaagaagtgctgtatttagtctgatggttaaatgcataataaagtaatatgtataatggtagatcatgttttacaaaactttcatttttctttataggtaataaaaaattggggggaaataatcagcgtttggaccatgtggtttagacatcatgcattaaaatcttagaaatcacgcttaaaaatcaccattaattgtttcccaattttttttcagctcttcttcaagtgacaatttcacttagcaaagtagagcttagtgttggagaatctaaattcttcacatgtacaggtacgtatttctgtaaataccttcagataacgtggtttctgttaaaatattaataaaatgtgttggctaaatttaactagttaaaaactcagttctctaacaataacatcttacagttggttttttgtttttgtttttgttgtttttgagacagagcctcgctctgtctcccagactggagggcggtagtgtgatctcggctcactgcaatctccccctcctgggttcaagccgttctcctgcctcagcctcttcagtagctggactacaggtgctcaccaccatgcctggctaatttttgtctttttgtgtttttgtagtagagacggggtttcaccatgttggccaggctggtctcaaacttctgacctcaagtgatccgcccgccttggcctcctgaagtgctgggattacaggtgtgagccatcatacctggccattgttgggcttataatgattggaaaagtgttaatagccataacttgcatataaaatgatattaattttatttttgttaatttgttaatttagactgctaatctagatcatttattttgaaaataccttatgcttgcattatatctgataataacttaaatcaatttaaatatttctgtctaaacagtaatattaggatgaatataaagattataactgaaccatttttgtaaatatgcaatgaataaatttggtatggcacactgcactatagttatacttgaatgaaaatattaggccaaaaatttattctaatattcattgaagaaatagttatttagtcaggaaagctttgactagatttttatgacaatggaaagaatcatatgtcatcatgcctatggcatattttatgggcctcattcagaataataatatacatatggttttctttccaaagaaatttaaatatttcagcatcaaagtttaatcaaacatattatagaactgacaaatgaatgcattatttatttaggtacaatatattcatttttacaaatacaagtcttcatatccaaactatgatatacctaaataattttttaaaccttagtgctaaaattagttgagactattttagaattgtttctaatcttgattacactaaatcaacttaaaactggattaaaatagacactagaaacataaaatgcattataaaaattgtcttgagaatgacatgatttatttaaaccaagattcaaatttataaatatagagatataatattttataaataaaagatatagttataacattttataaatcatattcagagcatatatgtataacatgtcacattttataggaatattaatagagcccatgattctttatacattttccttcttaaagatgtcagttgatagttatgttaatacaagtatttgtatattgacaaatgaaaaaatcagagagtgtggaagagattgattcagcatcatatattatgtcagcagaaatttgacacaagcatataggttactgtttctaaatcccatccatattttattaatatcctcataaattagaacacacgaattgtatcacataaaggtagaataacaaaatagttaaaaaatcaattttgaaaatacaatgaaattgttgtacttttatggatttgtatattactatgaaatatattgcacagactaatttgcctgtatgtattgcatagctcaaattaagacatactttaaagtgaattaaggccattcattggtgatgagttttgctcttaataagaatgtaaactaagtaagcatttattttcttttatataaagatgtatcacctagagcttttctatagtactggaagtagtcttatttatattaaatatagtagtaaaacaagattctaaaaataaagatattggaaaaccatgcaagccactctgcttgtatgtatttttctactacaatgctgacaatctagatactcctccaacatttccagacgccttaaaaatacaaaatctaaaactcaataaaataaatatcttaaatttaaactagaaggatgttacaccctcaaagagctaaagaagtgtcatacagaaaattgttataactacatttaagaaaataaagtttaatgctatttataaataatctgtacgtacaaatagtccagccttatcaaaatggaaaattttgatagaaattatttgttagagatgcctgaaagaaaacaattataacagctttatgaaaatctgcaataaactgttaatgaaaatgaaatgttctattatattaagaatgaaaagactcaaaatatttatcagaatatcctatttaacttactatataaaatattattttgtattattcaaatgtaaagagatgaatgtttaaattattttttgtgacttctccatagatggaggaattaaataaaacacatccctcctcttcaaatgcattactctgtaacaactatggttttatgatttgtttagaaaaagatgaagataatgtaactgagatctttttaagattcactaaactttctttcatacttttactcaagcatgtctaatttcttatagaaaggaggataatttgtttctaaaaccatttcttcggaaaaatgagaaggaataattttcttcaaagaggtcctgcagatgttagttgacttcatgcatttccacatcgatacttttgagttaatagtgtctgctgcttccataaatgatatctgaagtaattaggtgaaatacatccttttggtgactaaaagcagacacagaaatcttcagctttaatgaaaggatagtaacctagattctgaattggaaaacttaaataaatgtttaccctgtaatgatttggttgtaattacctagataagtatcatttcaatgcattgaaattatcatatgaataaatagttaacagttttagattaaaataatgaaactacttatttctcttgggaaaagagattaggacatcattataaaaacggtcgttggccttatctattcaaatttagcaactagggaaattaatttcaaatttagtattatcaaaggccaaagttggttttgtgaaagatttacatttttgtaagctcgacattttcagagatttaagtgctatctcctgaccctagcaaagaccactgagcagatgaaatcatattagtaattgtggttctgttcagatattatctataagtgggttgtatgtctggctcagcagtcaaggaagtttcagaacttaaatgtaataatccattgattaccaagggaaaatttcaacaatcatagcttaaatactgtacaagaagtttgctgtgaaacttttaggtattgcttactcaagcgtgaatcttccatgttggataaacaaaggtgaacatttgcactaacatttgtgtttactttaagttttgtaagattctcagatttccagtctgttacataatttttttctaaatggttaatattattacataatagtaaatgccaatgttcaaacaaatatttttaacaattttcaaacctttattttccatggctctttgcagcgattggtgaacctgaaagtatagattggtataatcctcaaggagagaagataatttcaacacagagggtagtagtgcaaaaggaaggtgttaggtcacggttaaccatctacaatgcaaatatagaagatgcagggatatatcgttgtcaagcaacagatgccaaaggacaaacacaagaagctacagtagttttggaaatttaccgtaagtaatgtatttatatgttttagtttattcaatttcagttgcttataaataaccgaaaaaataaaatgtttgataacacttattaagaactatgtgctttgaaaataaatatcagtttatttatgctttaccagagtgtatcttagaatagaatagctaacagataataagtggttataaacatatatagggcatcaattatattaaataatattaataaaaatgttttcattttctcaagccattaagaattcactgggtatatagagaatagtggtttatttagtggtatgatatttattcagcattttttttttcactgtaaaatagaaggtcatgattagaataaatgaaaatgtgtgacagcactgaccattgtagaatgagaatctggggaagggtcagtgaacaagagtagtcagaaagttgaaactgatctagtagccaataatattgagtcaggattctttaccactaagtgtttttattagcaaagctttccacatttgcacttcattttatgtcctgggatggatttcttcctatgttcctttctcctccttatatttaagaaccattaacctgtttaggaacattgaaatctgttgactcctgcattttaaagcaagctatcccaattactttcgtgaccttgagcaaatcatgtaacctctctgtctttagtttcctcatatataaactgaggataataatggtacctatgtgatatatggagtttgagtactaccttaaattatattgcataaagtacttacaacaatgccttacgattaataggtagttagcatttctaccaatggtaaattatatatatattaggaatgcaagcccttaaatcatctcatatctgtagctttgtgttttgtttgttattctagaaataggatatgaaaaacaaagtcggaacattcctacagtaggacttcctgtttgatgaccaatgcaatttgtgggcacattgttgctcttgtgtttcctgatttggaatttttccctcccatttgattctgagcttccgaagaaatgatattttcctaatttatgtaaccccctagagtatctatttcacaatagcaaataattaaattgaaatggtcattttatagatataatgtttggaaatacttttttattttaaatgatgcaaaagaagaattgtgacatttgcaaaggtaaaaaaaatttttgcaagaacaattcattacttctgtgagaatttctcatcaagcataaatatccatgttcactcattcattcattcattcattaaagacacttattaggtgtgtatccactataattctgagtcctagccagagacagacagacaataaataaactgaaacagatacatagatgctagctaaacatgctatggaatcctatggaaaataaattacctggggtagagagatagagaaccttgaaatggaaaggaatattgctattttatataggcaggttggataagaatctgaatgaattgaaggcggtgcaaatgccctgtggtgagaacaaacttggaatgttcaaggaacctccaagaagacagttttcctgagtgacaaggaagagagaggagaaattgagattggagttgaggagatacactccagtttatacagaacctcatatggcattgaaagatctttggattttattctcagtgagataggaaggtattagggagaagtagattatctagtttaagattttaaagtatctaggtttccctaattattttattatagtatcaatagagtctggattatgttattgggagaaataagcaatgatacttttgtgatttgtgatttgtgatttgttttactttgttgatacagaaaaactcactttcagagaagtggtatctccacaagaattcaaacaaggagaagatgcagaagtggtttgccgagttagcagttcacctgcacctgctgtcagctggttgtatcataatgaggaagtcaccactatttccgacagttagtattttggtaactccctaagttatatgttctaatactattgcagtttttaaaaatctgaatctatgtgtctagttgtagaaatttgaatttttgaccccaaatattcaacaactattttgagaacctgtaagctctacattaggattttgcaatctagggatctcagggcaaattcactgccctttacccctatgttgtaatcaaaacacagttatgcccgttcaccacatactgtctgtggcagctttggaggcatagttgagaagctgtggctaaaaaaaatatacaatcattagcctaaaaaaatgtacaatcgttagcctaaaaaaaatacaatcattagtacctggagatttacagaaaaggtttgcagacctttgctctagtgtcaagaaaagatgaatacattataagcagtactaagtaaatgaaggagtacatcctgctgtattcaaattctgtataatttatacatgattctatggtatcactatatgtaaacttagtattgatgtgaattatgtttattattctggggcagtacgttcaaggttatctacaagttctaaatattatggaaagatccatatagataatagaaaagtactttcattcaaattgtcttcatgattttgatttagactgtgctaaaatttcagaataatatgacatctgaaatcgaatgtataatttgcttacattatgttcctttaccatgttcatagggagcattttcaatttagaattttttcaatgcacctgcacagcagagaggtacaaaataattgaatcttttaaagtagtttccatcttcgatgattctgatttgtgtccaagggatgaagattctacagcataaagaagagacagaaaataatatctatttttgaatatgtggggagaatgtatgataatcatgttcaatagtcacttttttaattttgaaagaatttttctgagcttagcatgttcaatgcttgtcagtttccattataatacattaatgagaaataacactttatttcctcttgttctgtttcagcataactctgtacagtgtattaacaagtcacatgagtaaatgggttgatgtatttttagctcttttcccctcaataataaagaaaaagcagtccttttgtaacggtggaatgacaatgtctaaatattttcagactgtctaatcttacacctcaagtgtaggtttattgtaaaactttattagtagaatattttgaagtaaattttatttttaaaagtcaaatagagcaaagcctcaaagcaaagactgatgacaacgggtagtggtgatggagaagtgatatttccatgctagagctcatacgtatttccccagcatcccaggactaaatgacgtacagccagatttccattttggctttcctcctttccttggccctgaagctttgaacatcttttctaaatgttctgtgcctaaatcagactctttatctgtaaaacacagatgattgccttcatttaaaataatggctttgtgtcataaatgagactttagacataaagtcctttcttgacatctatgggtgatttgttccaggacctcccacagataccaaaataagccgatgccaaagtctcttatataaaaagcatagtatttggtataacctatgtacatcctcccatatattctaaattacatctggattatccataatatcaaatacaacataaagactatgtacatggttgctatacagtattatttgggaaataaggaatagcctgtacatgttcaataaagatgcagtttttaaaaaatatatttttcatcagcagttgtttgaatccacgaatgtggaatccatggatatggggggtcagctatacttcatttgttaagtgaatgaataaaatatatggctatatattagattcttaataaatgacatgtatcgctctcattccttctctatgagtttttaaatcttggaatcagttttgctaaaattacatgtgtttaggttatatctagaaccagaaaatccaatgtagaagaaatgggtatagtttaacgtgaaacataacactaagttgtgtggcaggtgaaaaataaaaataaaataaaatcatatttttaactatagaatttaaagtattcaagtaaattatcaggaaggacacacttttctaaccttgaaatagtgtagaaacttatcacataaatcattattgaacaatttgtacatttataatagacttatatgaaataatattattcactgcttatacctcatatagtcctttattaaagctgatgaaataagatcaagattacaattatgtatgaggatttagaataatgccacggacccagatatatttattttgccataatctgattcaaaagtaaaatatagatattccagaggaaataatgaaagcttggaaatgctcatcttattagctatgcttttgattgtagctgcgtggcagatattcagaattaaacttcctgcagaaaagcagtggagattttccatgttgctcatagaaaggagatccgtatgctaaaggatccaagcattgtgggagtaaaggtgacattttattatacaagttgaatatctgtcatcgtgatggagggatatgctatttgctgatatccattcaatcttggccagtttggaaattctctcttaaactttttaaatgctttggccaacacctaattgatatactccttctgcattaaaaaaactgattaaaattaccttgttcaatacaatttttatataacctacttctagtataaaagattaattcaacaattatggaatacacaggatctatgctgtagtgtaccagatgattatgattcatggtaagcaagataagttcactgccttcaaaatactaagaatctagagggaaagataaataggtaaatcagtgtgagaacaagacacattgagtctatgataacgaaattgtggtaataaaggatgataaaataaatgtaaactacgtaggataagagagagtgtcaaagatgcctgccaggaggaaaaagttacctttaaatatacacacgtattagccaggcaaacgtcggtgcggaattttcaggaagagggaagaccatgtgcaatggcccagaggtgaaaagcagcatgaaagcatatttctgaaactggaataagtttattattactagaacttattaataagtgcaacttagatacttttacaaatgagtaaatctaactaggatttttaaacaaaggactaataagaaaggaagctgaagaaggaggtcaaaccaagtcagcacagccttgatatctgctactacggagtttgtaatttattcaaagggggcatcattaaagggatttaatcaatgcagtgacataagctaatatacagttgagaagaatatttgtatgtcagtgaaaacaacaaattagatgggagtcaaggcaaaactcctgagactcagaatagttcaggtcctaatgaaatattgctgagggagaagaagacttaaattaaataacgataaacagagaagtgatgagacatggagtctgattgggtctgcagactcagagagatgaagatgtcaagaatgactcgtggaatttgccttccatggagttccatcacttatggaatattcctttggcaactagttccatgtaaaggcatgtgaagacagaactggagaatgccaggtgataaatttcaggtggagatgttgagctaaattttaaatatatttttcctaattcacattaaatataatcagtaaaaatcattataggtgaaggatgataggtattttagaaagttagaaaatgcagtaatacaatgatctaagtatgatagtgttcctcttcattttaaattttatttatttataattgcctctcatctaaatttctgaacacacactttaagagaggatttttaattgactttgaaactttatgaagtttcaggagtttctggttatttcaggaccacttatgagttatcttctaacatttcttgtggattggttttctttctccccagtctttcttttgatgagggcatttcatgtttgtgctttaatttaccaggggaaagaatctgaataaacatttttgtctctcttcttaggttcaacctaaggaaaaagtgagcattatggaaaagtttacacctcatgggctgcaaatcatgtggccgtagcattagaatcactattttcactttgggggagcctctgaatctgtgcattttcacccctgattagttacctcttaaacaaaaagcaactacaggcttgtccgtttaatgagtatctatgccctgatgactcttctatttgttatttctagccccgacttctcccctctcattaaggaacggctatgacaaatttgcccccaaattggagtggcctactaccctagcagtttatggctcactcatgcaaagtccagttggcagcagaggtataggcaggatcctaccatatcctttccacgatcaggctgatggagactctgcctttttcacatgtggcttcaagtggttttcctaacctcattatcaagccaacagatagggaaaaaagcagtacacattggaacaggcccaaagagtaaacaatagactgtagatatgttagaggctgggtaccttaaaataatcacctttctacctgatcaaaaatcccaaagggatagaggcggggtgtctcttattcatcaaagtgtcttatatacagtatccagcaaacagataatagtcaatgagatctatggatgtgttaattaaggaaattttagatattgcctgtacaaagagtttcaaaattggactatatgtaaaagcattctttgaatgataaggagagaaaaggttttagcatggcagcaagattgagatgcttataaaatcagggcagacacaaaaaataatgccaggctgagatgctgcttaggtgtcacagattactgtagcagattactttacacaatcagtgaatgcaggctgtataccagcttatttttttatatatgcatgtgcacacacacacacacacacaaatggaatcttgaaataaaataacaaaatctaatctatttattcctaatacagattatcttattagccaaaaaaatcccttgaataaatttgagatataatcttttttatatcctttatatgacttgaatattattatatcatttagttgcctccacagagacgcaaaattttttgtttaattattgtatgaagaaggatgttcaataaattttctagcccttttccacccatgttgccgcatatttgcagtcaaaagtttgcacatctgtgatacctaatctctctgcattgttcttttgtgtatcatttctgcatccaaagtaccaaggggaaataatagcctaaccattttatgtggatataaagtcttgaatgtattttattttattcttttaggaaaaaaaaaaaggtgtaacaaagcagtgtagagtggaaaaattgaagtcatgaaattacattttactttcaaatttgaatttgtttgctgatgaaaagcttgatagtgtcagacagtgccatattttaactcttaacaatttagagcactctggacttagccttcaattactgataccattttctcccctttgctttctttccagatcggttcgctatgttagcaaacaataacctgcagattctcaacatcaataaaagtgatgaaggtatatacagatgtgaaggaagagtggaggccaggggagaaattgacttccgtgatatcattgttattgttaatggtaagcagtaaataatttgtacatgttttatggattcattttagcaatgttttttattaaatggcaaccatgtgaactcaaaatacaagtcttatctaataaacctcttctataccaggaagaaatctttccatctttattatggcatctgtaacattgtattacagcctcaaggcaggatccatgacttatgttacattgtcattctcataacccttttcaaataggctatatgtgagtaattgccttttgctggaattgtagttgttgaaagaatatcaaataaacatagtacagtatcatactaaatgttacttttaaattacatgaattatttttgcttaaatttacatattttactctacatgtttctcaaatttaataattaaatttttaaggttatatttacaagtattaatggacattagtgactggttttatgaaatcatgatgaaatctcttcctccaaagttgcttctcctatatagttccttcctgtgttaacatgatattctatggagctggaaaatacattacagttatcttggctgtctcctgtactagcccattttcacactgctataaagaatactcgagactgagtaatttataaagaaaggagatttaattgactcacagttccaagtgactggggaggcctcaagacacaatcatggcagaaggcagaggagaagcaaaggcatgtcttacatgacagcaggcaagagtgcgtgagaaagactgaagaaatgccacacttaaaaccatcagctctcatgagaactccctcgctgtcacaagaagagcatggggaaaaccgcctccatgatccagtcacctcccaccagttccttccctgggatacctgggaattattaatacaacatgggatgaaattttgttgaagacacagattttgttgaacaatttcatctccattttggcagtctaatctgttatgaagacatatccattgtatattttaacatctctcaaacatactctattttctctatcatgttgttttccatgagagtggtgatctaatttttttttcttgaattcatacaacttggtttctctacacttaatctcacaattctacctttctctccaccaagactttcaactgtaataattcttcagtgtttctcactactgtcaagacaaaatcaaaacgacttttcatggcatagaaaacccattatgatccaccccttccctaagcattctgccattagatgtcagtcatagggaaactgggtccttagaggagatctagtatttttcaatggtctttctagaagtacagagtccgatatttattaagggtgccataatcagtggagtagttaaccttcagtgcgggaggaagatttcagtgcataaaggataggtttaaatagggagatgtctgtatctaacctttatctatatcaatatgtaactctttctctttattgtatacaataaacaagggtaataaatatatagtggctatttagtttgttaattattgaattgtctaccatactttgtatccaaaaagatttatgatgaaatatgtaagtgtatttcatcatgagcagtctttgtgttaagtacgtacttatgaaaaagggaattataataaaaattaatatatgtaaaattctttaaaattggttaagtttataggaaacagtatataagtatttcctattattgttattatatatacatataattacactaaaatattaattcaagtttgatattaaaatgaaatttatccagcaggcatagtaaccctttgttattcattctgctattgtagtttctactttaatatgtggttggtgcaaaagtaattgtggtgtttatcattacttttaatgacagacaccgcaattatttttgcaccaacctaatattttctttaatatatttatagcatgttgtaatctttttccctactagattatctgtgattattatgattacattcattttaaagaaatgattattcaggtatgaatattcttttaataaagtgtgaatcttcatgcccatcatggtctgcatttcaactggaatatttagttttatatttctatacttatttatttcaggatgtataaggagacaaatataggaatatgtttttatgtgccatttctgatcaatcatgcaaataattcctgttttgtctgtatcagttggaccctcccaaaagtaaattcttctcctctgtctcccactttcctctaacagaatcaaccatagattctaatatgaacatctttgctcggacattgataattagtctcatttttccctttaggatcacaaactcgcgtagcttaaaattcctggaatctcttttattttaaataacagtgttcataaaatcaggtatcaattgatttccgtctggaggatgcagttggacactgctgagagaatgcattgactaatgccatcagacgcctgtgcttttctctcacattttgccttaagacagaaaaatcattttactccagtcttattgactttcaccctgcttactggctccttttaaatatcgaggtttttttttttgaaagttttcccttattatgcctcttttataaaactgcttaaagatgtttcagtgaaaattttgaggctgcaaaaaataataccaataaaataaaagtgctacttttattcatattatttgatctttaattactttgactttgactgctgccctattctgttcctctcagtttacattcccagccctctcacttaattgctactaatttttatctttaccaatttgacatttattctggtcctctttcattcatcttcttccacctcaagtataccgaagtcctacccaaatgccccagtcaaatgttttttcacatgcagcgcttccttgtcaaatcttggccttgtaggaggacctgccctttattctacgttttgttctttgcaaacttttccatcacatttctatcctaccaattcatactcttttgtttcaacaattagttgaaagatatccttgctggcttcctctgtagtaccagcaataatacatgtttaggatcttattacttactttattttttcttacctccctctgtgactttcttaatgtgtttttcaatgcctgggtattgtttttcacaaatattcttcccctcccttgaagaagattatacaccaatgcctttgatatgtgaagtatggcgcctccaaaggaaggattatgcatcttcacccagtcgatcatgtgacttgctctagccagtgacttagaagcaaacaaaatacacaccatgactgaaatcaaacttcaagaaaacatcacatattttctctttttctcttgtttttttccttccgccatgaaaagagcatgacccaaatagggacttacccttcatcctgggcaccttgatgaacacaggaggagcagattacagttgatctgcaagtgcagacaacataacatgagtacaaaataaagtatatttttaagcactgagattttaaagttgttatcatacacacacacacaaaaacagacaaatgcaaaactagtgcttttgtctgtttctctctctctctctctctctgtctttaaacaatcaatttaagcaccatctgacctaggtgtacttttgaaattacttaccttggtgtcccttttcactttccctgatggtgatcatttatgacaaatttttgtcaccttattgaggtattgaaaatttagctgaagagtttttactgtcatttcaaaattattttatattgttttcatatatttattcaacaggtatatacaaagtgctggctatatgttttacactatattgtgcttggactactaaaaggcctaacacagcatcatttccctttagacacttagagttgtagctcaacaatctgtaagaatcaactttactaaagtcctttattgtttatggggtagctggattcaaaagcatttaacaaatgcagttttcctagatattcacagactattttttgagaatggaaacccaatgcagctgaagacaggagagtaccttggtattaaagataaatataatgaaggaaaactgttatttaggagaatagggcaataatatgttgcagacagaaagaccaacacttgtaaaacaaacaagagcataagttgtgaaaaaatccaagcacctaactgtgattgaaatatactgttttttgacaggaataagaacaatggtgtgttggttggtttggagattaggtggaggtgcagctgaaaagcaggtagcagtcaatcatggatgaccatcgatgctttattaaaaacctgatttatgggacaaggaagagctgccattgagaagcaagtaatccagagagcaagggagttgacacaaggatattggcagggagaaaaagtgagttcatgtgagagataattggggcctttactaaagggcaaggaaatgaagaggaaggcgtacaataaaactagatttcaaagcaaaatcatcatgttatacctgtgtcacagaggcaagaggaatcaagggtaattttaagacttctagtgtgggttttagggcttccagttatccatgcaagcaaaaatgaccaatacagtgtgcacaaaaataagtgtgctgaatttagagattatgaggttgcaagagacattatggtagatgatactgcttatgttctctgtgttaaattcagattacaaggacttgaagcataaaggtacacatatattttttaaaggatgaaagctaaaaaaaagttaaagacctgctacctaaggtttttggacttagctattaaatggggaacatcacaaagttgagttaatgactataggatgttgttgaggctttaggacaatattaaggaatattaccttgaacataaggagaatatattttatattgagcctggaggaaatgagttaaaaaatgagtaaggacgtgcataaattcataggtagatttggtcaataatttgagagaaatcctgctacatgacttcagtattctattttcagttagctggttgccctcaccgaacaaacattgatataatcttgatagtcataaaaaaattttacttgcttatattaaactttttattggatcttcaggtaagctctccaacctgcctaaaacctttctgttcatgaacctctgagtaaatgctttcctcatatcatcataccttgtttcactctgacatactatgtgaaatcttttaaaaacagattaacagagacattgactgaattgattggctaccttttccataaattcatattcttttaactagataattgtgctatacatatacacaaacatgcccacttacacatcatggatacgcttttctaaaagaggattaatattgtctctcttactttaacccacatatattctcccaccatctgattcctaggctttagttaaataatacacactgtactactcaaaaaaaaaggctcatatagatgaaagacctggaaataacttttaaacttaaaatacagtcagtagagtgttcattttataaaatgttcttctaacgtatagtgatttattattttatgaatattttgtaaatttgtaaagagtgattcactaactgcaggttcaaattggggtaatggaggcaggaacaattgagattggataaaaaacacctagtaatgcaattgtaaagcaattgtttctttagtcgatctttgaacagtaaaatcaacagtgggtgataatggccagagatgtccgtacaaatgagtgtctgaatgtatagtgcactttgttatctcagtaacccccaggcagtaatttttgtattcctacctatttcttgcaatttcttgaagtcatgaaaatgaggcaaaaaaacttttctatttataaaaaatgaaaagttaagtcaaaattttctctttaagttgtatgcagtgttttagaatgtaaagcatatacaagtatgaaagagtgaatttgtctcttgtagttgaatcatgtaattgaatcaaccatgcagacagctattttaagtcagtttaatgagtgcaaattatgagggaatttgtagtttgtaacaatgttatataatatacaatatataatttacccaaatcaataaatatttacccaaaccagagtattttatagttttattaattgtgtatccctaatgattttattaaatttcaagaataggcaatctgggaacacaagaaaagaaaagtatatctttttctccttatctcttatataactgttacttcagaaatttttagtttatataaactagagaaatgatagatacagatagatagatagatagatagatagatagatagatagatagatgatagatagagataatctgcacagatctaggcacatctttctttgcttttctcttccatataagtaattgatttgagtatttaatacagttcttttccttaagtctctatttctcttttactcagattttctaagtacacttagtgtcataatatcatatttgaaaagctgtagaaaagcatgtattgatttttcaacattgtacttttaatccctgattaaatatatggcagaattttctcattgtttgaattggattcccattctgaatttatctgtttcaagtgtaacagtcttctgcttgttgattaggggctgacctttgtatgttgttctctaaaatttatttgatgagtacagaagtgaatcctatcatttgtgaaaccacaacttatagaaatctatagggatcacaagatactgcaataatgcaaatttttatcatttcatagaatcaatcagtaaaataaaagtcaccatcaagatgccatctgacattgtggagatgaatggcattcaggaaaattaatgtctaaataactttggagagacattcatgggtcctgttcctcaaaatgtgctgcactagaggataacctatgaaaccatatcagtattttattcacactgaaattcacaaatgaccagtatcaccactatctcttgccttttttttttttgcttgtgtcatatcctatggcttttaataaaagcataggtattcggataatgtctgtttctgatggtgaaagtaataaagcagagagaattcaactcacgttacataaaaatgaaataaccactcagttataagtaaaactagttccatgtgctacatcatcttcttaagcatagtttgtttttctttttatgcagatatgcttaatttctctaggatgagatttcacaatctccgtctaaaatgtgattctctctctctctctctttctctccttccctccttccctccctccctccctttttagccagactgattgctatttgtcttataaaacttagtccaagcatcatttctagaactagaaagcaattctaaatatgacctgccttattgcaagatttcttcccatgagatctcatagtactaggtccactctgtaaacttttcaacgcttaagtatttgaaaggactcagcaggcttcacaaagtacagttgttccttggtatctatgggaagttggttgtaggaccaacatccatgggataccaaatccatgaatgctcaagtccctttatgtaaaaaggcatagtatttgcatatagcctacacacattcttcccatatactttaaatcagctctagattagttataatacttaatacattgtagatgctgtgtaaatagtgttacactgtattttaaaaaaattgttctatttttattgctgtattggtattttaaatgatttttaaaaatatttttgatccctgcttcgttgagtcctcagatgcagaacctggggatacagagggctgactgtatagtcatgtaaatgccctattcttaaaaaaaaggatatggtgcagccagaaaaagaatgcaaagtgtcagacctgtgagagacaatcccctgcacaagatttccaggggccctatttgcaaacaagatgatgtgtatgttcaccttgaaccacgaagatccaaatgaggcacctcaaagagactctcaggtagagttctttaagtaatttagccaagcttcacaaattgtttaggttgagtccaaactatcagtgcagaaaatgactttggaggttgccaggaaactttctggtccatcataaattccaatgtccttaccttggccaaaagtcatccacgtatctttgaagatattgatagaacttttccagctgatccagaaaccaactccattccaacagcctctttaacaatgtacctttcacactgacttgaaattatccatttatgtgtgacattatctcacagataacaccattaatccttcaaggaaaaaggtgatattttataaccttaaggtatactgtagagatttgcatacaggaggcggtctataacttctggaaagatttctttaatttttaattattttgtgcaaatatgtgattatctcaatcacaaagatattttatttcataattattactacttagtttttttctctatccctttagattatataatccaagttattttactattatcttgagaacatttcctcctcaaactatcaatctagtaatgcacttccagatatcttgcatgtattttaagtttgtcatgtacaataatctgcatagatttaaaatttcaacatatatttattaatgtatgtgtatatatagatatgcgtttgtgtgtcggaaaaataatcaccacggatagtgaatatatcttcttttgagaagtatttgttcgagtcctttgcccatttctttaaatgggattgtttgttttttgcttgatgatctgtttaagtcccttagaggctctagatattagatctttgttggaggcatactttgtgaatatttcctcccattctgtaaattgtctgtttattctattgattgcttcttttgctgtgcaagagctctttagtttatttgggtccaacttgtcagtttttattttgttgcagttgtttctggggactcagccaaaaattatttgcgaaattggatgtctagaagggtatttcttaggttttcttttaggatttttatagtttggggtctttttttttttctattttttttttttaattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtaacaaatttacaagaaaaaaacaaacaaccccatcaaaaagtgggcgaaggacatgaacagacacttctcaaaagaagacatttatgcagccaaaaaatacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattagtgggtatatacccaaaggactataaatcatgctgctataaagacacatgcacacgtatgtttattgcggcattattcacaatagcaaagacttggaaccaacccaaatgtccaacaatgatagactggattaagtttggggtcttttatttgaatctttaaaccatcttgagttaatttttgtatctgatgaaaggtaagggtccagtttcaatcttctgcgtatgaccagccagttatcccagcactatttaatgaatagggagttctttccccaatgcttgtttttttggccttgttgaagctgaaatgattctaagtgtatgatttttctattctgttccattgaactatgtgtctgttttttctgtaccagtaccacattgttttggttatgcttatcatcactaatcatcagatagatgcaaatcaaaaccacaatgagatactgtctcacaccactcagaaggctattattaaaaagtcaaaaaagcaacagatgttgaaggctgcagagaaaagggaatgtatataactattgttggaaatgtaagtcagttcagccactgtggaaagcagtttggagacttcttaagaaacttaaaacagatatactattcaacccagcaatctctttactgggtatatacccaaaggaatatagatcattataccaaaaaggcatagagacgtgtatgttcatcactgcactattcacaatagtacacacatggaatcaacctagattcccatcaatattggattggataaataaaatgtattacatatgcaacatgaaatactatgcagccataaaaagaatgaagtcatgtcctttgcagtgacatggatgaagctggagaccataatcgtaagtgatctagtgcaagaactgaaaaccaataccacatattttcacttgcaagtaagggctaatccttgaacacacatgaacctccgcatgggaaccatagacactgcagaatactagagcagggagggagaaagggaggcgtgggctgaagaacgaccttttgggtactatgcaaactgcttgggtgtaatgtgcccatgtgacaaacctgcacatgtacccctgtatctaaagttgaaaaaaaaaagaatataaagctttaaaaagaagtcagaagtggaaatgaaaacatagtaaactttatgaaatgctaaaaaagatagtgactatagtgaatgtatctattatccataataatttctaaaaatgtcatataaccgtgcaatatgtattttcttttaagtggattcttacccttttttcactcaaaaattattttgagattcatttatgttatcccatgccataatatgtcatctctttttattgctattagtattcaattttaagaagatttcacaattttcttacccattcaccaaaatggcttttgggaagtttcagatttttggcttacaaatatatacatatttatatattatcttggtatgggcatgtttttatatctcttggttaaatacctgtgagaggtaatggctggatcacatgccaagtgtatgtttatcacttttaaaaaacacttcctaaaagttttccaaagtgattgtactattttaccttccccaaagcagtgtacgggtatttcgggtatttcacttgctccacatcctcaccaaaacttgacatactcaggactttatgtttagacatcctaatacatgtttagtggtttcatgttgtggatttaatttgcatttccctaatgcctcaggatgttaaacatcttctcatatacaactcagcattgatcatttttggtaaaatgtcttttcaaatatttaacgtagttttaactgggctgttttcttattattgagtttactgaattctttatgtatttggaatgtaatccacttaccaaatatgtgatttagaaatatttttatccaatctgtggcttgtttttctattttttaaccactgcctttcagtgggtgaaagatgttgatgaggtttaatttttcttttttcatatgaatcatgcttattgtttcaaatctacgaatgtattgtgtaaaacaaatatgttaatactaagattttccccaattcttctttctagaagttttgtagttgttgtttttaagtttagatttatgataattttttcttaatttcttacgatattgtgacaaattggcgaaaggttttgtttggtttgttgtattttttttttggcatgtgaatgtccgatttttcatcattggctaaaaacaccgtactttagcaacagaattgccttttcattatttaaaatatattttaatatatgtgttttagggaatctattctgttccattgatctatttatttgtccctttacaccaacaaaagccgttatgataagttggaataatgtattataagtcctccaactttgttcatcttttcaaagtagttttaatatagaataaaatactctaggttctgttcatttccatattaattttagaatcaagctttcaatttttacatatacatatgcactaacacacacatacacatccactaccataactttgattagaattgtgttgaagctatagatcactttgagaataattgtcttcttgacattattgatccttctgttccagaaacagaaaatctctgtatattcaggtctctttaatttctctcagcagtgttcttaagtgttttttatacagtcctaactcatcttttggcagatttatctctaattattccatatattttgatgctattataaaccacattttaattgttaattgtagcatcatatataaagatagataatatattctgaaatgtactaaattcatttattatagtagttcataattagcttatggttccgtagaattctctacataaatgataatatcactgtgggtcaggcacagtggctcacgcctgtaatcccagcactttggaaggccaaggcaggtggatcacctgaggtcaggagttcaagaccagcctggtcaacatggtgtaatcccgtctctattaaaaatacaaaaattagctgagcttggtggtgggcacctgtaatcccagatactcgggaggctgaggcatgagaattgcttgaacacgggaggtggaggttgcggtgagccaagattataccgatgcactccagcctgggcgatagagcaagactttgtctcaaataataataataataacaataaaaataataatatcactatgaataaagacacttttacttattcctttccaatctgtatgtttttccactttcgcttattatactgggtagacagactctcctggtgaatagaaatgatacaattgaacacacttggccttgtccataaactttgggagacagggcattcattcttttaatatcaaatgtttttagatataggcttttcagggatttttaaaatcaggttgagaaactgaccttttcctaaattactgagtttttttatcaataatgaatttttctctgtctgcctcctttctgatcagactggatagagttttattagttatattgatctctcaaagaaacagcttttggtttttcttgattttatatttgtttttccttttcctattttatcagcgtgccatctgatctttattattttatctttctggcttatttggaggtatattgatctttttttctgttttctcaaggttaaacctgataatactgatttgaaatctttcttgtcttctaatgcatgtatttagtgctgaataattccctatatgtctacttcaactttatttcacaagttttgatatattgcatatacattgccattcattttaaaatgttttgtaatttcccttttgacttattatttatcccatgaaacatttagaagtatgcacttagcttccaattatatgtggattttccagagatagttctgtcatgaatttctaatttgattctaatgaggtcagagaacatactatgatttagatcaagtatattcctgatgcacttaaaaagaatgtgtattttgttgatgttagttaatgttttggtaattatcagttaggttacagtcaattggtaatgttaatcaagtcttctgtatctttttaacctacttgctctattagttattgagaaatagctgtttaaactctaataaaattaagaatttgtctatttcttttcacagttctgtcagtttattctccatgtattttaagctctcttattatatagataaaagtttagaatcatgatgtcctcctgatgaattgacgtctttctcattaggaattgattctgtttattccggataatatttgctccaatacctgagtgttagcaatatagctaccccagcattttttgcattaaggattacatggtgtatcttttttcctttcttttaattttaacatattttaattttgagggaacatagtaggcatatatatttatggggtacatgagattttctgatacaaggatgcaatgtgaaagaagcacattcacatgagaatggggtatctatctcctcaagtgtttttcctttgagttacaaacaatccagttacactctaagagattttaaaatgtgcaattgcattgttattgactatagtcaccctgttatggtatcaaatagtaagtcttattgattctttctatttttgtacccatttaccatccccacctcctcccccaaccccctactacaattcccagcccctgttaattatccttgtactctctgttccctgaattcaattgctttgatgtttagatcctacaaataagtgagagtatgcaatgtttgctcttctgtgcctggcttatttcacttaacgtaatgatctgcagttctatccatgtggttgcaaataagcatttacctatacttaaagtgggtttttgtaggatgtgtacagttgtggtttttttaatccattctgacagtctctacctttgaattagagtgccacacattgaatatattactgatgtaattgggtttaagcctattacatcttgctatgtattgtctgatatctgttcatagttttatttttcttctgtttcttcatttttgaatattttaatgaatcaattaatttcctattttgtcttgttaactataactcgttcttattttagtacgtggttttcagtcttttttcaaatgatgttgcactacttcacatataatgtaaaaaataccccctccagcctttgtgctaagtttatcagatatttttacattaatcataaaactcataatagttttctatttctgctccaacaaattacaacaaattttgtggctcaaaacagcagaaattaataattaggtcagaagtccacataggctctgctgggatctgctcagtatattataagatcacgatccaggggtcagcaagactatgatcttttctggaggctctgaggcagaatccttcctaatgtcattcaggtttttggcagaatccagcctctttcttctgttggactgaggtcctgttggcttgcttgaagtcacctgcaggagggtgcctttacctttgagcaattcccttctgaaccttgaatgggaatctctaaagctctgtagcagcagtatgttaaatccaacccatacttggaatatttctgacacatctctcttctgctgcatctcttctgccttcctcttcttcttacagctgaagagaaatctctgcttttaatatcagatgaaaaggggatcatgtgattggtctcgcctagataattcatgataatttcctcacttaatgtctgtaactttaaaaaacacctgcaaagtctttttaaatcatgatatttaatgtgttcatagatggccaggtgttagggcattgacatctttgggaagagacattattcttcccccaacaactgtgctatgcatacacacatacacacacacacacacgtacacacactatgtatagattcaaacttccaattagctcatattcataaattattacattaaaattaatgttaaagttattagaaaaaagtattttatatttatctacatagttactattcacaaggcttttcaatactttgtgtaaatccagatttctatctggtataagttcccagatgcttgaatgacttcctttagcatttcttgtagtgcacttctgttgttaatgattcagttcacctactgtatgtctgagaaaacctttttttacttttatatataaaatacatttttgctggatatagaattctaaatgaacagattttattttttcagtactataaacattatgaatcattatgtttgcctgagtttttttagatacaaactcctctgacattttgttcctctgtacataaagtatcccatccaaccagtcacccccagattcttagagatttttgctttatcgcttttcttaagcagtgtggatacattataccttggtgaagctttcttcatcatacttgtacccaggttttggtgatgaccttgattgatcatttttaacaaatttagaaaagttttagtcattagatgttcacatattgttctctgtcccacattcctttgggactccaatttcacatatataggctacttgaatgttccaactgatcttgatcttatctttcattttccggataattttcagaaaataatcttatctttcatttttgatcattttctttcctttttttcctttttgtattaatttttggatattctctcttattacatgttctagtttactaatcttttctttggcaatgtttaatccactgttcattctgctgaaggcttcatctcaggcactttagcttttaatatgtagacacatgatttttaaaatacctaccccagaactgaaaatgaaaataaaaataagttaaatttctgtgaagtcttcaacatgatcagtctttcatctagatttttggttgcatggaatgccatcataataactgatttaatgttattgtgtactatcatctgttattcctgggttagtttttggccaattatattttatcctcattatatcttatatttcctgcttcttttcataataattttagcatggatgctagatgttataaatgttacctctttatctgctgtttttttgttttgttgttcttttcaatattttagaccttttttttctagaaatacagatgaactacttggaaacagtttaatccttcagtctgtgcctttaagctttgttaagtttgatcagaatagctctggactttctttgccccacccatgagataagaatgtttctgaattctttatctgtcatgcattaggagttgattttattctggctcatgagagtatgaacttttgtttgctctgtttgagcttggaagttgttccttccaattcttttgcacagttctttccctggcctcagttactttcctctcatgggtgcactcatcagtactcatctggaggctccagggttaatcactgcaaatctcagggaatcctcactttgccattaagtcctgtctggcactgtggcctgtgaactatagccaatatccacttctctgtactattagcactacctccgcactcagagagacctctaaactccaactgagatcctcattcctgtgctgcaatctagaaactctctctagacagtaagctgagacacagcaggactcacctcatttccccccatattttaggaatttctattgaatgatttcattgactgattcacaaagtcttgaaaaacagttgttttatacaatgtttctgacatttttagctgtttcaggtgctaagataaattgggtatacgtttctgcatcttggttggaaactgatatttttagatatatgtttcagtacagcaaacaaaatttcagtgttctaaggttttgaaaaatgtatcctagtaataggaagacctgacttctaaatattttaatctctcattctgtactaaactcaaagcaatttcagatagctatgtctgaatttcactttcttcctactttatccatacatcttgttctataataaattatttttattaattaattactttaattctccctcaggtttgccagtgaatttttaacagcagggtatcacaatggttttttcaaaatatgtagcactatgaactgaaacatggcccacattttaggtgtctcaggaacatgaagaatatacaaccagtgcaatctgaagttcataacaaagacaaacagtaggaagtgaaggaatcttcagaatactttgggtagatcagagcaatgatttaaagaaagagaagagtctgatgaactgaagtagaaacaggcattccttgaagaagagtcatgattccctcaaataggcagaattaaaaatgtttttctgctttagatcaggaactgacttctccaggaggatgggctgtttcagagtatcagcttattgaatctgattgtaactgttacaaaacacaatgacaattttttaactatcaatatgatttttaatatttgcatgtttgttttcaagttaacatacagtaaaattcacttttttaattgtagaattctatgaattttaacgtatacatagattcatcttggctctactacagtcagtatacagaattgttctttcaccccaaatcactctctaatccctttatagtcacttcctctttcaacctctaaactctgacaaccaccacttctttccctgccattataattttatcttttccagagtgccatattagcacagctttagaacagctttatagtaagtcccacagttgagacctacttctcaggaaatatttctttcaaaatatcacagtgcactggcaatgcacttaaaatcaggtagtatcatttatccaactgttcttttacaaaaggttctagaaattataatttatttgccttccattgaaagtttcacaacaatttgtctacacaaacatatcaagctgggattttaatcacaattgtaaaggagctttatattagttttaaaagaattttactttttttctatcttgagtctacaaatatattaacatggtatatatttttgttgttgttgttggcctagtgtttgggacatcaatatgcttttgttaaatgaatgaacgaataacaaaaatgactttatgcaaaagatggttacaaatatggggcatttttttttttttttttttttttgagacggagtctcactctgtggcccaggctggagtgcaatgatgcaatctccgctcactgcaagctctgcctgctgggttcacgccattctccttcctcagcctcctgagtcgctgggactacaggcacccgccaccacgcccagctaatttttttgtatttttagtggagacggggtttcaccgtgttagccaggagggtctcgatctcctgacctcgtgatccacccacctcagcctcccaaagttctgggattacaggcgtgatccactgcgcccggcccatggtatgacttcttatttactaaagtcttcttttgtttccgttatcagatccttgtagttttcaacattcagatatcatacataaattttgcttgattggtacctaagtgtgatagttttggagctgttgtacatttttttaaaaaaaattttggtttccaaatgtttattgctaatatgcatatgagatttgatttggggtgtttttctttaatcctttgactgtgttacactcaacaattagttctagcaatatttttgaaggttccttgagtttatattgtatataacaatctatttctaatttctgcaaattggaaaagatttctttcttttctgactgtacgtcttaaatctatttttacttgagtgctgtgttgttctttcagcatgaggtttaataggagagctgacagcgaatttccttacttgctcccagtcttacagataaagtattcacttctttacctatatatcaatgttaggtctaaattttttggcaggtgtttttcatcatgataaggaagtcttcctttattcatagtttgctcagagattttatcatgagtggatgaggaattttgttgtttttttgttttagcatcaactcatgttattacatgattttttctttaaactgttaagttggataaattaattgagtattgattaatatgcttaatatagttaatataatttaataatactcaatatacttaatataatttaattatcttcaattaatttatccacctaacagtttaaagaacaattatttaataatattaggttcagaggtttctgaagctctattcattaatgtcatataattaaattatattaatactcaattaatctatccaacctaacactttaaagaaactgtttgctgataacagtattgtgtcagccttatattcacaggaaaaagaaaaaaaaacttaatgttgatatatttcctatttacagctagattttttttctaattttttaataaaagcacctattttccatgaaatattggtatgtaggtttattttcttgtaccatatatgacatgttaaattatcagcataatgctgtgttcataaaaatgggttgaaaaacattccctcctcttatattttctgaaagagattttacagaaatgctattgtttcttctttaaatattttttaaattcaacagataaactgagtctgaacatttcctttcaggagacttttgatttatctttaaataaatgtattttttatatttctttaataattataggattgtttttgttatatattttattttgagtaactttgtggtttctgattttcaaggatgtggttcgtattttcaacattgataagtttgtgtgcataatgttatctggattttttaaaatatttttattagctgtacaatctgtgctgatatctcttctttcaatcctgatattggcaatatgtgtcatctctccttttttcatcctgagtcttgctggaggtttaatcattgtattcttattccaaataaacttcatttaaaaaaattttctctattttgttctgttttcaatttcattattatccttttattttatattgttttcttcctcctgcttaatttttgcttattttgctcttgtttatctagtttattaggctatcccaaagagtaattgtgaatttgttccaattttttttgtctgtcagattttgctttatatattttgaagcactttttcaagttgaatgcacatgtaggattgtcatattttcctgcttaattggcctttttatcattatgtaatattctattttacatcttttaatttcatttgttctgaaacctacattttctgatattgacatagccactgcagctttcttttgattagcatttgaatggcatattttttctattgtttttattttattctagttttatcattacatttcaagtgatttcttatagacagcatatagttaggttatattttattcattatgccagtttctgtgtttttattcatgaaattaagccatttacacttcattcagatttacacatcattcatttaaaatgttattttagtctgttctttttgtctttcattcttctattttccctgctctaaattcttgattattgaacattatttagaattgtattttactgtatctataatgtttctggctatatctgttttcacaatttgtggggagggggtgttgccgttgtaattcaatgtccctatttaagttagaatcaatgtttaccatttcaatttgaatgtagaaagtatagcatcatataggtccctacatcttctctttatatcatacttttcctgtgtattatacctccattcattgaaaattccatcagagaatttgttttattctttcaaccattaaattactttaaataacttaaaaagtgaatagtgtgacatatttctcagatatttaccgtttgtaactcacgttttatttctggagtttgatgtttcctttgatttaatttcttttctcttttagaaggcgccttgagcaattcttttgtatcaggtctgctggtagaaattgtaatagttttcctttaccttcatgtctgaaggggattttgctgaacatagaccttgctttgacaggtgtgttctttcagaactttataaattttgtttcatttccttttggccttaatgatttctggtcaaaaaattcagtcatgtgaatcattcttctcctataactattgcatattttggtgtttgtatatttttggtttttagaagtttgattatgatgtgcctcaacatgaactgttttgggtttttcttgggttcgatgctgttggcctatttgagaagttttcagatgtcagatgcattgatacatatacatatgtacacgtatatacctacattattttgtcctggtcgtctttctcttttccttcttggatttcatgacattttggtagtgtctaagaagttcctgaagtctattcactttttcctttaatatgtttccttttgttttcaaaattggataacttccatttgtaattctttatgtttgataactctctctgtcaatcaattcagcacatccatgaattttgttgttgttgttgttgttaacataagtagaatgctaatatttatttggggttttaaaaatatatcgtatgtctttggagagactttctatatttccatttatttcacctaattatttagaacatgttttaaacagttgctttaaaatagcttttagataatccaacatgtgtcagcatgccattggcatttccaatgacatgattttcctagttcttaacaggtaaaacaatagattatctttaggactttgaatattacataatcagactctggatcttatttcagtattacggaaaatgctcactttttttgttgtttttgtaggcaatcagtttgtttagatcagacaacaaattctgaccatctttcttggttttatattcagacgccattttcattacctttcagtgactgtcagatctgtcctgcatgtgtaccaatggccattccaggacccatatggaggtttaccttttagttaaattcacaaaatcttagcaatgtttagaatccgattcaataagcacaggtcaggacagagctcaagatttcctaaagaacttgctgtggatgccttcctaagaccttcctactctatgatctctgacatactttcctatttcttaggtcaccactttttagtcccctggccagaaagctgcgatcttatttatctctctctgccccaactatggccttattctggttcaactgatgagattaatgaggaggataaaagcaatgggagattttgctcttaggactacagtttatctgattgaagaagaatgtcatctctcagagaattgggtgtttgcagctttcctctgttgacattgtcactgccagatttccttcctgcttcctgagtctgaactggaaggcttctctttcttggacatttctagagcagtgttgatgacaacttctgggttttgtgatgccttcaatccaggccatggaattctgaaaagaaaattgttatctcacagtttgtctggtgatattttaaattctgttatatttcttaatagcaatatgtctgctgcgatttacttttaagagtcttcaaatagatgacatacatattctatccaaatatattggtcatattaagtggggagataggacactgcaagatgtctcgaattaatccagaactggaattctgtgattacttttaaacttgttgacatatatatgatcagagccttatttaaacaataaggaattaatatatatattaacaaagtgattttcagatgcttacttttttattgatatttaattgatcacttcagtgtgactttgaacatttagcccacactttaggattcttactgccttttgaaagctgtgtatttaaagccatacttttcttagttaatgggataaaaagtaaaagatttataggggagaaaaatgaaagtagttccaattatttctttctggcagtttatcaaaggtggaaataatgctgttcttacaaaatttgttattttatttacttttttattattatactttaagttctagggtacatgtgcacaacgtgtaggtttgttacatatgtttacatgtgccatgttggtgtgctgcacccattaacttactttaaaaacatgcaataataacttgccaaaattgaaacaccagatcatatatttattttttgtattattaagatgttacagtaaaatgaccagttttaaaaaccaagatgaccctttctccaacatctccatcatcttccaattttatcttttattcttttttttttttttttttttgagacagagtctcactctgttgcccatgttggagtgcaatggtgtgatctcggctcactacaaccctacaacctctgcctcccaggttcaagtgattctcctgcctcagcctcccaagttgctggcattacaggtgcctaccaccacgctcagctaatttttgtacttttagtagagacagggtttcaccttcttggccaggctggtctcaaactcctgacctcaggcgatctgcctgcctcagcctcccaaagtgctgggattacaggcgttagccaccgcgcccggccatatttattcttgatatataaataaaacaaatatagcccctgtatattggtccttggaccattagcacataaaccccccggtgccaaattcaaaaatttacacatccgactgttttaaattaccctgcataagcctattttaaacatttacaatcagcctgctttggaaactgcaaaactgcacctaacttctgctagccatacacaaactccaagggcaatacaagacaccaagcccacagctgcccttctaccttctgagagagtctgagagacgctgctgtactgctgagtgacatcacgtggacacattatccccctctcagattcttcactcttccaggagtttccttccccttctcccactctctgagtggtgactggacatggtgtctttaaacagcctcctgctatcaggaacttccaatgtcaagcaacttgtatgagtagcacctaagtcaaactcattatgtgttaatgcctcctatcatcataagtttttccttgatgagtcctgaaatcttcacacttacttatactttccaacagattattttctgcagaattttgcaaaaatgagtactaccaactctaaaaatacgttctgaaatcttacacctttagattacttttaaatatacatcatgacttttattatacattatttttcttataagttttatatgattcttaaaattaattaattattttttttgagatagagtcttgctctgttgaccaggcagtgacacaatcacaggtcactacaacctcgacttcccaggctcaagctatcctcccatctcagcctcttaaatagctgggagtacaggcacacaccatcctatcctgctaattttttctatttttttgtagcgacaggctctcattatgtttctcaggctcatctcaatctcctgggctcaggtgattctcctgcctcagcctcccagatcgctgggattacaggtgcgagccaccaggccttgacttctttttaaacttgaattaccaacttgtattctagtccattttgtaccccaggtggtcccaaaacttttctttaatgtataggttgacataaaacaggtgaattctcagatcagtttctgcaatcagtctttcctgatatattttagaacctgagaaagacttttggataaggagataattgaactttttctccattagcacaatccaatagctgactttctcaaaagaaaatccatctgcacacagatacatggttggaaaaggggtgacccaagagagtttctgaaaggtgtttgggacctcaaggtttcttgaaatactctgagggcctttcatgtagaatattgttaactgtagaatatacgctgaaagaatataaaaattgccatgtttagtggtgaaattaactttcaagaattaaaggaacattcaagcttgaatttatttatttatatatttattgacttgagagatcttccatattaactatggccttttatttaattattatctcatactgtggaaagacttcttttgacaaaaataaagtcacagtaatgttttacctcctttcaactgtaacttttcacttagattttatttaataagccctttagattggtggtaaaatgtcgtagacatctagtgatggattagctttagtaaattgtattaaaaaatctattaacatttttatttttatgttttttaatttgttcatttatacttctctgattataaaaataatccaatgttagtatagaaaattgtataatgtctactgaggacatttcaaaagagctgattatattcttaaatcaacatattaaatattcatttaccactttacctatgaatttcaattatggttaattaaatatagaatttattatgtaaacaaatgctgtaatagatatgtatctggtcatatttggccaggtgacttatacttgcccaatagtgtatccacagggtttggaatactgatcagtttgagtaagagtgaagacttatttatatattgacataaatatgtctcttacatgtaatgtcagcttgataaaagaaacagaatacagaagcaggcgtatttttaaaagaaagaaaaaatattgaaatattaatcaatatttgcataaataaatgcatatgctggccaggctctgtgagacactcctgaggcaggagtactgcttgagcccaagagttggagactgcagtgagaggctatgatcacaccactgcatgtcagcttgggtgacagagggagaccctgtatcaaaaagaaaaacaaacaaaaaaaaatgcaagcacagtcagctcttcatattcgtggtcttacactggtgttttcaaccaatttggatggaaaatattttttaaaatagcaataaaattaacaatacaaaaatgaaaacatacaaataaagaacaatatagtataacaactatctgagggagttcctagaatcaatcctctgtgaatacgagttaacaactgtaattaataaaaataactaaccaaggccagtgcagtggctcacgcctgtaatcccagcactttgggaggccaacacaggtggatcacgaggtcaagagtttgagaccagcctggccaacatggtgaaaccccatctctactaaaaacacaaaaattagctgggcatgatggcgcgtgcctgtagtcccagctgctcaggaggctgaggcaggagaatcacttgaacccaggaggcagaggttgcagtgagctgagatcataccactgcactccagcctgtccgacagagtgagactccataagaacaaaaaataaacaataataactaaccaggaaaatgaaaaggtcaataattttagttgcctcttattttttttttatttttgatcttgtacatatgatctacgcaaaaagccaatttaaaagaaacataataatcaggttcctttggcaaataattagaaaatggagaaaagcgtaattatgaaaatgcaacaaagcatcagttaacaatttttcattgtttttgtacttgctgtctaaggaaggaaatacttatttgattaaactgctgattcctcttatattaactttcactaagaatgtaatcgtaaatgccaatggaacctttttttgatttttcttaaaccaacttaatgagccaaatttgatcctcacgcttctacagtctgatggtactatataaagcctttactgtgttgttcagataggtttgattttagaagtcagtactcagtaccttatggcagttaggtcacggctttactatattcacaaattaggaacaaccatgtggaaaatgcccaaaatttgctattcgtcaaatatgcatagaaatgctctattgattagattttgtaacaagacggatataccaaatcagttgacactgaagattgaagaccactcagctacatttgtttaaaaagaattgtatgtacgtatttagtttatagtaatcaggaagatagactttttttttccaaacgaaattataaaattattgttccttatgcccatcattttatactttgcatttttaaattttgtatgcattttgagttccagaaaagtattctcattaaatagcactttaaattgatcaccctcataaattcagaatggaggactatgacaattaaccagaagcaatattaatgaaaattgagagctgttagatcatattacagcatttgcagcagtagggaagagcagaacatacaaatttttaaaaaaagaaaacagatggatttcattgatgcctgatatgactatatgaaagtaacaatttcatgatcaaaatcatgatgaatgcattctccataattgagatgtcttattgtatattgagaggctatataatattaaaatactagtcattctttacctcatataagcaattaagtatttgaaaaattgtcaaagatgtaaattgaaaaatgagggtacttcatttgttatcaaaggaaggttcttaaaattaactgaaaacatgtaatttcttactatccatgagtaataaaaatagctttgcaaatgtggcttcccaggtgtttcacttttctaacttcatataataaaatgcaatggaaagagatgtgttaatgaaattatgggaagacccaaagaaataaactaatttgcttttcatgcagactgagaatataaatagagaatgttagaactatcaaataactttggtgttaatctgctctatctattctcttggccaggaaccaagatcacttctgtgactttctaatggacacacagccctaaatgtaaaatcatttttctgatgattagtgataacgagcattttttcatatgtttgctggttgcttttatgttttcttttgagaaatgtctgttcatgtcattttcccatttttaattggattattatttttttcttgttgacttgtttaagttccttatagattccggatattcaacctttatcagaggcatagattgcaaacattttctcccattctgtaggctgtctgttcattctgttgataattggttttgctgtgcaaaagctgtttagtttaattaggtcccactcgtcaatttttgtatttattgcaattgcttttgaggacttagccataaattctttgccaaagccagtgtcgagaagtgtatgtcctaagttttttttatatatacttttttatagtttgaggcgttacatttaaccctttaatccatcttaagttaatctttgtgtatgatgaaagatagtggtccagttgaattcttttgcatatggctcgccatttatcccagcaccacttaccgaataaggagtcaacattttgttaactttgtcaaagttcagatggatataggtgtgcagctttcatcctcagagaaatgtaaatcaaaaccacaatgagataccatctcacaccagtcagaatgaatattatttaaaaagtcaaaaaataacaggtgccgtcaagacttcagagaaaaaggaatgcttatacactgttgatgagaatgtaaatagttcaaccatcgtggaaagtaattttgagattttgcaaagaacttaagcagaactgccatttgagccagcaaacccattactgggtaaataccaaaaggaaaataaattgtaacagacacatgcactcgtacgattatcacagtgctattcacaatagcaaggacatggagtcaaccttggtacccatcaacggtggactggataaataaaatgcagtacctatacaccatggactactacactgcaaaaaacaaacaaacaaacatgaaatcatgtcctttgctgcaacatggatgcaactgtaggccgtaatcctaagcaaattcacacaggaacaggaacagaaaaccaaatactgcatatcctcacattgaatgcccatggacataaagatggcagcaacagacactgaggactactagagaagggaaagagggaggtgggatggtctgaaaaactacctattgggtatcatgctaactatctggatgacagaaccacctttaccccaaacctcagaatcatgcaatatacccagttaacaaacctgtccatatgtcccctgaatccaaaaaaagaaaacgtaaaaagaagtaaagagaaaaaaagggttgtgagtcttaagattagcagtcctctgctaggtgaaaaatctatgtgtgcatttatttgttgctttatatttaaaacagaattggaattgaattacaaatgagtatacttcctggctgtgcttgagtggagttagttttccttggctcaaataaatttgaaggaattagtgggtgccggttaatctgaaccaaacaagctgtgacatgaataggcatttcatggttggtatcatctttatcttctgagaaatatctgagggttgaggaaagacttggaagactcagaaaacatatgaaattgctgcatgccattattcataaaaggtaaatcagtctgtcaaattagtggtatatctgttgcctaagcaaccggtcaggagaattataacttgaaggtagtccaccacgtccatgttagtgggagttaatagaactacttcactatacatccccatgttccttccagctaaagaaaaaatagaaactttccaggaaacgttgactactcaacacatacagaatacaaatccatgaaagaattcatttcattgtaattctctaaggaatgaaaaacctttactgtaataaaaagagtaatactgctcttgcaactaatgtataaataatgataggtaaaacatgcattttgtttaaaatgttatttcccataattacagaggaagaaaaacagggtacagatagtcaaatgacaatgtacttaaaattcagagttaatatctgaaaaagttctatcttttgtaatactagtaattattatgttactttagagacaacatgtcagattatgtttcttgtatctaaattcataaaggcagaaacttgatttattgtgtttaattactaagttacataccagttcttatctctaccatcaatggaggtaatgtggcatcaacgctgacctgaatgctattatagagatatttgagtataatcacacttgtaaatgcctgtctggtattgtttagtatatgtaaaaaatattaatatacttaattttaggaatattactttatgatattcagcttaaaattataaaagtgtgcattgagtcacaatttatcctctactttgaaatttagcttctattgtggatgctagtgatttgtttattgcaaacagtgcatttcagtaacagtttcaacatgttccaaatgtgcagcatatacagtttttgcaatgtaattagttagaaattggagatgcttaattttaaaattgaacagttcatgaaaatctatttccattctctgtatggcttatgcagtttctcttcataaaatgttctatagctgcttgaagaaattaagtgtagttaatcagaaagaacattatgttttgacacctaatttgaaagccctgttttgaagcagtgatatattgcttatggcattacacagaccaatgagaagccaaataggaaatccacttatgctcaaagtagatctccatattgatgtaagttagggtggtattgtctttttctgagacataattcctaaaagtatatatgtttgctaaaatatgtactttattgtttaacagatttagtagtgaaatagctttacaatgaattgatataattattgcacattagaacacagatcattgatggacatttggacatatgtaacaaacctgtacgttgtgcacatgtaccctagaacttaaagtataataaaaataaaataaaaaagaacgcagatcagtgataaagttattttactgtgaaaccaaatcagtttcattaatataaatggagatgtgaaggatgacatttgaaagcttaaaatgtagcaaaaattctctaaatgatggtagtgaaggtgttttcgtctctatttattctgtattcatctctccttcagtgccgccagcaatctcaatgcctcagaaatcttttaatgccacagcagagagaggagaagaaatgacattttcctgcagggcctcaggctctccagaacccgccatctcctggttcaggtaggttatgcacccccctccctctggcttgtgtccattatcaggcttatggaacagtattgggatcttaatcattttggtaaaaagcaaaccattgcattttagtttcattaaaaaaaaatcctggtgctatctttggggcttacggtggttagattaaactgctaaagagatcaacagtgtgaccccgctctaatattctgagtcaaaggctgtacccattatacttattctgtctgtaaaagcagacttttggaaaaatgggaccaggagcacctgtgacttattcaaacattttattatcattacaatttatcttgaaattgatattctagtgttattgacaccactgtcatatgtatacaatatcatattttattagaatataattgtgtatatttgtattatacacaaaatgttgtattatagaaaaaactgatttatagcattaaaattcaatgaatttaatgtgtaatttttaaaaattacctcatcaaatgaggaaattctgtattctaaatctataatttgatagtttatttttttagaattttaaaatactatttgatttttattaagttcaagaatatttttaaaatattccattcttttagattgtgtctcaaactacgaaattggagacgatgaactttaaaactggaccatcttgtagatatgcattagtaatgcaggttgctacagaagcattagctacaagtatttacagaatcatttcataaaccatatagtgaaaaattatttaaaaagattagtaaaatatacatcagaagtgcaaaagtgtccctactaagtattaggttgttgttttaaaagttctttgaaggacaacaattgaaatcccaaactaacttttattcttttttgcttgagcatgtactgatattaccttcaactttcaaccatttgtttctactgcttatcattttaatataggatgtaacaataaatgagatgtttcttcaaatattgtgtgtttagatgttcttttcagacactaattttcttgggacaaactgttggtattttttagtaggattacaccttgaatattaacatacccaccccagataatcatcgtctgtctcagtgactgctgatttactaatgtggatccttaaaagtccatatcagacctaattgtatcacagaaaagctactgaatcattcattccaatgaaaaaatactgttctacaatcttttttcctatggttttgtatttccacagagatttcttttttcttatttgaacagcatttatttaacagataaagaaagtaaagcacaaaaataatatgagcaggaaattgagcaacaaacatgagcttgagatactcatgttccactttgtatgtagtgggaaaaacatcttaaacttcaagcttatgccgatcttagctaatgtaattgatgattccacaaaccaatagtgggaatagtagctggtaggaaagtacaggtgaataagccttgttttgaaataattttccagtcatttattaaggaatgctataaaatgtaaactgttctgtgtaaaggggctagaagtcttcctgcattcaagaggaagaaaggaacatgtatctttatcctgtgaattcatcctgacgtgcacttcatcatttctgaggcagaaatacatggaaactgggtgtgtgattgttacagtgttagaacatatgtccttgaaaaatatgacaccaggtttaagaagaaaatctcctttacttctgagattacttgatcacaatgattccaagtttgatagtaatttcagattccccacctatttatgttgatgttaagttatgcagattcctcattagtcccatctttaggataatattagaacacttaccatcaagtcagaatagtaattgtgagactagatgcttttagtttggtcagtttagttgtctgcagcacaaccctttcaaataacagcttaccaattacttctcaccagaataccaagatcctccagcagctgggaagtgttagctggcttggtttttcagagagacttcttttctgcagagatttttttttcttaaagttttacattccttcaaaactgttttcttatatttaattagaaatagtattatatagactagtataaatcagattcaaagaataatataatgagtaatttaaatttatattttttcttctccatatcttcatatggtattagtttcatcctttggatagaatgaaataacaatttattgaaaacctaaataattgttctagtctctggatataaaatatatactgggaggatgagaatgtgtggttgtaacattaacgaaggtaaaatttgtgttagagggaaattctgaccttgtatctgtacatatagacatgtcatgtttgtggaaaagaaaaaattcctgaaagtatcaggaaatgtagggtagcatcccgagagaaatgtccagactgtttcatagagataatatttccaagcgagataagtgaagtcagttgtactagtcagcttgggctgccaaaaccaaataccacccactgggtagttcacacaataggaattccttgatctcttgacttcgtgaaccgcctgcctttgcctcccaaagtgctgggattacaggcgcaagcaaccaccaacatggtgaaatcccatgcatggtggtacgcgcctgtagtcccagctactctggaggctgaagcaggagaatagcttgaacccgggagacggaggttgcagtgagctgagttcgcgccactacactccagccaggcaacagagcaagactctgtctcaaaaaaaaaaaaaaaaaaaaaaaatttcttttcccatatttctggacactagatgtttaagatcaagataccagcagggtggccttccctctgtgtacaaactcatggagagagagagttctggttatcttcctcctctttcagaaacagcaatccttttttgtttgtttttaataatttcaacttttatcttagattcgcaggtttgttacatgagtataatttatagaaaccgaaagtagataattggttgcctgggactggatatgagaacagagattaactgtgaatgggtataagagatctcttgtgatggttgaaccactcaatacagttactaaaacttcagccaaccaaacaaaaaccaccagttttatgggattaaggcctcactcttatactctcatttaaacttagtgtcctccatggaggccttattttcaaatacagtcattctgggggttaggacaccaacatgtgaatttgagggttgggaaaacccaatttagttcataacatcaataagataattaaagaccataataggggaattataaaacatgttcacaaagagaatcaaaagcacttagtgacatgtaaatccaagagggagtaaaagcagtgactctaaaggttccccccttcattttcgttcaaacggtacttctatattgagaatacaatatggatttttattgttagcccattaatttcataaatttaatttattttaaaatgttccatttaaaccccacttaatcatgatacacaggcatgcccagcataatgacctatcaatgacacgcctcatatgtgatggtggttccataagattataatggagctgaaaatgtcctattgtctattgacatcgcagccatcataaaatcatagctcaacatattactcatgagttggtagttacactagtgtaaacaaaccaatatataaaagcatatacatattttatacactacataatacttgataaatatgttactggtttatatatttactataccgtacttttaatcattattttagagtgtactccttctacttataaaagagagaagttaactgtaaaacagcctcaggcagtttctttagataatattccagaagaaaggattgttatcctaggagatgccagctccatgcctgttattgcccccaaaagaccttgtagtgggatgagatgtggaggtggaagacattgatattgatgatcctgaccctgagtcggccgaggctaatgggggtatcttcctttaaaaaaaaaaaaaattagtgataaaaacttaaacaagaaaaaatatatatccttataaaataaacaataaagaaaatattttgtacagctatacaatgtgtttgtactttgagctgttattaaaaaagagtcaaaagtttaaaatttttaagagtatataaagtaaaaaaagctaaggtgaatttattattgaagaaagaaaatgtttagtgtcgcttaagtatacagtgtttataaagtctagagtactatacagtaatgtcccaggccttcacagtcactcaccacttactcactgagtcacccagaagaacttctagtcctggaagctccatttacaacatatatatatgccctatatatgtatagcattaattttttttttttttttttgagatggagtctcactctgtcacccaggctggagtgcagtggtgcaatctcggctcactgcaacttctgcctcctgggttcaactgattctcctgcctcagcctcctgagtagctgggactacaggcatgtgccaccatgcccggctaatttttgtatttttagtagagacgggtttcaccatgttggtgaggctggtctcacactccatgtgattatcccgcgtccgcctcccaaagtgctaagattacaggtgtgagccaccacgcctagcaaaaaacacttttataccatattttttactgtaccttttctatgttttgatatgtttagatatgcagatatttactattatgttacagtcgcttccaacattcagtatagtaacataccgtacaagtttgcagcctaggagaaataggccataccatatagtttaggtgtgtaataggctatataccatcttggtttgtgttaagtacactctatgatgtaaacagagctacaaaattgactggggacatattttgtagaacatacccctgtggttaggcaatgcatgactgcattatcctttttatgcatggctggaatcaatgtgtcaataatttgttaagaattttttatattcatggttatgagaaatattgttccatcattttcttgttcttgactttttaggggtcagggcattactagtgtcagagaatgagtagtgaagtatttcttcctcttctgttttccaatataacttttatgtaatgtttattatttcttaaatttctggaaaaattgccagtgaaaccatccatgtcataatttttcttaagttcacatttaagtacaaattcaataatatttttcatagaaatagggctattcaggtaattttctttagtgagcttagatgattaacgcaattccaggaatttgtccatttcttttaaatggtatttactggcattgtcattcatagtatccctttgttatacttcaatttgcatgttttctgtagtattctcccctctctcatcttgataacctcataactggttatttgttctactgtcttttttatcctgattattctagatgtaggtctatgcacatactaatgtcagtgaatctgcttttggcttcacttatttcttttttgtttcctattctccatttcattaatttctggttttatttttattattattttcctcctgtttactttgtctttaattttcttttccatttttgattgcttaaggtggactcatgtcattgattctaatcatttattctaatacaagcatctgtttttcctctctaaatatggctgtaattgcaccctgctaattttgatatgtcatatttccaatttggaggggtttaaattttgtttttaattctcatgttatttttaatactattcatttagaagtatgctgatttgtttctaagtatttgggtatatttcataaatattactgctgttgatttttaactaaattctatacttatcaggaaatagactttttaatggtttcaatttatttaactttattgagtcttaaattaaagtatgtgtattccactattattgtatggagaaatccctaatattaaatagatcaactcccttgatagtattgtggaagtcttctatatttttttgtaacgattcttctccaactttatttttaaatgtgtctatttttatattcagttctctctgttttgcttcatattttttgaagctctagtattatatgtttaaacatttattcacgtagatcagtactatgaaaattattatttaagggctttaaggatggaaaaaaatgataccatatagaactttgtttcagtctttttctgtttttcattttaccatgtcttcaagtgaactaagttacgtcactatgtcttcaagtttactaatattttctactgtaatatctaatgtttttaatcccatcagagtatttctcataattttatttttcttctctgagagtttcaaggagatgttttgtatgtcctccatgcctctcttaccattctcatgttttacttccttgaaaatattggaatatatttctaatagttgttttaataggcatctactcacctaccctctgtatcatacctatattttgtaactgactgatttttctccctcttgttttatttattttttggagacagattctcgctctgccacctgggcaggagtgcagtggcactcactgcaacctccaactctcgggctcaagtgatcttcctgattcagcatccccagtagctgggactatagacatgcgccacaatgcccaattaactttttaattactatttagagaagtggtttcagtgtgttgccagggttgaacttcaaatcctggcttcaagaaatcctcctgccttggcctcccaaagtgctggggatacaggagtgagacactgtgcctggtgatttttctccttcctctgggttgtattttcatgtttatttactatcctggttagtatatatactctatactctctctctctatatatatatatatatactctatatacatatatatatatactctatatacatatatatatagagagagagagagagagacgagagtgagagagagaatctccctccgtcgccaggctggagagtgcagtggtgcgatcttggcccactgcaacctctacctccctggttcaggcaattctcctgcctcagccttcgagtacctgggaacacaggcacgtgccaccacatggttagtttttgtatttttagtagagatggggttttggtatgttggccaggctggtcttgaactcctgacctctggtgatccatctgccttggcatcccaaagtgctgggattgcaggtgtgagccaccacacctggccgtatcctgggaatttttatttatttatttattttgagacaaagtctagccctgtcgtccaggctggagtgctgtggtgtgatcttggctcactgcaacctccacctcccagattcaagtgattctcttgcttcaacctcccaagtagctgcgactacaggcgcccaccaccacgcccagctaattattttgtactttttgtagaaaccgggtttcaccatattggccaggctgatctgtaactcctgaccttgtgatctgccctgcccgcctcggcctcccaaagtgataggattacaggtgtgagccaccatgcccagccaggaatttttaattgggttccagacattcagaattttgtgttttggggtgctgaatatttttgtattattttactttgttttatagatgcagttaagtgacttggaaaaagttttatttgagggagagcttccatttaggctcttttaggtggatccaaaccaccttcagtctagggttaatctggttccattactgatgcaatattattctaaggacatgacttaagtcctgtgttttaggatatctttttactctggatggttgaattgcagattattcctggtgctgtgtgagcttctggaattattgtactttatattttctaatggttctttccctcatctgagaaggccttactggtgtacactcattgatcaatactcagttaaagatttgttgggaaccctctgcagatatctatagctctgttgtctgtgcagctgtcttctctcacattatctaacctgcaccttctgtcgctttgacctcccccaactgcacactctgtcttccaacccagatacattgcctgactctgttcgtgttctctgcctcccccagctgcagcctgaaaactctcttcaggcagtcagcgatggaggtactcatatgccactgtcatatgcaaccagttggctaatgtgtgaaaactattgttttatatgtatagccagtgtttttgttgtttaaattgggagcatatagtttatgttaatacaatattgttcaaaatgaaattatcattcaattctttagtgtttacattaattctgtaatcctgacccctacattcttgtacctgaaaaaggggacgcttagagaagtggtttgagtttcaaagaatgggcttaatgcatgtgtcagaatgccttggagtgattttttagacgttgacatttcatagacatggattgtgaatagcaataggagcatttctacctgactttattgggagggagtaataaggtatttattgggagggagtaataaagcattggtaatattcccttatttatgatggcttaattatatttcctattgagcatttaaagtgaatgtaatctgtacacacttatgttctctaaatatgttcaagttttgcccctctacttcaaaggccaaatcaaggatttttattttctcatgaaaattcccagagtagtacagccatcttccttgtcatatctcccgttataacagatcacctcctgctcaaaaaagttgtaagtccactaatggaatctgcattaacctctattaatgccaaccaaattatgggttcctcatgatgggtggcaactaatttgctatacatcaaacatttagcacaatgttttatatgaagtaaggagataaccctcttttttagaaagaacattggaacttaattaacctgctgcttttattaatgggtgagcctgtctttttatttgtgaattgaggagtagagatatacacatactgtagttctctgattttgaatgagtaagcagagggaaaatgcacatttatgggctaattgtgagtgctgaaacctctaccgtgctattattattattattaggaaacaaatgaataattttcattgaagatattgagaaatatattgtatccctaattatgatgaaaaccctatctacatattaaattctagataaaaactctgaaatgtcatttttatacctgttgtaaagattgcattagtaataatatcaaaaatatatataaaagatactatatatgcatttattattattttttttttcggacacagtctcactctgtggccgaggctggagtgtagtggtgtgatctcagctccctgcaacctgcctcagcatcccttcggagtagctgggattacaggcgcctgctaccacgccaggctagtctttgtatttttagtagagatggagtttcactatgttggccaggctggtctcaaactcctaacctcaagtgatccaccggcctctgcctcccaaggtgctgggattacaggcatgacccaccacacccgacccatttgttattattttatgaatcctaattttgcaatcttccactcctcttaagaaatgttgtgtacttcatggtacatttagagatgtcatgagaaactggaacaataaattctattgagtatagacatataaagattatgttcatatatgtgttagtggtttctggaaagtagaaccagaattcactggaaggaactgcttagtgtatcagagaaatgtttgattttattttagaaaatagttttaataatatttatagagatttttttaaatttacaattgtatggacaagcaaatgtctccataccaatggacaaattccagaactttccattagtggttttaaaatcaattcagtcatgcaaaatactattataagaaaaatacaggaggggatgcaaagaagagaaaagaggaaaaaagatgaataaaatgaaaggagaatacacaatataaaacgatttcacaaataccgagggaaatcatagaaatagttcagattttaatatattgaaaatatttcttactgtagattatagtaaaaaatgtttgaaagccgtggttggttttaaaggacaacttagactagaatggagcagagtgagatgtatttcagtagagaaaaaaaaccttaaaaatattgataattatttgggactaagaggaaacagaaaaacaatttattttcctcattaaagaataaaattatcacattcaaaatagtttctaaattaattgtgttttcatgtaattctctcatcttactattttattggcagtacttatatgcaatatacatttatgatatatttacattgtatttactttgaagcttctgtgaagaaattttctacataaattattttaaatgtgtcccaagaggggagtaaataaatatatataataaatatgtattgtctcaccaacatttaattgtgtatgggattaaaaacagcaaacaaaatgttttttttgccaataatcaaagtacaaattgaactgatatactttttgcctggtaactattaagattttgacatagttcaaatgttattcttgtgtttacattcaaaaaaaatttcaagtataattttattgtttattcgttaagttctgaggctactaaaaatatacttttgattggaatatagccctgtctttcaatgatgatagccatatagtcatcaatgcctatagattaaaaagttgattaaaatctactaaattataaagccagatctgtgaggatgaacctcttttttcttctttaggaatggcaagctcattgaagaaaatgagaagtacatattgaaagggagcaatacagaactcactgtcaggaacataatcaatagtgatggtggtccttatgtctgcagggccacaaataaggcaggagaagatgaaaagcaagctttcctccaagtctttggtaagtattatagcatagtggctaaaactgttatgtctattggaagatcagagtgaaattctactctaatcatttgaactatttaaactttccatattaaatctgtttcctcttctctgtaatatgttttttaaatttcagctaccagatagaattttttgaagaataacgtaaaattacatatgcaaatttttgtaagtcattgatatgcttacagaagctggaaaaaaataatttaaattacacctagtggggtttgtcatctgtgtctgtaagggtggatctctgtaagtctctaaatgacacatgttaggatcagttttacttacaatatagttcaaaagggcacatttttaaggctacaatttaaaaacattgacatgtaactatacttaaatatttgctttcatttaactaaatgaaaatataagataaatatcttccatatttaccaagagccatattatcttatttgggtaacttatagagcatataaaactagtactttacagaaatataatgacgtagcttcaattatgtttacaagaagaaagacagtgatggcagtgggtgcttctaatagaatttttccctttaattagtgtaacactaaaaaatatatgccctattaacatttaatatgttttctccaactttaaaaacactgttattgaaatgctttcacaacaaaaagagggaaaaggaaggaaggagaaatctgttagaataagaaggactggggcctgttgtggggtggggggagtggggagggatagcatttggagatatacctaatgttaaatgatgagtaactgggtgcagcacaccaacatggcacatgtatacatatgtaactaacctgcacgttgtgcacatgtaccctaaaaaagtataataaaaaaaaaaagaaggaccagtgtttgcagttgacaggtgcagagtgccccttacactgaccatgagatgaatggtaatccctgcgtggacacgccctctgcagactggccctgtagtcactgctggaagcattttctgagctagagagatatttataaagcttattttcaagtggagtgacaaggagaataaacagctataccaaaatgtattaaaataaaaaatacaattttaaaagtagagatgttttgagaaagaaattggataaatcaggaagcattgaataaagagaagtattgttttggatagcatagtgtttggaaagttattcagcaggataatgtttaggtgatgttcagaatgatgatcttctaatgatcagaagtaggccaagctaagagcctggagaagattgttcacttacagggaaaagtaaatatacttaacatttttagaaattatagaaagtccctaacttgttctagcagtgttccccacttgaaaatattttttctataaaacctacaaaattaaataagtatgattcagtataaaaataatcatattagaaatagtattgtgtgagattattccaaaggatagatggtcttaatctgcctcagtgtactcatctgaaatagtatttacatcgtttttatcaggattgcagtgaaaaagaaaaaagattttttacatttctgatattttcatcctttcaagtagaacataatacatgaaaattttacatgttatgttattgttataatcccttttgtgtagtaacattcaacaaacttttgttgctcctgacacaaaattgtatgcatattgtgggaatataactaaatctattaaagttaatgaaataaagagtgaattgttaaaaattctgtatgctgtttttctgataccaagaatgttattttctgagcttaagaacaacttatttgtgtttctttgttaaatgtattaaaatatataaaaagtaactcacactgaaataatgagtacttgattgtatccattttatatctaaacaagcaaacatttaggaaatacaaataacacagatttcaaaaaataaagctctctggaactatgtaagtttatggagggacatattttaatattaagataattaaaattagtagacataatgcttttctttttatacaattgatgattaaaaattagttacgttgtctagtatattgttaagtaaactgaagtcaaaataaatcaagtggaataatatatataagtaaagtaaatatatttacttagtaaatgtttcaaaattttatatgattctacttgctacattttcaggatatatcatttacttctttggtgaaattgttaaagcttaagagagaattaaaccaattgtgtgtgcatgtgtctgtataaatatattcatgtgtatgtatgtgtatatatacatatatgtgcacacatatgcacccatatgcatgtgcctttaaaggaagaaattttgattttgtggctttaagataggaaaataaatcatgagatgacttttaaattggcagaattttgaaacaaattataatttggatgttggtttctaagtcacctcaagttattttgtataatggtaacagatgagttttatttcctaaattttttttcctgtgctattcaactgtcctggtacgtctgtaaggcaaagcaggccactgtaattctacaaagctaataatatcatactatactatagtagacttaaacacccatcatgacttttgtctgagaagtaatattttcctccaataccggttgagtaatatatatattctttacagtacagcctcacataatacagcttaaaaatgaaactacatatgagaatggtcaagtcacactcgtatgtgatgcggaaggggagcctattccagaaatcacttggaaaagagctgtggatggcttcacgttcactgaaggcgataaggtaaccacatctcaatatgtaatggtttccattaccatgcaatttcagtattttcaatatcattaaatcacaaattagtctccaatttacctagtaacttgtaggatcaaataaatggtttgatttttaaaaaggtaactaacacaatgtcggctttaccactttcgtgggaggggaaatgtcaatatgaaatatttaaagatgttctttattaagtcacaaacgtttaggctattggtattactagcattgcttaactagacttttgttatacgttgaatctataaagtatgttattgcagttttaacccctgctgtgtgagtatctggcctttgcaaattcactgaccatgagaaaagtgctaggacaaataatattgccattttaaaaacaggaataaagatttacaaaccagtacatttaactttaaacctcagcaatttcagtttcttaaagaaatgattgtatatttagaaaacactgtggtgagtgatgagcgttgggattggcgaagaagatttacttcaaattaatttaatgtattttctacttagacaggtgtcaacaaactacagtccatagggcaaatttggcttccagcctgttttggtaaataaagctttattgaaactaaagcaaaagagtaatttaaattcaaaaaagtctgactgtcatccaatgctttaccctttagaaattgtctttctgcagtagaagtgtaggttctgctttcatataatttagaatctaatgtagagaaataggtacaaacaaattactgcattgtgatgacctttaaccagaatgcattcaacttacttagaaattaatgaaacattactatatgtttcactatactaatggattttaattactattatatttcacaacttttcatatgaacttcaaatacaaacaaaagagaaaggaaaagatggtgaaatattgaaatgatagaactggcaatttcacataagtgaagattataacattaggctattacattgcttttctctactcagtgttaaagagaaacctcctttaaacttttttcattattaactttatttaggtaaagagtccaatttctaaagtattcatacacctcaatataactttgatttattaacattgatagtaaaaaagagaagaataaatgtttgtccatagtacactttacatcaatcagtccatcccatcatgttatatttaacaacatgctaaacccataaattcaccaaaaaagtaacttctctggtcaatttattactttccttttgaaagactgtgttatcatatatgttacccttttttgtttcattttctcctcataatggcattttaagagattatttgataattgtactattttgatatacttattttatatattcaagttgaaaatcaaatttataaaatgtgaatgacagtcataatcttctgcaacccagataaaagttatagtttgctttagtatattcttaacaaaaaataatgtatgttactatgacacagttgccaaatctgaaaagaattaaatttatgtgaaattaaaaaaatacaatcgtatctgaaaccatagaggattgtttttgtttcaattttgcatgtttatttagattagatcactcaaaagtatttactttcatgcccttagactttatcataccttcatatttctaatgctgttttctaattatttttcagcttactgcaaaattcttaaaagttatcttctcaaagatagtttttactctgcatttaatgaatgttaccttatatattatgcagagaatgaaagataaattatactcagttatttcattaataaatgtcatcaagtaacaagaaagctgttatattttattcttggatctatgcctcaggccaccccaaactacacacagatacttattctgtagtaactgtgaaaaataatcttaaagcttttgtttcctaaggagtatattaaaaaacacatcttgttttaagaaaatctgacttggtttctttgcaataaacaattatagaaactcaaatatgcttttctgcacaagtttaatccagtcaataaagaaattaagtctattgtatttctattatatttctccaaatatattttaagatccttgacttatttttctatactccagtacacttcttttcccctaatatttctagtttcctgaatagcataattcacaaatcaaatggttgagctgaactttgaagtaaagtttatctagttttgaatctcagctctgccatttatgatgcctcagcatgataaaattgagttcaaagagtccaaataacattaccagtgttatttgaactctttttaatatgagtttttaatatgaattttttcatctttaaaatgttgatatttaccctcttgttataaggaagatgagcacattacaaatgcatatcaatgtttatcatattataaatatccaataaactttactttttaccttgccatattacaaatttacagtacaaatttacacattttactttgtcatattacaaatttacagtatggcctcacataatacagcttagaaatgaaattacatatgagaatggtcaagtcacgcttgaagcatagtttatcttgttgcctctgtaaagtataactaaggtttgattgaactttaatgagatcatattattcctatcatggaaagtagcatgggattgtactttccataagaatcacgtgggaagactatgaaaatgcagattctagattcccacttcttgaagttgatttagtatatgcagcccagggcataggaatgcatattaaataaactcatcagttggtgtcatattgttagtcttcaagccatattttgggaaacaacttcaagtaaggatgaaaattaacagctaatatttccaacagaaaaatgatcttaaccaattagttgacacctgatgggggcttgggaactataaaacaaaactaaactaaaatttccattatgcatgtatcagtcaagttttgatgaaactaaaatatatagatcaaaaatagtgaaatatcataaatgtcgtgtagtaaaaactaataatttcatctaacaacatggcaatgtatttagcaaatatgttcatcattttagatttttcagagaggagggtctcaattaacaatattcttttttttttttttgtctaagttctcaatcaccagataagacaaaaaaaatggggataaaataccatgtgacttaaatgtatagatgagtgaatgctcttatactgagctcaataattagataaacatactcaacacagtcccaagtagcatgagacttacagccctcccctgtgtgagaagacatgctaagataaccttgactgagggggacaatggtgaacccatgttctctttggggtggtcctttctgaaaagaaaaaaaggagtggttaggaagtgtatttaattttttgtgcccccatagttacctatcagatatctcttcacttcccatgggagaaaaagtaagggacttgaaaagtccaactgtggtatgttggaagaccttcctccccatggaataaatgattaagagttcacgagtagcattcactgcccaactaacaatatgctaataacatttaaatcaccatatacataactatctcagtttatcgtctggtattattactgcatagtaaatgaccccataatataatggcacaaaccaataattttctctcacttttgattttgtggatcagaagtttgagtaaggcttggccagatggatatcacttggaatctctaatgtgcttgtatcagatgttgctactaatgttgcttgtagttgtagttatgaggaggttcaactttgctgagaagccaacatggctcacttaagtggctggaattcagtcttgactgtgggctgcaagctcaggtggagctgtttttggaacatctatatgaagcctctccagtatggctatctaagagcagcctgctgtcttttgtggcggcaggctttctccacagagaacatttcagaagaatcaggccagacagacactatctggtctactctgacatagtcttggaagtcacacatttctcacttctgccacagtatattggttacaaacaaattataaggtcgcccaaatccaacatgagaggaattaggcactctgtcttgatggggaaggattcacaatcatattgtagataagtatgtggggtgggagatattgttaaggccatctttggaaatgcatctacaatttatctcaaaatattcccatgacttaagtccaatcattttcccaggcttgtagatgaggaaactgaggctcaggaaaattcaggggtttgcacaaggtcacacagggagtaagtggcagtggcaggatttgaactgtggtctctcactctgcatagtgcatgcccgtgcaagggcttcaggattctgttaaagtgtatggctggcactctcataggaatttaaattatatttccatttaatcaaataattgaaaagtcagaagaagctttgtttttaaaacttttttataatctgatattacttattttaaactaattaaaatatagtgttcagtaaacaccaaaactatttactggtttttgttaaaatacatatatgtaaaaaattacttcgtataatgggtactaccaaaatgtttgaaaacccatgccatataaaacaatctagaggtgtgggaggggagcaaaatggcagaatagaaggctccaccaattgtctccccaaccctgcaaggacaccaagttaacaactatctatacacatacacacacacacacacacacacacacacacacacacaatcttcatgagaaccgaaaatcaggtgaacagttgtagtacttggttttaacttcatattgctgaaagagtcactgaagtgatagaaaaaaatagtcctgaataaacaacaccaacaaacctccaccaccctcagcagccttgacatggtgtcgagagcttctctgggagctggaggagagagaacatagcaattttgaggcagtgaactcagtcctgacctgttagagcagaaaggaaaacaagacctaattcaactgacacccacccacagagggacaatttaaaccagccctagccagaaaggaatcaccgattccagcggtacaaacttgagtgcctgcaaacctcaccagtgaggaccaaagtgctctgtgtctcccagtaaacttgaaaaaacttatgaaactctaggccataaggactgcaactcttaggagagtcctagcgctgaactgggccaagagacagtggactggtgtcaggtggggaggaatgtgacatacagatacaccagctggggtggccaaaggagtgctgtcatcttccctcccctaaccccagcctgcacagcttgtggctccaaaagagacctctttattctgattgacgagaggaaaggaaagagtaaggaggacttggatactagctcagccacagcaagatagggcaactgttagagttgtgaggactttgttccatgtcttatctcccaaacggtgtttctataatagacaaactctgggccagatgagaacacactggctttcatgaaaggacccagtcctggcagcattcatcaatggctaactaaagagcccttgggccctgaataatccacagtgatacccaggtactacgtcaagggctttgataagcctctgatactttgctgggtccaaataatagcacagccatgggggtaaagcatgaagtggggtcgtagggtctgccaatccaggaccttactcttgcatgccatttctggacctgctgtgggtcactgtcctgaaatgtgattgcaggccaggcagcattcaccacaagctaacttaagagcacctcagcctcaggggaacattgttgtagtctagcagtactccttgtggtctggggtggtggtggctacagggtgaggctcctctgcctttggaaatgggagggaagagggggaagaactgaatcttgtggtctgagtgccagatcagccacagtaccatagaacaccaggtagacttctaaggttttagacctctagtctctgactcctagacagcacctctggacccacctggggcaagggggaccttgcttccctgaagggaaggatgcaggcctgactggctttgcctcctgctgattgtagagccctaaagccttgagcgagcataggcagtagccagggagaggttacaacaggccttaggtgagactctgtgctgtggtggcttgaggtctaaaacagcacagccatactgctgatggccacaggagtgcttgtgtcactcttctcccagctttatgcggtcagaaaatagagtgagactgtgtttgggagaaagtaagggaagagaacaagagtctctgcctggtaatacagataattttccccgaacttgtccaagactatcaaggcattacctctatgagtctgcaagaacctcaacattactgggctttgggtccctctaaagcaaatacaacttagatcacaatacccaaggtttttcaaatatctggaaagccttcctaagtaggatggatacaaataagcccaaacagtgaagaatgcaattaatacctaactctttaatacccagacactgaagaacatctactagcattaacaccatccgggaaagcatgacctcaccaaatgaactaaataagaccccagagaccaatcctagagaaatagaaatatgtgaactttcagacagagaattcaaaatagttgtgttgaggaaactaaaaaaaatcaagatgacacagagttggaattcataattctatcagatcaatctaacagagattgaaataattacaacgaatcaagtagaaattctggagctgaaaaatgcagcaggcatattgaagaatgcattagagtcctttaatagcagaattgttcaagcagaagaaatagtcagcttgaagacaagctacttgaaaatacacagaggagaaaaaaagaataaaaaaaatgaagcatgcctacaggatctagaaaatagcctcaaaatgaaaatcaagagttattgtccttaaaaaggagatagagaaagagataggtgtagaaagtttatgcaaagggataataggaacttcctaaacctagagaaaaatatcaatatctaaccgcaggaaagttatagaacacaaaagatttccctaaagaaggtactacatcaagggctttggtaagcctctgagacttgctgcgtccaaataatagcacaggcatttaatacctcaaggcatttaatactgaaactcccaatggtcaaggataaaaaagcaaaaaactaaatcatatcaccagagaaaatcaccctcactgaaggaagacaggaaggatagaaagaaggaagagaagaccacagaacaaccagaaaacaacaaaatggtagtagtaagtcctaacttatgaataataacattgaatataaatggactaaactctccaatcaaaagacatagactggctgaatggataacaaaaataagacccattgatctgttgcctacaagaaacatacttcatctataaagactcacatagactgaaaacaatattccatgccaactgaaaccaaaaaaaaaaaaaaaacaggagtcactatacttatgtcaaacaaaatagatttcaaaacaaaaactataagaaaagacaaagaaggttaatatataatgacaaatgtgtaaattcagcaggaggatataataatttaaatatatatgcacccaacatgggagaacccagatacataatggaaatattattagagctgaagagagaggtcccatcacaataatagctggagacttcaacacccaactttcagcattggacaaatgtttcagacagaaaatcaacaaagaaacttcagatgtaatctgcactatagatctaatggatctggtagatgtttatagaacatttcatccaatggctgcagaatacacattcttttcctcagcacatggatcattttcaaggatatattatatactatgttacaaagcaaatgttaaaatatttaaaaaattaatatcaagcatcctctctgaccacaatgcaacaaaactagaaattaataatgaggactttttgaaagtataaaaatacatggaaattaaagaatatgctcctgaatgaccagtgtgtcaatgaagaaattcagaaggaaatttaaaaacttcttgaaacaaatgataatggaagcacaaaatacaaaaacctatgggatatagcaaaagcagtagtaagagggaagtttatagctataggagcctccatcaaaaaaagaggaaaaacttcaaatatgcaatctaatgataaatcataaagaatggaaaagcaagagcaaaccaaacacaaaattagtagaagaaaataaataatggagaacagagcagaaataaatgaaattgaattaaaaaatacaaaaggccaatgaaacaataagttgctttattaaaaagttaaacaaaatttacaaagctttagacagactaagaaacaaagaagatacaagtaaatacagttataaatgaaaaaagagacattacaaccaatactgatgagcaactatatgccaataaattggaaaatctagaagaaatagacgaattcctatatacatacaacctacacataaacaaaatttaatgacatttttcacagaaatagaaaaaactttctaaaatttatatagaaccccaaaagactcagaatagccaaagctgtcctaagcaaaaagaacaaaactggacaaatcacattacctgacttcaaattatactacagagctatagtaaccaaaacagcatggtacaggaagaaatccaaaacctgaacagaccaacaacaagtaatgaggtgaaagccataataaaaatcctccataaagaaaagcttggaacctgatggcttcactgctgtattctaccaaacatttaaagaagagctaatcccagtcctactcaaactaattcaaaaaatagaggagaaaagaatatttccaagctcattctacaaggccagtattactttgatacctaaaacaaagacacataaaaaaagtatctgatgaatattgatgcaaaaatcctcagcaaaatactagcagccaaattcaacaacacattagacaaatcattcatcatgacaaagtgggatttttccttgggtcaacatataaaatcaatgtgatacatcatatcaacaaagtgaagcataaaaaccatatgatcatttcatttgatgctgaaagagcatttgataaaatttaacatccgttcatgataaaaacactcaaaaaactgggaatagaaggaatatatgtcaaaataatagaagccatatacgacagacctacagctagtgtcatactgaatgtggaaaaattgaaagtgtttcctctaagatctggaacactacaaggatgcctactgtcaccactgttattcaacttaataatcaaagtaccaactagaacaataagacaagagaaagatctaagtgacatccaaattggaaaggaagaagtcaaattatccttgtttttagatgacatggtcatatatttggaaaaacctagagacttcacaagaaaactgtcagaactgataaattcagtaaagttgcaagatacaaaatcaacatacaaaaatcagtagcatttttatatgtcagcagtgaagaatgtgaaaaataaaaaatatcccatttgcaatagctgcacatgaaattaaatacctaggaattaaccaaagaagtgaaatgtatctataatgaaaactttgtaaacactgatgaaaaaaatttaagaggacatcaagaaatggaaaaatattgtatgttcatggattggaagaatcaatatttttaaaatgtccatattacccaaagcaatctacagattcagtgcaatccctatcaaaatttaatgacatttttcacagaaatagaaaaaactttctaaaatttatatggaacacaaaagactcataatagccaaagcaaaaagaataaaactggacaaatcacattacctgacttcaaatgatactatagagctatattaaccaaaacatcatgatactggtgtacacacagatacatagacccatggaacagaatagagaacccaaaaacaaatccacacaactacagtgaacccattttcaacaaaagtgccaagaatatacaatagggaaaagacagtctgttcaataaatggcgctggggaaactggatatccatatgcagaagaacaaaacttgacccctgtctctcaccaaacacaaaaatccaatcaaaatggattaaagacttaaatctaagacctcaacttatgaatctactacaagaaatcattggggaaaatctccaggacattgacctgggcataattttttgagcaataccccacaagcacaggcaaccaaagcaaacgtagacaagtgggatcacatcaaattaaaagccttctgcacatcaaaggttacaatcaacaaagtgatgagataaccaacagaatgggagaaaatatttgtaaactacctgacaagggattaaccagaatatatatggagctcaaataattctatagaaaaaatataattatctaatcaaaaaatgggcaaaagatttgaatacacatttaccaaaagaagatacacaaatggcaaacagatatatgaaaaggtgctcaatgtcatggatcatcagataaatgcaaatgaaaactacaatgagatatcttctcactctgattaaaatggcttatatccagaaactatgcaataagaaatgctgacaaggacgtatagaaaagggaacctttgtacactctgagtggggaggtaaaatagtaaaatagcaatggagaacagtttggaggttcatctaaaaagctaaaagtctagctactctatgattcaacaatcccactcctgggcatatacccaaaagaaaggaaatcagtacaacaaagagatctctgcactcctatgtttgttgcagcactgttacaataactaagatttggaagcaacctaagtgtccatcaacagatgaaatggataaagaaaatatacacagttgggtactattcagccctaaaaagaatgagatccagtcatttgcaacagcatggatggaagtggagatcattgtgttaagtgaaataagccagcatagaaagataaacatcacatgttctcacttatttgtgggatctaaaaatcaaaacaattgaactcaaggacatagataatagaagaatggtaaccagatgatgggaagtatagtgaggtggggcgtggtaaggatggttaattggtaaaagaaatagaaagaatgaataagacctactatttgatagtccaacagggtgagtatagttaataccaacttaattgtacattttaaaataacttaaaaagtgtaattggattgtgactcaaaggataaatgcttgagggaatgaataccccattttcttgaagtgcttttttcacattgcatgcctgtatcaaaacatctcatgtaccccacaaatacatacacctactatgtaccccaaaacttaaaaatttaaaaattaaaaattaaaaaaaatctagaaacttaacactattctcactgtaaaataaatgattaagatagtaaataaatattttcagagttcatcttcaatgataatgggttaaagttttaataactgtaactcactaactacgatgtgttcctaattgtttttattttattattgggcacaattttatactacaatccaggacagcttcaaatagtgatagaattatattatttcacataaatgctactgggaaaaaaattatgccttttatatgaaatttctcatattctactggtttctgatgctaataacccttccttgctttgaggaagatattgaactgttgaactgtgcatatgaatacagcacaaaatagctttgcataatgtgatatccttcaaaaacaacagaattcacactggttaaaaacagagctattttaaactagtgactattgttatctgtcatccaaagcattttatgtacatgtaaaataatatatgcaatttttaaaactgttcagatcaatttcagatatacatataagcgtatctattttccttagaaatgttttctaatatctaggtcgggtgcggtggctcacgcctgtaatcctagcactttgggaggccgaggcaggtggatcacgaggtcaggagatggagaccatcatggctaacagggtgaaaccccgtctctagtaaaaatacaaaaaaaaaaaaaaaaaggagagaaaagaaaaaaaattagccaggcgtggtggcgggtgcctgtagtcccagctactccggaggctgaagcagaatggcgtgaacgcgggaggcggaggttgcagtgagctgagatcctgccactgcactccagcctgggagacagagagagcgagactctgtctcaaaaaaaaaaaaaaaaaaaaaaaaagaaacttttctaatatccaatataatttcaagataatttttctctattttattgagttagttgtcactaacttttaattattagtttattttaaatttctaggcaatttattttagtgataactcaaatattattggcgatatttccattaaaatataattgatgtacagtagtagggctatccaaaaataaatcaacagcttaaacttttcatagaaatttggcattttcttaagatgcacttgtgtttacaaattggaaaccctgacctctttatttaattaatgttgtgtacttaattgtaatatttaaatgtatataataaagcttaagacaaaccaaagctctttccacagaatatgaaatagccataagtcaaaattttgaattatcttgtacatactaagcaatatattgtttttattaaaaacttttctttattaaattaaaccatgctttttttcaaagccttgatctgagatatatgtgagattgtatgttcaaagtgttttaacataattttgtcacataacaaacacctactaaatattgccactttatataaacatctctcatctatttgttcatttgtttgtttctgttttgttttgttttgttttgttagacagagtctagctctgttgcccaagccagagtgcagtggcacgatctcggctcactggaacctctccctaccaggttccagtgattctcccgcctcagcctctggagttgctaggattacaggcacacgccatcacgcccggctaatttttttattattattactagagacagggtttcaccatataggccaggctggtcttgaatacctgacttcaggtgatcctcccacctcagcctcctcaaatgctgggattgcaggctctcatctgtttttgaatcaaagttgtttggttgttattgtttccttgtttttttgagaaagggtcttgctttgtcacacaggctggagtgcagaggtgcaatcacagctcattcaagcttcagccccccagtctcaagcatcctcccacctcagcctcctgagtagcaggactacaggcacatgccaccatgactagctaaatttttgtaggtttctattttactttattttatttggctgttgttgttggtggtggtggtggtggtgttttgtaaagacagggttttgtcatgttgttcaggatggtcatgaactcctggactcaagcagtccacctgcctcagactcccagagggctgggattacagacatgagccaccttgcctggctccaaatttatttagatcgtctcttattatcattcttcttgatcaataaatgttagtatacatagaaatcacagatattgatgaattataatgggaagtcatggaaagtgtcacacaattaaagcttaattctgactttcttgcttttggtgtgtcattgaccatgttagttctcatctctgatttcagtttctgcatgtacaaatcaagatataagacctacctgaaaaagggttctgaagatgaaatgagattacatgtaacaatatctcagacacaagcccaacaacttgaaagtgtttttctagttatacatttagaagaatgtataactagaaaaacactttcaagttgttgcacatgtaccctaaaacttaaagtataaaaaaaaaaagattagaaaattaaaaaaaaaaaaaaaagaaagtgtttttgtttttgtttttgttttgagacagggtctcactctgttgaccaggctggagtgcagtggcacgatcccagcccaccacaacttccgcttttcgggttcaagcaattttcctgcctcagcctcctgagtagctgggattacaggtgcccgccaccatgcccagataatttttgtatttttagtagagatggggtttcaccatgttaccatgttggccaggctggaaagtgttattttctattattcttggagttatcctgtcttcattccatattatacatactgttatgttgcaattacatttttcataaagaaaaatgaatatgttaactccgtttcaatgactgctgtcacacaagagactagataaaaatttttaaagcatagtcctatgtactttatgatggaataccatctaaaaaatgactgagtcttctacccttagttgtcagagattgtgcttccgtatagctacaaagtttactctaaaataatctctagcaatattaattcagtgattcatatatcaggttttaccacactaaattccagatcttgtgactgtatatcttattccttttggaagttgacaatgtcggaagtctgcatttggctcttgtcataaccaccttatgtttgccttcaatcgccatccatacaggcgagtgcacataaggtctctcacgtcctatgctagatgaagatagattctcaggccactcttaagtgatgaaggctagtctctacctatgaggcacaaaatcagaatagaaatatagatttcttatatcatcatctttttcttccctttctctcacatctgtcttgcctaactccttcaaatttttcctctgtgggaagtgagtcagttttttccttctttgggccattatacacctttcacattttatagcagtatatattgatttggaaaagattcttcaacattctaagaagtacctaaatagggcattaaggtaggaaaaaaagaacatattgtgctccacaaaacaagttattgaagaatgctttgttcttcatctatttttcaaactatgtttttatatcatatgataaaactgggtgtttttagaacatttgtctaaaaatgctatgttacttgtcaattttagtattaaattgaagtaaaaagttctaccgagggagtgattttgcctctagaattcttacaaaatgataaacataacagtaagtaattttatgtatatgaatataatgttttatatcataaatataaagtgcttattatatcatctagcagatgacatctcccttgtatcatttatcatctcttaagaaacagaatctataattactttattcctgttatacttctcctacgtagtatagacctacatccactagaaattaatcccactgtacattgaataagtatctgaaatgtacagcaataaattataactatcttaaggcagcatttctcaacttcagtcatttgataaccagcttcatctcttttctgtattcatgtgctgcctgaactgttacatgtcctctttcttctttaaattgaattgtttttatttattcttatctgtacccaaatgatcagtgaaattaaaagtatgatacatatgccagttatatttttaaatgcacattaaaattaatacaaaatatacagtacaattgtttttcaaaatattacctaacctcagcgtatccaccctcccccagtggttcacagatcacatttttagaaattctgcttttgtgtccaaacatattttgaattaatgtgatacaaaatttagctatgaaatattgagtgggacatgtttaaagatgttgtaattaggatagaacctgttttccatcctcctgtttgtgggtccatgcacttttctccagtaaataatatgcttcacttcactaatgggcactgagtttattcacaaatcattgtaaaagaaactcatttacttccagtccttagcactaaatgattcttttaggatgagaccaataaactgaataaataaaacagcgggataagctttaaaagcaatttcttcccttttttctgctaaagtgaaataataaaatgctggccttggtcttagcctagatcacctgcataatttgtaatcaaaatagtagtattttttgtgattttgcatttattgagaaaatgtgtctttctgtgttaaataaaataaactgattcaactttaatttttgtactgtgagtccagttttaccttctcttccttccaataaatagatgtattaaaactgaaatttaagattatttcgtgaccgggcatggtggctcaagcctgtaattccagcactttgggaggcttaggcacatggatcgcatgaggccaggagttcaagcccagcctggccaacatggcaaaaacccatctctccaaaaaatacaaaaaattagccgagcctggtggtgtgcacctgtagttccagctactcgggacggggccgggaaaagggggttgcagggggctgaggcaggagaatcacttgaacccaggaagcagaggttgcagggagccgaggtcctgccactgcactccagcctgagtgacagtgacagactgagactatgtctcaaaaaaaaaaaaaaaaggagagaaagaaagaaaagaaataagggagggagagagggaggagggagggagggagagagggagggacggaggaaagaaggaaggaaggaaggaaggaaaaagattatttatttgaattttattgctgttattattattattattatttaaggcggagtctcgctctgtcacccaggctggagcgcagtggcacgacctcggctcactgcaacctctgcctcccgagttcaaatgattctcctgacatagcctccggagtagctgggactacaggcgcgtgccaccacgcctggataatttttgtatgtttagtagagaccagcatgttggccaggctggtcttgaactcctgacctcaggtgatccacccacctcggcctcccaaagtactgggatcacaggcgtgaaccactgctcccggccttaattttaattcaaagtagggatagtcacctttaacaattaatttcgcatcaacacacacaaatacacataaattgtagttttaccaaagtggtccttgctgtttccgtagtgtagaaatagtatttcctccacgaatttagacacaatgatctgaagaatacatacttaaaatattttgcagactaaagtaccaattcaaaaggaatttctctcaggaataaagataggcagttccttaaatacaactacatgaataaaatatgatgcttttaaacttataacaatttaaatatctcaccacgtaaatatttcttacaacactgctgcattcattattatattattgttttattctcagttatattattctttattatatacttacaaatattttattgcaatttaatattgtcatttatggttcgcggttcctactgtggatttaagcaaactttatattttaaaaattatttatttaagccaggtttattggaagacagaaaacaatggagtgaacttttcacaatacaaaattcttagattatttttatttataaaatgtgaagattacattatattttttgtttctttttttattcttaagaaaatgtaacttctggaaaataaattttataaaatataagcagtgacttaatcagtcatagtaatttatgtaactaacatttcctttattactaaccccaattcacttaacaactatcaataaataatgaagacttttatattggcatgtgctaatctagacacaaggagtgtagcgctaaaaatataagtttcgccaggcacagtggctcacgcctgtaatcccagcactttgggaggccaaggaggctggatcatctgaggtcgggagttcgagacaaacgtggccaacatggagaaatcccatctctactaaaaatacaaaattagcagggcgtggtggcacatgcctgtaatcccagctactccgaaggctgaggcaggagaatcgcttgaatcccggaggcggaggttgcaggagccaagatcgcgccattgcactccagcctgggaaacaagagcgaaactccatcaataaataaataaataaataaataaataaataaataaatgtttcttgcttcatggtccatgcaatttaagaggggagatgaaactaaactacatttaaaattagtagtcattttttatgaatatacacttttgaaatatgcagttttcatatacaaaataccagttttgagtatacaagtgggctttcacaaggtcacaaatatagctttggcatatttctttacacttacacaggcccgttcaatgcgtatgcctcacagtcctctttttcagtgtattttgcaaactctatcaccaaaatatctcctcgtaatttgtttcaggctgacaaaaattacttagactttgattataaaaaatacaaaacttaaaaaatgtgtaacggtatacttaattggaagcatctttatattatagggggcattttaagattttgaacttccttttttcacctcaaatagaaatcaccaaaaggaaaccaacaaatccataattattgatttaaaatatggagcctgtagcatttcaaatatctgcacttttaaaaaaagctctggtgaaatgaaaaactaaaatataaaaaagtggcatatttatagcattgtctttaagattgaaagacagtatgtaagtcttttttttatacatccttgtgagtagttatacttctgggtaaattttttacaactttatttttattacttatatgaggaattttatttctacctttttaccaaaccctgaaggtgcattctgggatgcaattatagacaattcttagtgtttgattctaagacaaataaaaaaacaaataatacagaacaaaaagcgaagaacaaatgtcaaagagataagtttaatataaaaatcaaataaataaacttaataaaatactttagcaaataattgaaggaacaataatatgtttgttcagatattttagtcatacatacagccgaactagacacattgcttacttactgtgcatggtagtacatcaacagggttgtaattacgaaaacgcatagaatttgcaacagagattatagataatagcatgcattacattccaaacaagagaatgtctattcccttgaatttctctagcgtaatctgcaagatcatcaatgtctaagagaaaatattttcattcgatgtgatgttgccgtagaggatctcaaataatctatatttccctgatattctgtcttgtttaggatttagatctgtgagttagtattcagcgtagtgggactaactcacttttgtacgtaagaatcacataaggagctgtatacaagtaaacctgactgagcctcactccctaagatataactgcacctacctttcagatcttttgatacactaactttcagtggggattaaagagtttcattttgaaaatgtccagaaatggttcttgtgtatatgccctatagagatcctgtctttgaaattactttatttattctatcacagacacacacacatacactcaacacacaaaaatacacgcacatccactttcatgaaacatttgttacttagaaaaattattacggttttgatattaaatacaactacatatagaataagttacataaaacaaattagttcatatgactcatgtcttcctaatcatgatagttttggcattccaagtttatataaaatagagcttaatgaactagtattacgtggtagttttaacactgatttatctgctctgtgatagcaggtaaattgttataactttttctggtacaagtctaccatttataaataagtttccttcaatctgcaacatccccttattctgtaagtcttccagttggctcggtaaatattacaaatttttagatagtttttaattcatataaatttgatatttactaactttttagttgatgattttctaataacattgtatagtgagggagtgtttcttcaattttcttctgtttagctttccatataaatcaattagtaaggaaagccaaggttatttggataatgtctttaaattgaaaacaaaagtcaacttctgattgtagagaagaatgctgaacaacataccaccagttcctggcacctgtagattttcacgctgtgtgtgtgtttttcttttttcttttttcaacagagataatggacttttctgaaggattttttatttgaatgacattttaaagatctacctaatgcattttttcatactagtgccccaagagcaataatataagtccctgctgggcagtaggcaaaatggatacttctattccccatctgatgtaggtggtagaatataattaggcctgttagaaatcttccttgatgcttctgagcttgctgagaggtggattttcaatcatttacaactttctgaaatctttttctgtacacagcttgaataaagattttcagaaaagtctagtcatatgttgaaaatgtcattttaaaaattgtttttgaaataattctagataatatttttaaattgaatatgtctttttaaaagcatcatttactaatgaactattattttgaagtctataataagacctttcacttaaaaaaactgtcgtcagttttataagataatgtgatagtagtttacaattttatgatagttgtttgggggaaaatgttatttatatactaaaagtgattttaataaggctttgcagcaaaacatatattattttcttcttataaataccatattctacatacagaattcagttagcatttacatctgcttatgaagtagtcgactactacacttgaagaaaatataaaatcgtatcactataaagaagtctaaatatatcagtgaatattaatagacttaacaaaaacaacaaatttctagtaatgtaatttgagttaggtatgtggtattctagtgaataatgttaaattgtttaaacaacaagattaaataaatttgaatgaatgtatgtacagcaatgcattttggttcaatttttaaaaatatatagaaaaacaatttgaataaattatatacaagtaagtatagtatctatgaaaatatctgagcaaacattttaataaaaattgcagcaaaagaatacatttgatgaatttcattgttgagcttaagcatgcaacaaaaaccagtgcgtaagataatactgctttcacaataattaattaataagatggaatccattataacaaaaattgccttaacacagaagttgcaatggattcatttctcttgactcagggattgacataatacatttaaaaaagatatattcaatgaacatattcatttataagatcaaccgtatgtttagtagctgtgtttatagagggtgaaaaactcttaggtaagaatctttcttcgctatgatattatattgtcatgatctatctcttatgatagcatcaatgcttctgttttgtaatccacaaagtttttgtctgactatctaagtctttctttctcagaagttacatgatttttagattgacaataatatatctacttataagataatgtatttcatactctttcaaataagtacgaatagtaaaattctagtatgcataaatcctaccattttacccctggttcatagcgcttaccttgttcactcctttcaatcaccaacttatattttactgtctattacaataatcagtgcattatgtatatgccagtcttttttttttcgcttaaagaaacatttctggcaaaacacaagtcatggtttaatttacttttctcctctttctccacatgcagtagcacagctgaatatagctgaagaaaatcccacagtaattttaagtggtctgtatttaaaattatgttccagaacataacgtaaattctttctgctgcctagaactcatcctaccttttcttggttcattttcttgaccactgttttagataactacttcataaatttttatctattctcaaatttacaaaactcctctatcatcaaaaagctcagctgatgattcacttcctcttttactaattagttggaaacagaagaaaatcttaataaatcctgactactacacctgcaaacatacccagtggaacctgtatgttaccatgaatgaaatatctgagttttcatgtggagtctggatttcatccactctaacatcagtccagtaattcatctccctatatataatcatacctcattgatcattaccataacttttaaagctattcttatttctcttgatacacacacacacacaaacacatacacatccttcatacgtatgtgtatatttatgtgtgtgcctgttcttccaattatctcttgaacatactccagttagattttaccactccactgaaactctctggcaagcttaccaataaccttcactttatgaaacctaatggttgacctagttaaacaacctcttctgtttgtaccatgttttttttggcttctagtgaactctcttggtttttttcttactatgctgttcacttcctcaatctcttttgatcattctttgtcttctaattgacatctaaataattgggcaccctagtctgccattttttcttggatttctctaatgatgctgagtccttggtgatttcatctagtcttacggctttaatgatcaattggattctgtaatctccaaatttcaactgtggacctctctactgaactccagtcttctatgtccaatgacttaccagacagcttcacttggatattaaataaatctttcaaagttaaaatattcagttcaatactgtacttctttttccccttgatttgcttctccctcaatcatcccattctcattaagtggtgtctttttctgtttaggaaaatgcttgaaaacatctttggcttttatttatttttattctggctagaaatacattttttaactgttacttttggttcagacatacacgtacaggtttgttatataggtaaattgtacattgtggggtattgaagcacagattatagaaattcatatttttagcaaattttattagccctactttaaatatatccataattcaattacttttcaacaaccagctgttactgccttggccgaaaccattgttacttgcctgcgttatttcagtaacttttttttttttggatgggttacagaccagcgtttgctttatttgaacagagtttgaacacaacagtgagttcttaatgcatccacccttgtgcctgttattttcattaaaatggttagattgattcacctgaaacaagccatataatataaatgttctgttcaaaagcctttaatagtctcatataatttggaattctctgctcttatttaatggctttacatgatagaccacttttccatttgctgtgacaacctgcttttcctcatattctacttttttttttttttaaacctgaaacagggtcttgctctttcacccaggctgagtacagtgctgcaatcaaggctcacggaagccttgaactcctgggtcaaccaatcctcccacctcagccttctgggtagctgggactacaggcacatgccaccatgcccagcttatcctactcttaagatcaattaatgaatcaatgaaatttcatgtttcctccataaatcctagggcattgcaaactcttcagtggtaatttatccatttagaagactgcaaattgcaagtcttaaattcagtaaaaactatttcaaaactttaatatgcttactgaagtttctaattattttttgtattttctgagagagtgcttgaactgtcaaactgaaatctatatgatagactattgatttttaacaggtaataactatgaatatgtttaggttaattgttggattctttagataaaaactaaggataaagttcagtccactgtcattcaacttacaaaatgaaaagtcaatgtacatgacacactatagttgattttctatatggatatttgcatttaattccgaagttcactatacccagtagagtgacaagagctttgataatactggaaccaaaatttaaaacaaaacacaaatttatattaaatttttagtagcatattcattgataaacatatgaataaatagatgtaatttttgattgattagtgaataatttgtttataaactagaatctcttttggggccaaatgatagagaaagtgataattaacatatcatacacaagtttatagaagcaagagattaaagagcaatgaaactgcatgcttttattgtgtgtattatagagaacattttggagatttattgtgacataactacctctttctatgttactggaaacatggctagctttgtttagatcagcatcataagttgtcatattgcagatattaccactaggtagaatactttttaaatacccactcatacaatttgcctcaattttccctgtactataaatactcaacacttttcatacctgcatatcccaacacagtattacaagctggaaaaaggctgtttctcatcatttttatatcttagcaaagatacatataattttctagaccatttctgcttcgtgggtctttagctcccctgtcaccagacttacctttaatgaaaatatccatagtgttttattaatcatctggtgattgatatacgttaaagattcatcacagtctgacacatgattttctttgattttttatagaaaaggtatcatatagaaaatatactattcctggtactgttttaattattttttttacaaaatccatactctatcaatggtttatggttgttgcagcattgtatattttatcccacactgggaaggtgttttgataagactcctgattttgcttaaaaagcgtaacattttatcaacatttccaactctgtttctcctatacattattttatcttaataacttctgttagatcctctctgaagagtttcttctcttttaattgaaggcttctaacaatcacaaaaagcttgatttgtatatagagtgtttgtataaattacctgttcttcatggagggttgctttacactaagacaacaaaaagcaaaatcaaaactgaaaagcaactcagtggagttcatctatttgttttccacacttttagtttttagccactcatctcttagagataggttgtttctatgtctctataacaaaaataatttgatgaaattgcggttttcagattttaatttttttagtattttgatgtttctttcatgttctgtataaaatatttccaataaatataggcatatttatttaaatataaatctgttatcaattatacatgagttaacaagacagcctgaggatcattcaaagctcacaatatagatatattttacccttcttgaacttctcacccaatgtgtagttataaggcatcatgacaaataatgcatatgaatcattcagcatgtctccatattcaaaataaaacatatatttgctataataatatcagcacatacaacagtaattatacatatagactatataagatttcttatacatctaatgacataggtatgttaacatgtatttagcataatgtgattgtttaaaaagaaaatgtatgtgtagcctgtatatatacatatatacacatgtatatacatgtatatgtatacgtatacataaatatgtacatatacatatacacatacatctatatatgtatatattgccagatacttttaattttatggtatcagtccaataaaattaatactttgaataaggatgtgttctataacataagaaatctcatattggtgacaaaatgtggtcactagatgtcactgacattaactatggaactagtgacaatttaaaatactttttagaacttccataatggatgaagtggggcctgatttgcacaatgaacttaaaaatcctcagcaacaacaaaacaaaatgtacaatgtgatgggcagcacattgatccccaagagaagagaagcatgtgatgtaagctccattattgctcaagcctactgcctggagagagatttcaggcgggagcacagggatgaatgcttcaattgttttccctgttaggagacagtgttctgagtttgggtgacaacgtgtgctggaattctcacagtggggtagctgaaagggcagagccctgtggagatgacagaatttcacacacacacagagaaatacctccggagatcttcagtgctttccgttggagatttgagctaattattgcttagtgcgtgtgtgtgtgtgtgtgtgtgtgtgtgtgtgtgtaaaaacaatgcaaggccttggaaagaatcattggaatgctagaactgttgctttggttgtgtggccaaaatagccctaaactaaaagttgttcccaactcacctaacaaagcttcaaagcaaacctcaaaggaataaaattgttttcaagtaacttaatgtctcagaagagagactggacatacataaaggaatacaaaacatatagcactcaaaatatatcagttacaatgtctggcataaaattaaaaaaatcgtggcatatgcaaggtgaaaaaaataacccataataagaaaaaacagaaacagtatcaatagaaacataccatcgatgacatacatgatggtagtaggcgagaacactacccgatcaattgttttaatgggccctgcatatgtatttagaagatacagaaaagcacaagcacaacaaggagagatgccgatgatataaaacagctcaaataaaaattgtatatattgaaaaaacaacattttcaatactgaaaatgaccttggacgggattagtagcatagtggatactgcagaaaatgactagcaaaatcaagacatagcaccataatctatccaaaggttaagtgctatgatttccttttgggggagtaggtacccagtagtgggattgctgtctcgattgatatatttagttctttgaaaaagctttgtactgtttcccgttttaggcaggaaaaaggtgaatatatcctttgacctgaactgtgtcttttccatgctgtgagtatggggtggacaaaggctcagaatgggacttttatttgttctggtagatagagcaagaagcatagagaagaatgttcccaaaatattctgagtttcttcatagtgtatttactgtatttttccactttgggagatttacgtaaaaacatactaaaggacaagcgcaatgactatagttaacatttgtttaatagttattatacgtcacatattgttacaagcatatcatatgatattgtagcatctcctgtaggatattgtgcttcttgcttaaaaaaacaacctctcatttgtctgtaatttgaactagattaactatactgcttaggcactgggtactaattatatcactgattttaacaatatttatcatgtacctagcatggagcctgcctaatcttatttaattctcaccagatgtggattaaagcaaccagcactaaatgagtgcattagtccacttgtgctgtcataattcttcagtaaaatgtcatcaaaatctcagtagctttcaatacaaaagtctgtaggtctcttttaagtatgctatagcagcatgctctagacctgagtctggtttctgatctgctccacatattctcttaattcaggaaacagcctgcagggaaaatcccatctggggtgtgatgtttgaaaatttccatgataaaatacaaaatgtaattttacaagaagacaagtactagagaatagtgtcatcaaatcccatgtatatgtcacccagcttcaatagttatcaatacttttcccttccaattcacacgttttaagtatcacactttatctgttttccagtagggaattttgactttgtattagataccaaaacattttaaattttcgattttaaaatagttgatccatatgatgtatgactccctcaaaaccttgaaacaatgcagtcaatacttactaatgactagttgtatgacttgagagcagtgtggtttaataacatggtatcgctgttcacagggtgaattcaattatgtggcatacattatcaccatatctctgaccatattataacgcatttttaaaaggaagagcttcataatataatttggctcattctttcagatttctctttgcggttttcatagttttgtgacatgaaagtaaattttacaagatgtacattttagatctgactatcttcttggcttctttatctattggtgattttttttatagatttagggggtacaactaaagttttgttacatcgatatattacatgctggtgaaatctgggcttttatattcaccatcatcctgataatgtaccttgacaaggagttatgtgaaatgttttattatttattatagcagttgtctcctcctatagtagttatttgtcctaattgtattttgtcttttactaaatatattatgtattggccatggaaaaatactataaattatttgcacgtggttcatgggatcaagagaaaagtctagcagcaaaataaactgtcaattaaatagagtatgggaaagttattattttactttgagatggaatatatgtagaatgcttttggaaatcacaatgaaatagatgggtgtatgaaactcatatttattgcttagatctgcatatcagtagctttagccaatttattatgtactttacagatgctaaactccaaatattcactcatttaatctgcataggtatcctttgaaatctgtattcttatcatacccattatacagaaaagcaaactgaggtaccactaagtaaagtagttaatctcaggctttagagattataggtgccacagccaggatgtaagcctatccattctggttctgcaatttatggtcctaactattatattacattaaagtaggtaggatgcctgtgcaataatataaatactcaggtcatgttttgaaaaccagcattttgacaactgtctgttggaacccacctagtctctagtctcatgttttaaatttaaaaataataatctctaaaaggtttattctacttaaagctttattatcataatattttaattttaaatattatttttaaagtattgaatatgaaatacggaatagactttatacatgtattaaaatatgggtacttattttaaaatataaatgtatacagccatagtataattttatgtagaggtaacaatctactaatgtagataacattttatacctaaagggtctgtgacagaatgcaagaaatatttcttttctcttttctttcatcaacactttctcatttggtcatttactaaaaacactttcacttccaccttaatatatttctggaatccactcactcttttccattttcactaccattacctttcccagcatgtcatcagtgtaataatgtatttccagttgttctccctcccccaccatcttagtctgttcacgctgctataacaaaatactgtaaagtggcttataaacaacagaaatttatttctcacagttctagagactgggaagtccaaaatcaaggtgctagcaggatggatttgaggtgtgctgagggctcactttgtcaaagatgctgttttcttcttgtgttcttatatggtgcatgggactagctagctttctgtgggctcttttattgggcactaattctaataacaagggctttaccatcatgatctaatcaactcccaaaggcccaacctccaaaaataccagcacagtggggcttaggatttcaacatatgaactttgaggggacccaaacattcagaccatagcaccctctctaatttactttttttcctgcagtgtgagtgatctttttaaatcacaagtgcatctactttattcctctgcctaaaacctatcctgtccatttccaattgttcgtaaaacacccaataaccttcaactgatatttaccttttcacagtgttatttatgtataagtcacatagcaaacaattcacccattaaactgtgcaattaaaagccttttttcctagagttgtgcaatcataaacacaatcaattttggatcatttgatcacttcttttggtcatcaccccccaatctcctcaccaccacctcccattcccttgcctgccctaagcaaacattattctactttttgtatctatagatttgcctattctggaaatttcaaagaaattgaattattcaatactagtcctttgttatcagctttttcctcttactgtaacattttcatgattcatccatgttgaagcatgtgtgagtacttcattttggtttttctttggccaaataatattcctttgtatgtttataccacttgtttttttcaatccatgcaccagtaaataggcatttcagttgttttcactttttgacattattaataatgctgtcattagcatttatgtacaagtttttgtgtggacatatatcttcatttctctttggaatgtaattacaattctctgtttaacatttggaggaactgtcaaacattttatacaaaacatctgcaccattttacattcccactcacagggcatgagggtgccaatttcttcacatcctggccaacatgtgttactatctgactttttcatggtagccactccaatgaatgctaagtggtatcatgattttgatttaaatgtccttgatggctagtgagtttcagcatcttctcatgatcttattggtctttcttttgcttgggtacttcttattgtagtcttgtttatttctctaactctttcatatcttaccccttcaacctcatatttaatttgatagttccagtgagcccctttaaactctttcaacacagctttttttttcctcaagttcaagcccacacagttaccatttttttcctacttttcttacttttttattggtgagggctgactttgtaggggtacaactcatgcaactgcacagattctgcactctttaacgaccccaagtttgagctaatatgctgcagtcatcgtcatcttggcattttaatagtttttaaatagaaactcccacattaaattttgcaattgccccctaaaattacatagccagtacagttcctgacttatcattttgacttgtccttccgttttggcataaatacctacgagaaactcttcctcacctttgtctaccaaattaggtttcctttctgaatgtcatctatatcagcatgcattataatttgtcattttttcctctgatccttatgacctgagagaccaagggctttgctttcttacccatttttctttttttatatgtaaaagtaaacgtgctaatttattcccattaaagcatcaaaaataaatgttttgtgtctaatttttgaaaccaaatattgtacatgccatcaaatgtttcaaacatcttattggcatgttttggtgtttgaaatcctcatttaaaattgaataacatattttaaaaacaaaaattagaaaaatcactaatgaaataaacacatttagtaggtaaaaatgcccacttttcaatttgagtgaatgcatttttctagccccagaacccagcaaagtgtctattacatagctgcggtacatacatagttcaaactcatagttgctactcaggtggtaaatcatatatcaaaaataatcaaacatgaactccagggctagacaacctggtcattcagctgctaaagcttataagctgtgggatgtgggctagttattgaatatttttcaatttcctcatcttaaaatggaaatactagcctcagcctcatagtgatgtcatggagattaaatacactagtaaatgtaaagctttttggatgttgtctaacaagtataatttatcatatgtatgtattgccttttataattattacattcaattcctatttgttgaataaattttttattttattatcaaagaaaagagaaagacaggaggacctaataagaaaactacctaagtgaagaactttgattgcatgtatttatctttctgacatcatttacactgctgggtgaaatggtaattatacaagaggtcagctcatgaaattgaaataagaggaagattagaaagctaggagcaaatccagaggaaagaacattattgctaatagtaaagagaagaaacttacagggagggaaaacagtatttctgtttaaaattcttagtatgactgtagaaactggtggatttgatacattaaaacagttttgagaaggtagtttggataaattaattctaataacctttggagagtgttggtttttctgtctacatatttagcagttatgcattgtctttacctcagagtatttgaagttgagtttacttactcgatagagaaataatgccattaggaatgaggcaaacagaatacctatagaaggcatccacaatggggtgcatattcttttgtgtatctgcattgatcttgcattctgcctatggtccctatttacctgtccatcatcaggagaaccacatgaccccactgtcttctgtgcgtattcttgcttctctcatatctttcttatgtcctcttagggcatctgcctggaattcttccctcaacaccacccttctttcactatttacagatcacaatccacactttggtttgtcaggaaacatacctaccccattcctccacttactcctagaaagatatagtttgcctacctggtgcttttcacatttatttgaattgtactgtaaaattagtatctatcttgtttgtttaactttaatgccaccaagggtagaaactattacagtttgctcagcactgcatcgcagtgcctggttgcttattgtaaaataaatgcgcgtgcacacacacacacacacacacacacacgctctgacacaaaataattgttgaatggttaagtgagatgatccatcaatctcccaaaaggccaaaggatttaatgactctaaaagtgttccatgacacagtagaaagaatagaaagttttggaatactggccacctcaaatgtgctgtgaactctaattggattctaaatttgacaataaacgtctagtcaggtgaggccacaaaaaataacctataaataatgacacattatataatttcaattgtttgacaattaaaattgtcaacaaaaacttttagttgcaaataaactcaagaagtggttatcacatggatatttgattaagggatttttgaaaggacaataaactctaaaaataaccatattataaaaatattgaaataccatttaaataagcaattcttaaactgaccttctagaagggcaaagaacataacatcaaatcaaatttcagagagtgcgtttttgtaaaggatggaataataatgtacagtcagacactttgttttctaatcatcttacttaattcagtgatagaacctggaaatactagatagacagcaaaaatgctcattaacctgtctcaatcaaatatcagatgtcttaaatgaatctttagtaggtgttgaatcagagccaagatataaatgaattttctttcagatatttgtaatgcgtttctgtagcacaaagagacatgtcctttagaatgtcagaaacgaaaatagaaaatgaccttggacttttagtgcaagtatttgactcaaatgcatattgtgcatcattacagagccagtgatgaacctgagaatggcttctaactttcctaggaatcacacacttgggcacagtgtctgtttttccagaatttatgttaataatttcaggtatattgataataacttttaaatgcaaacatttttactaataacatctatatacaccaatagtttttcacaagtcaaagccatgtcatgtataacaggtaattacaagagaacatgtttattttcaagcgaagatcatgtaactttaaaatttacttttcaatactgtgaaataattacgtttcctttataaaaatgaataatttgctttgcattattaataatgtattttgttgttatattccaataaagttaattaagtacaagtgcttaactcatagtaaataatagctgaaggagtacattttctttactcaactgcatgtaaatttcactataacataatttgctttctaaaaatattagaatatactgtttctgtcctagaaatttaagtgacttttacgtgaagtaccataaatattttcttacatttgttcaactatactatcacactatgggatgaaatctgaagttccagcaagactttagtaaaagcaacttattccaagaaaattatgtagttcaaataagtcataattatttaggcaatcaggaactatttttaatacaatatgaaattttgccagtaacttaaaggatagaaagtaggatgttgccatgtaaatatagagagaaaaaaaggggaaaagtgtaaaacacgtctgtgaagagtgtttattcaaagcacaggatattgtggagagtacaagtaattcaaaataattggaattgacggtatccaaattgtaaagtgtgcttggacagaaaggtgataccacatgagagatctttaaacatcaggctgagtgattgggttttgtttggagtcattgaaatgctttttatcattatacagccagggtacaggaaaccttcatgaagctatgagaatgtaaaaagtgtgctttttaaaaaaaacttattcttagctatacaagaaatactttctacatcaggaacagtttcttttttctttttgccagagaaacatgggaagtaacataatgttatatgtttggtcaccattttgcacacacaagcataaaatctttctttttcctgaatcgatgtaaacagagcctggacggccgtatcgaagtcaaagggcagcatggaagctcatcactgcatattaaagatgtgaagttgtcagattcagggagatatgactgtgaagctgcaagcagaattggagggcatcaaaagagcatgtaccttgatattgaatgtaagttactttcctttgtattttcattaaaataactttgcatgctttgaaacatatgatttttcaataaagaccaaaatatatatgtagttcacatttcagtacttaatgcatagctttagaggaaatataggaatcattcagtcagttattggagacatctagtggaaattacaggatatttcacagtgctgtatatttcatcattttgatattgcttttcctgaaaatggtctttctttttttgcaacattgaactcaaaacacagtatcaactgaaaaatattaattatcagtaattggtcgatatcactttagattttttatttctttataatatttatgattatgtctcaaatatgtagtgtttacatttcttattcaaattgttttgttaggctattttacattttcataaactataaagagtattttaaatgcagtgaaatgtactaatatgctgtcttatcaaaatagtgtttattttctgtctggaagaaaggagcatgacaaggatagtttttaaaataaatttaaaaatgtacataaccacgtgagttttgggaaatgggagggctaatgtaagtcaagctttcacaaaaccctctggcactgatggatttaaaaataatttgtatacatgctatttaaaaaggagaacttaacatcattctcaataaatatttatgaagcatcaatattggagagctctgatgcttgaaaggacatagctgttcttagtggatgtatgagatattcttattgccaaaatatttctattggagcatgtctagtacattaatattgatagaatgcaatggtaactgtgaaacaagatgcattctcttatcgagaatgccttcaaaaagaaaatattttctcaagaatagacataagttatccatattattttacattttatagactgtgcttgtcaagaaattcatggaaagaccaatcagaaacttctaaaagaaaaaaggactgttgtggggttgggggagaggggagggatagcattaggagatatacctaatgctaaatgaggagttactgggtgcagcacaccagcatggcacatgtatacatatgtaactaacctgcacattgtgcacatgtaccctaaaacttaaagtataataataataaaaaggaaagaaattcccataataggataaaaagaaaacaaaaacaaaaacaaaaaaaaaaacacccactgatatatttgttaaactatacaattcctggatctgtaacaacctttttaaaactattcatacagttgttggaatttactaaacttcgtaactaaaagaaaaaaaaagaaaaaaggattatgaaaggcagtcaacaataaaaggcaacttgattctgacacaaattactgacttcatttgctgatattaggcagcttctaagaaagccactttatttccatcacactttctaaaaaaataaaaatggaaagcattgataatattgagaacacacaaaggaggaagtgatgccaataacttacttaacctttttcccttaataattttttctacttttttccattattacagtatatttctttttcagaccaacaacatcattagcaaattataaatactttacacttttacagtacatttgttatatttttaattaaaatttgtttatttaaaccaaaatttactttatgattttttttaatttttctaaatgtgaatctaaatgaagaaaaaaaaaacttaagcatgccaagatatgatttatatgagacctcctggcctcttccactgtcctacaaaagtgctaggctgctaggcaacatattatcttaatgaaactatatttaggacttttattctttgcatttcattaatattttaaaacatttgctgtatcataggattagtactaaatgtctgttgcaggtcctcagaaaagtggagtttatgagaaatgaacactatggatatttccaaagcacagtaaggcagagtggctcgtacaagatatgctagtattagaataataggactagctaatatgttaattaatagtgtgttatgtgtccctgagtcctcaatttccttagttataagataagagggtttaaagaagagactgttgggacctatttatactcaagcatttaaagatacttttattcaagcgtatccacattctccagagatgccctgggatttctgaattattgtccatgcatgacagcataggtatttgtgtgaaacaaatgaaaaccgaaattaagattataattcatatatgtttatgttgtaaaacctcactgaaaatagttttaaaaaccatactaggtccaccttaagcttcaggttttgtgctgagtgataatggacacaaagatgaataaaacatagctcctcctttattagaagtctaccatcaacaggagtttaaattaaaccgcagcatgtattcagatttcaaagtgagaatgaataaaatatcaaattaatgtaaaatgctaatacataattacatgagatttttagttattggttttagctgggtagaaaataatgggataaacaaacaactgtatattgcaatttgaattatttgctcttgtaatctattaataccatgaattaataactttaatacgaaaaaagtacattgggtactttatttttcaaggactgatttctaacaaagtacaagttgcttttgatcacattgcattccttctttataagtttaaatattggtttatgtttctgcttaattattccaaggtaaatgtgcagacttaagctcaccagaaaattatgtagtttagtttatcttatttaaacagggatgaaaggtcttgttttctaaaaggatgttttgagaattatttgagtatcccctgagattattattgccgccatcttgattagagggtagctagattaatatacattgaaaaaaattttcttactattaaactatcatgtaaatataactactttttgttttccctaagcattgattatttttctgcaaatattgttgaaaatgagttgaatggctcttataacacttgatcatttttcctttttttccaaaatgaaacattcaaatttattctacttgagtggggataattagaaaaataaatatcatctcttgttaagacattattcaaatatatttaagtacaataaaagcccatatataatgtaaaatatgagttttgacctatgtatacaccactaaatctataataatcatcaagataaacatttacatcaccctcaagaattttctcaagtcactttaaaatctatccctcctttttacaactatccctaggcatccatttatctacttttgatcactacaatttagtttacatttacatgtaagaatgtatatacatagagtcatgcagtattatttttaatttactttattatctttgaaatgtacttatttacttttatttagttatagttgacaaataaaaattgtatatatttaaggtgtacaaatgtgatgcttttaaaaatttatcattagtattatttttgattggccaacaataattgtatccatttatggggtacaatgtaatttttgttgtatgtatatagtgttaaatgattcagttaagctcattaacatgtccattacctcacctaccttttttatggtgagacatttaaaatttactcttagttactttgaaaagcacattattgactgtagtgatccagctatgcaataactctcaaaacctatttctcctgtctatctgcctgtctaccctttgatcaataactccccatttccttccttcccatgcacccaccccagcctctgctgacatcattttactctgtttctgtgagttaaactttataagcttccacagttaaggaagattatgaggtagttgtctttttgtgtttggcttatttaactgaacaccagtgtcctctagattcatccatgttgtgcaaatgacaagatttatcattttttaaatgctcaatagtattccactgtgtatctataccacatttcctttatcctttcattcattggtggacatttaggttgattccatatctaggctgttgtgaataatactgtcatgaacatgggactgcagatacctctaccaggtacagacttttttttttttcctttgggtataaacccagacaaaggattcctgaattataaggtggctctcattttctttttgggaggaacttttataccactttctatgatggccatgccaatttacattcccaacaagtgttcctttttatctacttcctcttcagtacttgttattgttcatctctttgaataaagccattctaatgaagtgatttttcactctggttttaatttgcattcccctaatgattagtgatgctgagcacttttttaggtacttgttggccatttgtatgtcttcttttgagaaatatcaattaaagataatttgcccattttaaaatcaggttgttttcttgatattgatttgcttgagttatttgtatattttgaatattaaccctctatcagatgtgtggtttgcaaatattttctcacattatttgaattgtctctgctgagctttcacagctggcatacattcgcatgtatatgtgtgcatcaataatttatactacttgttcctgttattacatcctacagatataacagagtttgtttatctagtacctattgatggacattttacgtgtttttagttattgactactatgacaaaaaacttctgcaaagatttttgcagattgtgtggatatataaatactattctctggaataaacatttttgtttgatttcttcaggtaaatttttcaaaagcaaagaattataattttgctgtcgtctagtttattaaatttatcaaactggacttttacatgttatacggttcgtgttttttctgaaaaaatattacctaatttaaggccatgacaatttatgtctaagctttctttttaaagttttgtagattttggttttaccttagggctgttattaattttgagttcatttttgtggagtaggtgttcattatttttccatgtttatttctagttgatcaagcactagttaatagaaaggacttttctttttctagctaagagtttgacaaagttgttgatcttttcagagtgttagctttccattttgttaattcatattttctataatatgtctgttttccagtttgatgattctggctttatcttcattatttcctttcttctatgtattttgaattcaccatgcacttagttgtagattttttaggtggaatcttagtatatgtattttagataattcttattttctaatagaatcacataactccagattttcactaagcagtgctttaacggaaccccccaatattgtagtatgttgcatttttgttgtgattcagctaaaaatataattttccatttgatttcaactttggctcatagttatgtacaagaatctgtttaactttcagatatttggatttttccttgatattttgctgttattgatttctaatttagttcagttgtgctcagaaaaccctgtattttttatttttatatgtataaagattttatttatatcccaccatattaactattttggtgaatagacgattttacttgaaaagcacatatattctgtagttgttattgtgttttaatgtcagttagatcaaggtaaattatggtatttgcactcatcaggattccttagagggacagaataagatatatatgtatatatatatatgagtttattaaagagtattaactcactccatcacaaggtgccacaataagccatctgcagcctgaggaccaagaaacccagtccgagtcccatagctgaagaacttgtccaatgttcgaggacaggaggcatccagcatggaagaaagatgtaggctgggcggctaggccagtctagtcttttcacgtttttctgcctgctttatattctggccatgttggcagctgattagatggtgcccacccagattaagggtgggtctgccttttccagtccactgactcaaatgttaatctcctttggcaacaccctggcagatacacccaagagcaatactttgcatccttcaatccagtcaagttgaccttcagtattaaccatcacagtattgtttaaaacttctatccttactgaatttttattatagctgtttgatcacattaagaggtattaaaatcttctaccatgactgtgaactattttttctctcttttctttgcattatgtattttgaggcttacaatgagacacataaacatttatactttgtgtgttgtgttactttcctgttgctgctgtaatcaattacaaaagacttagttgtataataaaacaaatttattgtcttaaccattttggaagtcagaggtctgaaatgattctcactgggctaaaatcatgtgtgggtcgggctgtgttcccttgtggaagctccagaaggattctgttttcttgttttttttttcagcttctctgaggctgcccacattccttgcctcatggattccttcctttctcagagcctgcaatggcagatctagtctttctcacatcatatcactctgactcttttttcttcttcacaagtccatctctgtctcaaactttccttgcaattaattgcatccacttggataattcaagataactttctcatgtcaacatctttaccttggtcgcagctggtaatgtgtttgcagtttccgaaggtaaaggtgtcagtatctttgggaggtcgttattctccctcccgtttgtgtctttatgaatatcccctttcatcagaattaaatacctctctttttctctgctgatctctcacttgacatatcttagctaataatcaaatatctacgctagccctcttatgctttttgtttgtataacactttccattcatttacttttaacctgtctgcatttttatgtgaaattaaaatgtgtctttttaggcagcatatgatagaatattgctttctcattgactgtaaatctccttataattggagtgtttaacaagcagtcagtaattaacagggtcagggaataaatattttactttttctgggctacatacagtctctgccatatttttttttctcttgtaaaccatgaaaaatgtaaagaccatcctcatctctgagtcacatataaaagaagcccttgggcaagactttgcccatgggctataatttgccatccactggtttaggctattaagtttaatgccattgttgttactatttcaattaggcctacaatttttatttatattctgttttttttcctatgtttttttcacattctatgcccatttttctgccttctattgagttattcgaagttttagtatttgattttaatttatatattggcaatatttttggtttttgttttgtttcattttgttttgttttaagcgattctataggaattttaaaatacaaacctacattttcaaagtttccttgaaatagacttgagttcatattttgacactttacataaaatgtgaaacattgcaaccatttggattccttacacacaccttatctaattatctttttgacatcatgcattacatctcaaatcattaaaaatcccatcaggaattaagatattttttcttttaagtagttacgcatattttaaagaactaaaaaaatattttatatgtattcatctatatgtggtttctttattcttccttcatttttgaagatcccaattttttttcatctgaagaagtttcttctccatttcttgtagagcagattttccagagataaattccattaatttatctttcatcaaatgtccactacacctcttccttcctatttctgaaggattgtttttctttgctcttgagaattctacattgacatttctttaagcatggggtttcactatcttctagtctcctctgttttcaaagagaaagccatataaattgacccattgttccctcatatgccatatatcattttatctaactgctttaaagctattttctttacctttgttatttatcaatttgattaggataagtctaagtattgttttctttgaattttcttatttggagtgtactgagcttctggaatgtggggatttatatttgtcaatatgcttgagccactatttctttctggccactatttctgcaatttttttgtgtgtgtaatctcttactaatctctggaactttacttacacatatgttataccctttgaaattgtttcacaggctcatgatatacttttcagttttatctatctcatttctcactgcccttccaattaggtaatgttctcttgtttcctcttcaagtcaactgactctttaccccatcatctcgtttctgctgttgagccaatagtgaagttttttgttttatttcaggtattttttttttttttttgagatggagtcttgctttgtcgcccaggctggagtgcaatggtgtgatctccgctcaccgcaaccttcacctcctgggttcaagcgattctcctgccccaaccttctgagtagctgggattacaggtgcgtgccaccatgcgaggctaattttgttttgttttgttttttgtatttttagtagagacggggtttcgccatgttggccaagctggtctcagactcctgacctcgtgatctgtctgtctcggcctcccaaagagctaggattacaggcgggagccactgcgactggcccaaatagtattttttttttttaagttctaaaatttcaatttgctccattttattctttctgtctttttactgaaaagtcctatagtttcatccatttcattttatctattttagaatatatacattttcttcacctcataaatgataagcaaagctgctctaaaatagttgctctaaaatctactatctgataaatttaacatctaggtcattttagtatttgcatgtgtttgttgtattgttcctttacaattcacctcactgtactggttgtcaaaaaatactgaattttgtcctggatattgtaaatattatgttgtgcattctctgtatctttagataaatatgtggggattttatttttcaaggagttaatcacctctaagttttgtgttccatcctgtcagcagtgactcaaacctcaagtgatttctcaaagcttttgctgtgctggtttgtgcgtgcagagctagggcataggctaaaatttctgtgggtttttacacagaattttgacatacccttctctgactcctagctgagattaccctcacactctccaacattatgtatgcttttttccaagatacctctgtccttctggacaagttttagttaccacgatcactttgaacctcttcaactagggcccgtcccctgggaaaagccttgagagaaaaacaaagaaaaaaaatggaagctagttttcatttcccatcacaatcttcctgatttttttcctcttgagaacccttggatagttgtttttgaaatttatttcatattattttcagagttctaaattcttattagtagtgaagatgtactatcttgggtttcagctgccattatataatgaaaaatctttatatattctacttctagtacaactttaaagcattaatatatttggtatgtctagtgtctggaaccaataacctacgtgttttagtttcagttttcagcagtatttttattatttttcttttttaaaatttatttttcacattgtttagagtattttacatcatatattctcaaaaacattatttttgtaatgtaagattgtttaaactacaaaatttaaaaaagtgtttaagtatcttttctttctgtcagtgtatcagtcctttggacagtcaattttgtttaatattttcttcattagcctggtgtttgttgacatgtttacatagagacaaaaactatcttcatgaaaactgtaataagtttactggtagatatataagtattttaaattttaatttgaaagatattataactttagctgaatttagagttatatgtttaaagtcttaaatagtatcctttaactataaaacgttatttctactcatatagaatgaatttcacataaagcaaaagaaaatctttaagatcactaaacaaattctcaaattttgtcatggattatatttacatattttattttattttttatttctattgaaagttttttttcttatggatctaacctatgcttgatgaatgccatttttagactggttattaatgtcttacatgtttgttataaattacttgtgagtctctagcagtctagtttcctttttgattaatctagattcttatagtatttctttacatacattcctgaaaatttattatttttcacaattaaagttactcatgaattccaggaaaataccaaatatattggaaatctacctcacgtttccaaacttttgctacatataagaataaatttttaactttagcatgatactgacttgctcatatatttgcctaacctcttcactattgtagatacaagattattaccttctaagtgacctataattaattgaaagaccaaatcatgtaaataatgtttaaagtagatgaatacgatgatagaaaattcacttatggtaaattatataaatatgctagtgaaagattgatgaatacttaagtagaaagtaatataattcttaatattaatttcattagttgctacagttcaggttttattttttgtaatagaaatagaaaaaatatcacgagatatatgtctacatttagtggggtattgggttagataaccatttggaatatgtaaccatgattgtaatttaaaatttagcctgtcctctcttttagttacactccttttaagcctgtatgattgtattatgaaagttgaaacttgtttttttttacgtttatgccaccactatttattaaatcttaattccctttatgtgaagattatgacacatttttagttgtatattgcaatcaaatgcccatgatatatgtggaagttgtctaataagtatattttttggcagttgaagcctggtttgttattagatattttatttcgcaacaaattcataatagtaataaaactcttagtaccttatgtgaaaggccacaaaaagctattgtcgtaattaaatatttacctattaataaagctcagaatacttttgttatgcatcatggccatcaaagttgtatggagacaaaaaattacaaagacattacacaatgttaaacacacacacacacacacacacacacacgcacacacacatacacacacacaattaccagaacagtcttataccacctgaaccaagcacctacagggtaatactgctaagagtgagtagaaaagagtcaaaccatttataatttgatagaagccgcatttactgtaatagcactaaacttaaggtgttagaaaattaagcctttttttgctcaaaacctcttttgtgtttcagcttaaacagatttcttggcattcttccagttcattttcaacatttccgaggcgttactttactaagaagcaggaattgaactaaacttccaatttctaaaacaaaggagaaaacaggcatgtgatatacagtttaatgcagtaagcactggttacatagtatgtttgattacaattagaatatcattaagttttgtgactaggtaatcattacatagtaactattaattagacttaattattttatgtataaatttaatttaacagttacatactaacaatgcatgctaagaaatattagaaattttcatttactttttttttctatttgagcttgctgcacctgcctttaattctccttagacataatggtgatttgtaaatgcattttctcctgtagtataaaagagagagttagcagtatcagatacattctaaggttatggttacattaaataatcccataacacagaatcatgttacttatttacatgctgtccatataattaatagatgtgtgctttattgagtaattcttatctcaaattctctgaatataacagtggatgtacattctctatatataaagtgattttactagcatgattggttagatgtataggatgaggtaaataagatgtgaacataatttaaacatataaagaagcttatttcagtaaacacttagaaattagaaaaattccttggtcatagcagacacacattttatatctgtgattaaaatcttgtcttatgaccctgacttttacactcaccatagtacatttaagccaatgaaactttaaagaagatggctcatttgcagacataaattggttctactgcctgcaactatttaggttttatgtccagtatggtaatttcaaggacagcaactgagaaaaatggaaagcatatctcttcatccagaagataaaaagaacagaccattaaaaaagaaaggtgaagagtcttttattgttaagctgtagatttttaacccaaactttatgtgagccccctgggaaaatgtgaaataccacattcttcatgtgtatagatactgtcgattgtcctcgttttataacattattgtctctctgacaggtgttatttgattcagatcagatcttgttaaaatgtatttcagagataatggtaagaaaatttttaaggaactttaggaaatattcaatccttgagatgataagccttagaagtgaacaaacagcaaacaaataaataaaaacatattttgtaactggatttatcactgcctgttggcgtctgtttaacagtcagaaatactaaagtctacttgaatcttacccttgctttctgtcctttctctggaatgaagaccttgccctgggaatcccagttctcactgggacaatgaatatcttagttcaagctgctgtactaaaatagcacagatagggtgggttaaacaacaaacatttatttctctaaatctaggggctataagttggagattaggatgctagcacggttgggtgactggtaagggccctctttttggttatgtactggcatggcctttacttggtgcgcacacacacatacacacacacacacacacacacacacacacacacaaatctggtgtccctttctctttttataagggcagtaatcccatcacaggtgtttcaccctcataacgtcacttaaacctaattgctccccaaaggccctacttccaaataccattactttgagggttaggaatttaacatagcaatttagggaggacacaagcattcagtgagctttctgggtttaacagagaagacacctcatggataggacaagtacagaatttccacagcgtgaggggacagcaagtcatctgccacaaggtcttagtgtatctttcaggatattcaagacaaaaaaaaaactcagtgaagtctgtaacagctcagtatgatgtgatctcagcctcacactgttcatatggatctaatcctaaaacattggttaattcatttaaattaccaagtttcaatttcccattttgtaaagtgaaagagacatatctatgaattaaggcatactgaggttagggttgtaattaaattttttcaacaatatgaatcagccgtatggtacacaccaagccctcttctaggattttagtgtatagaattgaataaagcaaacaaacacccctgctttcatggacattggcaagagaaaccaatgactttaaaaaataaagtagaaaaataatgtgggaaacagtgagaaagtctaaggaagaaaaaagtaaaacagtgcagtgagacacatcagtcagcttgccataataattatgcatcataaacacccaaaaacacagtgtcatacgataattatcacgttggaaactgctgatcaaagccaggtttgaataaggagcttggcttcaaacagcagtgcttgactcattggtatggatccagtaacacatataaccaggctgaagaggcaataagtacagagaggatatcatcttatggtgatggcagaagcacaagaaaacaagcccgacaacaaagacatatttaaagtgtttgttcacatcacatccaaaaatgtcatgtggctaagccaaacatcagttcatcagggtaatacactagccttctatttggaggtcttttggagtgaaattttgctaaacagtttaatccatatcagacatatatgcttgtgggtgaaattttaggtagataaagaaaatatggtaagagagggacctgctgcaaatgtaggaaaagtacattccaggcagagggaacaagggcagattattcaagcaagagcaattctaggaaattcaagaggcagcgcagaggctaatgttgctgaagctgaataagcaagggtcagagaggaggggaagatgaggccatgaagttaacaagctgccagatgttatagagatgtgctgtccagtccggcagccacttgttacatatggctatggagcactggaaatgctgccggtacaactgagcaactgaaattttgatttctttttactttaattaacttaaatttaaaatgtgatgctcgatttagttattggaaaacttttaagtagttttggaacaaattgagtatgtgaatctgtttattcggttgtacattatataaaatctaaatgcagaagaggctttcccaatacaaatctagtggcttatttgagatatgctgtaagtgtaaagtacacaacaggttttgaactcttagaacaaaaaataaaggatataaaatatctcactaactatatctcactaattttgttacttatttttaatttatatggatatgtattagttgtatgtatttaagggatccatgctacattctaatgcaagcaaaagtgtgtaatcctcaaatctgggtaactgggatatccctcacttcaaacagttatcatttctttgtgttgagaactgtacgagtctgttctcacgttgctaataaaagcataccgtagactggtcatttataaaagaaaaagatgtaatcaactcacagttccacatgggtggggggaagccttacaatcattgctgaaggcaaatgaggagcaaagtcatgtcttacatggtggcaggcaagagagtgtgtgcacgggaattccctttaaaaaagcatcagatgttatgagacttactcagtatcacaagaacagcactggaaagacccactcccatgattcagttacctcccaccaatccccttccatgacacatgggaattatggtagctacaattcaagatgagatttgagtagggacacagctaaaccatattgggaacattctaagtcttatagctattttgacatatacagtaagttattgttaactatagttgccctcttgtgctaccaatcactacgtcttattcctcctatctaactgcaattttgtacccattaaccaatctctcttcatttttccctgctcaatatcctttccagcctctggtaaccaccattctattcttcctccatgagatcagttttttcagctcccaaatataagtgagaacattgtcttttaccgcctgacttatttcactcagtgtcctctggtttcgtctatattgctgcaaataataagatttcattctcttttatggctgaataacattccattgtgtacgtgtctcacattttctttatccattcatgcactggtgaacacttaggttgattccatattatggctattattattattatgaggcggagtctcactctgttgccaggctatagtgcagtggcacgatcttggcttactgcaacctccacctctccggttcaagctattctcctgcctcagcctcccgagtagctgggactacagtcacgtgccaccatgcccagctaatttttgtatttttagtagcgacaggctttgaccatgttgaccaggatggtctctatctcttgacctcatgatccaccctcctcggcctcccaaagtgctgggattacaggtgcgagccaccgcgccacctggctattatttttttttatattgactacgtgttgaaattataccactgtaaatatattggcttgcattatgttattacaattaatttgacctttattctgtttctttttcagtatggctcttagaaaatttaacattgcataggtggctcccattgccattgtctatattagacagcactaatatagagctttataatatcaaggaggactttgaaaaggatgagaggccactggagagttctgatcggaggtacaagcagtcttctcagatcatattttaagtgaatgacctttgcttcagagctgagaatagactgaaaggggtacaaaggcagaagcaagggagggacaccagtagggagactattgcaagacatcaagtgcatttcatagtgttattgtaatttacatcaccttaacataaatgtatataactattagtgaacatcgttttaaaaagaacaaataacatattcagtatatattaattagaatggattacattaaagacaagaattgagtttgttatatatttttctttattcaaatcatttcaagaatttataaaaacaactcgactgtatttttaagaaatgcatgcaattctagaaagcaagagaaaaacattaatcacagggaaatattacattctaggtataatgtaaaattgtgcttttttatgctaaatgtatggtcaaaagagtaatgtgcctagttttaaaatagtattcacctttgtgaaaatatgcacacctatatttttctctaagtggtttccaacttgcttggataatcatcacatattgataagaaaaacaaacaatatttctgtaagttgtcttaaagttattcaagaagaaaatggtatttctgtatattcgtttaaaaacctttgattttagttattcaatttaataatatttagtcgagtgtggtagtgcatgcatgtaatcacacctcctcaggaggctgaggcaggaggatcatttgaacacagacgttcaagaccagcctgagcaatacagcaagaccccatctcaagtaataatagtaataatagaaataataataatatttattgtacaacactagaaatagactgttagtatttttcaaacatgcaaataattgaacatacttacaaatatttcaataagtctagggaaccggaatctacttatgtagaatagcttagaaagcatcataaattaacatacaacttaatgtgcttataagaaaatatgtgtcatagatagtatacaaatgagcaataagagaaaaaactctttgaaaggtaacatcatcacagtattttgaagtagaacctaaggaggagataatattgaatctgagtctaatacaacattaaaacaataatgatcagataataattaatctgaatcaaatgtgatattaaaacatacatgactaattcagattagtgtatttattcacatagatcccttcattgcaaatttacagctcaccaacactaacatgtcttctctctgctttagtattgtggacatgaaaaatttcctgcccttggaatgaagatgaaggcttaatcagagcaaatctcctctttaaatcattatttttagtactcttggtatctcagaattcttcacatgcaacagaatttgaaacattgctggttaggtacaagttattttatgataatcctctttgtttaaatgatctttgatgtttcttgggctgctaataattttgctaagattgtaagagcaattatcaatgagttcagtctaatgccaaaaaaaaattcttatttttaaaaaacttttaaattcaggggtacaagtactggtttgttacacaggtaaacctgagtcagagggtttgtgtgtctgtgtgtgtacagattatttcatcacccaggtattaagcctagtacctattagttatttttcctgatcctctccacctcccaccctccaccctttgatagttcccagtgtgtgttgttcccctgtatgtgtccatgtattctcatcatttaactccaacttataagtgagaacatgcaataattggttgtctgttcctaagttagtttgctaaggataatggccaccagatccatctatgtccctgcagaggacatgacatcattcttttttatggctacatagtattccgtggtgaacatgtaccacattttctttatccagtctatcattgatggacatttaggttgaatccatgtctttgctattgtgaatagtgctgcagtgaacatacaaatgaatgtgtctttatactagaatgatttacattcctttgggtatatacccagtaatgggattgctgagttgattggtatttctgtctttaggttttgaagaatccccacacagtcttccacaatggctgaactaatatacactgccaccaacagtgtaacagtgttcctttttctccacaacctagccagggtctgttgtttttgactttttaataatagtcattctcactgatgtgagatgggtatctcattgtggtttcgatttgcatttccctaatgatcagtgatattgagctttttatcaaatgattgttggccacatgtatgtcctcttttgagaagtgtctgttcatgttctttgcccactttttaatggggttggtttttttcttgtaaatttgtttaagtttcttagagatgctagatattagacctttatcaaatgcatagtttgcaaacattttcttccattctgtaggttgttttattactctgttgatagtttattttgctgtgctagaagctctttagtttaattataccccgtcaatttttccttttgttgcaattgcttttggcatcttcatcatgaaatctttgcccatgtctatgtcctgaatgatattatctaggttgccttccagggtttttatacttttgggatttacatataagtctttcatccatcttgagttaatttttgtatacagtataaggaaggggtccactttcagtcttctgcatatggctagccagttatcccagcaccatttattgaatagggaatccttttcccattgcttatttttgtcaagtttgttgaagatcaggtagttatagatgtgcattcttatttctgagttcccaattctgctccattggtctatatgtctgctcttgtatcagtaccatgctgttttggttattgtagccctgtagcttttctgtgattttttccagatagtataaaatgtttaatttctatgatgcaaatactagggcgatcaatgctaaaacggttgtcctgtacaattttttcttaccataccaaaattttttcttatgactgtttattttaattattttaagagatctttattaacctaataagtattggatatgtaaaatttaaagataatatcttaataaaccaagattttaattttatttggatatatgcaggtttgttttgaaaggcaaattctgaaaaaacaggcattatattatttatgaaacaacttgaatactgatatatctatatcaccagtaattcttcctttgataactcagaagtttttatgaaagaggttcatttaatctttgttttctaaatacataggtgaaattatacttaaaaatgatacagctattcatgaaaaattcaaatatataacataaccaatagaagacaaattagccattggaagtacagctacaatatttttattcatattttatgtatgatttgatgaaggaaagatattctgattagaaaaaggagaataatattagaaatatgaataattcaccttacttatcaaatttttcttatgaccagtaaatgttttatcatgaatgaaagtcaaattagagagaaagccagtatgtgctaagaagtcacatataggtattccttaataaaaattactcttgtgactcaaggatcataaaatatgctgagatgtatgcataacttggctgtttaaaattagaacaaaaactgcatatccagtgttatggttaactggaaataagcacacatctaatttagtattccacatagccattagaattcccatggtacatggactgaatccagttaattgtcatagctttttctacatatgacagaacacagagaactggatctatgaaatcattaattgaattaccctttaaatgtgccaaaagatatattagtttttactcccttggtagtttccctcagcataaatcaaatgagaaaatttaaatgactgaaaaaaaagaacagtgagtgttacaggttattttaaatgtgcagttagaccttagttaatttaaggggccagctttttttttttttttttttttttttttttttttttttgagacagagttgcgctctgttgcccaggctggactgcagtggtgcaatcttggctcactgcaagctccgcctcccgggttcacgccattctcctgcctcagcctccagagtagctgggactacaggtgcccgccaccacacccgctaattttttgtatttttagtagagacggggtttcactgtgttagccaggatggtctcgatctcctgacctcgtgatcctcctgcctcggcctcccaaagtgctgggccagcttctttacaaaataattataaaggtctaagaaagacaatctattacaatagatataacactggattgaagtccaaatttctgtgtctttagaaatatcaaacaaatgtgggtgtatttctcatcttcttttaaatggagtgatgacatctggaatacatacttatcctggttttcattcatccattttactgttattgactgaatagctacttatattcaggtgctgtagaagaactgtgaggcaagtaacattgttctttccctcattgaatgtataaattaggctggctgggtgtggtggctcacacctgtaatcccaacactttggcaggccgaggtaggtggatcacctgaagtcaggagttcgagaccagcctgggcaacatggcgaaaccccatctctattaagaatacaaaaaaaattagctgggcctggtggcgcatgcctataatcccagctcttgggaggctgaggtaggagaatcacttgaacctgggaagcagaggtgacaatgagatgagatcacgccactgaactcctggcccacagccgggacagcagagcaagactttgtctcaaagaaaaaaaaagaaaaataatttttaaattagggagatagaacatacatgggtacattaaaatgaaatatatcaaaggtggttaggttttgaccatactgccaaaagcagtctacaaattcaatgcaattctcatcaaaataacaccataattcttcacagaattagaaaaaataattctaaaattcatatgggaccacaaaagagccctcatagccaaagcaatactaagcagagagaacacatctggaggcaacacattacccaacttcaaactatactataaggctatagtcaacaaaacagcatggattaaatagacacacagtccaatggaacaaaatagagaactcagaaacaaagccaaatacttacagccaactgatctttgacaaagcaaacaaaaacgtaaagtggggaaaggacacccaattcaacaaacggtactgggataattggcaagccacaagtagaagaatgagactggatcctcatctctcaccttaaacaaaaatcaactcaagatagatcaaagacttaaatctaagtcctgaaaccataaaaatcctagaagataacatgggaaaaatcctctagacattggcttaggcaaaaacttcatgaccaagaacctaaaagcaaatgcaacaaaaacaaagataaatagatgggacttaattaagttaaaaaatttctctacagaaaaagaaataatcggccagtaaacagacaacccacagagaggaagagaatcttcacaaactgtgcatccgacaaaggactaatatcaagaatctacaaggaacccaaatcagcaagaaaaaaaaaaaaataccatcaataagtgggctaaggacatgaacaggcaattctcaaagaagatatacaaatgggcaacaaatatatgtaaaattctcaacattactaatgatcaaggaaatgccaatcaaaaccacaatgtgatacaacctccctcctgaaagaatggccataatcaaaaaaataaaaatacaatagtgttagcacatacatggtgaaagtggaacacttttagactgctggtggggatgtagactagtaacactgtcatgggatctttacagtgtcactttgccagccagaaacttctgtggctggtagtacctctgcttgggttttgcttgcttccactgggctcattctgcccactcagctcatgctattggcctagatcccatacccgccaagggtgaaccaggtggggagtggtgaggggtgtatcagtgggcgagtgcagggtccagccactgggcccagccaggcactccagctgctgtggtgggacaggcagctccaggtgccactccatgcaaggctgaaccaggtgtatctcaaggggcttccactgtgggcacaagcatctggaccaggggaatgcagtggtgcccgaaagctcagagacttcagggagtgaacagccccaaagatggtgttacatcacgccacagccctggcatggggagccccaaggtctaggctcccagaaggaccacagctcttctctccttctcattgcctgcaacgtggcaagtagggggcatgtttcagtcctgtttgtgttacagctctttcagtcccgccattctgcagatcctgagttcttgtctcatgtccaagaagaatgaggtatgcagacaagtggtgggttagcaaggaggaaagcagtttcattgagctacagaaaagctctcagtagaccctaagtgggtagctctatccactggcaggtcatcctgacatctgtccaactctggctgagtcggggttttatgggctcagagggaggaagtgctgattggtccatggttggccatgggtaggcctggaaaaagcaccagaagttatcactctgggccacgattccacccagaacttatagccctaactccaggcttcaggctctccttggcttgaaggtggaccctcagctttctgcccagaaggctgtctgcctcctgctgccatcaacatgttgtatatggcccccaggctgttcatgccaaggggtgcctataggcccctgctgagccacatttagtcttccctcagcctccctcctatgctcctaggtgcccaatgtccagagggggttgaggtagcaggggtctggtgtgtcagcacctccttgagtgtgcacacacctaggtgggatgggacggcacctgggctgggccacaactttgctccaaaatcggagcaggcaccaggaatggagagaggtcagggatgggagcaggcacttcccagcctttgggggaagggggagttcctcacctcctgagagcagagcgcgactgtgcggctgcacatgcaccagggagtgcagggctcccaccccacctactcggtaggaggcagggcttcttcctgttcctggcccctgccggctctgtggagtgcacaaacctggccagacctccccaactgcagctggcatcttcacagtggctgctccagatgggctgccactgccatcacaaccactatggaaaactgtgtggagattccttaaagaactaaaagtagatccactatttttccaacaatgccactactgggtcattatatgaaataaacacttgcacatgcatgtttatagcagcacaattagcaaatgcaaaaatatggaaccagcccaaatgtccattaatcaatgagtggataaagaaaatgtagtgtgtgcgtgaatactattcagccatatgaaggaacaaaataatggcatttgtagcagcctagttggatttggagaccattattctaagtgacgtaactcaggaatggaatgccaaacatcaaatgttcatactcataagtgggaactaagctatgaggatgcaaaggcataagaatgatacaatggactttggggactgaagggaaagggtgagagtagggtgagggataaaatattagacactgagtacagtgtatactgctcaggtgatgggtacaccaaaatcccacaaatcagcactaaataacttatccttagaaccaaacaccacctgttccccaaaaacctattgaaataaaaaattaaaattaaaaagaagaaaaaaggtgattaggcagattgagacagctagtacaaagcaccgaaagcacaaaagagttcgggatgattaaggtttaagaagaagagttaatttaaatgtatgcaaggtcacaaataagcctaggttattttatgtgaagctttgtaaagagtcataaaagtttggatttaaggagtgtgaataggatctttaaaaggttttaagcaggatagttacatttgcttaaagtagaaactggtaggtgagtaagtcagcaaggggcttctaaaactgaccaggtagtgactatgaactgggcaagagagctcatactaaatattgagagacatgaatgatatttctatatattgtgctttagtggtgagaaatcaatgacaaagcttttaaaattgacaccctattataaccaaatctaagttcagctgctcatcacttgaaagccaaacatgagagatgagagttggcaggaggaaaagcaggtttattctgagagccagcaaaccaagaaaatggtggactaaaatcccaaagtaccatattaagtcagtacaaatttcagcctctttttggttaagggcagggagggtgaagagatggggattaggatcaagaggtgaccaagggtggcagacatctgagtgtcagtgaggatccaatggggttggaaaattttgtctttggtcaagtcacaatgcttccataaatatttaatgagaaatatggttaatttgtacatacttttcctttaactccagaattcgttttgaaaattatgattgctgtccttgcgtattatgagcgttattaaattattctagcctccatgtaagaatggataaaggctccttaaacaaaaatggagttagttatgacagttcttttgctgtttcactgttacactattacatgtgaaaataactctttctgttatttgtagttcttaaaatataatattaaaaaggacatttgaaaattgtttgccacagagtattatgactggaaaagaggaagatatttcactctagtatgtgaatgctttgaagagtatgtaggacataatctacaatacaatcataatacagttttacaaggatgatgcctattcttattctcatcaatatgatttttaaaaacttatttttattataaattatttccctagtaatgccttttcaatttgatttagaaaatggattgtatatcgtgagttttatagtgagttacctggttctaatattcatgacctagtggaaattcaggtcaaagacttgtatatttcagttcccagagcctgtgttatgctttattatcagcttcaccctgctcagacacaggcagaattcagtaatgcaggccagcactgagcaagaaataagacttttcttaggtcacagttaccaaccacaaataaactaggctcagagaaaatatttcagagccaaaggaggaattacaaaagaaagtagaaagcttgcattaagcaagtaatcaagtcaagaaatctcatactgcaggagaatgcagtgatcagtactgactccaagttcacctctaaatctcagaataagaaaaaaaagaggcagggagggggcatttatcaaaacaagtataacttggtaccaagtccaaagacatgctttaaattgacaccctattatagtttctttggtgtctcctagtatggaaaggattgggctggaaataagcttgtcctgaatgaaacattgaggaaggtgacacattcagatgctggcatatgttactgtttcatgtgatgctggcaatgtaatgtcagagattcagtcaagggcatggatttaagaataaatgttctaggtcagacttctgcctgtacagctgccatttaattaaatctaaataatttatcattagggatcatttcattgtgataacagctaaaagagcatagttccttgtttttaatgtctgtagacacattacatcttgtttgcagtattccttttcttatggtctatatagtaatgcacaatttttattaattatatacttattaagaagattttggagtcttaagataatacatttaccaccaaggactactgcattatttaccctcatgtagtctctttttgtctgtttgaaagatattcacttattaaaatatttaccaaaaacttttttttttttttttgagatggagtcgcccaggctggagtgcactgatgcaatcttggctcactgcaacctccatctcctaggttcaagtgattctcatgcctcagcctcccaagtagcagggatcaaaggcaccttattgtacaaacatatgcgtatcaatgcctgcatttgtatgtagtaaactacaccagaggcttttataaacatgaaataattattatcccaagtggcttacatagttctttagaaaggcaaatgccaccttttatatggactagtgctactttatgtatcctaaaagtaatatgcatgtttattttttaaatttgtcccagggtaattttaaagaaatcttagaggttaaggaatttgggaagaatttatctagttcaactcctaaattctttaaagaaaagaaaaaaaggccaaacttaaaagcagaaactcaaggtcacatcttttctacttgacagagttggcactcaattttgattgcaagctcaatgctatttccaatacaaaattttgcttatgagcaccagccacaaattttattttgttttcatccactattctctgtgtgtatgtgtgtgcacatctccagacctttttaatttagttgtatatatttatgggtcacagtgtgatattttcatatatgtctaacagtgtggaatgtttaaattcttcacctcacatactcagcctttttcgtggtgagaacatttgaaatgtactgtcttagcaatttttaaacacatgatacactaactgttgtcatcttattgggtaatacatctcaaaaacttacttctgttgtctaactgaatctttgaatcccttggccaacatctttctattcctcttaccaccataacctctggtaaccaccaacctactgtccttttctatgaatttgactgttttttattccacatgtataaattagattatgcagtatttgtgtttctgtgcctggtttatttcacttaagataacatcctccagattcattcatgtcattgaaaatgtcagaatttccttctattttcattttgtatatatactatgtgttttgtatccattcatctactgatgcacattttaatctgatttcatgtcttgactattgtgaataatgctgcaattaatataggagtatggatatcttttctacatactaattgaagttcctttggacatatactcacaagtaggataactggataatatggtaattgttgcaggaagtcagggaccctgaacagagggaccggctggagctgcagcagaggaaacaaattgtgaagatttcatggacatttatcacttccctaataatactcataatttcttatgcctgtcttactttaatctcttaatcctgttatcttcgtaagctgaggatgtaagtcacctcaggaccctgtgatgattgcgttaactgtacaaattgattgtaaaacatatgtgtttgaacaatatgaaatgagtgcaccttgaaaatgaacagaataacagcgattttagggaacaagggaagacaacagtaaggtctgactgcctgcagggttgggcaaaaacagccatatttttcttcttgcagaaagcctataaacggacatgcaagtaggagagatatggctaaattcttttcctagcaaggaatataatattaagaccctaggaaaagaattgcattcctggggggaggtctataaacggccactctgtgagtgtctatcctatgtggttgagataaggactgagataggccctggagtcctgcagtaccctcaggctgactaggattgggaaaccccagccctggtaaatttgaggtcagactggttctctgctctcaaaccctgttttctgttaagatgtttatcaagacaatacgtgcaatgctgaacatagacccttatcaggagtttctgattttgccctggtcctgtttcctcaaaagcatgtgatctttgctctgctttttgcctcttgaagcatgtgacctactccctgtttgtacactccctccccttttgaaatccctaataaaaacttgctggttttgtggctcaggtgggcatcatggacctaccgatatgagatgtcacccctagtggcccagctgtaaaattcctctctttgtactctttctctttatttctcagagtggctgacacttagggaaaatataaagaacctacactgaaatattgggggtgggttcccctgataggtagttccgtttttaattttttgagaaacctccatacagtttttcataatacatgtactaattgacattcccaccaaaagcatataagggttatcttttctctgcatccttgacaataattaccttctgggttttttgtaatagcctttgtaactgatgtgagtttatatcttcttatggctttaatttgcatcttcttaatgattagtgatgtggaacattttttaaaatacctgttggccacttatttaccttcttttgggctaattcagttcctttgcccattttaaaatcagattatgtgttttttttgctattgaattttctccagattcttgttgtaagacttgtgacaagttgtgagaagcactatgcctgggacattttaactgctcacaaaatagtagagatttaagttaatgttcttctgggaatctttctctgggttgcagttatataacaatatatttatttacttttgcatctgcctcatccactagaatgtttcctgttgagatgaataccttgcatttaaacagtaatttgcatgaaataaactaccagtgataatttgggacagtggttgccctcccagagctgcagatggaaaatctttaagattaaggttgagacattcatctttttcctccacaaactctcaatgtgccagttaatactcagggaagaaaaacttttatacccaaacagttgtgtccagcatctgctaaatggcttactattcatagacataaattttgatattattttgaattattagtgtacaatcaaatatatcattctgatttggaggattttaacattttatttggcaaggcaacccatgatggcagtatatcatgaagaagttaaattccttcaacatctttttgaaagtgaaggtagaataaatgtacaaataggtaaatattagtttgaaatcaaaacaaataaaaccaaaacataaataaaatgttaattattcaccatacgttatggagtatgattaattctaaacaagttattgtagcattgaaatatgtgaaaatatagaatgtatgagctctgtcattaaaatatgagttcaatttagaaatttaaataaaaataaagtcactatttaaggggtcaggcttaatatatggtatcataatactgttaaaatttaatatgaattttgccctctttatgataaaaataattgatgttgttttatgctttcaagtgtcttactacatatggagtgtcttgacatttttaaaaatggaaataaagcctctttcaattttaatttcaaataattatgcctctcaacaaataaaatagataactcaatatttcccctgatgtgaggcatacgtgtttactgtagagtgaatatatgtgtgtaaacaatatcaacatatgtcaatatattgtatgtatatgtgtacaatatggtttggctgtgtccccacccaaatctcatcttgaattgtagctcccataattcccacgtgttgtgggagggacccagcagagcataattgaatcacagggtagtgaataagtctcacgagagctgatggttttataaggggtttccccttttgcttggctctcattctgtcttgtctgcagccagggaagatgtgcctttcacttccccttctgccacgactgtgaggcctcaacagccaagtgaaactgcgagtttatgaaacttctttttcttcataaattacccagttttgaatgtctttatcagcaacatgaaaacgaactaatacagtatatatttgtgtatatgagtgtatatatgtatatatagtatgtatgtgtatataccgtatatcaatatatgtcagtatatctatatatacacaatatatgccattaaatgtatatttgtatacatgagagtgaatatgtatatattcatatgtgtgtttacacatacccactcgtatgtacatatatgtatatattcactcatatatacatatatacatatgtgcacacactttacagaagtgaaagtaaagttgcttttttacaaaagcaactttacaatagtaaagcctacataattatttgaaattaaaactctaagggtttttattttcatttttaaaaatttaaagagactccacatgtagtaacgcattttacatttttaaagccatacatatggctttccaaaagtttgtaactttaccgggactgaaaaacatcaaaattagaatacactattgaggaaagtacagtataacaaatatattattattatacttactatttttagactatcaagatatttttgcagtcatgtttagtatttttgttatttatttatggtataattactaacaagactcttttagtttttatgtttcagaatattgatttaatagaggctgaatattctcaatgaaaaaaatgtgaaaaaagcatacacaatatgcctactgccaaacacgttagtattaacaatgatgggagcattgtaatatattttaacctcttaatgcctcagcagagacttgggaagaggtaacaacctaatttcttcataaatgtcctaattgaaagttgattatagaacctaactttggcgaggtccagatgcatattcctgatgtaaaattatacagtaaaagtattttaaaataaaaagtataatttaaaaagtgtctttaaaatcaattattatatttgaagacgttagtaagtatacttatttgggtattctttcttgagatgtcaaatgacattttccattattttaggcaaatatgttttaatgcagaagtttacttgttatgatcaagggcaaaagttctatgaatcaatttatttgtaatttcttaatcacaactgtgctagggagtacaattttgaaattcacctttgaaatccaaatcttgtctgtaaacaatattgcaacaaattttctacactagtttaacaatatttcttattaattcaaaatggaaggcattttaacatttctaaactacaatctagggaatcttctttgactttctgataatgaagcaagtgattaacttacctgcccattcataattttaaattaactgtagctttttattttaactctcatatttcaaatatacaaattttaccaaaagtaacccactatctcttattactgatgcatctgcttcacatctgtctctctcattctctctttaagaaagggaatcaagctttctttttaaacaccttcttggggttaccctcattcgtcaaacagaaattattccgagacctgttaaaaactgtaaggaagactagtcattattactaacacaatagtgctcaagactattgcaatagaagagagagattgagctcaaagccaaatacaaggacaagttggaatgtacagccaatgagtagagtgagagatggcagtggatgaaaagttattaagagggacctggtaaacttcagaggtaatgactttcttggtaacctggcctaacagggtccttgctaaagacaggccaaagacttagaccacaattgtgttgaatgaagaacttggtcagatagcaagagtgatcagaaatcaagggtgcgggaactcttataaatggatttggcaggattctttgctactggcaagccagggacagtgccaaggtcaaggcctagttgaaaagtgggctaagaagaacctgactaaagtttgatcaaagagggtgtctgtgtcactttcttgattgtcactggcactggaggctttcagaaaggagatctttttctccacctccagtgaatgacatacttccatcttttcactattcaaatttatcttaacttttttctactctgctcagataaaaattaattcttccaataaagtcacttcttttcattataatttgtagaatcatattttgatttggactttgataagattgatggacacataactccttaagatatgcttccataacttcatatttcatgtagtcaggaattaattgggcacaaatcctaagccaaaaaaatgcaagttcaagataaaaatgtttccatgcctattgccttttttctttcatatatatgtgaaagaatatagcataggcaaaagtatctttccacttctgcttatgctatattcttttctcctttttcccctgtatgtgtttctctaaccaccagtgtttatttcctctgtacatttgaaacctttcatgatgtaaagggccttcctgattttgaaaatgactatttttggtacaccaacatgacatatggctacattcttcagccacttcagatggtgctatgcaagagtcacatccctcataccacactggcccagtaccaagttgttaattgcattgacatgctaatcttgtgccagtgaatatcgctgccttgctactgtattgatatttacaaagcatatcctgtatagacatttagtttctgttttattatagaccggcgttatcaatattttcttgcttgataccacaaatacattttttaatgtggctttcagtatagcatgtattgcctgtagcaagtattgcattcaacactgataattctgagtaaaattcacactgagatcatcaggcaagcaattagtggcaattgctttctgttatggaaaacaacaaatcttaccctcagtatatagttaaattacactattaaaatacactacatgcagatgccacattgtggacagagtgtgactgcaagtcagctattaatgtttccattaggatgtatgaatttcttattggattgagtttatttgtaactatattttccttaaacctctccgtgaaatagtataatgttaaataagttatattttacataccttaacagttgtaaataaatttaaagatatagatatagacgtatgaatttcttgttggattgagtttatttgtaattatattttccttaatcctctccaagaaatagtataatgctaaataaattattttacataccttaagggttgtaaataaagatatagacgtaaacttagtttttgactttgaatatcaagaaatttggcttctcttatagttgttcctttaatcagttgtgtgttcttagattcttcatgtccctggctttttcaatttagttgaactgttgaattaaaatttatttgactatttaatttccagtcaattcaatgtacagtttaaaaaacactgtgtaagccattagataaataattgtgactgagatacattctgacccccaaatggacatcatttggtgtagaaacgatcaaatagatgcttccattgcctaatgaccatgatgagggaaatcacagaatgctgtgggtgcacaatttaggccacctcatctagaactgaagagtgtggaaaggctgtgtttagaaagtgaggagcttacttttgaactcagtcagttgaagggaagggcaggtatatgccgagctaatggaaagccataggcaaatgtatctgtgtaatatttagcacacctaagtacaaagatgtaccaccatttatgggatgttaagttgttttcagtttttgttattaaaataatagtgcattaaaagtcctttaaataaacttttataatatttataattattttctctggatacatactggattgcagaatcaagattataaagctgttttatcttcctgagaattgtttcaattatattccctttaataatagatgataggattcacagcaccaaaatgtttcaaaccctgaaaattataattttatttctgtatttgattgggcatataatagacgttggttaaaatagccctatattgatatctgagccctaaaacttattgtgggaatgagcttggcatctcttaactcagatcccttttccatagaacagagattattccttccttacaaggttattaaaaatattaaatataataaagtatataaacaacttaccttcatatagaaatgattcagtaagcatttcagacttgtatgtgagattgtcattaaaaacattcattaaagtaaaataggacaaggacttctaaatgattacttctgcatttgtactacagataagttacatatctgatatttatataattagtagatataacaaaactggatattgcttttttaagtagtttgcagtaataaaatatttaaaagttaaatgacttaaattgataatttttgatgtgatattaagttctaagtagttaatattagtaacaataatcagcataaatatgagcaaaattttagctacagcttacttgagaattatgctttcatgtaaaaataattataaaatcttctcaaataattatgcaggcaggaaattgagaggttacaatatttggcatttgatttagatcgtagtcctggggtggaggaagagtgaaaacaacatttgtatgttttcacatttagatttttaaataaaattatacattgttttctcttaacttctgtgatagagatctagaatacagacctgaaaaaattgatagggaatcgtaagaataggaactggttacttttcaaattaattattgttgattaatttatgacatctgtggtttagtaaaaatgggaaatatggatactttagggaaaaaatgtttagttatgttgttgccattccaacttagatttcatacctgagtcttcaaaataatttatagaaaaagtgactatgacttaaacgaaataaaaagtgaggaaagaaccatttattagattttatcctaaactctcactttatagtttgttccagaaatagtttctacacaagtagatagtcattaacatagtcaatatgtattttttgtcagattagtaagagcaaatttaactctggttctcttatattttaataattggtaatttatgagtgtatgttaatcctattaaattatgtgataaaagtattcaaatgacatatattttcgtgagttctgatgcactgtgttaaatacacaaaattaggctgggagcggtggctcacgcctgtaattccagcactttgggagtctgaggcgggcggatctcgaggtcaggagatcgagaatcacgaggtcaggagatcgagaccatcctggctaacacagtgaaaccccgtctctactaaaaatacaaaagattagcctggcttggtggcgggcacctgtagtcccagctactcagaaggctgaagcaggagaatggcatcaacccaggaggcggagcttgcagtgagcggagattgcaccactgcactccagcctgggcgacagggcgagactccgtctcaaaaagaaaaaaaaaaaatacacgaaattagaattatgtggcttctttttatacagtagaaataactaatgcttatactacttaaatgattatttaacttaaagaaaatgcctataattattttattatattgtattacagatgcccccaagtttatatcaaaccaaacaatttattactcttgggaaggaaatcctatcaatataagttgtgatgtgaaatcgaatccaccagcatcaattcactggagaagagataaattagtcttacctgctaaaaacacgaccaatttaaagacttatagtacaggaagaaagatgatattagaggtaagtccacatgtatacatcaataaattgtattattttaacaactatctactatttcagaatatatttaaatatcttcatatgcatatatatatataataagagagagaaatcatggtgtatatattttacagttatttacttaaaggtccatggctcattaatgatgagtgtatgaatgtctattcacttatatagcaatgtggctatatagcaaagaccattatttttataaatgcacttttaggaataaaaacaattatatggccgggcgcagtggctcactcctgtaatcccagcactttgggaggctgaggagggcagatcacaaggtcaggagactgagaccgtcctggccaacatggtgaaaccctgtctctactaaaaatacaaaaattagctgggtgtggtggtgtgtgcctatagccccagctactcaggaggctgaggcaggagaatcacttgaacttgggaggtggaggttgcagtgagccgagatcacgccactgcactccagcctggtgacagagcgagactccgtcttaaaaaaaaaaatatatatatatatatacacacatatatatatgtgtgtgtgtatatatatatatatacacacacatatatatatgtgtgtatatatatacatatatatgtgtatatatatatacatatatatgtgtatatatatatacacatatatatgtgtatatatatatacacatatatatgtgtatatatacatatatatacatatatgtgtgtatatatatatacatatatatgtatatatatacacacatatatgtatatatatatacacatatatatgtatatatatatacatatatatatggaaaatctaggaagaaaaaattggtaatgtaatagttattgagggataaaaatttttccatatatatatatatggaaaaatctaggaagaaaaaattggtaatgtaatagttattgagggctaaaaatttgtcttcaatgttgatgttttcattgattccatgtggtatagcttttttttcttttcagtctggcaggtataaatgctatctgttggctagatttttacaattctagtgtaaattccaaaataaatgaaatttacttgttcagtatcttttgttttattactaaaaataagattttgtataattatttttatattgccaagtaattggcctttaaatactgtctgaataaagtgcctcttatttattaattggagtgtatgtgtgtatcaatttccgaaacataaaaaaatctatgaaaatgatcatcaccctttccaaattatgatgcggttaggaaaattgggaatctttttcacacagccttatttgctgaaaggttgctacattttattcactaattcagtttgcataagctaaaatgaaatgcacgttttagaataccgtctaatatccatactgccttaacttaaaatgtcctcattgatgccatttagactttaaaaaaattcgtttgataggaggatttagccatcatgtctgcaaatacttgcatagctggctggttggtaattaaaccgctatgtctaaatcaatttcaatataaataagtttctttggaaatattttagaagaattagctatttgtgacttgacagggatgtcaatttcataaaaacatctggacagttttaatctaaattttatgtgttttaccttagtgaaaagctcaggttagatttaacttgttttgtgtagtgtgtagtctccttgaatactttaataaaatactatagacaggatggttgaaatcacagaaatttgttctgagttctggaggatagaggttcaatatcatggtgcctgccaggttgctttctatagaggactcttccctggacttgtacttggccgccttcttgctgtgtcctcacatgccctttcctctgtgcgcacacagagttctggtgtcttccttttcttgtaaggataccagtcctgttggattaggtcccactcttattacctcgtttaaccttaattaccttcttaaagatcctatctccaaattcattcacaccggaatttagggtttcagtatatgaatgggcagagtgaggaggcgggcagttcagtccatagaaagtagattgaatttcgtgagtaaatgacagactaatgtgtaatttctgctttacttcatcttgacattttttagttcctcagccaactcataattctctatatttaatgtgaagggacattttatacatacaacatagtatatagtgtatgctatttaaacttctgcctaaagacatccctctgcactccaaaataaaattttaaaaaacccacaatttttgcctacttgacacacagccaggtgatctgttggctaaaccactgactttaaacagacatgtttatgtgtatactctcacaaattaaatttaaattctgaatgaaaaatataaatgtgtgattaacacaacttgaaaacatagcataacaaaataacaataatataaagagaaagcaacaatgagcattactaatatttaattattagtatatacagttgcttgagacagttacttttgtttagtaattattgtaaaagtcatatatgtgctaattctttagaatataaaaggaaatataggaaaagtttacacttaacaagttgtcagtaataaatttattgaattgttttaaagattttttctttaagtatatatattcaaacttttaaaattgtgtgttttaaaacataaccaaatattcaataaattatttaagttactgccaataaatgcctctgtaatctgtaaaggtcaaggtcatcaaaactttatttttttaactgaccacatcctgaggaaattacaaaacttttcaatatgtgggcaaacattgaaagaaggattggttttaataggtttgttagaataatattgtgctttgcattgtctgtatctttgtttcatatcctaaataggggtgcttactgttgtgtccatgactttcttatcatggaatacatagaagaaataaatatttttaggtttaagaaaaagactagcaagcttcttgattaatattatacacttagcttatatttagatattcaaaactatatttgttagttcactatactctgtccaaacctaatatcattaattaatatcagcatttttagctggatacagatataccttggagatattgcaggtttagttccaagagcacctcaataaagtaaatatctctataaagccagtcacacaaatttttgcttttttcagtgcatataaaagttatgttggcactatagtctattaagtgtgcaaaagcatgatgtataaaaaggtctacataacataactgaaaaataattactaaaattttctgggaataatttgagatttaagcaagttgtaacttttttcattggtgaagcgttttgtcgcaaggttgatggctgcttactgatcagaatgttgattgctgaaggttggagtggctgtggcagtttattaaaataaggcaacagtgaagcactttgttaattaacacttcctttcatgaaagatctctgtgtagcaggtgatgctataaggctaacagcatataatactgtttgttaggaattacctatagcagaacatctttcaaaaatgaagtaaatcctctcaaaccctgtcaccgctttatcaactaagtttatgtaatattctaaatctttggttatcatttcaacatttttcaggcatcttcagcaggagtaaattctaccaccagaaaccactttatttgctcctccatgaagagcaattttcccatctgttagagttttatcatcagattgcagcaattcattcacttcttcaggctccatttctaattctagctctctatttccaccgcatctgcagttacttccttcactgaagtcttgaacccctcaaagtcatccatgagggttggaatcaacttcttccaaattcttattaatgttgatattttcactttctcccatgagtcacaaatattcttaatggcgtcagcatggtgaatccttttcagaagattttcagttgacttttcccagatccgtcagaggaatcactgttttatggcagctgaagccttaaatattgtatttctgttttttgttgtgtgttttttttttttttttgagagggagtctcgctctgtcgcccaggctggagtgcaatggcacgatctccactcactgcacctccgcttcccgggttcacaccattctcctgcctcaccctcccgagtagctgggattacaggtgcctgccaccacgcccggctatttttttgtatttttagttgagacggagtttcacggtgttaaccaggatggtctccatctcctgacctcgtgatccgcctgcctcggcctcccaaagtgctgggattacaggcgtgagccaccgcgcccggccacaaattgtatttcttaagtactaggacttgaaagttgaaattactccttgatccacaggcttcagaatggatgttgggttagccagcatgaaaacaacattaatatctttgtatatgtctatcagagctcttgggtgactaggtacattgtcaatgagcacgactagtttgaagggaatcttttttttttttttctcagcactatatctcaacagtgggcttaaaatattcaataaaccaggctgtaaacagatgttctgtcaaccaggcttagttttcccatggatagaacacaggcagagtcgatttagcataattcttaaagaccctaggattttcataacgataaatgaatgaacaatggcttgaacttaagtcactagctgtattggcccctaacaagagattcaacaggtccttggaagtttgaaccctgccctttacatctcctctctagctataaaagtctagatggcatcttcttgcaatagaaaactgtttcatctactttaaattctattttttagtgtagtcaattccatcaatgatcttagcttgatcttttttttttttttttttttttttttgagacagggtcttgctctgtcgcccaggctgtgtagtggcgcgatctcggctcagtgcaagctctgcctcccgggttcacaccgttctcctgcctcagcctcccgagtagctgggactacaggcgccggccaccacgcccggctaattttttgtacttttagtagagacagggtttcaccgtgttagccaggatgatctcgatctcctgacctcgtgatctgcccgcctcggcctcccaaagtggtgggattacaggcgtgagccacctcgcccggcccttagcttgatcttctggataacatgctgcagcttctacatcagcacttgctgctccaccttgtatttttatgttataaagatggcttcttcccttaagcctcatgaactaacccctgccagcttcaaactcttcttctgcaccttcctcacctctgtcagccttcattgaattgaggcatgttagatctttgctctggcttgggctttggcttaagggagtattgtggttggctttgtcttctatccaggccaacaaaatatttctccataacatgagtaaggctgtttagctttcttatcatttgtgagtccactagcgtagtactttagatttttttcaggaactctctcttcacatttaccacttggctgtttgttgcaataggcttctgttttagcctatcttggttttgtcatgccttcctcactaagcttcatcatgtttagcttttgatttaatgtgggagatgtgtgactcttcctttaacatgaacacctagagaccattgtaggattatgatttggcctaattttaatattattgtgtctcacagaataaggaagccaaagagggagagagatgagggtacggccagtcagtggagcaatcagaacacacatttatcaattaagttcactgtcttaggggcacagtttgtggttctccaaaacagttacaatagtaccatcaaagattactgatcacagatcaccatagcaaatttaataataatgcaaagtttaaaatattgagagaattaccaaaaagtcagagagacaggacatgggcaactgttgttgaaaaaatggtgctgttagattgcttaatgcaggattgctacaaaccttcaatttgtgaaaaaaaaaaagaaaagaaaaaagaaaaacactatctttcaagcatggcaaagtaagacacaataaaacaggtatgcctatatttaaatatgaagaaatagttttatcagtagatgtttctagtagatgtttatcagtgggtgtttatcagtagatgtttcttgattaatattttcaatgctttgcacattttaaacatttaaatatttttacttaatggtctataatataccctcgttatattatcttatattttcataaaattatataacatttcattgtgctgggtttaagtgtaaaaccactattggactttagttttatgttgctttcctagaatacatcaaataagcttcagggtacatgatttggccagattatatctagagcatgtgtgtggatgtgtgtgtgtgtgtcttaatctatgtcgtgatgggtgttttctttatttattaagcatacaacatgataaaaggttgcttatttaagatgaacttttatctgttgatagctgaactcccaggaacaacaacaaaaaaatgaattgagcttttaagaaattgttccaatgaaaatggctctatttaaattattaatcttaaggagctgtgtaatagtcacatttctttgttgtggctatcctgtcttggcattatattgattcaataaacacattcttctctgttgaatttgcaaataactttctcatatgcatgtagaataagaattttttgttaaatctctttctcattagaacaattagtttagagttaaattagccttgcttattaaaagctacacataaggaaaatgaatattttaatcacttagcagtaattatgtaagagctgttacaaattctaagcttattcctatgatctgtttctagatggacagctgactagaaaacgaatgacacagcttttctgtactctttcagaattatcatcttcaatgggcctcaaaattgcactcttagttaatagcctcccattactacaaaatcatttttccctcttttgggatagagttgaaattaacagcaactcttgtaggcatattctctcttaataatagttacagagattgaaaattatatctattactatcatcaaatctcttatctaaattgatacttcagaatttctgtacattagaattacagggtttgtctcagtgttcaccaatagaatccccgaaggttaacttaattatggatttcaaatgtttaaggatagaggtcagctattttctacctagagtgaaaaagaatggtaggaattgaacagaaatggaagcaagatactgttattagatagcgagaaaaagtgcctgtctatgagtattgttgcaaagagtaacattttattgcacagtatgttcctggaaagatttcattaagaatgatccttcctccttcgttagtattatatgttcaataaactcaaaacagggagagaaatatcacatatctggagactttgttgaacattaaagcaaactgatctgaggccaaaacataaaaaacagttaacaatgcttttattacaagcttcctgttttcaagtttacacctacattgattgcaaactatagatacatatatatatacatgtatacataaatatatacacatatatatttcaaactgtgtactactttctgagctttacatatatgtagatataatggttatgctatttaatagatacatcgaagtggtgccatttgtttacttaatgaattaatagataaattctgatttgcctagtcctgtggatattacgggctcatggatacatcataaaaggatttatattatttagtaatgcttacttaataaagaaaattaaaaatatatggtaaggagttgttgggtaaaaaatgaaatgtgtgaaagtggtagtcatactggggtttattataaaacttctgtgatgttttagaattgtaacatttgttattataattatttcagattgcacctacatctgacaatgactttggacgctataattgcacagccactaatcatataggaacaagatttcaagaatatattcttgctttggctggtaagtatagcacaataatttttgagatcgcacacaatatttctgagagcaaatgaaaatttaagttgataaagtggtctcatttacatgtgggatttaaaacaatggatctcttggagatatcaggtagactgtggttaccagaggcttggtagtatattgggaaggagggaatgaagaggggttactcagggagcataaaactacagttgattacaaagaataagatatgctgttcagtggtacggtagggctataatagttcacaataagttattgcatatttcaaagtagaagaatatatttggaatgctccaagcacaaagaaatgacaattgtatgaaagaacagacatgccagttactcagatttgatcattatatattgtctgcttatattaaatagtcacatgttccctgtaaatatgtacaacaattttgcatgcataaaaattttccaaaaccttagactttagcgtgtctataacaaaaatatgaacttccaaaaagtgggtgtcatgtaattttaaatgttagcaaagaatatattttacatttttataggtaacaatacagattgctttttataaagaatgaatcacttttaaaaacttgaaaccattgtatctgctatacagtgagcatgtacaatgtatttactcatcaggattgattttaaaacctgattctaatccctccaacttaaaagtgagatatttgtgaaagaaatagggaactttttttttttttttttttttggatgttaggaacggtcatggttttttttttcgatttttttttattattatactttaagttttagggtacatgtacacaatttgcaggttagttacatatgtatacacgtgccatgctggtgtgctgcacccattaactcgtcatttagcattaggtatatctcctaatgctatccctcctccctccccccaccccacaatagtccctggagtgtgatgctccccttcctgtgtccatgtgttctcattgttcagttcccacctatgagtgagaacaggcggtgtttggttttttgtccttgtgatagtttgctgagaatgatggtttccagtttcatccatgtccctacagaggacatgaactcttcattttttatggctgcatagtattccatggtgtatatgtgccacattttcttaatccagtctatcattgctggacacttgggttggttccaagtctttgctattgtgaatagtgccgcgataaacatacgcgtgcatgtgtctttatagcagcatgatttataatcctttgggtatatacccagtaatgggatggctgggtcaaatggtatttctagttctagatccctgaggaatcgtcacactgacttccacaatggttgaactagtttacagtcccaccaacagtgtaaaagtgttcctatttctccacatcctctccagcacctgttgtttcctgacttttaaaaaattaaattatatttcaagtaaagagagaatcctgatgaaaaaattaaaaagcaaaacactctgagaaaaaatgaactataataatatattttaaacttttagacttgaaagtacaaagagctatcttacttctgaaggaaaatagaaaattgaaggttacataaatttgttgaaaatattttattttgtatgtatatgttaatattctagttttacctctaaaacttaaagatatagaaataacaacatatagaataaaaaattcatacaaaccagaaagccagatattgtttacttatttataaaatttgccattatgttttacaagactgataaggaatcctaaaatacattttaaaaaatagtttatgtagctcaaatggaaaaaatgtgatttacagtcttctaagactaggtaaagtaatatcagaaaattattgtaatattatattttaacagacttaaaagcatctgtaaagaaattttataaccttttcaggtagagattttatttataactttaattttatattaagttcagaaaaatgttcatttttactgctgtataaatatattctaaatattaatgtcattgatcgtaaaggccaagaagggaaatttttaagctaataatgtcaaattattatgtaacttagagaacctgctattctccaattcaggttttactgcattgatagagaagggagaaaagagattacatggaaggaattgatggaagaaggcagggagaaaaaaaatcaagataagtgagtttagaaatgtgaagagactgttatacaagcaaattaaattataagaaaatgaagtgtgctaattctcaccaaaatgcatagataataaattgaagaatcaactgtactaataagaaacattcactactcaaattaattccaagcctttggaaattatgcaacttttctttaaattagtatataattttataaataattagatataggatcaatatatgtatatataatgttattaatattgatccagtattgtatattgccatttcgtaaatgatgtgtttttcgattaggtacaacttaataaatgaccagaatttttaggagggtgtattaatatttggtatttaaaacattatgttgattaggtttaaataattccatgaacttcacaggtagtatttaatgtgcatgtacctttgtatctcacaatacttactgcaatattgttcattgaaaaatatatttgattcctatccttctagtgactatattaaattactgagttttcttctgtccaaacataataaaaattaaagtttttcatcaaagctgagttagaaaatattggaaattttttgaatatttttcagcaattttcctaatattccaaattttatacaattccaggctaagaatttgttttagaaaaaggtggattcagttgaaattgtaatgaagatataaaaatgattcagacagtcagccttagatgggaaacatgcatttaaatatcaacatttataaatatgctttattttatggtactcttatttaatactaatatttggtagaaaacaatctgtcctgcagaatcctaacactgaaactatactgtgattttaaataagatgtaagacatttattatataaaaaattaaatatttcctaatatatgaggataccacagtttaagatttcattggcctatttgccttgtaaaaggtcaagatcatttggcatatggtattttacagtgtaagagaataccttacttccaaagggaattaattagagccaaaatgtagtgtgaaatttttgtacacattcagtggtaatataggaaacaattactttttcagcattcagaaacattttttccttttttcctcccatttgtcctcctttccttcttttttccttgcattttccctttttaataacttagccctacatcggaatgaggtaggcatctgtgtaggagtagggtgaagcacagaagcctggcatgggatgtgaaagcctgagcagagtgaatggagtggaaggagtgttgcaggggtccagtgttgagtgttgggatccagagagggtaaaaagagtgcccacttgccaagacagaaacagcaacccaaacaggcttgttggaggccattcacctaagtgaaacaactcaaaaacagaaattcaaatactgcatgttctcacttgtaagtgggagcttaacagtgtgtacacacatggaaaaatagacactggagactcccaaaggtgggaggctgggagagaggggaagattgaaacattacttgttggatgcaatgttcaatattctagtgatggatacactaaaagcccaaactttgctagtacataatatgtgattgtaagaaaaccccctacacctataaaaataatataaaaatgaaatatttttgaaatggaagtaaaatgtatatgtgtttggtttaagtcagttaaccctaagcaaggactttccattaaaccctgacttcctattaatgagcaggagttgacgtagtcttcttttacctatctcctctgtttttagaacattggggggaaaaagtaatctttctatgttgttacagaaatatgaaatatttcacatatgtgcttgataattttgttttcttaacttttaatccaaatattaactagaaatataagacagacaaatacgtatatattttaagacttcaccataaagttggtttttaaaatgtacctcctaggtgttgatcctgctttctagtaggaagcattctctatttggattgaagtacatatcttgaatcaaattaaagttgtacagcatgtaaggctaaataaaagtttgactatatagtgttatttcttccttacaattttctacttccaaaagatgattatctgacaaggcattctgtatatttatatgcatatttattatttcttttcttaaaaaatcattaccctacattttaaatattattatcaagtaatttcatttatatatttttaaatttcttaatttgtttcatcattgttatatttttaactgttgaacttttttatattaaaccttaaccctaaataaaataatcacacctttgtttcattaattgatgcaggtttctgataaagtcaccttctcttgggcaattttatgggagggacttggctgttagctgtcatcaggtagtatgtccagcccctggggaatgagagcctcagctctttaagagtttctgtgcagtcattccaagaggtacctggtaacagtattgtgacaactaagtgagttaatgcattcaagcacccagcacatgacaagtactcaacaaatattaggtaggtattattatggcctaattatagttcatattggtcacttttcttttggatagaagtcagtaccttgatacctctttagttattatacatcaatctagacatcaaggaccaaggcttagtaaaatgagataatgaccttacttattctgaacattatacttctattaaataatgttaaattcatttgacttttgttatttttttccatttaggagcttgtactaccaattttttacacaaactgctattaagggaggtctctgatactgtgcttcacaattgattttttttaacctcagttcaggactctatacttacccctattaaatctcatcttgtcagttttgactcattttttaacctactgaaaccctgtcaaattcaatattttagctctttttttcaggattgatttaagtcacaagtacaatatcatgaagcactcatctgtattttcaccagagtcaggattagcctgtataagtcatccttgagaacagagattggcttacaggttaaactggatcaattgaatagaattctaagatatggaattatggccgatctactggtctgtgtacctagattttatcttagccagacctttgctccataacacttgaaagcatgttaaaattagttcatttggtatcacactttcttcacctaaatataacggcaggattctttaacataatcagttttatgatctagcctggacaagtctacatcttgatttttcaaagaactcattaagcaaacagtgatattcagaaactattcataatatattcttggttttctcattctcatattgctatgaaggaaaggaaatcaggataacttgacattattttcagagaatccatgtttgcatcaattcctaatcactttttaattcattcactcaaaaaatataatgaatttctagtaggtaccacacattgttctagatcttgggaatctgaaggtaaataatacatggcatctggtctttacacataagttggagttcaaaagatataaggttgctgtagaagtgtgaatcaaaggtttgggagaacaaaaatgaattctgattggagttcttggaaaaggctttcaaaaggtgtcaacttttgaattgagtctgaaagagggagtagaaacaggtccagggaagatgaaagggaaagactcaaagaaacatcaaggttacacttgtacataggcactatgctctgaaaggatgggactgttaatgagtaaggcatttaatggaagactggaagggtatattgtatgagaagaccagtgttggtaatgtgcttagagaggtagagagaagttaagttatagatcttaaaaacattcatcatgtttgcagggcaaggtggtttacgcctgtaataccagcactttgggaagccgaggcgggtggatcatctaaggtcaggagtctgagaccagcctggccaacatggtgaaaccccatctctactagaaatacaaaaaaatattagccgggtgtggtgatgggtgcctgtaatcccagctactcgggaggctgaggcaggagaattgcttgaatccaggaggcggaagttgcagtgagctgagatcacaccattacactctagcctgggcgacaaaagcgggactcttcctcctccaaaaaaaaaaaaaaaaaaaaaaaaaaaattcatcatgtttacattctgtctggtatacaacgagggaaatttggagatttttattcataaagcaacatgattcatgtatcttagaaaattatcttggtggtgttctagagacagatttcaacatagaataaaatgtacgtatgtaactaacctgcacgttgtgtacatgtaccctaaaatttaaagtataataaaaaaaagtgacacaactgccaatttccaaatttctccaaatatctaaaatatataaatttaaactcaaacactctaatgttcactcttcaaaatttttttctggctcataatagctctaaattgaatgtttgaatggttcattgtgttatatttgatttgcttatgacccattgttgaaatgcccagtactaaagataagtgaatctgggtgtccgtgagttgtgagaagagtcaagacatactcatatttggaggaaataatttccattgatatcttggtagtgaatgaacactgctatggagaatattagaggtaaaaatgggaaaaccaaggtcagatctctggacaacttcagtttaattcatggatgtataagaacaaaaaaaaaatgaaagaaatttttcagggagatagtgtatctattttgaaggataaatgtaaatataattggtcaaatattgtgaaaaagtctaaataataatttggatttggcaattggtaaaaactaggtgagtagtgaaatgagaaggaatttacagcatttcagatgtattgcaggttggctatataatattagattaagctcacaatgtttcttgctctattctggatgctatagcaaaatatattagactctgtaatgtattaccaacataaatatattgcttacagttctaggggctgggaaattcaagatcaaggcaccatcagatttggtttttggtgtaggtccaataaccaaattgtttttatagatggtgccttctgtgtgtccttatatggtgaaaggggcaaacatacttcattcagcctcttttatggaggcactaatcttattctcgagggtggatgtctcatgactttatcacatcccaaaagaccccacctcttaataatatattcaacatataaaatgtggagggaaaccagcattcaaaccacagcatgatcgaaacaagaaaaatgtatataaaaccttatagaagtaaggtagccactcaaaacagaaatagatagaacctatctcagcatagaagtccttgagttgtaagcaattatggtgacactgcatgtaacagtgttactggatctaggaaattcagttacttatgttccaattcttttagtatttgagacttttaccagatagaaattgatgaggaaatcaagcagaaactgatttatgataaagaacaagctggttatgaaatcactggaaaggcagagaaaagaccaaagacagccaccaatattctaccttcaaggtcacaaaatagcataagcgtggtccacatgtgaagtctgcaatgactaactagaggtcaggaagccctcctgccaagttacccctcagctaataatcacagccacaccactcctgaaactggatgaataggctgtggaatggggagttcggatgctactctcattcatatctgcagagcctcttgtccatgcgcacctcctgagaaaagtgggactgacattcacacccctccagcattctaaactgtatacatgtacctttcattctaggttcactacatgaaacttagaaccatagcagcaagtcagtctaggaaatgaagattttagcctgcaatttcttatgataaacaggagtgtcttaaatcgtataatttgactctgagtgttaatagaaaaatatctaggatagggtttaaaacaccattctgaaataatattcatgctagcacttccttttaaaagagagtttacaaaaatcaaactcttcagattcctggatctaagtttagcaacaccacagcctcatatgtgtaaaaagagcacagttagtgtctatgaactatgcgtgctgggagagcaaattctcagaaataaagatgttggggcagaaattagaaataatctattgaaacagagtaacaaagaacaaaagaagagtatgtttcctgagaagagagtgggattgaaaacaaaaaaaagagatctttataattcacagtaataagactgagaagaaagaataaaattccaaagaagaagaaacaggaaaagagctatctgataaagaaaaattttggagaagacaaaaggaaaagacatgtcattcagagatgaagggtttagtcttggaaaataagaagatagagttccattatcagttaatcaagacgtgatagctgtccaagacattggttacattgaagcattactcacaatagccaagatagccaagatataaagatgtacagcatgatctcacttatatgtggaattctaaaacagtgaaagtcatagaaacagagaaaagtggtagttgccaggggctggggagtgggagaaatgggaagatgttggacaaagattaaaaagtttcagttatgcaagatgaatagcttctgggagtttaataaacacaagttcattcagtgactccagagattgtatccatctgactcctaggtcatggcaccaactccttgccattacacacctcaaaaaattctgagctgaacatcgatattgtatccattacctgccatttgactaaaacattgatacatgtcaatggatacaaaagtatgtaatagaaggaggctgatgatcagggagggatagaaaaattacaatgactgacatttgctaagagttttaacgtattctagggtttaagtgctcaacattacttgatatttccaacaacactcgccgtcgtactattctaatctccatttgagagagaaaactactgcgatgtgaaaagattaagtgctgtagttgacaaaagtggcaaggccaggtcttgaatccatggactctcatgacatatccagtctcttaatccagcactttgccagcactgttagaggtgaagagaaagggtaattaaacaaataagtatttgcacaattgcttttctattcatttattcattcattgagtggtgaatggtattcatcaatttttgggatataagacactagaaaatagtttagaaaaatatggtaacaatgaaggaataatagtgtgtaaaactgagcatccgatatgagcctcagttgaaatattgggctgtgtctgaaagtcttttagagtagaccagtatctttgcatacacccagtgcattagataatccaggatcctgaacatgaggctgaaaagatcgagactaatgttgtaatgaaaatgaagctcctgaataccattgcagggaagtgatgtgatcagagtggttctttacaaagattgattttgcatttgcatgcctcgtgcattgatgtttttgttagacatccaatagaaaaggaagccaagagccactaatggcatcacaggaaaagtcagatagggccagggcttgggaggtaacagaggaaatgggaaggaagaaatagatacaagaattataatgcaggaattattaaaatagtgttttgactgattgtgatgtataagatagataggaatcaagggtgaagacaattacagattacagaaaaatccagaaagtgaagagaagaattagagatgttgattctaggcacatctgacactattcacttagatatgttctgtatctttgtatataatttttcattactgaaatatttaattcatcaagtatttcctgagaacttactatattccagtcactttgttctatgttacatgtatctatctgtatgcatgtataaatacatgtgtgcgaatgtgtgtttgtaaagtgttttatctctttcctcaagaaacttacaatttagtagtcagttgacagttggacttataaaaccaaaatgtaaaaaatatttagaaagagaatgaaagtcataagcatgcttttgctttaaaagaagtaatagaaataagaggccagtggaaaataatatgaaaaaaaggctacagtaagtgtcagcagatctgaaaacggactatataactagaagagactaggcactggcccatgttttgatgatggtggctttgtgctgaaagaaaaaacaaaggctcttctttctctgcaggtgcaccatgtcagggtgcacagttggtgaatggtgcaacctctgcagtcagagtaaaaacaaacaatcatgtttataccatatattcaaagatggaagcccaagaggatagataatatctccctctcatcccccagaatatactaccttcacttttgacacatgtccccaaactggagtgtaatgcctatgacatccaacttagacctaatgtacattagggagtcagccactcagcacagattgaagaattggcattttttaaggggatccgtgtgcatttgtttgcctttctcctatactttggatcaaacttataagtaaattttggatcaaacctacagctgaaaagacatgcagattaacctggagattaaggaaacatgaaaattattagaatatttgaaggccaaaacattatttagatatcttaaaatttgtatttccagatatgattttaatagttctaagacttttggatgcatcagaattctacacgtgtgtttgaaccttagagttgtaacatcatgtacttcataggctctctaaataattcacagtttctaattagagttgaaatatacactgtggcatttctttacagtattcacatgtgaaaggccgtaaagctgtgctcctggctcttgctcagtactatttataaggcatatttttatatgacctacagtgaccttttttaactctagcaaaaagagtacatttgacttttgactgccatatgagattttttatttgtatttatttatttttgagatagagtctctctctgttgcccaggctggatttgcagggacatgatctcaactcactgcaacttctacctcctgggttcaaccaattctcctgcttcagcctcccaagcagctggaatcacaggcacactccactacacccggctgttttttttatttttgtggaaacagggtttcaccatgttgaccaggctggtctcaaactcctgacctcaagtaatccgcccacctcagcttccaaagtgcagtgattacagttgtaagccatcatgcccagccccaattttatgtaaatgactgatataagaattgaaattcacatgtactgcatatttatcagtcaagtttatatatattagcccattctcacactgctatgaagaaatatctgagactggataatttataaaggacagaaatttaattgactcacagttctgcattcctggggaggcctcaggaaacttacaattatgctgaaaggcaaaggagaagcaggcaccttcacagggcggcagaacagagtgagtgccagcaggggaaatgccagacctttataaaaacgggaagagccagaccatttataaaacaatcttatctcatgagacttattcattatcatgagaacagcatggagaaaccgcccccatgattcagttacctccacttggttccacccttgacacatggggattatgggaattaaaaatcaaggtgaggccaggcactgtggctcactcctgtaatcccagcactttgggaggccaaggtgggcagatcacgaggttaaaagattgagaccatcctggccaacatggtgaaaccctatctctactaaaaatacaaaaattagctgggcgtggtggtgcgcacctgtagtcccagctactctggaggctgaagcaggagaatggcatgaacccaggggaggctgaggttgcagtgagctgagatcacgccactgcactccagcctggccagaaaacgaaactccgtctcaaaaaaaaaaaaaaaaaaaaaaaaattcaaggtgagatttgtgtggggacacagagccaaaccatataatatatgtttgtgtgtgtgtgtgtgtgtgtgtatacatatatatatattccctctctgaaaaaaaattatttttttatccaaagtttaagattatttcagatgtgataggaacaaaagaggaagagattcatagagaaattaatgttaatgtgtctctaaatcttgatgtttctggagtagagttttcaaaaatccctcactgggattttttttttttctagttctgcgtgctctgcctttgagataattcttccgaaataattttttatattagacactaaattaaatgtccacctaagataccttattgaacttgaaataatttaagtagtggatggattaaaataaaacacacaagaagaattttatagctattttgaaaatatgggaatagtattttaatatctcaactaaaggtttaatttaattggataatatataaatgaaattagacctaatagtttacagtcttatttagttcataatactgacatttttctcaaaacttagcacttacctacaatttaggaatataattgtggtgaatgcaaagaaaatacattttgtattttcacaaggcaccattatttatggtgatggttgaataattgatttatgtattctaacgttttaactaccctctttatctctcttttatttttttttcttaaacacacacgagattgttttcctggacctcaataaaatgtttatatcgtatagaaaatgcagaagtaacatattccctcaataattaaagtgtgattttaattttactgtctattttctgaggtaataaaagttgactcatgtatactttcttgtaatttcaaaagaacattcaggtgtttcaggaagttctgtaactcgaacatattaagtgatacaggtagcagttttccttcactcctagttctcataacaccataagccttaataatggccattcccattcccttggttatgttttctttatatttctttgtccatagacgtgccatccagtccctatggagtgaagatcatagagctgtcgcagaccacggccaaggtttccttcaacaaaccggactcccatggaggtgtacctattcatcactatcaggtggatgtcaaagaagtagcgtcagaaatctggaaaattgtacgctcccatggagttcaaagtgagtcaacaatttcaaaatgtgttggttaattcaagctgatcttcagtatacctgtatgattggctttttcggtttcctccaacattttcttttcttttaataaaatggtgttgggaagatattttctgtgccccattcttcttgataataactcgaatacagagtgaatagtttccatcttcagtaaaaatgaaagagcttagtagaatcagcagagttcaattctggaggaagaagtcactttaaaaaaattcgttggtggaaaggcaattgctcacatactagatatgatggctggattttatgaaatgtatgctcatgtttcatttattaatatttctctcaagaataggtgtgaaaatgatactgcaaaatgtagttaccttctatacttatgaagccatctctaaaaatctgtagaattttatatatttgtttactttttgtatttttatatttttttacttttatatttctattaaaaatcaaaataatttacagagcttcttttcacttacgtaaaatttcatcgtcttatgaaaatgtagtttgttttctcattaggaggagacaaaactaaagcaggaaataataagaattaccagcgttggcctctgttgtttaagacacagaaccatactgagtgttccaaaagggaagcataaaatagtgaggaaattaatgttccataggtctgttctatgaggatcctaccttgaccctaacacatatggtgtaggggttcagtaaaaagcaagagccttcctgagaaagaaagagggaaccaattctagtgaacatagagagaaagcaaatgaaatcatcctggtctcatctgtgttgaccctactttatcagtttgcactgagcataactatgggtttttgatagaagtatcagaaacattaatcagtcatctatcatgtaccatatacttcaaataatgttctcaaactgatgagctcatattatttattttaattatgaaatacttggattatattatctgtgcacattgtgtggtttaggagagatttataaagacagtgccccccaaaaacaatgagtgagacgaaggactatagtttttttttaaaaaattattaacctggatgcaggaatattgtgctactttaaattttgttttgttttattttattaaaagagagaaagggccaggagcggtggctcatgcttgtaatcccagcacttttggaggctgaggcaggtggatcatgaggtcaggagaccgagaccatcctggctaacatggcgaaaccctgtctctactaaaagtacaaaaaaaaaattagacggatgtggtggcaggcacctgtagacccagctactcgggaggctgaggcaggagaatggcgtgaacctgggaggtggagcttgcagtgagccgagatcgcaccactgcactccagcctgggcgacagagcaagactccatctcaataaaataaaataaaataaaataaaataaaataaaataaaataaaataaaataaaaataaaagagagaaaaaggagggtggtaggtgaaaaacagaaggaaaaaaggcattatttcctaaactgcataaaactcagtgtttgtgctcaagcacaagcacacagaaaattaatattaagtctgaatattatagaaattgaacacggcacaaaagtgctgctgcaccctagccctgccaaacccaggaaaaggttaataggctccctccagacttcttgcaaaggtgcagcacgatggagaatttatagtgcccttgatctggccaagttgatcaaggtaaaaatcctgacattttatcttacctgtccatctgtcagaggcagatcactatgtttataaaactgaaatataataacaaagcacattcgttactttgaaatgagaaataactgtcacagaaattagaacattcagagtctatataagtacatactttacctgttggtatattatgaagatacaaaatgagagtcagaaacttgtttggtgagtctagaatatgaactagggaagctgcgtgcatagaatgtttagtggcctcagactgggacagttaaaagcttgcgaatgagaataaaatactcaaaagtcttgtggctagggatttctcactttgatttgaggaaaatgacagcattagtacttttttctgtttccattgttgattcatcttccataggtatgttaatgagtaccttaaaatcaagttacagttatgtaatcaaaccactgtatgatctcaactcagtgcagtataaacatgaattttaaatttgactactacattaagctcttctttttgattctccctttcagttatttaataatatatttggcagacactgtagatatattatcatcttccagtattagaaaaaaaaagttcaatattgttggtatagtggtgagcatcgctgccttccagaataaacagttcagccatgcacagtttaaaacttataataatgtttaattttgcattcacattgtctctggcctccatgaaagataaacctcaacctggggagcttaatggtgaaatgaactgcatcttgtcttgggaaggtgaaagagatcaaatacctcatgtttctggtgctgttgacctcattgggctgtcgctgtcacctgccctctgtgggacaggcatctaagtacctgccccttggggatgtgtgactggagtgcaagcacaccagaaggagatagaatatttcatttttggagatagaatattcctttttggagacagaatattcatcatggggtgctgcttagcttgagctctttatacctttcctcaccctttacttcagcaggatttcttttaagtgtgaatgtcacccactaacattatgcaatttccacttgaccaagagaaatgctccacattctcacttagctaagatgtaagaaactgcatttctttgcagctgatctctttctcattttctttctcctcattttaaagagacatagtagatcaatcctctgtaaaagcagaagtccaaatttccaaattgcgatgcaaatatcatatctctcctctcatctcttgtgccaaacaattcagtgggttctgttcacctcttggacttaccttcacttactgggagggaagcatcactgcgctttcttctgggtggaagacttactagtttcatcagtggattttttcctccgcctagttttctgcttacattgcggggagtgggaaggacagggggcatgggagttaattctcaaggcttgggttgcaaacccagtttaacatcttcttctttaactctgcaggaggtgcctgacctcttctcaaatcttaggtatttaatgtttttttcttctctctatgaattgtctcagttgaaaattacagcactacagaaacatgcccgctacatgtttccatacagtttcttatggctgtgctggtactattctttctacttgagattaagagtacctgtgtaatgggatttatttattgctgcatttacactttatatctcaaatggtgatgtgatctcactttatatataaaatcatgttttggggaaaaccaagtttttaaggatttcttagtgtagactccatatttgtatagcaggcatgaatgtaaatatgtaactgtaagatcaatataaatgcaatgagtacccagggaaagaagctgagtaattccattgggaccacccctaacgttgtaagatatgtgtgtctggcacttattctttctttagccaagagatgtattattttgtaaagacatagtaaagatattcatcagaataacatgatttttgctgacagaaatatgaaatgtgatgttaatagtcataattatatttactgtaaattgacaggaatgatttgattattgaaacatatgacatagttttgactgaaacgttctactttaaccaaacatactttcattttgtttctgtgatttcaatgagtcactatgtcctttaaagtagcatttccaccttactcacattttcccatctgactgacttaggtccttttaatacttcccagaattattgttttaccctgaaccacttacaacatactttcacaatcagtccttgaaagtgctctcacagtaaaattccctcttcctccagaatgagtgactgccaagtggcactgtatttcagatgttatattgtattgtgcatattttaatatataacatattatattttatggtacttctcttacattataactctgaaggattttttctcctagtttataaactccatgagtggacctcgtatgccttgtttatgtcattgtttcaagtaccaaaagcatattagggtagagggaatactgaaatttggtggaggtaggagaatggaaaggattattttatagcacctctgactgggtcttaagtgaatccattatacatccccttccaataagtatgtgtctacagaagcaactttttttttcttttttttttttgagacagaatcttgctcttgtccaggctagaggacagtggcgtgatctcagctcactgcaacctccgcctgccgggttcaagcgattctcgtgcctcagcctccctagtagctgagattacaggtgtgcaccaccacacctggctaatttttttttttatttttgtattttttagtaaaaatgtggttttgccatgttacccaggctggtttcaaactcctgagctcaggcaatctacctgcctcatcctcccaaagtgctgggattacaggcataaaccaccacgcctcgccagaagcaacttttaaatggaaactaaggttcaaagtgtttatgagagattaacacacttttgaaaagagtgaagatgaagcagaattcagccaatggagtgagctacagttcaggctccagtggtatgccgggagttgtcgttgttgttgttattgttgtttttaaggtacacaactctgcactgcatataacattaccttgatcaagaaaccagaagactttactgtaattcttccactggggcatgccagaaattccacacaacatttcttccaacctctattgtattgacgaatatcagcctcaccagatcgatcatgtgagcaatttatactatgtgagcaattcaatggttatgaattttcaaagaagtatttatccaatcccccaccaagattctgtgtgtgtgtgtgtgtgtgtgtgtgtttctagcacacccttttatttcattctaaggatattaacggtcccggtttatgcagggatccccacttcatctccccattttgaatctttttttaacccactgaggccattcaaaaccaatcttgtacatcagagacccatgcaaaagctctgagaatctgagtaccagaaaactgccacaatttatagaaaaaacaattatatggctgctcctctagctcctggtctttccacacacttcatttttgatgtttcagagtttgctttccttttctgtgagataatcagtggatttgaaaagattttcgaaaatgatatgcataatttctaggtgtacttagaaggcttgtttttctggctatctaggagaagatattgttgaaaattagaatacatatttaaagcacatattatatatatatatatttgaatactaaggaaaagcttgtttgtgccttcgttttgtaaatcacaggttgtgttaatcatatatcttaaagtttaagaattctatgtaagcacaattatactcattctctgaagcatttgttagaagatagatttaggtttatctctgaaaatgcaggtacatatggtctcaacatttcagctatcttttccctctgagcagctttatttattctaatttatgtgagtttaatgtttagttacttttccttggtagtaaatatatatgattttgaatacacttattgatgtgtccaattctaattgctgatgtcaccacccagaagtaattatcagctcttggtggactgcaatgctatttaagatgaatattgtagcataaatactgtcctgttagtagattctaatcttaaataaatcattaacaaattcttattaattttaccttctcactgtgcacctggtcctaggtttaaggtacaatggaagccaggcctattattatattctttttgaaggtttagctgaagccgtactaattatcccaaccaatgatgtgacatgaaactaattttcaaactgtaaggaattgtgaaccagtcacatatcaacaactcgaactatagagatatagaatgtgagtcagtgtgactcttcattttgagtgagaaacatgtatcacagctgtagcaagactttttggttggggaagctacaggatgtattcattgccaaatcatataatattttgtgggtttcatacacctcactggccacttaatgaagagaaaatactaatcttacaaacagctactctttttttttcagttttcttaatacaaatgacaatatcaatattttaaaatgttaggccaggcatggtggctcacgcttgtgaaaccaacattttgggaaggtacggagggagaattgttcaaagccgggagttcagggtcagtctgggcaacaaagcaagaccccgtctctctaaaaaaattgttttttattagttgggtgtgaaggaatgggccagtagtctcagctactcaggaggctgaggcagaagaatcacttgagcccaagagtttaaggctgcagagaactatgactgtgccactgaactccaacctgggcaacacaacaagatactgtctctaaaaaaataaataaataaaaataagtaagtacttcctttttttttttttgatacagagtcttgctctgtcccccaaggctgcattgcagcggcacaatcatagctcactacaacctccgcctcccgggttcaagcaattctcctgcctcagcctcctgagtagctgggattacaggtgcgcgccatcacatctggctaatttttgtatttttagtagagatggggtttcaccatgttggccaggctggtctggaactcctgacctcaggtgatccaatcgccttagcctccctcagcctcccaaagtgctgggattacaggcgtgagccactgcgcccggccttcaggtttaattttagcaaaagtttttattttaatagaaatctggaggaaaaaatatttgtggtagagaaacttatttcagtttggtagaaaagtagtgctttcttgttttttatatacctttttttcctgatagggttttgaaatatagattttgatttataatcaatatgcctgttcttgataggtcagaaaactaattttgaataaaggcctgaattaaaatatagtaaagtttagtagatcagatactgaaatcttaggtgcaaatatgcaaagtaccagcaataaatatagccagcattcaaaaaacaaattattcctatttctttaaatgatatgtgttgaaatgtttttatacctatgatacacattgtcaaagaaaactactcttgcatcctaataagcagctggggatgtacaaaatgtattcatttattcaagtatagaacacgtgtatgttcattcatatactgagtcattggtttcattagtgaaaaataagaggaggctaatgaaacttcccaaatctcttaaaacagaggaactgactcatggaatatgtgtaactcctactagcctagttgtgcagtcataaagttctgcgttagggctaaagttatggtagaatttctcttagtatatttggctcaacaaactttagttcgctgctgatgtagagatttcatgcttacatatttctaacagcttgacattttaaaaaatgtgtcattaaaataaccttttacttaaaaataatttgatttttatatatgagttcaaagatggtaccaaaagtattcagacacccttcacccaacctccccttataataacataccacagtacatgtatcaaaattaatgaattatcatgggtatattagtagtaaataaactacagagtttattatgaaatgtcatttttaacagccttcctctattgtagttatctcatattgaaaataaataggcctggcacagtggctcatgcctgtaaacccagctcttagggaggccaaagtgggcagactgcttgagctcaggagttcaggaccaacctgggcaacatggcgaaacctcatattgacaaaaatacaaaaattagctgggtgtggtggcaggcgcctgtggtcccagctactctggaggctgagatgggaggatcacttgaacccaggaggcagaggttgcagtgagctgagattgcagcacggcactccagcctgggaaacagaaggaaatcctacaacagcaacaacaaaaaaaagaaaagaaaagaaaagaaaaaacagagaaggagagaaaaagaaaaaagaaaagaaaaaaatggattaataagaatgcaaacatggaaaagttcatatcatttttacctgttaaagatttcagaaattctattcaacaagtaaaagctacatgtacttaccaagcttagtaaacattttagatgaattttacttttctgtttgtttaagacaatttttaggtagaaatataagtcaagttaacaatcaaactcatttgattgactcatttaaatgactcgaattagcagggtttcaaataaaaattaatgaaattcttcataaccctgtagtcttccaaatcaaaattttcaaacatacttttctctcttgctcatcatacttcactctcaatttgtagatttttaaattctggaagtgtttctgcttcagcagtagttaatatttacatcaccttcaggtaaactttaatgcagttttcatgagaaacccatacatgtttcatgtctacaaaactaaaagacagttattattttacgaagcatggaataccaaaaacaaaaacaataccttttaagtgacatcctagtgaatctccatttgtcacgagacctcaagctttccagttctggcacaaagtgattactcataccatcacttcaaaatgatgattatcttcatttattttagttatattgaacaaaatatacatttaaaaaatctaattactaaatattctccaacaaatatatacttagtatatactattagtgatgcatgctttcaaatatttggactatatcaatgaatgaaacaaaaaattatttgcccttaaggagcttagattctaacagatggattcagatgatttttatgccttatttcgtaggtttaaaagagcaatggggaaaagggaagaagagagggattgaaaatattgagaaggttgggagacttagcaattttaagtaaggtagtgagggtaggttttattggcaaagtgatttttcagcagagactgggaaagatgaacgtggtatcctggaggaaagcctcccaggcagagttaagctgctaacaaaagtgcccttaggctggagtgggcttgtttgattaaggaacaaagaggtcagcatggttgcactagagagaaaaaatcagatggcgtaaggagatgaaatcagaaagatacgaggctaggcaaaggggtactctatgtaatgaacatgacctggcagtactgacatctcctgagggactgttagaagtgcagactcttgtatcttttctcaagtctatgaaatctagacttcattttaacaagatgacccgatatttacatacacattaaagttccagaagcactgatataacacattgtaagatcgcacaggacttcaattctttttctggtttttagaggcagtcctttggggtgttttgtgtagagtataatgacctgaaatatctaggatcactctagctactatcttgaggaaagagtgcaataaggcggaacagttcagaggcaatggtggtcttctaaatgaaagacacacagcactcaaaccaggcagttgaggagggatgggaagaagttgtcaaattctagacatattttaaaggtagtgtccagagaatttccttagatgcgtaggaacatggaggataggacatagggtggaaataaacgaaataaagaaactgaagctgattctgacattttagacctaaaatctcaactaaaagttgccaagatgggaaaaactaggtgcatcttgtttggtgagtggaaatcagccttgtgaattaagacttaaactgatgtctttaatcccgtagaaataccatgaaggcagtagaagatggctaaagagaggtctagactgtaggtacaaatttaaaagtcacttgcatttggatgcttaaagtcaggatattgtgaagtcaacagaggaataaataaatgcagagaggggaaagaaaaggcccatagactgagccattgtctggtttatttacatattagtatatattttcttaaagatgtttgctatataataatgagttacctaaagtgtgacttttctaaatttatggggaattttctacattgtgttatggcactactaaaaataataaaagaaaatattgatatgagtctatgttacttgaaatattttttaaggggagatgtacctcaaaagatattccacaagaaatgatctttctctttatcccaccctcgcccctcctacaaacactggattactttaactatacaaaaattttcctgctttctcttgtgggcatttagtgctataaattttcctctacacgcagctttaaatgtgtcccagagattttggtatgttgtgtctctgttctcaatatgcagccataaaaaaagatgagttcatgtcctttgcagggacatggatgaagctggaaaccatcattctcagtaaactatcacaaggacagaaaaccaaacattgcatgttctcactcataagtgggagttgaacaatgagaacacatggacagagggaggggaacatcacacaccggggactgccgaggggtgggagcctggggagggataacattaggagaaatacctaatgtaaatgacgagttgatgggtgcagcaaaccaacatggcacatgtatacctatgtaacaaacctgcacattgtgcacatgaaccccagaacttaaaagtataattttttttttcttttttcttcttctcttccctattgtgcttgctttctgtgttgtggaaaaatatattactgtgtatttttatgtatattagcagacatcttttataagcaatgagtaaaggattcatttggtccaatgacatgaatcaatgacaggtattgcatttttcaaatgctgtagcataccagatatgaagcttctttggataacagttctgatgggatgggtctaaatttctctttttaagtactcagtgagagatagcccttttccattatagtagaggcagttgttctgtaggaggacctatagatttctcagaggttcaaggtcattgtaaattaatttccacttatgcttcaaggtgtttatcctgcagcatttctttgaaactagttatttacaattccctggaagtaactggatttccctctatcatactactcaacttcactgttatagaaaaactttaagataatcagtatttgtactggttatcaaagggaataattctagtttttgcccattcaatgtgatattggctgtgggtttgtcataaatagctcttctttttttgagatgtgttccatcaatacctagcatttttagagtttttaacatgaagggatgttgaattttttcaaaggcctgcatctattgagattatcgtggtttttgtcaatggttctgcttatgtgatggattacgtttattgatttgtgtatgttgaaccagatttgcgtcccagagatgaagctgacttgatcatggtgggtaagtttcttgatgggttgctggattcagtttgccagtattttattgaggattttcataccgatgttcatcagggatattggcgtgaagctttctttttctgttgtgtctctgccaggttttggtatcaggatgatgctggcttaataaagtgagttagggggagtccctccgtttcaattgtttggaatcgtttcagatagaatggtaccagctcctctttgtaactctggtagaatttggctgtgaatctgtctggtcctgggctttttttttggttggtaggctattaattattgcctcaatttcagaacttgttattgttctattcagagatgtgacttcttcctggtttggtcatgggagggtgtatgtgtccaggaatttatccatttcttctagattttctagtttctttgcatagaggtgtttatagtattctctgatggtagtttgaatttctgtgggatcagtggtgacattccctttatcttttttattgtgtctacttgattcttctctcttttcttctttattagactagttagtggtctatctattttgttaatttttcaaaaaaccagctcctggattcattgattttttggagtgtttttggtgtcactgtccccttcaattcttctctgatcttagttatttcttgtcttctgctagctttgtggttagtttgctcttgcttctctagctcttttaagtgtgatgttagggtgtcgatttgagatctttctagctttctgatgtagacaattagtgttgtaaatttccctcttaacattgctttagctgtgtcctagagattctggtacttcatctcttcattctcattggtttcaaataactttttaatttttgccttaatttcattatttacccaggagtcattcaggagcagattgttgaatgtccatttaattgtgtggttttgagtgagtttcttaatcctgagttctaatttgattgcactgtggcctgagaggctgttcgctatgatttcagttattttgcatttgctgaagattgttttacttccaattacgtggtcgattttagaataaatgccatatggaactgagaagaatgaatattatgatgatttggggtgaagagttctgtagatatctattagtttcacttcatccagagctgagttaaagtcctgaatatccttgttgattttctgtcttgttgatttgtctaatattgtcattggggtgttaaagtctcccactgttattgtgtgggagtctaactctctttgtaggtctgtaagagcttgttttatgaatgtgggtgctcctgtattggatgcatatatatttagcatagttagctcttctcgttgacttgatccctttagcattatgtaaggcccttcttttgtattttttgatctttgttggtttaaagtgtgtttcatcagagactaggattacaactcctgcttttttttttcttggtaaattttcctccatccctttattttgagcctatgtgtgcctttgcacgtgagatgggtctccagaatacaacacactgatgggtcttgactctttatccactttgccagtctgtgtcttttaattggggcatttagtctgtttacatttaaggttagtattgttatgtgtgagtttgatcctgatcaagagtcatcatgatgccatcttgttattttgcaaactagttgatgcagtttcttcacagtgtcattggtctttatattttggtggtttttgcagtggctggtaccagtttttcctttccatatttagtgcttccttcaggagcttttgcagggcaggcctggtggtgacaaaatccctcaacatttgcttatctgaaaatgattttttttctccttcagttatgatgcttagtttggccgggtatgaaattctgcattgaaaatgcttttctttaagaatgatgaatattggcccccaatctcttctggcttgtagcgtttctgctgagaggtctgctgttagtctgatgggcttccccatgtaggtgacctgaccttttcctggccttaacattttttttaattttatttcaatcttggagcatctgatgattatgtgtcttggggttgaccttcttgcggagtatcttagtagtgttctctgtattttcctaaatttgcatgttggcctgtcttgctgggttagaaagttctcctggataatatcctgaagtatgttttcctgcttgtttccattctccctatcttcttcaggtactccaatcaatcataagcccagtctttttacgtagtcccatattctgtcatcactcctattccacatagtattggaagttcaggcctgtgcaatcaggcaagagaaagaaataaagagtattcaaataggaagagaggaagtcaaattgtctctgtttgcagatgctatgattctatatttggaaaaccccatcatctcagcccaaaatgcccttaatctgataagaaacttcagcagactctgaggataaaaaattaatgtggaaaagtcacatatattcctttacaccaacagtagacaagcagagagccaaatcacaaatgaattcccattcacaattgttacaaagagaataaaatgcctaggaatatagctaacaagggaatgtgaagtacctcttcaaggagaactacaaaccactctcaaggaaataagagaggacacaaagaaatggaaaaacattccattctcatggataggaagaatcaatattatgaaaatgtccatactgcccgaagtaatttctactttcaatgctattcccatcaaactaccatagacattcttcacagattagaaaaaaactactttaaatttcatagggaatcaaagaagaccctgtataaccaagacaatcctaagcaaaaagaacaaagctagaggcatcaagctacctgacttcaaaatatactacaaggccacagtagcaaaaacagcatgttactggtatcaatacagacatatagaccaatgaacagaacagagacctcagaaataacaccacacatctacaaccatttgatattctacaaacctgacaaaacaagcaatggggaaaggatatccttttcaataaatggtgctgggaaaactggctagcaatatgcaaaaaactgaaactggaccccttccttacaccttatacaaaaattacctcaagatggattaaagacttaaatgtaaaacccaaaaccatgaaaaccctagaagaaaacctaggcaatgcagttcaagacgtaggcatgggcaaaaacttcatgacgaaaagccaaaagcaattgcaacaaaagccaaatttgacaaatgggatttaactaaagagtttctgcacagcaaaataaactatcatcagagtgaacaggcaacctacagagtgggagaaaatgtttgcaatttacccatctgacaaaagtctgatatccataatttacaaggaacttaaacaaatttacaagaaaaaaacaaacaaccccatcaaaaagtgggcaaagaatatgaacagacacttcccaaagaagacatttacgtggacaaccaacttacgaataaaagcttaacatcactgatcattagagaaatgcaaatcaaaaccataatgagataccatctcacactcgccagaatgttgattattaaaaagtcaagaaacaatagatgccagagaggttgtggagtaataggaatgcttttacactgttgatgggaatgtaaattagttcaaccatcatggaagacagtatggagattcctgaaagatctagaaccagaaatataactggacccagcaatcccattactgcatatatacccaaaggaataaaaattattctaccctaaagacacatgcacacgtatgtttattgcagcactatttacaatagcaaagtcacggagccaacccaaatgcccatcaatgatagactggataaagaaattgtggtacataaacaccatggaatactatgcagccatagaaaggaatgagaacatgtcctttgcagggacatgaatgaagttggaatccatcatcctcagcaactgacacaggaacagaaaaccaaacacctcatttcttactcataagtgggagatgaacaatgagaatacatggacacagggaggggaaagatacacaccagggcctgttgagtgtgtgggggcaaaaggagggaacttagaggataggtctataggtgcagcaaaccatcatgccacatatatacctatgtaatgaacctgcacctgtatcctggaaattgaagtaaaataaataaataaataaataaataaataagtaaaataatcagtatttggtcttagctttaaactactatacagattttaaaatcttaatgagttacagtgcttttaaaatttttctactagagtattttctatgattacactatttctaacataaatgcccaaagaaaaaagactatcatttctaaatgactatatttcatatgataaaggagaaattgactataaaattcatctgactatgttaaatgaaactgcagtaaacttatgaattgcaaaaaagaagaaaagtaatccacactaattccatattttcagtgaaagaaaatttgttctgatttgcatgttgtggaaaggtttctgtatgttaaaattcaaataagaatatcttggactgtgttcattgcacccataaagagaaccatagctaaattaggatgttgtatgtaattacattcttaatgattttaaaccatgtagatcaaagtatacaggcactaagctaagagaaaaattaagcaaaataacaattttaggtaaaattacttgtctgctagaaacctcctcacttatcttaagatgaagacacaaattcatacataattctatactcagcctggtctctgctatatgttaaggagaacttctatgcaaatactttttttaatttttcaataaaattaatgagcttttctgtgcatgcataattttatgaatcaaataaatagtacaaataaatgatattaatttatgtaagaaaaatgtttgtgagtagtgagaaaacaaatatgaatatttcatgagtgttttataggagtttaatccacgggaggagaatgaaagtattcatagtgcccagaaacttaaaaaaaaaaaaattagagctcatctgactgctcaaacatacactcttaaggcaaatttaaaattcaatgtacatatgatgtttgctagaatgtagcttttaagtccctaatcccagtgaagaattcttgtgggctctcatgcacattttgagagtgaattttattgatagcgcattttagatgacatttaaatataataactataaaatttttgaaattatgccaacatatactattgtattaaacattatttaacttttggattattaaaactacttactataaacattaaatattttatctattatagtatataaatgtcctcaaaggttaaggaggggtatagagccattccattattcactcaatggcttaagatgcttatatcagcaagattctaatcttctatttcaatagtaccatcctatatggagtgatgaatgccgcagactgacatgtacagatatgatttcagaggctggtactatcttggttctcattgcttttactttatgtatagattatggagataatattattaatttttcttatttttagcatcttgtattcgttctttttctgtgtatcagtgtctgttcatctttcttttaatcttttaaactaatgtactgttttgattttttaaactaatgcactgcctgatttgcctttttacaaaatctccattgcacataacagtgttatttaaagatgcacctattccagggtatttgaaagatcaatcatcagggtacacaaagataaatcagaaaatattttcaattcatctaatcaaataatataaattacaatttaaataatcacactgaataaatgattgacaatactgtgtatatatacacattatatatgtatatgtatgtatgtgtgtatatatatactattttaatatatgcgtgtgtgtgtgtttgtgtgtgtgtgtgtgtgcctcatgtgtcttaatatcttagtctctttttataaattaggagacagggtttcgctctatcacccaggctggggtacagtggcacaatcatagctcactgaagccttccaaaacctgggctcaagcgatcttcccacctcagcctcctgagtagctgggactacacacggctaatttaaaatttttttcttagagaagaggtcttgctgtgttgctcaggatggtctcaaattcctggcctcaagtggtcctcttgcctcagcctcccaaatcaccgggattataggcatgagccactgtgccctgccttagcctttcttttctgccttacctcatatcttttctctacataaatacttggcactttcatgtctgtccacttattatgtccaatatgcattttactttcttacagtcatgcatgaatttgtgttattcctcctccccatcatgtatgtatgtatgtatgtatacacacacacacacacacacacacacacacacacacacacacatatctcctgtcaccaaaggggattcccttttgtctttaatgttagaatacacagtagaagtagcacatgttacacacaggttaaatgctgcttttaatttaaagggtgggagaaagaagtaggaatatatatatatataggtccaatatattccaagcgtttatatgagaattcatgagattcatttttagtggaaatagttttctcttcctttggtaccctataggaactattgctcatacaggtattttgccagctgctcacttgttaagcagtatgacatcagtcacgcctctctgtcttgactgcacattggagggcctgtttaccgttcatttggctctttgagtcttccatatcatttgaggtgaataaatggattatctaattactgtttgtttacactcaaataaaactaaatagttactgttttcaaacatctataaattatcaacatgtccaggtcaaatcaaattaaaccatctaagcacattgatcgttttattctttctttggaatttgtagaaagagaatccacaagcttttctgggaagtaatgttatgtagttagctgttcttcaatattaattcttaatgaacatgagtaaaccttcattctacttaccaagatttttaaaaaattccattgcaacaatttattttattctaagtgcagacataagtagacattttagtaaaattaaaatagtagtttctcttcctctaaagcacagtcttaattgttactacttctttctcccaccctttaaattaaaagcagcatttaacaactgtgtaatatgtgctacttctactgggttatctaacattaaagacaaaagggaatcccccttggtgacaggacaagcctgtgccgttctggtaacgtgggcttgtcaatgaaaaataagataaatttcacatcacagagaaaataatgggcttcatgacgctgcttcaacttggaaacctcaccagacatcttcatctccacagtttattgtgacacagaaacacatagcaaaaaatgtaggtttaagtttcaaggcccatgattttctgtccatggtagtgttgtcttttttccccatctattggttgggccactcatactacattctttatcttcaactctttcttgacaaatgattctcacttaattctacaaatatttgtcctgcctactctatttcttgatgctcagattctgaatagctttaaagaacacttcctttctttcgttttaggatatagtttattagtgactttatctcttatgttatgtaattttcaggaggttttttatctcctctgatttataaatgtgaactgaccacacacacacacacacacacacacactagatgtatgtacacacacatatatattatatacacacatatacatatgtgtatatgtatatatacatacatattctaacacaaatgacttcctgcttggtcatcttaattgaaatgatatatgtccattcatttaatttaacaaaaactgaaaagcacctactatgtttagggagattttagaattttgaattgctagagattccatagtgaagaaagtaatacaatgtcttcatggaatttacattgtcgggggggaagatgtatttatagatgcatcaatagataaaatatcaatttatatataatatataatatataaaatatattatatattataaataaatatataatatatactatatatagtatatatattgtatatatattgtattgtacatataattgtatatatagtataatatatacaatatattatatattatatataaatatatatattatatatatttaatatgtattatatatttatatatcattttaaaaatataatatatattactttatatattatataatatatataatatataatatattactttatgtattaaaatatagtattactttatatataaaatatagtattactttatatattatataatatatataatatataatgtattgcattatatatgaataaacatttctatgaattacattatatattatataatatataatatatattactttatatattatataatatatataatataatttatactatatattatatattatatatattatatattatatattatattatataatatataatatataaaaatatataatatataaaaataatatatacatatataaaaatataaatatatttataaattattatatatttaatatattatattaaatatatattatatataataacaaaatatatatagtttatatataatgtttaatatatcaaaatttataattttaaaacagttaatgatataaagtatgaagaaaaatgaagcagagcaagatgctgtgtaagtgggggtgggaatggggactaattttataaagaggagtcagcagggtctgtgatgtttaagcagagtcccatatgaagtgagggcatgatcacataaatacctagggaagcctagccttggcagaggtcagtatgaagggcgtcctgcctggaatggcatgatcagagagaggaattaaatgaagtaggagtagacagatagccaagccaatgtcccatggggccttacaggctatggagaagactttgcattttattcttaatgtcatggaaccttattgaaaatctcgtaagtaattctagaaaggagtataggagaggtcatttttaagtactgacattattaaaagggatcattttgagtagggaacaacctttctcaaaatctcctttaccacatgaagcaaaattttggggttagaaaagtaaaagttaccttctgccatatgtttagtaaagatgaagaatccttagtgcattgtatcacttgatatacattttccttctttttctacattaaacaaatgattctttgctatttttgaaattctcatctttactagttctcaaaatattgaaatttagtttccccctgtattattcttgaattagtccttagaatataaggcgatgtttatagttaaggtttgtttttgtttgtttctttcttcggtatggtgtttttattcttgaaatacagaggtctacaatgacaatagttcagcgtcctatgaatgttctttttgaatttttaaacagtatgatgaaggtaagttatgatttaccatgcctaggatttctagttacatattgtggaaattaattgatctaactttgtagaaatttgaccacctacccttttctaaatatatatatagacacacacagagaaatcatacttttcctgtactaattacaaaactctagagtgatgttaaatttttcatgcattaaacaactaaagcctacagtgtgccaaggcactgttcaaggaagtgagaatataatcacaaaaattcttccctaattcatattaaattgtatatatggagtgtgtatgtttgtgtatacccattggaagtttgttttattctgccaactgatctaattagataaacttagtcaatatatttgaatcccacattccagcagctattttctccatttgcttttattgctgtttgtggtgagtttgatatataattttaaggtgttaacatccctaacttatgtatgggtacagctcataaatacgaacctgtgtcatgcaactcatatatgactgtgttcaaaataatgtgtattagactgtaaaacgattttaatattttaaataactttcctgcatttgtcggtttcagcaggaaagttatttttaataacttccctgtatttgttggtttcagtattaattaatctcattaatgctaaactttgtgatcctaggttaaaaaacatattcaagatagcttcagaatgtttggtatacaaataggtctggctaaatataagtgttagctttctcaagcatctaaatgctggcgggcttttaaaaaaccagggctttaaggagaaaacacctgctctgtggttttgtagcagatatgaagtattcaaatttcttaataaatagaaaaagaaatatataacagaaacaggttgcacttgtctttctcattaagcaggtggttagtaccattatttgcattctcatagccttaatatacattttccttctctagatacaaggggaaattatcacaaatttgcctaaggatagcaattaggattactaatttattcttctttgcattttattaagctttaccaaatacaaatgaatttcataagggaagattatatgtgtttttacgtctaccattataaatttgtatgccaaataagatcacatggtttctttcccaaattctaacataatcttccactcagagtccttttaaaaggaaacctattggcaaaaaaaaaaaaaaaaaaaaaagtttaatttgtcctgtttgatgactcaatacagccaggatatcccagatcaaaagttattggaataatatgatttcatcgtttttacatttatacctacaattatttgtattcactgcaactttaatttagaaatactcatttttttgagctctaaaatgcaaggttcaagtgattttttttccttttaatttaggaggagatccaatagaataattcaaataagcattttcaggttctatgacatgctcataagaaaataaattattcatagaaatgtttattcatagaattactgtcctaataatttaacttctccagaaaacatgttttaaaatgctatatatcaaaataacgtgtaatctttcaaaatagcattagaaaaatataatgcaatattttcctgaaatatttgaattattatttaggaatacaattcttgtcacaaatatttagtgatgtgaaaatctcggcaaaccattcatattaattcatttaaaatatttaaataaataacttgaaaatgaaaaatttgtgttaagcaacaacaaaggacagaaagaaacataaatgtttccaaatatctagagagattagaaggtttttatggcttgaatttcattgaaaaataacaagcaatttattagaattaatggagatatctgggttaactatatagaagaatggcttagcaaagacaaattttaaatattattatgaatttcttcccaatataatattaaaaattctttcaaaataagagagaaaactttaaaaaaagaaacaaaaacctgcctagtgttgcaattggtgcgttgatctcaaatcttgttcacattctaacaaggcctctgggctttctgtgtgatttggtatgttccatagtagagaatacaaatgatatagcaagaacagttcattcatcattattagcaaatttgactgggaatcttgaatgggatatatgaaataaataggttgatttcatagtttaagaaatgacagcatatgctggccagagtgtataatagtaacaaagtggctggtacatgcatctttactacaaaaggcctaagaataaaatctctaattaaccagagaatctgattgactttattctgaatctctcttctctgtatttttagtgtgattacaatttgctcctgtgaactataaggaaaatgctgaattgtattcattttatagtgctagcaattcatgaggataatcagcatggatttacatttttttagtctaatgagaactcagaaacacgtaattaagtaaaatattctgagaaagacactgtgtcctctaatagtttaaattaaattttaaaaagatcttacaccatatgcaaaaatcaactcaaaatagattaaagacttaaaggtaaaacctgagcccataaatctactagaagaaaatttctatagaatgactgtttggtaccctcaaaatttatatattgaaacctagtcctcaatgtgatggtattggaggtggggctttgagaggtattaaatcctaagggcaaaatgctcatgagtaggattggtgcccttttaaaagatattccagggagcgacctaacttctacatctatgtgagggtggaatgagaagatgtctataagccaacaaccaggccctcatcagctgtcgaatctgctttcacctaaacttggacttctcaggctctggaactgtgagaaatttctcttgtttataagccacttagtctaagatattctcttataattgtctaaatgtaataagccagaaatgggcaccaaaaagtagaggtgctgctctaacaaatacctgaaaatgtagaagagggtttagaattgggtaatggctagaagctgtaagagttttgcagtacatgctagaaagtgttggcattgcctcaaatagactattaagggaaattcttgtgagggcccacaagggaaaaaagagctacatagaaagtctcagtattctttgtgaatacttctttgtgaagagaattctgttgatacaaatataaacagtaaaggacgttctgatgaggtctcagacaaaaattatgacatgtgttggacaatggaggaaagggcatcattgttaaaaagtggcaaagaggtctgacgcggtggcacacgcttgtcatcccagcactttggaaggccgaggcgggcagatcatgaggtccggagttcgagaccagcctggccaatatggtgaaaccttgtttctaccaaaaatataaaaattagctgggcttggtggcatgcgcctgtaatcccagctactcaggaggctgaggcaagataattgcttgaacccaggaggcagaggttgcagtgaaccaagatcatgccattacacaccagcctgggcaacagagcaagactccttctcaagaaaaaaaaaaaaagtggtgaagaactcaggtacactatgttagtatgctagtgtttttggtaagttacaacttgtgtgtgatggaatcagatattcgcctggaaatttctcaacaaagtgttgaagaagcagtctgatttttcctgactgcttatattaaagggctagagaaatacatgatttaaagatagaattattaatcaaaagggatgcagaactttttaccgtatccattttgtaacaaatgagaaaaactgggaaagaacattaagggtttggccaggaggacatttgatatagagattgattagcatggatcagccatctcagtcgaagctaggagttaatttttccagacaatggaggaatgtccatgaagcagatacaaagataattagagctgccactcccatcacaggatcagggttcaagtgcctaggagacaggaagtttcaaaggaaggtttgaaggtgcctacaggatctcctagtgccatctcacatcgtgggctctgctcctgttacgccagcactacgcctctcattgtcccagctgtggccccactggggcctggtctcgggtaggacatggtgggtgccccttcagagaacataggcagcaaactttggtcatgttcctgtggaaccatctccaccagggcacaatgtgcccccaggccctgggagcgtggctgcctccacgtggatttcagaggaagggcctcttagcagagctgcaggctcaggtccctagctctggagagccgctgggccccagcagagaactggtgtaggagtggggctcaggcactgagcacacttaggggcagtgtgggagtggagcaaatcaatgggagtggagccttcttagccttggaaatggtgcctttattagatagacctcagagagctgctttgccccttctgcaatgtgaggaaaaagtgacatatgtataaaccaggaagcaggccgtcaccagacactgaacctgccagctccttgatcttggacttcccagcctccagaactgcgacaaataaaattgtgttgtttataagcctcctagtttatggtaatctcttttagcagccagaatgtactaagacagaaatatagggaaaaggcttcttggcgttggtctgcacaatgattattttgcatatgacacccaaagcctaggcaacaaaagcaaaaataaacaagtgggattgcatcaagatgaaaaacttccgcacataaaaggaaacaaccaacagagcgaaagggaatgtataaaataggagatcatatttgtcagccatatacctgataaggggtgagtctccacaaatatatgaaaaattcatacaactcaatagcacaaaaccaaataacccaattaaaacataagcaaaggatcagaatagctatttcccaaaaggagacatacacatggccaataggtatatgaaacggtgctcagtatcactaatcatcagagaaatgaaatcaaaccacattgagatatcaactcacacctgttgggatggcttttttttcaaagagagaaaagttaagtgttcgcaagcatgtagagaaacggtaacagtgtacacttgtacactgttagggaaaatagtatgacatttcttaattcagcagtcccatatctgggtatatattctcaagcgaaatgtgtacgtctatgttctttgtagcattattcacaagagccaagatttggaaacaaccttaatgtctatctgtgaatgaatggttaaagaaaatatgtatatacacacacacacacacatatgccatatttataatatatataatatatatacacacatataatattcctgtatgcatacatatgtgtatagaatgtttatatatattatatataatattgtttatatattagaatataggatattgttatatatttatacatatgtatacatttatatacattatttatatgtacacacatatgtatatagacataaaaaagaattgctgcatgatctcacttatatgtggaatttaaaagaatcatactcatagaagcagtgagtaaaatggtggttgccaggagtgagagataagggaagtgaagaaatgttggtcaagggatacaaaatttcagttatgcaagatgaatgcattctagagagataatgtaccgcattgtgactataattaataatgccatattaatgatacatatggatatgtgctaagttaataagaaatgtaactatagttaacaatgcatattaaaatgtactaagaggctacatattaagtgtacaaatacaaacatattaaaaaactggtaaatatgagaattggtagatatgtttaattagcttgaatttatggtgattatttcagagtgtatgcatatatcaaaacatcaagttaaaccccttaaatatatataattttattggtaaattatctctcaataaagctgggagaaaagcatatacagtaatatcatttttcttatttatcatttttatttttgtttgtattgaatgttttattgggagataatacattttccttataattcgcgtttatgaggattttcatttactacaaagtgctctctgtactctagttttatattaataggtcaatataaagctatgggtcatacaaagctttaacttaagctagaatcatgttcaaatccaaactctgatgcttagtggctagttcatctttctgagcctccctttactggtgtaggaaatggagaatgtaaccaaactctgttagttctggtattaaatgaaataggatcagataggacttgaatagtagatttttccctaaaacaaactttaatttggaaaagtaaaatttgttttcaatgttcagcaacaagagcagagtgcatttgtaataaaggataactactatagatttaacaagtgctctcattgggtcagttttctttaaaagtggtgtttcatttggtataatttttaaaaacataaattcaagcactaactgctgaattattattttacatttaaaatgtgtaggctagatgagggctgaggacagtatttatggtatgtgatatgtgtcctcacaagatccttataataaaaagattctcacagtatagtagccaaatacaataatgagggtgtgatcaataactgagaaaaattatatagagatgttattaggaggttaaataggtaaaatggaggttagagtttccgtcagcacagaagagagaagagcatttaattacaaaaccttaactcatcccagttcacctggctaaaaaaaaaaaattaaaaagtttgtggcagaaaaagaatttggcagtatggacatttagggaagttagcaattttgtgagtgaaaaaatttagcaattttctggttatctgacatcatgaagatattttatgaatattttataaaaatctacgcatttagactatagaaggaaatgtttagtaattacacatttgtgatattttacgtactcagtggaccttgaaaaaacgtcagttgaatttttcttgcataaataattttacgtatactaagaagtattatatttgaaatgaaaaatactataaattgtttatgaaacatattttgttcaatgaaactgttatgtttttaaattaatgtttttatacaaggcaaagtttttctatttaaataggaagccatctgattttaagggtaatatgtacttcctgtataaaatctcgcagcaattaaactccaattgttaaattgtttattttgagtataacttatactcatgatggaaagttacataagcagtacaataaatatgttgtaaacatttggatgtgctgaactgtgatcttaaaataatgccatcaacatattgttttgatgaaagtcctagacaaatgacacatcattattagattaatttttctttccactgttcatcaaaatatatatccatataaatgttttattaaccaataatctatccataaaagttatttataccaaaatatgtatgcatacaggtaaaagtatgattcataaaatatttaaagtactgttaaaaaaactaagattatattattaatattatgcaagtaatgagaacttcaaacacaatataatttgtgcaaaaatgtaaatttcagaagtaagtgaaaatataattgaactgagatgattacatacctaagcttctaaggaaacttaaaggcaatttcattaataatggaattccctctgaagtcattcgtacgtgtggagctggcatcaaagtattaaaatgttctgcgtgtgtatagaaacagtaaaaaattatttttattttgcctgttgctaactcctgcagaagtcagtcagataattctctcaaaaatagacctgcttttgtttcttttaattgtttacagatcaaaagcttttttaagtgagaaacttgagggacttcactgtgttttcagatctatctgaggggattaacaccaagtgttattttggatgatcagttttacccttgctaagctttgtaatttctcatagctctctgagttgttgcacagtacttgacaatatgaacagttccattggggttaagtgataaagcagttctacatctggggagactgtaattgcttacgttgaataggacaaaaaccccatgaagagagccagggtttgagaaaggaaagagaacatgaataaaaataatcttactttagaattttgctgagcttaattagttaccaaatatgtatttagttgatgtcgttgctgcaattgttgtaaatattctatagcctctacttctcttgacagccaacaggaagtaatttataatgcattataggaacaaaaaattattttgtgtagttccctttaataaagtctggttctctaataaaaagagaataaactttcaaattcaaatttttctctctactatgatcatttccaaacttataaaaaatgtaaaaagatttatatttttctgtcatttttaagttaaagtgtttttaatgtatcttgacttttttgtcttttttgcctttatagacaggtgataaagcgttatttctaaaattcagttatatataaatgatgtagaaatattagtgcaggaaactagattctatagagaattcatttctgttgccgtgttaaagaaaaattcatgattgtttataatttttggaagaaccgtgttaagatttgtaaatcgtgctgactaaatatagctctaaaataccttaatttatactttgtccttaaaagcttttactagtttgtaatctagatctgctttctcctaattctggagtttgaatttctagtaaattacaaggcaagaacccatcccacacttcagtttaaggttctgttgttctgtttgtatatgcagatttagggaaagaaagtctcacattaactatcttcataatttgaggtacaactctattattgagtacacagcctttcattttccaagtggtagttttctttcagtccctaccttgggtgttcagaaactcttgtttggtaaaatgccagtaaattacagatgatttaatgtatatatcctctcatttaagaaaggcaagtcaaattacagatccaggctttgcctcctccaaatcttttccctctctcactttaatgtagtctcaatgtgtggagttctatttcacacaataatcttcatgttcacgcagtgttaataagcctcataataagagttattgtatcaaaacctgcattcacgaatcaaaaacaaactgacttcttgtatataaactttgcaaaacttacatcagtaggtttattttatacctcttccctataattttaaaggttatctataaaacctctctttggccagctttcagttttcatgttttagcccaggactgtaataacagtttagccatcagtgtgccctcttcgctcctttcttctgccaactgatgtgaaactcggtcagtacgtgggtaagccttgaatctgagaacagaaacatgtgaggaaacagggaaattccattctgagttgatccagtgtaactaaggaaatacttacccttggcagaggtagtggggcatgcaaagctcctcatagcgcctgtgaaatgttgaaggaaggggattgctgacaatacaagccagaaagagcttttgcctgaaatactcagataattcaagtaagatctgcacttgatttttttttttgctggggtatgtggggtgagtatcatctttattgtttaacctaattaataacctcaacttttctcacagtaggtttgccctggtactttggtagctctgctgttatcaatttttaacctacaaagatgaagaaatcatatctagaataatgatctctacacttccgatttatgtaggattttatttgcaattgaaagtgcatgtttaaattcttttgcttctctttttgccttgtattaagaaatacaattgaatataagcattgccagatgccatcaccaacgcagccaagtcacagactactgaatgctcttaaaatgatgttgcagctgcaccaggatatcacagaaatatggaaaggcataccatatatcaaagttggctgttttataaaagggcgtttattcttcaagtcttattccaaaacatgttaggccttaggacagccaatatgatgttatagcacagtctgtgttctattgcactctttaccctaatgaagcatgactagatatagcatggggcgtatgagcctagctcacctttgcttttgcttttaaaaatattcattatctgatttaattaataaaatattgtgatttttaaactcttgttaaaggagttcaagaccagcctgagcaacatagtgagaccacatctctattaaaaccaaacaaaatgctaaataaatgccttgattgtaaacattgaggaaaagaatggaacaaaaggaagcatcaaaacaaattcatgttatgctgactttcagcagaggctttacatcttaaagacagtaaaattccaatttactagcattttagcaaccttggttaaatttcctcttctcattccataatctatataaacaactctttatctatgcactcagcttctcttcagtgtaactatatacttttctggggcttaaattatataccattaactaccagttatcaagtgggtttgggtttcctgaaaagtttgcaggtcattaccctgtcagaaatcattgaattcaagccttggctatgccatttatccttgcagcttctaatcagtaggatttctgtgccaatcaatctattcccaattggcctcccttaaatctgaaataatgtattataatctgaggcttcaataaggcagtacactctaaaaagcaagttcagttttcttataaggttgagaaattgagaaatacgaaagtaaattttgccatttggaaatttaattttttttgttgattttagaacatctgtacaggattaagtaatgtctggttgatatgtgtgttgtggctattaatatttatctggtattaaataatttttatatattttttcttttaattttggacacagtacattcaacaatgtatttctttcttttctagaatgtgataatatagattaaatgattacaatacaaaatgctaagccagacctagtggcccactcctgaaatcccagactttgggaggctgaggtgggcagtttgcttgagcccaagagttcaacaccagcctgagcaacatagtgagaccccatctctatagaaaacaaacaaaatgctaaataaataccatgatcataaatattgaggaaaagaatggaacgcaaggaagtatcacaacaaattcattaagtatcctcatataatacagagaatatgttatctagtaaattataattatttagaaataatattaataaattatattacaatgttattgcatgtatatcatttctggtcatggtttatgtaaaactatagttctgcaaagataatcttaattacctatgatttaatcttttatatctcctaatattaattgattatgtgacttggagttactgtgtaaaccagacataacttccttttgattttcatcaagatattgttatatcccctagctgagtttctgctttctttagcaaaagcatttaaagaaagtggcaactataaaattctggtggctccatcagatgaatttgtgaagatgtaatattttgaaatctataattgcatccaaaattaacaagggtcaaataacaagggttgacatgacccagatatttctagtaacctttatttccttgtgccttttcatattcttccttagtgtcttattgaatccaggtctggtagagtatgtaaatgagaagaaactcagagtgaaaatacaagttatgagtaggcttcaaactagaattaaaacaacttgatttgatttgaaattgtagaataaactatttttgctgtagtttcaactttgtcacacttgtttgacatgactaaatcacctgacattggaagccaatctgcatattaaattccatgattctattaaatactatagaaataatctatgtagagtacttctacttgagacacatacagaatatatgcattttagcatcattaacatcattcttggtttttggatattaaaaagatttaactttctattttgagaatgtgtcacaaatgaaacgggtaattttctttgaaagtacgtggcttggaaagctaaaatagaggtgaagaagagaactattcacaaatcattttcttcttatatgacttatctattttttaggtatttcatggaaagatttcagtgaaattattcactcagaattgtaatagtttgatttgttttccttattaaaatgtgtccaattagatatatatgtatatatatgttttattttgttttgttttgtttttcttctagcaatggttgttttgaacaacctggaaccaaatacaacttatgaaatcagggttgcagctgtaaatggaaagggacaaggagactacagtaaaatagaaatcttccaaacattaccagttcgtaagtaatcatctctattttttattctcttttgtcattttcttcacttgcaaatttaatagattttaaaatgtagggagatgtttcaacacttttgagacatgaattatgtctttggtgaagtggtttctgaagacagtgacatctcagatttattaacataaaaataactttgctttagagcaaggcagaaaaaaaagagtgcactagaatacactcagtaaaaattgttcccgggaaattgtcctcattgcaaaagcgtccttcttacttatggtctgattaattggattgtagtcttcagactatattctgggagaagaaaaatgtctatgtaacatgttcaatattttgttctttttggaggcctgactattgaccttgttccacaaattatatgggctctaagtgtcagaaaaggaatcattatgttaattcattaaaacagtgactgcaggagaagccttgttctgataactatcatattttggggaattgtaagttaattgagtttacatagagtgaagattaaattttaaaagacttaacatttcctttatgttaaataaattactttaaatgtgagaaaacataataaatacgactgaaccactgttataaaaatctatgcgtaacactgcctgatatatatatctttatatatatatatatatcgttgtatatgtgtatatatatatctttatatatatatatatatcttttatatatatatatatgttaggacagtcaaaatggctgcaatatattatcttacagagtatctctctcttggtaatcataaaatctgtcaggtaagtttcttttctccattcccaatgctggtggttaagataaccagccagatatggtggcttacacctgtaatcccagcattttggaaggctgaggcaggcagatcacttgaaccaagaagctcaagaccagcctgggtgatatagtaaaaccctatctctccaaaaaacaataaaaaaagaatcagctgggtgtggtggtatgcacttgtactcccagctacttgggaggctgaggtgagaggtgagatcacctgagtctgctgaagtcaaggctgaaatgagccatgatcacactatggaactccatcctgggtgacagagtgaaaccctgcctcaaaaaaagaatgaagaaaagaaagaaagaaaaaagaaatgacaataacctgctgagaagaaataacaggtcattccggtttagagatatgaaatccttttcagtgcatggtctgtttttcttggcccttcacatagaaaattcttgcactttggtagatccctgttctattcaaaacaatataagcatcattgttatatggctatctctatgttgaagtataatatcaaaggcaagtatatgaatgaacctagaagaaaatgaaatattgaaacacaggtctataaaattggatactgcaaactttattcaaatttgcacccaggaaagaaaatgcttattaaagcacatttactaattgcaagtcattatctttactggtaggtatatattccatacagattgatgtattaatgtattcatattaataaatgcttacaaaacatttacaaactaaatttacattaagaaaataaaaatgatttaatactattaataataagagaaataaagttttacatttgtgcaatgctatacttttctcagagcatttgcatatcagtgaaaataatatatttggtcctcaggctacagttttggcatgacacttctagatttataatgttgctgcttcttggatagggaaaatgatcagaaattatatcacaaaagggcaatgtcaaatggtaaatccaggataacaccatatattttgattacattactgttctttttattaaaatatagtttctctaggtatctgaaatgtgtgcaaatgaagaaatgttgtattgtatatctaggtgaaccaagtcctccatccatacatggacagccaagcagtggaaagagctttaaactcagcatcaccaaacaggacgatggaggggcccctattttggaatacattgtgaaatatagaagtgtaagtaccttgtttattatcatatcatgctaggttttttcaaattaaattgagttgcactgaatttataaacatatcaggagagaatgtgtatttagtaattgtggtaataaatgctaatcttccttccattcctgacagtcatcattgtgatttatttttattttttttgtaaaatgtaagcatggatcatcaaagtattctcatggttttcatcttatgatttttaggtgtgaaatgggactagtaaacatttcagaaatgagatattatttcccctgttttgctgacaagcttctcattttatttgatattagtaacttcaggctaagtccctggcaatcatatgttaggtaatattattagaaaaatcacacctcaaaacaaattaatcaaataatttgacttacttatccatcatgtttaacaaagaatggccacggtgaacttgatgaagagggaatccttttcttcaactttaattagcactatccagtaaggatgtttggagagctaaaagctgcacacagatttttgatagcggttagaggtaaacaatgttcactagttgcagagtcatagagtgacactatggacaactgcgttttgccttcagaaaagatgatttcaaaagccactgaaaataatttcttcaacatttttttccataagtaccttggagtattggtgtctactgtaaaataagttaaaaatgaaacacaattttaagttaaattttctaagattcatacaacatgcgttttatgcttatgttgactgaatccatattagtgctatccaaattaattatattttagcagatcatgtttaaaataattactccatagtagtgtgtgggttaattttcagtattttctcatcaattttctaaattataatactgctgcttctaaatggaaagatctacattctgaggggtaataaaaaagaaaaatttgattttgaatggcatattttaataattaattttagatatcaaatcaatttttaaaatttaagattaatactcctttcagaggacaagtttttgtcccagctttcatactcaagtgaggtctcctggccattctcatttgcacatttgtaaacacggtagaagagagataatcttttctagggaggtaggcttggccagaattcatgaattggactgttagaacaggctttccatgcagattgttgctcacaattctaggatgaaaaaatttattgtacaaaatactgggggatagtaacagtttgtaaggaattctaatacaatcccacagtggactctaaaatgcaatgactagttgtgagacaacgtgttgtatatttttatttgtactgtattgtcagtagtggccccagtcattgatgtaatcaaaaatatttcttgagtagcactgcatctatttagagcaaagcagagtcacaaatggaaataatgacattttagacagccatatatttatgtatacatatacacagtttaaaacataaattactattttaaaaatctgacttcaaattcatattgatttctttaaatgtggattagaattaatcttttttgagaagttatgtgtgaaacacagatggatagaaataagtaagattttaagcataatgagattagtaagattgaagagactcaagttcatataatggtactcaataaattttacctttgcacatagttgctaaggtatagttgatacggcttactgataaagtttaaacaagaacaaattttgtctccagtaaagttactccttccgttttctcgcctttctctttctcctcccaacctaatggtaaaagtgcctggtttcttcccagttacccagtgtctgtgcttaccacgccaataaaagtatgtccttttccctcctcttctttctaatttccaaccctttctaactccagaagtgctagaggatctgtttttcataacacattggaaatgattgattgtattaattcatacataactataattgtctgataatcaatcaattactaagttatccatcttagagctactatcattttaacaggggacattgttttaatagtagaaatttaggcacctatggcaaattttgcaaagggaatgattccatatcctttgtattatgagataggcattgctcactcttggctattttgtattttgtaattaatcaaatataaagtgatactttttcacatttttttcaagcgccaatggaaagttagagaatttgagtgacttggtggggagagggaacagacatcagaatgtaattcataacagtctaaatatggatggcagcagtactgggcaagaggcaacccctcaatcactatctcatctcagctcaactgcccagctcttgtgccttcggatacagccatcctggcacagtttctcttgaccatatcacttgatagtatgccttctagtttcatcattaaaatactctatatatccctattttgttgttgtctcttctcttctccacctcctccatcctgtcaacatcatgctctgaggatccaattggagataccatgattgaataaaaaatgaaataactacttcaaaaagttcttgatcatctgttctctttatatgattccaaactacttcatctattagtttctcaaaccacatgaactccacagtggaataaagtgcaactgaataacttgaaaaaatggtttagacatattcaatatatttttaataaaaaatgaagaaaaaagtacatagaggaatctggaaaataagaaacagctctaagattttcacttcttgatttcttctttggccacatctttcaactccagtgtgcacagggctatattctgagaacaatgtaatttagacaatatattctttatatgacttgatttctagcagacactgaatctaagcctttaatttgggtttcactgggaaaggacaagaatagctatatcctattatagaaagtgtaaaactccctatagattatgaaccaggaaacaccattattctgtcagcctgtaatacagcacatggctttgttcactcacccattacaaagacagaatttattggaacagaactagagtaataaaagcagaatgagatatttctgtggactcttcatgaaaattaatgtctctaacaataaatcagtaagtttaaaccgtgtgtttggaaaataaagacaaacatattaatctcatgaaatgtttggaaaaaatcatgaagttatttttacatctactttgtacttatagtgtcaatgtaacttcatataatttagtacatagatttttacatgtttccatgagtttttcaccattttatttctaatttgatgatagctatgggatcataactatcacttagtgttggcatattaaatacatttccttaactaaaataattggtagcttaaaatcaattgtgaggaagtactatagggactagcatttgtaagtcttaattgaacttcttaagtaagttggagtccacgaggttgtacactatctcaatggccataggataagaaaggtaagtttgaaaagggcattaaaataataaataagtaaaatcaagctttggttcttaagaaaacattttccagttaataatgtttatgtatgtacatggaaatttatttaaagccattatagtttaagttttgaagtatttttaaacaatgaatacttatggacattaaagagtagcaagcattttagtaatttttctttgctgtaagttaagaggatgagttttattcttctttgtatagatagactatgtgttgtctgaatgaacaaatacagcaagaaatcaataaagaaattagctcactatgcaattataaatagtattataaatagaataattaatatgagaaataagaaacacaagaaaaaatgcactgccaatgtttatagatatgagaacacagaaggtaatgaataggaaaattagatttattttgccttaagtactatgtgggtggtggagactagcaacagattatgtagggcctaattttaaaaaagtttaccaagcatcagcacatggaacaaaggcaagtagaatctgttatgatcatggaaaaagagatttaaatttagaactcggctaaaatcttcaaacctttaaatcttccaaatgtatatatatacatatatgtacacacacacacacacacacacacacgcacacatacacacacacacacgtatatataattttatatacaattcggtgttttaaatttaagattaatatctttctcagaggacaactttttgtcccaggtttcatgctaacaatgatgagtacctgtttgtttcttttggatattctgatatggagacttttgtgcctctacccaggacagctctgaaggactcactggtctctcgatgaatctgacagtgccatggtattcaagccaggtcccttgatgcttctcgtttgcccatttgtaaactcttcttgaattctgtatatggtctatctgtatatatatataaaaatatatgcttgtgtgtatatatatgcaattatatataatatacaaaatatatgtataaatatatatatatatatatattatatataaaatccagactgatcaatcacctctctgacattgagagtagcaaatggagttttaaataatttctgggccttctgtgaggtcatgtaaatatgaatacctgaaccatgctaccagggaatccaggaaccgggaactgctttatatacatacaaaatcttaaatcataggacatgagagtcagaagaatcaaaacttcatcttgcttatatgagctcaccttctctattgtcctctcattttataattgttcagtttatatttaaaatgatgctgataatacatttcatgagacttcaaaaggagtcagtaaactgtttcttgttatgaataaaagtatcaagcagcccctgaaaataagaaaatagtgacccttacaccttgcctctaatcacttccctgtagagatgatagccaatactttcctgaatgctgatagtatgacttcagaatcactattaagaagtaccctgaattgccatatggccctgctattttctgaccaaaaaaaaaaaaaaggaattgcttaagagaagcgataccaaaggcaaatgaccattttttttcagtagctgcccttcaacatttaattggcttattaataatagccatattcagcaaatcatctcattaagttacctaggggaacgttttgcaactagattatcttaaattgttccctaggcatttcaacctttgtaaattagacactctacagatatgcatacttgagattttgatgccaggggagtatttggtaacacccactttaatttttttcctattccctaggaatagcaattaggggattaaaatgccttcttgcctaatgttgaaaggaaaatgtaattgatttatgctgggaacatgttagagctccctttggtttcttatactatcagcccaaatacttaaaatgatggagggccctttaatttatcatattaagggcttcaacaaataagagctaaatgattgttaatttacaagagactgccttgtgtttgtacagaagtttcaccttaaatgtctaatttccaaaaatggtatttttgaaggattacctgaaggacatgacatctatctatccctctaaagaatactttttttttttctggggtaattaaggtctcattttttggcttattttctggctctttcacccacatcttcactcagatacataacaaaactgaattccaagtatttccacaaaaatatttactcacatcaaccacttcatcgttacatagaaagtactgaatagctgaggtaatgccagggccacagggacatgcagctgtctgctgcctcatggatcccttgtcttcataccacccttcagtgtccttgccatacaccccttccttcccatatatgtgtgtgtatacacaatttataacttataaaaatacatgctacatgtatatatgtgcatattcatactgaatatgctatacatagcatttacaattatatgttgtgtgtgtttgtgtgtgtatatatatacatacatttaacatatcatctcaaattacttttgggttgactttttaagcttttttgttctatgtaggtctatatatataacacatatataatacattataatacatatatataatacacatatataatgcacatatatatatatatacacaatttttaaaaatttatatgaaacagctacagtgtttgcttatacatctcccagtgattatgcatctaaggcttaaaatcactgtgtttctttttggatttaaagctgtgtaaaaaactgacaccttcttgtcattaactcaattaggacaaatgaagagaaaaatggcgctagagtgtattatttccaggaagggtgatatcacctccccactggtgacctgcctagcccttgactttattaggtattatgtgcctccattccaccttctcatttttcaaaggcctcatgtctttcttctgggctggtttgcaaactacaacatgagggtattgcacatgtcttggtcactattgtgttcatgccttctagaaagtcctcactaatcaattaactgaataaataattgatgaatgagtgggtgaagacagagggtgttgtgatagctgtggctttttagcatagctgccctaagcatttcaaaattgcaactaggtttctttcttaaccttactgtccattgattaacttagaaaagttacaacctctcttctcagttattccatcgttcatacatctcataatactttaagtagtactggctacaggccatttttataaaaacagatattcctgagtttcaaaaatcaaggcaagtgcctcttgtgtatattgataacttgtagtgcttgttcatttaaaaccagggcttcgttaggggttctaatatcttcatttttacacgaaatagcaaaacaggccaaacttttctgttcctttgtaatggaagttctatgtcaccaaaaagtttatttcctttgtaataaaagttctgtgtcaccaaaaaaaatattaactagaaaaagagaatactagtatgttatcaaaattacaatgtcttcttgcctccttctgaaggacactccatgtttgagtactgtcaatttaatgcaatcatgaatttaactttcacaattatattttagagaacaaatacttaattgtcaccaaaaatggagaatacatcgttattctttatactcaaagaagcagtgttaaattgtggctcaacatagagtaatacagggctgagctatgaggttaaaagacatgtctgcatctattgttatagacaggctgtaatttatttatatttataccctgggaaagtgagatttgcagttgcaatgatagattattagatacatgatttcagagaaaatgtttcatttccatacagtttttatggaaacagttatatcctaaaatcgctgttatttttttaagtggttatgatctctaaggccctgaaatacacaacttactcaattttcctcattgcttttccaaaaacctgacagaagcagctgctaccatcacttttgttataaagagaaggaagacaagccagaaaggttaaggaagctttctgtgtttaaatttttaatacatggcacaacccaataatcacactgttttagataatttaatttataattgtatcaatttatatttcattagtaattgtagttctaatggtaattttttcaaataaagggaaattcaaatgtcatatggtcaaatttatattttagaaaaagaatgagatagtatttaagtgtagaatgtttgagaataggatggcgttgttttatattcttatgctaatgatatatttaaaacttagtaattttgtttgtatattattttatgtcataaaacatcatagtagtaaaaaataccagtgataatataaatctatcattcatatccagactttatttcaagatactttatctttcttccccccaaaaaactttaacaatagtccctggcaattcttttaatggacatactaagttttttctgtgtatcatgtttcattttcccattcacataatgatgaataatcaacaaaatggccaaaaaactaactgatatatgtgaaataaaaaaaaaaatcctaatggaggtaaattgtcaaccactgaataaaggattaatgacaaaaccactttttggctaatataaacaacattatattttatatagaaaaatgttggaaataatactggcttcattgacacagcaacttcatgtatccctgtgcctatgaaaattgttccaatatccaatataagtatattgttccaattccaatataatttttttaaaaaggtgtcactttagtgtatggatatttacaaactgcatttttattgctttcacagaaagataaggaagaccaatggctagagaaaaaagtgcaaggaaataaagaccacatcattttggagcatctccagtggaccatggggtatgaagttcagattacagctgccaatagattgggatattctgaaccgacagtttatgaattcagcatgccaccaaagcccaacattattaaaggtaagcaaaactatattcttttttagactgaacaataaatatgataccacctttttataacccttactgacttttcttattaataattaaaacaaactgaaatgtaaattccaggttctaattattattgtgacatatcatacacaaagtttctcatcgctcttgccatagggtattgcttaatttgtaaatatattttgaccccattaatagttggagtggtggagaaagaatgactaggagaacatagagagtaagagtgactgatgataatcaacgtgaaaagtgtctattgaggccatacgaaagctttgctaagaagacaatttctctgccaatcatgtggagactgatgatccaattcttgttagatttgaccgaaggtaatgatgagccaacctatgcctgaccaagcaagttgattttggaaacataaaattagtcacaaagaaaggcaggaacagccacaaatataattccataaagacctatacctagagttttaagaaggctcataaaatgggagaacactgtaaatcagcctttgcaacacactggttagattctaccattgataggtaacagtgcttacattgttacatcttagtatgttagtaatattatgaaagttcacaacagggatgttaaaacttttattcagataaatgctcttgaagtaaagatgcaaaaatttattccgactcaaaataacatttaactctgttcatgagttgctaaattggtcatatttctacatttattttccctcagttattacttttaatattttaattttatgcagacatgtacagatatttatgtatatatggtatattctttataggtacatatatacagaaaagaacagcatattaatccatgaaaccaagatttatttgtcttattatattagagtataagtatagatatataatatttttgaaactggaaaagaaaactagctagttcagtcatgtcattaaaccctcttgtaatttcaaattgatgttaatttcacatattatgattttgttatatcatacatcagttgtttagtaattgaaagcagttttatatgattaatctttcaattaaaaagtaattagtattggttataaggtttaaaaagtaattgatattagagctttatattgctaatgttaataaattctaccaaattataatttaaaattaggaagtaaaaagtccctggaaataacactggtatgttacattttaaggactttttttactattttcaaagcccttctgcattgattatgtcattttattcttaaatctgagctggataaggaagcattattctcattttacaaatatgattttaagaggtttaatgacatgttggaggtcagaaatatttctagttatatgacaaatctgatgcccttacaagataacacatctaaataagaatgactgaatgtactatcgaattcattacctctctatgtttgaaacatcagaaaccacttctacaattgtaatgaatacgtatgtggtaattatatttcatgcaaatatcaggaacatgctatacgtattcccatactgagccagagcctcctccaaaggaaaattgcaacagtatatactataatctcccaaatttttaatttagtgtatatattttgaaacataatgaattaacttaatccgtttaatttaataatgtattaaatttaatatatgaagtagaaggcaaaattttaataacatagataaaacataaaatcaaaaaaatagattttacacagattactaaatgttatacccccaatgactctgctatctttgtaagaaattgttggccgggcgcggtggctcacacctgtaatcccagcactttgagaggcccaggtgggcggatcacgaggtcaggagatggagaccatcctggctaacacggtgaaaccccgtctctactaaaaacagaaaaaaattagccgggcgtggtggtggacgcctgtagtcccagctactctagaggttgagacaggagaatggagtggacccgggaggcggagcttgcagtgagccgagaccgcgccactgcactccagcctgggagacagagcgagactgcgtctcaaaaaaaaaaaaaaaaaaaaaaaaattgttgatgataaaaaccaacaatacgtgtagacaaaaggttgaaaaaattaaaaggtaataaaagcagatatgaaggcaccaaagtaaccaagacatgctgtaattcatttcctctctctctatatatatatatttttcaatttgagaaactcgtgtcctgagagctttgtaggcaagacctggaaagaaaatggatagaattctggtttatattcccagatttgttcctgtcacataacttgtcaaaataactgtttcctcatctctaaagtgagttccttctggttctgcaatgttaagatctatcatttattaatttaagaattatttattggagtacttctttgtgacaaacccttgaatgagtacaaaggatttatctgtgaaaaatacagcactgacccatgtcccccaaaatctccacagtctggtagagaagacagatattcaacatgagttagaataactgcaactggccgggcgcggtggctcacgccagcaatcccagcactttgggaggccgaggcgggcggatcacgaggtcaggagatcgagaccatcctgactaacacagtgaaaccccatctctactaaaaatacaaaaaaattagccgggcgtactggcgggcgcctgttgtcccagctactcgggaggctgaggcaggagaatggcgtgaacctggaaggcggagcttgcagtgagccgagatggcgccactgcactccagcctgggcgacagagcgagactccatctcaaaaaaaaaaaaaaaaaaaaagaataactgcaactaagagagatttttcttagaaggtgagtttccaaaggaaacatgcaggaatgaactttccagggaaaatgtgtgacgtggaaggtatctctgggacaagaaagagcatgatctgttctaggaggtggaaaaggcatgtgtggaagagaacctggaagtgtgtgactatagataaggtcagagagggaatgcaaaccagataattcaagggcttttaaaaacgtaattgtaaaacatcttccaaaagaaataaataattgtaagcagaaaagttgtatgaagagataggtattataaacagattattctttctcttatgggtaagagcaactgatggatgaacagcggtagaaaaaataaaagaacgaaaaatttcctgacacattataagtgtagactaacgctgcctttgcaatagattggattcagtcagtaatgacttctaggtttcttgcttgggcaactagaacattgctgatgtcatttctcaaggtgaagaattttgtaggagaagcaagacttggagaatgaggatcaaacatcagatccatttagtatttgttaaatttgaaatatcaaatcgttggttagatatgtgggcgtatggaaatgagaagataaccatggcttggaaacatacaccatgatgctgtcagtgttaacaggtgaatggtatgtgagtgagggtaaacccgtctaagcaatgcctaaaatatctgaagaggggttgatgtctgtagtactcatttgtgtttgccagtaactagaagggcgactggcacagcagtgatttccagagaatatttcttgaattactgaagagtagaaagaagttaagaactgagttccaaggaactatcatattatactagaagaagaaaccagatcactccacccctcatcatgagactaacactttacaaacttactggaaaaacaggagcgtagtatcttggaagttaacaaagggtcatatttcaagaagaatagatgtaaagtgtcaaatgctgctgaaaggtcaatggaactgaaccagaacagatgtgaagtatccctatcacgtgcagctttgctgacgtcattgagagataaattaggtacaagtgggcagagaattgtatgtgaggttagggagtttagactccatatttatttaatgctttcaggaagtttttctatgaaggtgagcagaggagggaaaaagccagtgttagaaggtcttttatgatgaaaaatgctagatgaaacaaatcaaggagtcgtggagcaatcacacatacaggcacacagacaaagccatctgagaaggtaggagatggtattcacccctctaaaccatgtagctgatacaaagccatcacaacttatcaaaaaaaggggaaaatgaaatatttattttatttgtaaaaatgtcacaaattcagccaggcgcggtggctcacgcctataatcccagcactttgggaagcccaggccggtgacaaggtcgggagtttgagaccagcctggacaacatagtgaaaccctgtctcttctaaaaatacgaaaatgaaccgggcatggtgacacccgcctgtaatcccagctactcaggaggctgagacaggagaattgcttgaacccgggagttggaggttgcaatgagccaagatcgcgccattgcactccagcctgggtgacagagcaagactccatctcgaaaaaaaaaaagttataaaatcgtgtctaatttactgttactgaatccggattgctaaggcctcatagaaagtcatatcagaaacaaaccataaattaagaattgtttgatttagatctaggttttgtgaggcaattttaaaggctgtgatgatggggaatttgagaacctttcagatcttatagagttaacattatatatttgcaaaatatgaaaaaagatcatataattttataacattttatttttcattttaaaatgaaatataaattcaaacatattagaaataagttatctgtaataaactagcacatcttaagtcttttcatttaagttagagaagatatagagtttaaaggttaaagtggttttaatttatttttatatttcatgcattgtagactgtcaaaataagttttctggaattttgaatttaaaaacccattacttatgtatattagatatatttaactttttgtaaacaatagggtaagtctagagaacatttatttgttggactaaagcactattttttcgttttttatcaacctactccctttacattcatataaaatattacattgataacaataatttttcttgtaagtatgctagtggatactacatttcttcttagtttataattattaaaaaataattttgtaattaatatttttcatttttttcttattaaagatgtacttattttgaaagatatgtattttgatttatttaaaatggagtttccataatcaatcgtgttccttttcagaatattcatgcagcataactccatcttattttattttataagaaacaagaatattgggaaactatagcagattaattgttataaaatgactaccaaactatggatttcaaggctgatagcatggcatttattgatttgttctgtaatcttaatgactaaaaatactactaaacttctggactggatataatctaatgtttaaaaaaatccttggaaataaataaacttactttgaaaaacattttcaccatttcttttggcctgccacatgtttgataacatttatatttaaccaaaaaagacgttagtatctttcagtaactgcttccttcttttcctgaagacatgtctaattttaatattgactatcaatataatttgatgacaataattctgttcaacattttttatattcaatgataaaataattctgccctctgggaacatgtaatgcatacataatacatacaaaatagttgtttagatttaacaagctaaaaaaaataatataaatcaccacaaaaaatattgctaaaatatttcagttactttgtattttcatgggcttttaatttgtacttccaatgaactatacagtaaaattattttgatcacctcaactctagtttcaagcaacactaataaatccttcatcactagataattcaacatgaacagaaaacaactttcaaacacatggcgaatatgaaaatattattttaggattacatttatggttgttttagaacataagtttaaaaattctaaaacaatggtgaaatagaagtccaattacctggggaaacttcatcttaaccctctggaattttcagtctaacctaaatattgatactacacctgcagcagcatttagtttagcatgtagtgaaaaagtaagtctaaaaaatattttcataatctttggttcctaaaattgttttaaaagagatgcagtgacatatgtctggagtttgcttatggccaataggttaatgcttctagcttctatgcttattgcaaattttaattatgtgaatatgcaattttcacttatatttgttggtagcttgtttattattaaaatagaatggcttttattaaatatatcctaagaaattacggtagaaaaaattaccatcaaacattgtgggatatattgagatcatattaaaagtagcactgtgaattcaccaatagcacagtgaaatgactggtgacttttcccttgtaatttacattttcaacttataaatgaaagatattcacatgtaagggatcagtgacagaattaatttctgagtaatgcagaataaacatcaatattgacctttgtatgtttttaatatgtgacaatacatagaaatgttttatacaagattttagccattcttgttttgtatgaaagtattttttgtaggtttgcattaattgttaatgactttgtgtaaatcttgcattaattattcttttttctttcctactgtcacgttttttctcttttgatttcctcgtttgtaactctaccctttattttcttaattatttcattcttattctattttcaaaaacaattttcatcatgcagataaatgctgtgaagcgaataaaggcgaaaatggaagccagtcgtggcagctgaatgctgctgggttttctttcattatagccataagtttgtcttgcgtgttttaatgtcattgttatatcatatggtatatcctcttatgccctgaaaattaaaaaaaaatagtaatagcaaggcttatctaaaattataataaaatatttcctaaggtccaattaattatgcatgtatcttcacccatgaatgattaagctttttctccttcccccaattatcaaccttttaagtggataatttgtcagaaaatcaaatgaaggaaattcaatcgggattgctactttcagctaccagttcactgcataacatactttattctaaattttccattaattcctaaagttgaccttgttaaatagcatgtcacttgtacttgaaacttaagcctttgctacatctaatctttcattattattttgcaaataattaaatatccatggccatactttgtaaaaatcataattttattatgtagaattgtggatcactactattgctttttttactgttacttttaagtataagtttccaactttatgaacatttctaatatttcaatgtgtttaccatttatataaaacataagcattatattttattagatgtgtatcccaattgtgctgcttattttccctttgttgaaccaaaatgtcttaaggaataaatgtgaaacagtttcctattttaaatttgaacaccgattaatttttttcattaagtgaaaatatctctgcaattttcccagaatgaatgttaaattaaatttgtatatgtctaaaaagttacacccaattcactggatttagattacattttgagctgacctcaagtcctattgttctaacataagtagttatttattacatttttctggacatctggtagtcagaatccttgcaagcattagagagagagaagaaaatattatagacactcctttaaagaagttgaaatcaagatgggaagaaattgagattggaactagattccaaatttcaaaggaatttcgatttgagggagtagcatgaagaatgatttttggtctttgcaaattttcattatgtgaatatgcaattttcacttaagtaatctttacctaagtaatttcaaaacaagtaaagagtgtttgtgtttttcacttgcaaccacatcttaacaagtgacttttactacttatttatttaggacaataggaaacaaccagatgtacatatatgcataaaagtgaccataacatacttggtaaatcaaatgattgggttctggactctgtgattcattcatcaaaagctatcattttgttgaacagaaatatttttcgtgtctctttttaaagagatagctacagaatcttttcatatgagggctaggcctctctttcatagtagattttcttttaacttatcttttccaaactcctagctgtcaactgctatcctttcttgtaatctagtaatagacctgtagactgcagaagcaacccatcaaccgataaaacacacttctggccggctgggcgcggtggctcacgcctgtaatcctagcactttgggaggccgaggcaggtggatcacgaggtcaggagattgagaccatcccggctaacacggtaaaaccccgtctctactaaaaaatgcaaaaaattagccgggcgtggtggcgggcgcctgtagtcccagctactcgggaggctgaggcaggagcatggcgtgaacccgggaggcggagcttgcagtgagccgagatcgcgccactgcactccagcctgggcaacagagcgagactccgtctcaaaaaaaaaaaaaaaaaaaaaaaaaaacttctgcttccctcctttctcccctgctgagataaaacgatatctcaactcacacattatggaaatataatccatttatagggcaagttttgtttttaaatcaccataaccaatattccgtttattaaataactatcattgcatattaaatttctcgatatttgagactgaagagtttatattggttactaatttgtagaaggcgttgataaaaagatttctagtaacacctccagaaactgttttttacattcattgtaaccttacttgatctttccaataaattagagacatttctgtgagaatttcatgtagaaatgatcttgacttaggaatgacaaaatatttttttggagatcacggaatacttatttagtaagttagtgcaaagtttatttatcttgaagttttacatatcataactcaaggtcactaagtgatataaagaacattcaaagtgaggtatacacagaaataagatatatcaatttggcattttgaaaagaacctaatattaaaattatgttagcagagttatatacatttaaagagttgtttgttagattttaagcatctaagtgtggatctagttttagtccttaactttataagcagtctgtcatttggccaaatgtttattcttacatgaacacctatttcacaactctgagatacacataaattcttttaaaaatattctcagagatggtaaaataataggctttgtgatctgccttatttctctaagaaattaaaaagtacaaaactaaacaataaagctattgcattccaataaataaaaccttagacattttacatcctaggattttttaaaagttttaatgtgttgctgagttatcttttatattatctgaacaatactgttgttatatgcagccataaaaatcagacagtttacttgtttattttaaaaatgagtttgttacttttttggctttactattatttcatctgtctacccatctaagtaaatgtgattactggtaagcaagacataaaaatttaaacttattttaagtatcttcctagtaccatccaatgatttttttttcatacaatggagttttacataaaattctgtctctgaagatgtataaatttgagcttgtgtgttgagtgtaagattagtcattatatataatcagaaatatatgtctatgtccaatggtgtgtgtattgtatcgttcactgttaaaatatttcaaaagattgttttgaccgtattaccagttatgaagctagattgatttacttatgcatgattgccattatctgcatgtggaatatcaggatttttaaaatatagatctggatatctccttctttctcctcccaatctcttctagtctgtcttctttcctccattttacagtcaacgttactggcctctctaccccaatcaaaactataattactcatcagttcacagtaagacccacaagtaccatgtttcagatatgctaacagagtaggcctaggaggtagcagtaaattctttcctataaaatgtattcttacgtggaaaaaccttaggtgagttgctatttttgttcatttctttcctaatactataggtcattaggacggactaagtttaattttataaactctatattcatattatttccagaagcattttgcaaatgcacatatatgccttcattcctggtatacatgaacaagattgaaattaaaatatgtaaacattttaaatatgcctatctatagaaggggttagattgatgtttaatatatatgcaattttcacttacatatagcaaatacatataaagacaaataattttattgcaaataaatttgactttttaaatattcaagttctttttaaattaacaaagttacaagtatgcatcctagtgcacatgttacacacaataatatgcaatttgtgtcaattgggaaaccattataatttaattataatattttctgtgtaagaatactcattcattatgtttgagttaaattaaagctaaaacaagaaaaattccaaagtagtttcaaccacgtacaattaaatttatgattagtcatttatgttaaatgaaatatattgtacaagaaagaattaaaccatgaacttttggatctggaggtattcttagatacataaaaataattttaaatattaatatggtatatttaccctgataatggagaaataaaaccttaaaattacaaattattttaataattcaagatggatactgatatcaatacaataatacaatatatttgggtctagctttcaagactaatagccagtattatgcatgataacatttgagtttgtagtaattaagaaatatccctagtcatgtaaagttttctttaaaggtttaaatttgatattaatatgatataagcaacattaagagcttgaaatgatcaattctggtattaaactaaatattatcacatatatttttgtctggccttgtagtattatgatttcactcactgaataaagataaactataatattgatcatacctaaatatgtaactttatgtgttttattatgattaatctgtgtaagagataatgtaacatcctttaaatgatcttttaataagtccaatttaattatgttttctttttctattttaatttttatttatttatttttttattttcttgagacagactcttgctctgtcgcccaagctggagtgcagtggcctgatctcagctcactggcacctccgcctcctgtgtacaagcaacactcatgcctcggcctgcctagtagctgggtgtgctactaggcgtgcagccaccacacctggctaattttgtatttttagtagaggcagggtttcaccatgttggccaggctggtctcgaactcctgaacccaattgatcctcctgcttcagcctcccaacatcctggaattacaggcgtgagccatggtgcccagcctcatgttttcacttttttaaaatttattttcttttatcctttcttactttcttctaatgctttatttttaattttctccctttttctctatttctgtctcttcctcctttctctttctctccatttctctcttttgttctgtctctctccctctttctctctctgtctctcttatgcttcctttctaaatttttggccatgaatgaatggaatatatttcctctattatgtttctgttcattgtttgtaaattttaaaatactaacctttgtggtatagaaatatgtcataaaagcttcagcaaatctaatatattggatagatagctgaaatctgcatatttcaaataactgaatatacagatattctacaaattgtctttaaaatgattacaacttatgttgaaattggtgacgaggcatttccaaattaatctcataaatagtattgtttaatcattaatatttgatagttaaacataatattcagaatatatttccacagtaaattttgggacttaactaaagaaaaaaattaacacttattaactcgttctcttaccaattaccatataaattggagtattattctaaagttaatatggtttgtcttttaaatacaaagttgtattattccttctacatgttatacttacataatcccaatttttatctaaggaaaacattccctcagtttaaatctaattttatttttttcaaaattagacaaagatgagagtttaatatccatgctttgttttccaaaaacctttagttttgttgtctaaaattaagaactcaacaaagatctcttgtaataattcaacatattccctggctattaactaatttccaagcctgaactgtcagtaaatgttgcacatagcctggaatagtccataacatctgtattagctaatattctgtaaaactaaaaaaaaacaatatccaagaaatgtaaaaaataattatgtttaagaattctattagtgtttctgagatggtcttaactgcatttcatctcctttgttggtagactattatttcatctactttttaaggatactttcatccaagtagaattaaacttaattttaattgtgaactaatctaatattggttgtattaaatttagatatattgaaagttctaaaactatgtatgcttaagttaaattcaattagtctttatcatttcattttagttagtaaaaatatgttacacactgtaaagaatgcataataatgagacacaacttcagtttagaaaatatatttttatttttattctatgtatgtactgaataggggctacgacataaatctagctagtcttattttttttcctaaaaagcaagcaattacaactactgttttaaatagtgtacacaattcatgtacccctttcaagaatatttttctcttacattttcattgatgtcatgtataacgcttctgttttaaagtacttctgatcatttaattgcattcgttttcatcatagcttgttttcttgaaaaaaaagtatgctataagtgtattgtcctcagtatcatcttatttaaaaccctcaacataatatccagcactgtgtgtaatcctatgcgtgtgtttcatagtatattaaatgtcattttattttctgtacctctgtgtctccattgttgtaataaagaaaactgaggaaaagctttgttatacgtgttttctttattactggtacagccttttttgtccttgtcgagtgttgtcatatctaacttgatcaaatttaatacaaacatttatttacttaggagcaggtaataaacttatactcattaagttactcaatttttggataacccatacatcatcagcagattcataacaattgtatattgtaaaaataatttcgtgacaatatcaaatattgttacttccattgtaaacttgttctagtgtcttcataaaaacatcgatctctagtgggaggccaaaataatcatatatttcaataaaacacatgaacatagttaacaatttcagtaatataaagattgttaactagtctccattgctagcaaaagtccataaaggaaatataaacacgtaaagtgatttttctccagttcctttggtcatttcttttgttttgggcaccaaatgaataaagttgcagaaattgattaacattctgtgcttatccactgcaaaggtatgaaacacaaatagtaagttgaaattttggaataatactataagtaatataaaaattatttaattagcttttatagtgtaaaaataatttttgacatagatataaacagaaaagtcatatttttcttttagagcaaaatgttacattgcctgataaatatgaaatgatgccaaaattcaaaagagaaaatgttcattttcaggattttggattgttttggagcatatttaatttctcttattccatgacagtccagtccaaaatgtatattttaatatatacattattatacaccttttgaaacatgcttgtgtatatttcaaaatgaaaattttaatgcatttataagtcttatatattgtaatacttatacttcttttaaatgatacaatagttatagtagtttgaaacatacaccagaacagttatttctttttattatttttgtttttatttttcctgaatccccttgataataggatgatatcaaatggagggtatcttggaattcttaggaatttgtatgattactgttgtagtaaatatatattactttattaattttttattgttctactattctgggccattgtgaagaaactaaagagatttgagaaaatctgaagctattataaccaaactctattattttattatatcaacaaactgaggatcagaaaaaccaaatagtcattgatatagtcaagcaactttgattctcagttttcctcctatctttgttgtattacactaaatcaaagttggtacaagtaaatttctgacctataagttatatggtcatatgtcttaggtctagttcctttgctattttcttgattggcctgtggagaacaacaacaaaaaatccctatgtgtcagaggaaaggctatgtgtacaacaaccacggtttcatccattaatcacagtatttctattagtcagcttttatctttctcactcaaacttttacatatagctgcttccctatgaccaaggtaagtaagcacacattaagtttatggttttaaatgaatatcaaattaaattttcatcactttcttgttttttacacatattttgataacaccttactaaattacttatttgcattgttggtagagataggtaatttttaattaatatatttttatttactgtccactaaaagtaagatattttcatctcaatatgcatcctttttattttaagaattcaaagtaaatagtttcaacacttacaatttgcatagcagctatgtgtttgcttctctactgatttcttatttaatattacaaagagaaacaaaatgttaaaaacaagtattcaagatagaggactttattttttctgtttaaatgtggttaaataaaaaataaattatcttcaaattggcatttctgttttaaagaatccatgaataacacacctaaattttactattgtttctagaatataatttcacaatagctgaatgggatatacttgtatgtaatgtgaagtgcaaactacccttggctcttgaaaaacatcctatttcttagtgcatgttggcagaaaacattaaaatttgtatggaatttttatataatagcctgtgactcacggtcctgtcaaatggctcagtcgtgaaagaaagtttaagtgaacagggaaaaatatttatctaaaataggatgtggtatggttcactgctgaattctattacataaaaacaggaagctaaaaccttttaaagcatctatatgtgttactcctcacttaatatgtggagtttttttatttgttaaaggacagaaaagtaaaagttgtttttataggagataatcaatctaggcatagtagccctttccatgcaggtaatagagatatcaccattgcatgttttcccttttaaatagactttagtttttcaaatacttttagatttacaccaagattgaatggaaactaaagagggctcccatataccatctaccccagtcaggcacaaccttcctgataatgaatatctaacacccaagtggtacctttgttacacttgatgaacccacagtggcacattgtaatcacccaaagtttacagtttacattacggtgcatacttggtgttgtacattttatggatttggataaattaataatgacctgtatccaccattttggtaccatacataataaattcactgtcctaaaaatcctctgtgtcctaaaaatcctctcttcctccctcctttctccactagttcctggcaatcactgacctttttactatttcctaggtttgccgtttccagaatgtcacttggtcgcaattttacattatgtagcctttgcaaattgatttctttcaattagcaatatgcattcaaggtttctacgtgtctttttataatttgatagctggtagcataaaatgtcttcagtcagatgcattatataataatagacgtttataaaccctacatgcttaaaatatgtagttttaataatgtagaattgatgtttttatataactctaagcagaaattgaaatatctaagatagaatgcagtgagtatctaaaactgaaaactttaaacatcttaataaattaccatagattccaagaaaaataataatacgtatcttctgtgtatttgctcacatttttcatttattctgttacatgtttagaaaacgcagaagttttataaatagttaggaattttatattggagaaaattaaacagtttggactttcgaaaacaaattataaaatatgaactgaagtataatcatatagagatatgtttcaattttgtaatatagtctaggaaaataattttgtttgtacaatgaaaatatatttttcattttctatatatggagcagcctttcaatgttgacagaaaaataaaattggtcaggtgggggcttaaacaaagaactaaaaataaaattattcagttcttttacactggctaatacatatttgggtcatattcatgcaaatctttgaagctgccttttctactaatcaatacaaacactagttgttttatagcaaacaaactgcatccatcaaagtcaaccagaaatataaccaaatttaaacagtatttggaaaagtttagagttagtaagataatagcaaacatcaaaagaagaggttcaactggatagttaaagaacacaaaagatattttatatgtgccaaaatgatctcagttccaacatacataataatgtgaaatgtcagtgtagataagataatagatattttgttgtgcaaagacttcagatattttatgatttttcatggtttacagttgtaccacatttattaaaaggatattttaaaatatttatttttaaaatttttagtactttgtgatatttatcacaaaagagctgttatgtatgaatttgtttttagccaattttttttcaaaataagcacagctcagtttctttctttttcttatgttaaaatcagttactttaaaggataacaagaatttgacaagttctcatcaacatttctatacaagcataataaacttctattttagtggttcactttttacacaagattgttctaaaaggatagctaaaactataagagggattgtgtagatattttaaaaagcagggcggccatggggggctacttaaaattccattccaaataaatatatagagaatagttatacataaatataaacgtatatattatacaatttcatagtattttatcttatttagtttctatttttaaaatataccaatagactttaattatgtaattttaattcaacaactaatcatatataaggggctgagtctatttaattcttcaccttttcaatccaaacattatccaaggagttctcattcttatatggtgtgtggaaatgggcatggaataggagagaaggagagagggaagactggacagacatttaatagccattaccatagcccaggccgcctctagctctttccaaaccattgtgacgattctgcttccctccaatgactccctaccatcttttggaaaatgatcacaatttctagtttgtttttggtgctgtttgtcaattttgatttggttgatctatttatttgttactgaattcacttgcaagctccatcctctttaacagcatccttcaccactaaaattccaatgcccaccaatcacctctaatatccatgtatgttttctaatgtcagaatcacacacagtttcatacatctttttttattcaagccatgttcagattaaaatggactccttacgtcaaatgggaacctgattcttattttcgaaaaccatctcaaacattattttctttattatgtttccttgaccattggtcactaatttatatgcttctccctcctatttgctaacctcacattattttttttgccaagaggtaaacaataaattacactgcatattaatttctaaatgatgtatcttactcttcccaatacattacccagtgtatgtgtgtgtgtatatatatatgaaatatatatataatatataaaatatatatatgaaaacatgccctttaacaaagtacagcacaatgatgaacatatgagtgcacgtgtcttttgggtggaatgatttatatctttcaggtagatacctggtaattggattactgggtcaaatggtagttctgttttaagttatttgggaaatctccagactgctttcctcagtggctggactaagttgcattcccatcaacaatgtataagcattttcttttctctacggcctcaccggcatctgttgttttttgactttttaaaatgattattctcattggtgcgagatactatctcattgtggttttgatttacatttttgatgattaatgatgctaagcattttttcatatgtttaatagccacttgtatatcttctttttgagaagcgtctgtccatgtcctttgcgtattctttaatgagattattcatttattgctggttgatttaagttccccatagattctggataatagacctttgtaggatgcgttgttcgtgaatattttcccccgttctgtagattttctctttgccctgttgatcatttattttgctatacagaagctctttagttgaattaggtcccacttgtctattttttgttttgttgctatttcatttggagatttagccaaaaatcccttgccaaggccaatgtcaagaagaatatttcttaggttgtcgtccaggatttttatagtctgaggccttatatttaagtttttaatccatcccgagttaagttttgtatatggtgaaaggtagggatccagataaaatcttctgcattgggctagccagttatcccagcatcatatactgaatagagagttatttcccccttaccttgttgtaggtgaggtggttgtaggtgtgtggcattactttgggttttctgttctgtctaagagcattcaagccaggtgcctatcagtggtagattgtataaagaaaatgtggcacatctgcaccatccaattctacacagccataaaaaaaatgacatcatgtcctttgcagcaacatagatagagcgggaggccatagtcctaagcaaattaactcagcaacagaaaacaaaatatcacatgttctcacttataactgggagctaagtattgagcacacatggacataaatatggggacaacagacactgtggactactagaggatggggtgtgggttaaaaaactaccaatcaatcaagctgtgtgctcgctatcagggtgatatgacttccaaacctcagcatcatgcatttccgcatgtaagaaatctgcacatataccccctacatcaaaaataaaagttgaaattctaaaaggtatacagttttacaattataaatgccattcctataatctacttgtttatagttcccccatttttaaccaaatattctcaattagctactttttcttgccctgaatcagatattaagaaaaagcaaataaaaggatatggttatcggtgctacctttttactgttccgaatccctgataagcttcctaggattttgaagtgatttgaaggaaaattttggattgccactgagtttatttacaaaacaattatttatacgtgtaacaacattttgacaaaacatttaaaatcattagagaatggagactcagtactgaagaataagtgttgggaaatacatacatctaccccctaaagaataagcattctgggaaaagaaattcggtagtaagtaataaaatgtctacatcaagactgttcagcaaagtacacataaaatggtacattaaaacgaccttattgaaagttaccaaaaatagcctgaggatgtaaaacatatataaataagcattagcctttttttatttatttaagtaatgttgaaaattgttgatgaattttactcagaatttttaaaacctaaagttttcaaattccccaaataatatgtggatgctgtaaatagtattgtaagggactaaaagagctggaaattatgtaaaatgattttacacaatctacatcagtgtattaatgtccagtataaacttttataatttatttatagatctaaaaagagttccaatgaactcattatatacgtatgtgaaaatagagcaaataacttgtgtgtgattctaaaaattaaaaatccctccaactggccacacacaatccataagctggtgtaatttcatcaaattaagtgctgtattcctgattataatttaattttgatttttaatgtttttaagcattattatttttaatattccaaaactcatttcatagaatttatctcttaaaaagacactctttgcagttttctcttcatagataacaatgcttttttcacagccatcacagacattactagcattacatactttttcttttcaaattattcattgaaaattacaggagattacatgttgtacccatacagctctcattcaattatttctgtaacacatgttgtacccatacagctctcattcaattatttctgtaagcagttttatatatgatgactgcgaacttgagtgaacttaaaaaagttgccaataagtgcattttgtcagggagctgaaagatgtaatgcctttttataatctcataaatactctgagctgtccagagggagccgagacataccagagtaaaagattagaacacaaaagaagtacagtatttattttggggaggtgattttgattcactttgtaacaatcttttaaaagttataattttatgttttattacaatgaagatgaattgatctaaaatattggacaaaataataatacaataaatatgttaatgatcacaaaaacgtaataatgtactagggggcaaaatgaattatagaagaagagaatgcctcccaaaatccagtatctccttatctcaaaactgagcaaaagccaaagtcatatatgagtgacagtaagagcattagtaaattatatggacttcctccatcttcacatgagttttaaaaagatgaagaaaaattttatagtgtcaattaggaatatagcaatgaccaaaaccaaaatttactagctaagaagtgaagaaataaaaaaggaataatattaaaatttttaaaaacttgttgattctggccacagtaaaatgcgtagctaaaagtagaagaatggaaatgatctgaagccttaagccttaatgaagataacatattaaacaaataacataatgttttgtttatttgtttgtttgagacagagtctcgctccaggctggagtgcagtggcgtgatctcggctcactgcaacctccagctcccaggttcaagcgattctcctgcctcagcctcccaagtagctgggactacaggcgcgtgccaccacgcccagttaattttttgtacttatagtagagacagggtttcactgtgttagccaggatggtctcgacctcctgacctcatgatctgccctcctcagcctcccaaagtgctgggattacaggtgtgagctactgtgcctggccaataacaataaattttaaaacaaaatgtttgtacttgctaaaatctaggaaggttttgtataaaagtggagaagttctagtttaaaaaaaaatactgctataagcaacaagtaacaagaagctactctaaactgaatgtttttaaaataataggtttaacaaatgaaataataacatatgtatataatgacttggaattcccaaagtactttcttgcttgagcctaaaagagcattttcattaagataactagatatgtatatcaccattttaccaacaatgaaactgggaatgaaacaacaatattatttagatatttccaattgtattatatggaccacaaaatgggtgaaaaatataattcactctgaagatataaaatgttagaatttccaagtgcatttatatcaactcatctttttatttttctgttttataatgtgcattacatatttcaatatatattataaaatactacctgtttataatttaaaataaaaacacccatcttggaagtggatactcagctcttctctagatatatacaggaaacaattttaaaagttttctagaaggaaggaagaatataaaattcaatcatggttgctgttgagtgtgctgtttatttttttaaattttgaatgaatgtcaaatgatatttttaatcatccttgctaatgaaatttgccatgatttttctcttttttctctaattgatacaattaaaggagtattgactaaacattggaaacctcaaaagttcaaacacttctttcaaataaggagttttaatgtgaattaaaattgaataaatctatccatttagggatgcactacaggtagcaaaaatgcaagaggccccacctggtgtgatgcagaagaaaaacctgttcagagaaatggaaatagtgttacattgtgctcggattgctagtatcagtggttccatataaaattcagtgaattttataacttgcgtaaatcaaaattttcattttccttttttctacctgtaattacaacacatgcaaatgcgatctgaaagtcatgttctttcaaatatataaagataaatattttggaataatttttttcttaccacccacaaatatataaagaaaacatttatacatatatttctaattatctatgtagtttaactgagagaagtctatcaaagtccaaacatgaatcttaactcatttaaactatttggtaagtaagtttgtgattaacatgtaaggtcttccctgtagaagataggaagttttgttaatataagacatctctcttcacaactccataatgttgaagagtactattttatttcgtgacaagtggcttctgttaagaaatgtaaaggatgctgtttggttttatactggaagaacattatgaatacagtttattctcaatatccccaccatttttaaagccgtgagcatttaattttaaaaaaattatttttgaacactattttgctcacctagtctagtatctgctttgattgattctttctacattctgctacacattgactctttgaactacattttactctttgtatattcaagggaattctatggaaaatgccacaaaacaaacatttaattcatcaatttaatataatatccaggtttataaggaataggtaatcttggtagactgcttgcctaacataacacaacaagaagcgttgtataaatctcagaaatgttaattggtttttaaagtagtgcaatgcatttttctttaaaactatgtattatctcagaatgtgtcttccataacgcaaaattttgccataatgttaactattaccagtatgcccttgttaatataaatatcatatccattagctcctttgtcgtgtcttttgtaattcaatggatgaaattatataagggaatttataatgctccctaagtaaatatggacttgaagtataatatttctaaagagttatgttaattttattaattctattttagtacattttaggcaacccttctggttctgcactattttattagacagtcaatcaatgtttgtgaagcatacatggattaatgttcctttttttttttttgctatgtagctgcagaagtctttagactatccagatgtttgacttcttaagtagctgtcaattctgacctagatggagccctgctgcagaaagatgcctactccacctttctccacaccagaaatgcaatcaaaacaagactaattgactgtgttcttgtaatttttgagaaattgccctttaagtttcagtataccaaattcaaatattaaaaattacaatcatagttttacttcagtaatttacaaagccattcaaatccaaatcagcaatattttaagaagtatccctgtgaagtccaacactgataatacatttcccagaaattggtaaataagagtaattagataccttccaaatttttaaaaagtctctatcccctggaggaaacatttctactgactaaagtattttgcgagaaaaattttgcctagttgttttgcttgactatattaagtaaatttaatgttttcaacattttgacactttatattaagtatttctcaaaccattttgaatagaagttagtgaaactttagactatactcatgcctctcaaagaagatacttttggggtatgttttacaatggataatttctaaaaatattttttgaaactctaaagaacagttattaattctctcaattttctatccatgtatcaaatttatttaattgtaggattaactctgcactatttaaatgattcaaatttgaggtaattttgaagagtatgttttaaaatattcttaacttaatttcacttcataagattccacaaaagtattgttgaattcatgtctattgaccttaatctacaaagcaaactaaaacatcccccatgattagatatcaccaggtagaatttcaagttgcaggggattttttaatcttctttagtttttcctcatatacatgtatgtatttgctatagacttaggccaaaattttccaaatatcatttgatgttagggagtatattgtactacgaaggacgaagtaagaacatataattaagagtcatgtagacttatcaccaatgtggaaagataccgtacgtagtaatatcatcaacaccaatcagagttatttaatgtcttctcttttcatatgcttaacctacttgcctgctgcatccaacaatatctcttatgaaaatagctaccagtattctggaaacagcaaccaatcaccatcttaggactctgacttttttctccatgtctttattgcagctttccacgtcctgaaattaattttcagtctacctggagaagatgatacatgcacatagaaaaaagttaaataaaacattgaactatataaggagtcaaaaagcatggctagttttatgaatctaatagtgcagtggtttttgaaaagctagtattatcaaatataatacatttcatggacaaatattttaatattgcagttgggatttaatttatacaacagaaacatgaaaagacgcatacaatagtccctgctttagccagagatacattccaaaactctcagtggatgcctgaaacctttgatcgtacttaaccctacatatacagattttcctctacgtacatacctatgataaactttaatttacaagttaggcacagtaagttaacaataatatctgttattaaaatagaacaattacaacaatttgccagcatcgctaatcttgtgtataagggccattattaagtaaaataagggttattgaacatgaacgctttgagactgacaatagagggctgaaacagctcctaagtaactaagaggtgggtagtgtagataacatagacatgctggataaagggatgatttgtgtccctgtcacaacagagaggaatagcaagatatttcatcgcactactcagaatggcctcaaattcaaaatttatgaattgtatacttaaattttccatttgatatttttggaccacagttgactatagataaccgaaactgcagaatgcaaaactggatgaggagggactactgtatataagacatttgaatgaagcttggattctcatactttaatactttgattttatgtttggctgaaaatttgaatgcaattacaagaagatatggggaaacagatttagaaagtcaatttccaaatttcatggggttagagaaaatgcagctcagagggaaactgattctcacagttgcttttaatagtaaaatataaaccaaatatatttttaactttttatattctaaattatttattcttattcaattatgaagcccatttttcataacagcaatacaaaatgatcattaaagaggaagcttaaagcagaaatataagttagataaataatttacattgatgtttttcatttaaatagttgttaaatagttgtacctccaaataatattaaaggtatatggatattgacatttttctataagaataatacatattttaatgtatttgctgtattgctgtactgtattttatccatatcttttcattactcgttggtgaatatccaagataaaatgttgactctaacacaagtataaaaagtatacaacctggagttaattagtgattcacgtgtacagttctcattttaggggttagtatgtgacttaggccaatgacctctctggatctcagttttcttttatgtaaattagaactgataatattgttttcctaccttataaagttaccataaaatttacaccataagtcgtaagtgtaagtattctgatgatcttaaaaaataaaaaatggatttacaattatttaaattattacttatgctcaggtttgatttcctaagtaataaaaccatgattaactaataaaaatgaatgttctggatgttattgtgaaaatacatcattagtagtgcccgaatcttaatgatgtcatttcatatgtgcttatggttttatttgtgaaacgtccagagtacaaatagtggactttttatgccagagtaaattggtgagagaaaataattaaaatacttaacttttatagttgtaacagcctaacctcatgagatatgagaaagtataagcatttaaatacatcctcaaggtgacatttaatatatatataatatgtatatacatacatataacataactttcaaaagacaaaacttataaacttattatttttcaattttaattttttttcagagaatagtacatttgtatatttgtggggtacatgacaacttttgatacaggcatacaatgtgtaataatcacatcagggaaaatggtgtatccatcacctcaagcatttatctttcgtgttacaaataatccaattatacttttagttatttttaaatgtataattattattgactatagtcatcctgttgtgctattaaatacctgatcttattctatttttaacacaaacctatttgaagttcacttctatcctctgcaatgacaaaaagatacttattttttcataaaaataacttcaagcaacctacgattgtaataagtttataaagttaattttctatatatagaaaaaagtactagctattagtattttagcaattcttcaccataataaaatagggctcctatatggttaaaaaagagtaggatcttaatctgatgggatcaatggccttaaaagaaaaggaaaagagagttctctctgagtctctatcccacaagtgatcacacagtgagaaggaagctgtctgcaaagccaggaaaagagccctcaccagaatccaatcatgctggtaccttgacctcaaactctaaaccaccataactgttaagaaataaatttcttttgtttaagccaaaaaatgaagatgttttacatatataatttttctgaaagcttttctaaagataaaaatgaagcatataattatactagtttaatgctaaaaaggtcacaggatgaaatacttgtcatttaaaagctaactagccaaacctgaattattaaaaaaaaacttactttagcctcaagagaataatcattacttaataagagatagtcttccactttagattactgctgaaaagatgtgcttacagaatagtttaatgtttaacattagataatttttagttgaaatatcatttttataatactaaatatcaattttataatattaaaataattataagcagtacttgctagatttttactttgtactgggcaataagtgctggaggttaagtacattaccacattcacacaatcttctcaacaaacttgtgacctatttttggttgttatttttattataactgtctccattttaataaagaggcacttcagtctgagagatactagatggcttaccccaaaagctaatgatggtaagtgatgaaaccaggcgtttcttactcctgatgcagtgtttttaagaacaaagcaagaatcttcatacttaggaaaggtaaatgggaatgtgtataataaatcagatatattgtcattgatctataggatttattgcctagaactatctgcatgtgagaagaccctaaacgaagtagcagaagagtgatccattcaaaccaataggatcatcatgtgaatgtatacaccagggctaaaccacaattgtatatttttttccaattttttttcctgagctttagttgttgagtaatgtgcaacatatctaaaatgaatacatttgaaattgaagaaaatattgtattttcatataatcaaacatgtttcataggtaagttgatttcactgtattgtaatgatagattcagaagtgagtcatttatatttggaaatggataatggaagaaaatatataccatgattttttttaactgcaaacagaaatcctagcttgcttgatatattatttttgtagcatgaggcaatagttcttttttaattcatgcatagagatatacctttgaaaaactgataactaatctttggaatctcattctacacttgtttattgagattttgcaaactaaaaaaaaatattaaatccccatggctgagaaaatactattctttctctagttattcctcaagtggtttcatgtgcaaagataatagttctgtcgaaaccagaaaattcccggatactagctaagcaattttactaaactatcaccatctaagtagcatgttaaaatttggtataggaaggtattgaaattgacattaatacattattttttttcactaccttgtgtttatcactagtttttcttcatgaaaaacaaaataatttcaataaaaattatacttgcttggacatgagcattctaaatttgttaattcagtgactaagtaattctcatttgccgtatcatgatgacattgtagaagtatatttgcaagtgtgaaccacaaagttgctgggatgaagtgccaggcaaaatcacaaattgaatgattttttttttcaaaactgagctgtttgcttttagaattataagaaataaaaataacttaaacctattttttgaaaaaaaaaataaaataatgtagacatgacactcagtcatcctacagaactagtattcagacaagtctgacatactcaaagtcgacctgctagtgcttgcttttgtatgttagcagttgttctgattcctttggatcactatttcctttggatcactatttcttcaagtcattattaaaatattaaacctaagtttaaaaatatcacataggaaaactttttatacatatataaaacaaatacaggttttatatacatattttttcaggagtggttttctcacagttcaaatttacatctatacccgtatctgtcacttgtgtttcacatcagttacatatttgaacatgcagttattatgctgagtaataaatgcattttgtcattaaaaagactaaactgggctaggcacggtggctcatgcctgtaatcccagcactttgggaggccaaggcgggcggatcacgaggtcaggagatcgagaccatcctggctaacacggtgaaaccccgtttctactaaaaacacaaaaaaattacccaggtgcagtggcgcctgtagtctcagctactcgggaggctgaggcatgagaattgcttgaacccgggaggtggaggttacagtgagccgagatcgccccactgcactccagcctggtgacagagcaagactccatctcaaaaaaaaaaaaaaaaaaagactaaactgttatgcaagctaattcttaacatgtgttaagaatcattttgaatgcctatcaaattatatttcttccttattcttctagataatacattatcaccagtttatttcttttcattgttattattttctgatccatattgttatagctgcggagtctaccctcagattctactacaaacacgtaacacgtgattcatcttcattactacttgctccacttgccatttcaattttatcaatcagaatacttcatcttcttcctattcacctctttcatggttactttctttatgtcttttgggatttcctgcaaccatatgccaaagaaaagtggcttccaccttctcctaccttctcatggtagaaactaacaaaaggtcataaataccatagctataaaatgttgcctttaatctaatatatttgttaaaatattaactggagaaatacaggtgatccatttcttgccaaatgatgattcctaaaatattcataaaaaggtatatttaaatacattctctgttaaaataacgcgctcagaaccatccattttcaagtttaagttttaaaactaacataatctcatatagaagatttatttaacacttttcacagaagttttgattataattttcttttaacattatgatctattaatgggtgtcattttctgataaagtacatttagggatatgataatattcattatcttccccacagggattcaagaggtatatttaaaagaagaggtacttagacactttttctttgttaataaaaaaaaaagaagtttgaaaaagatagtcacataattaacaaatcaattgcttaaaatattgtttgaaaccagggaataggcgtcaacaatcatgaaattgaattctgccggttactatgactttattctgtctcttaaattgaattattggaaaagatttatttttaaaataatcatctaatattttctaatttagaggtttaatactttttttccttttttttttttttttttttttttttttttttactttttaagacacgctgtttaatggtcttgggcttggagcagtaattggcctgggagttgctgcactgctgctaattcttgtggtaacagacgtcagctgcttctttattcggcaatgtgggttgctgatgtgcatcactaggagaatgtgtggaaagaaaagtggctccagtggcaaaagtaaagaactcgaagaaggaaaagctgcatacctgtgagtatcaggcatctacatcatgtcatattaaacaagcgccacagtcaagctcgagtgctttacctgagggcgttgtagggtaaaggagtagggtaaagagtttgattatgcaacattggacactgcactgcctgctctctgaccttgaaactatgtatccttatatataacctagaacaaagtgactttgacaacagtttattcaaaattaaacctcacaatgggatcttcactgaaaagaatcactaccatgatttatagatgataaacatatagatggatggatagttgtgcaaatgtattccattttgatttattccaccggttttgtttatattaaataaaagaaaggcttcaacaataatctgagctaaaaactcagttgaactgagttaaaaacaacaaaattgtggcaacttctacaaacgtaaggcatgattacaacaggcttcatgattttttgtatagaaaatatgatatgtgctataaaatacaatattacagattctgaatatactattctaaaatttgatcaaaagttgattacttgttagaatttggagctctctgtgtagttctatttagttaagcagatataattttcaagaaagtatgtagatcgattttttagaaaattattttgtcctgtaaaagggaaattacaatgttttaatatttccattttgttttattgtgtttgtctttacatagatatagatctaatttcaaaagtagaatatgatcaatgcaaaaaattcagcaagcacaggaaatcatacacaaacatatgcacacacgtttgtgtgttatgtgtgggtttgtatacatatacatgtgtgcattaaacacagcaatcaaaaaataaacagtcttaagagttcaggacattccctttattatttttaaccttaagtcctttctactgcatactttttctgacacatacaaaagtgttgaaagactttaaagcaaacaactagttgggttccacaattaacattttgtgctattttgtcatatgtttattcatacgttaatcccttatattttcttgaatttcaaaaaatcatcacacaacccctacataattcaacttgcatatcattacatacagtctaaaaggtgtttacatttatgtaagtaaagccacagaataaaatgcaccaaatgtttcagttgaagagttttgacaaatgtttttatatgtgtaacacaaagccatatcacaattcagaaccttaccaccacattctggaagttctctcatttccttatccagtccacccacattaacctccctcacccaggccattgctattcctgatttttcaccacagatagtttttgcttattttggaacttcacataaatggattcctgcagtgtctacccttctgtatctgacatcttcaaaaatgttgtattaggaccattcatgttttgtatttcaaggactgatgcttttttattgttgaatcatttatattctttttctatgcatctgttgaagcgtggaaggtctcatactgttttatagacacatttgtcttggctttatcatataattttgttccattgtatcatttacaccttaaattttaaggataattcttttatttgaaaagtttttactttaaagttttggcttttaaaatatatgccaaaatatatatcattttttacatatttctgcgtttttgctaattgttttaacatttttactctcatggaagtataatattctaaaaggcttagctattatcagtgtacagtttaataaatattcacaagctgagcatgcccatttttaacgctcaaatcaagaaaaagaactttattatctacgtctcctttcctgtccctattcaatctcgtgctaagcaatatcctgacttcatagcaccatagattactttttcctgttttgtactttacataaatgagtttatacttgttgcatatggggtattttgatacaggcatacaatatgtaataatcaaatcagaataattgtggtatctgtcacttcaaacctttatcaattctttgtgctaggaacacattccaattctcctcctttagttatttgtaaatatctgatacattatttttggctgttgtcaatctattgtgacaccaaatactgaatcctattcattctgtctaactgtattttcatacccattaactgttcctacttaatcccccattcccccttccttgttacctttgctagcctctgctaacaattattcttttctctttctccatgagtttaagttgttgttgttgcagctcccacatatgaatgaaaacacacaatatttttctttctgcactgacttatttcacttaacataattttctccagttccaccaatatttccacaaatgattttccattgtgtatttagcaaattttcatccattcatccatggatggacacttaggtcaattccagatcttagctattctgaatattgctgcaataaacatgggagtacaaatatctcttgattttttttaaaatttttgatatataccaagcagaggaatcactggatcacatggtagtttctatttttagttttttgaggaagcttcatgctgtcttccatagtgacagtattaagttacattcccactaatccacaagtgtataatggttttcatttcttcacatcatcatctggattcatctttgcctgtcttttggatacaagccattttaactgggatgagatgatatcttattatggttttgatttgcatttctctgatgatgatgctgagcattttttgtatacttgctgtctacttgtatgttgtcttttgagagaaatgtctatccagatcacttgctcatttttaattggattatttgttttgtttttttcctgttttgttttagatgctcgtatatactggttattaactccttgtcagatgggtactttataaacatgtcctcctattctgtgggttgtcacttcactttgttaattgtttcctttagtgttcagaagtttttcagcttggtgtgatcccatttgtccatgtttgctttgtttatgcttgagaggtattactcaaagaaatttatgcccagatcaatgatctgaggtgtttcccccatgtttactctagtactttcatagatttggtcttcgatttaagtcattattctgttttgatttgttctttgtatatggcaagagataggggtctacattcatcatctatatatggatgtccagatttcccagtaccatttattgatgagacttccctatctccaatgtcttggcagctatgttaaaaataactctactgtaaatgcatgggtttatgtctgggttctctacgccatttcacttggtctgtgtgtctgtttttatgccagtagcatgcttttttgtttattatacctttgtagtataatttgaagttaggtaatgtcattccttcacttttgttcttttgagtcaggatggttttggctcttgtgggtcttttgtgtttccatatacattttacgatctttttttctatttctgtgaagaatgtcattggcattttgataagaattgcattgaatctgtagatttctttgagtagtatggacattttgacaacatttattgttttaatccaccaacataaaatgccttttaatttttgtgtcatcttgaagttttcatcaatgttttatcattttcattgtagagatgttttacttattcacttaagttaattcctaggtatttcaatttatttgagcttttataaatgggattactttattggtttctttttcaaattgtttcctgttgacatgtggaaatgttactgattattgtacgttgattttttatcctgaaacattactgaatatatttgttagttctaatagtttttttggtggagtttttagcattttctaaatataagatctgtcatcataagaaggattatttgactccttcctttccactttggatacattttatttctttatctttcttaattgccctggctaggacatccagtactacgttaataccagtggtgaaagtagacatccttgtcttgttccagatcttagaggaaaggctgtccatttttcctggttcagtatgatactagctttattatttattttcttctactaattttgggttgggttagctttggctcttccagttctttaagatgcattgtaaggttatttagttaaagtttttctgctattttggtgtaggtgtttattgctgtaatatgccactcagtactacttttgcagtatccaataggttttggtatgttgtgtttccattatcatttgtttcaataaatttttaattttcctttttaatttcattgacttaatggtcattcaggagcatattttttttaatttccatgtgtttctattgtttccaaagttcctctttttattgacttttagtttattgttttccgttgtcagaaaatatgcttgatatgatttcaattttttggaatttttcaagaattgttttgtggcctaacatacgatctattcttcagaatgtttcatgtgctgaggagaagaaagtgtattcttaaaaacgtggatgaaatgttctttaaatgtttattaggtccatttggtctatagcatattttaggacttatgtttctctgttgattttctgcctggatgtcttgtccaatgctgaaagatgggttttgaggttcacagctacgattttattaggatctttctctctaggtcaaatactatttgcattatatatcaaggttttccaatgttgggtgcatacatatttataattgttatattcccttgattaaccaacccctttatcattttataatgaccttattcatctatttttacagtccttattcaagcattttagtcattttctattaggttgcctttcttttccttactgttatgcaggtgtgttcttttatacaacatgctctacatatataacctgggctatacatataaattatgtatatacaatttattataagtatacataaacctatatatggtataattaaatttatatttataataaaatatttacatatgaaatataattttacatataacctcttttcttatttttttaactggcaaaatgttgtctctggggaggctgaggcgggtggatcacctgaggtcaggagttcgaaaccagcctggacaacatggcgaaaccccatctttactaaaaatacaaacattagctaggcatggtggtgggtgcctgtaatcccagctactcgggaggctgaggcaggagaatcacttgaacctcggaagtggaagttgcagtgagccattgtactcctggctgggcaacaagagcaaaactttgtctcaaaaaacaaaaaaaaaaaaaaaaaaaaaaaaatgttttctctggtgaacagaagtgcctgatcttcatgtagtttaatattttaatttgtctcttgtcttattttttaaatatttgcctatcctgaggtcagtaaggccctctatattttccactaaatctttatcatttcgcattttacctttagacatacaatatacctgagttaggactccacacacttttcagttagtattttttaaattatgtttagaaaatagcactagtaattttagtaattgaaaatgtcattcttttctcatgaatagcagtgccatggttgtgacatctcagatgacagaattcaaataggcctgtttctgttcttcttattctattccacttttcactttctctatcctttcaccaatgccagactttattaaccactaaatctttgccatggttgttttctaactgatagaataagttctccaagtttgttgttcttcaagatcgttttgctagtcttgactcacatatccatttaaaaaatttaaattatttatccataaaaaaatttgcaattacaaattttaaaaatgttacaatttgtattgggagtgcattaattttgcagattcattgaaagacaatcaatatctttgcaagataaactattttaagcaacaagccaataataacttgtgtgagctttgtaaataatctagatttacttatgaagtgaaatttttaaagtaccttattctttcacatgcagtccttttgggttgctgaatatgtttaagcagatgttgttctgcacgagtccaaagagggctattcatgagggtcatgacaccacttgacttgtgagaaaatgagtgcagtaaccttaggaccaattcccttacttcagtaaagagttattcattagaatgcattataactaaacaataaattttttaaaaaatgtttctacctataaccacttgtcttaaaatatatgtactcatgaaacatagtgaaatcatcaagatagtctctaaattttaaacataattatttttattttttgttagaaccaaagcaaattgctttcctaacaagatattatctctaatgtactttttaagtttgaaaaaatgctgacttttcccaattctcatttcattgaataaagtaatttcgatagaattaattcagtggaaaatttaatttactacctgtaataccataattaaaatccaatatattatggacattcaccctgggtatgaccatgaactaatactgataagacactataaacaatgacagcttaaacccgtgtaaagtactgtataatgaccacacttagctagaattaactgttgggtttaggtgtttgaaatcttcttattaaattttatcatttataactgaagaagacgtcaattttagagtttttgtattccttgcctataaaaatagaccatgggccatgtaattttaaactttctttacaaatctaaaattatgtcactccaattatgaattgttcagtaaataactctacagttgttaagatctcaggattttgagggagccacacagaagcataccgtatgtccatgtatcgaatggaagtagaaatgacaaaaacacaagttttagaaaacaaaaggaacaaaaggcatcctacccttgcaattactccccaaagaaccacatctacagtttgtactctttcgtgtctggcttcttacagaaaagcttgtattactcacaaaaggagagtaaggtctacagtctctgagaaataagaataaaaatccttgcacaggcatttcataacatcagtgctaacaaatggagagaccattgagataaaaattagtttggcaaataattattagtttgggaaataatatattttaataatctaattataaaagtttttttttcaattctaaggcagaagtaatcattacttttcttaaaatgaaacgccatatgccaactgagatttatttttcaaaattgaaaaacaaaggcttttaatccactttttaaatattgaaattcttctgaatttctatgtgcctaaaattcaagaaacttaactgttaaatgttcctgtaatatcacattttattttgtataccagtgtttttttctcttctcttttttcgaatctggctctttctattgagaaaatctagaagtcaaccatctgtattttttttccactttcaacttcctccctcactgcttaatctcttctatttttggcttatgcttcactaaagctgctcttttcagtcgagagattttatgttgatcaaatctcatgtcttactttggttttcaaattctcaaaccatcttggagaatgtgatattgtttacatgttccctcaccgacattctaccatccccttccaagactctgtatcatcttttttctctgtgtttcctcctcagttctctttctttatgtataatttatcccataactccaaatatcacctctacatgtgtgaataccaaataaatgtctgcgtctggtccttatcattctcttgggcatcaggatgcctgtgtgtgtctatttctaaacaaaatggcagtaattgagaatgtctgaaatctaacttagagtgattactcccaaattattttctgtttctgtggtcctcatctctgtcaatggaataagtatatttccagttccacttcaattccacttcaaatgcttctagctcaataaagattttctatttcatcaacttggctaaaatcctgttttatctgtgtactcctgtttcattccatttgtcatattcttatatcctttattacatatttttatattcatttcttagcattgttttaaataagccattctgaataaattacaagctcattgattattggcattggctcatattaacattaacattctaccaaatggtctttttctgtcacatataagaagacactagtttcttccttctattctgtagatagtatgcaaggaactagagggatagaaagctatgtgttcttcttgtgatatattgttttcaaaacctaactcaaaagtctcatcagttttccctcagtaagtactgacttaaaactttaacacagccaggggcggtggctcacccccgtaatcccagcactttgggaggccgaggtgagtggatcacctgaggtcaagagttcaagaccagcctggccaacatagctaaaccctgtctttactaaaaatacaaaaattagcttggcgtggtggtgcatgcctgtaatcccagctactcgggaggctgagacaggagaatcgcttgaacctggggaacgaagatggcaccaatagactccagcctgggctacagagcaaggctccatctcaagaaaaataaaaataaagtaaaataaaactttatcaccttgtaagagagtaccattttcagcctatttttaagtagctgtgaaaagattccaagaaccagtggaaaaataaatgagcttgaatcccagtacacttggagaagtcattctgacttctgtgaacatttgtttctttcttcataaaatgagaatttacagttctgctccacatgttgtgtgacataagtaaagaaatgcatgcaatatatgtaaaattacccttataatgcctggcatttaataataatttatgcatcagggttagaaatacaggagaatcgattcttcctagctacattttttttacatcaccaagcctttttcaactttactagattgtttgtctatgaccatttgttatgtatgttctgtaagggatatttttacttcatgagatgataattagataacatatttcagttcaaaaattagattcaactgttctcaaacaaaatgcaaactgcatatttattggacatggaataaactaaagaacaaacataaattagcctctactgcacactaaatgagatacaaataagagacatggtaaatacagtggaatcaattcatttccaatattttttgctttcttcgtcattgccttttatgcctcctaataattttctgtacttttacattgtcttcctaactaaacaaacagatcacaaagcttagttttagttgttttatttaaatagaggcacaagataaaaacacatagaataaatattatatataataacatcattacatatactatatattatgctattatatataaaggtatagatagagatatatattaaattttataagtcttctcttttgcccatccactgagcaaatatttatggaataaatgccaggttataagcacttttatagaacttaggaacaaattagtaagcaaagcaaacaataattttgttcacatggagttcaagttattgtggaagatggcagttaataaacgttaactaaaaatgaaatgtccagtagtgataagcactaaatgaatgaaaggcaggatgttaagttgttatttgatactgtgtcataaatacctctcagggaggtgacattaagcttaagggtgggtaataaggagctggtaatacaacaatcaagggacagaacattctaggcaggtgtaaattaatgtaaagattctaacatggggatgagcttgctatgttcaaaggcaaatgacgcttattggtgagagtcagagaaagagaaactggtataaatatcagattgggaaattatctaggggccaaagtattattccatcttcttgggtcaatgaaaagggtctgaattttgtttgaaatagaagactactagaagagttttaagaagatgacttttgctattgtgtgaagaatgggttattggacataataggtttaggggaatgatttaaaatcagggagcccagttaagaggagcttgaagtaatccagatgaaaaaagttggggttttttggcccaaggcagtggtattacacttatataagagtgagtatatttcagatatagttggggtagtgtcaatcacctgattgattttatatttggattagggaaagagagaaatcaaaatgtaccttcatgatgttgtttggttgtgcagacaaccaggtgtatgcagttgtgctgtttatttttatataaccctgttatttgttaatttgtccaccaacacctctgtttttaaaacctgctgagtttaattaaccttaaggaattgggaaaatgaaaatatgtggttaattccatgcttattattgatcacacaatttttatataaatttcttctgctttggaaaaacagatttcagctcttttcaaaaatgtagtgttcaagtttgaaaaagatataaaatcttaatgaggaatagggttaactgatttgactgttcggatttatactatcttttacacatgatcccaagcattctgagactagctctttcatgttttcaaaacttatgactatgatgatttattaaaactgcattaattacacctaaagcatttttgttttaagagcatctcaaggcagagaaaaaaaaattaagatcagtgtcatagaggatagtattagtgtaaagttctattttaatttggttcttatcaatttaaattactatatatcttacattctcaagggtttttcttatcaaaatgactaataatactttttaatcaaattatctttttactgttatttactcaagcataatttactaagcattaatattaaaaatatttattaaacatctatacaacaagagacaactctaacttctgtgaatacaacttgtgaaaaagcagactcattcctttctatcaggaaacttttattctggcaggaaccacattttaatttaaaaaaatcaaatgataaataatttttataaatgttatgtaaaataaataatttacctactcatatttatgtaagcaagttgtgaagaactaaagcataaggaagagtaggaattaactagctcgtgtgtgtctggtggggtgtgtggaagatggttcttcaggcagagggaatggactgtgtaaaaggctttgttataagagaaagtaagatttgatacaaaaactgaagaaatatgtatgaaatatcaattgtattttctgaataacagtgacaaaacaaaccaaaacaatactcccggttttcagcccagcatgcaaagagattaaaagttgccactctctcctaacaaaccaaaagctaaacaaactgaaatcaacaattcttagattcataagaaaaatgtggtgttagtgcaaactaccgtcctgaaaattgaagaggcagagaggcagatgcagaaaatcacaacttatcagagcagaaacctgtaagcagaaacgtctgtgagaaccagttcaggaataggaaaaaaatgtaaaatgttattgatgaattggtagaggctcgatgtggacaaatctgtgagttgaaaactccaggatgacttagtcataggaggtcctatacttctgagaattttaccttcaggagcttaacctagttgttacaatgattattggagaagtatctccttatgtttctggaaatagaagggggaagtaactacattaaaatatatcagaccattctgttcttaacaaagtctactctcagaagaaactgtttaaccagagcctaacatggggtttttaacagagcctaactgacccggagaatggaaatagccaacaccacccggctctatgtttccccctggaaatccccaactccagtccactctattcattctgtcccaccaaggctgtgggaggatctgagaaatgcttgtgaagtttacagccagaatcacggactcactaaaggactgagacctaatcatgggatgatagtctcttcttctgccccacacattacctccaaattactaaaggcctattgattatatttacccctactcagtatgttatgtccagctgtcaggaaaaaaattacaaggagtactgaacagcaaaaaacacagtttgaagagagaggcagcattagaaccagatttagatatgatggcgatgttggaattatcagactaggaatttaaaatatcgatgagtaacatgctaagaactctaacaggtaaggtagacaataagcaataacagatgtgcaatgtatgcaagcacagagatgaagattctagaaaagaggaatgtctttgataggcttattagaatagaaacagctgaagaaagaatctctgagcttgaaggtatctcagcagaaactgccaaaatggaaaggcaaagaggaaataagaaaaaaaaagactcaaacaaacaaataaactaacaaaagaaacagaacataatatccaagaaccatggagtaaatacagttataatatgtgcatattggtcatattaaaaaacaaagacagggagaaataaacagaagaaatatttgaagcaataatgacagaatttcaccaaattaatgtcaggcaccataccatagatccagaaaattcaaatgtgtaaattcaaacatgtaaaaagaaaatgcccacatatatacatcatattcaaactgcagaaaattaatgtgtatatatcaatatataaatatagatataaatatattattcatattcatatatatgaatgaatagtatatatattttatatatgaatccatatacatgaataagaatatatatgaatactatatttatatataaatatgaatatatatgaatgaatactatatatatgaatatgaatatatatgaatgaatgctatatatatgaatatgattatatatgaatgactattatatttatgaagatgaatatatatgaatactatatttatatataaatatgattatatatgaatgaatgatatatttatacatatatattccttatctatatagaatactgaaaggagcaagagagccagaggtaaaaacgcccttactgatggaggaaaaataagttttacatctgatttttctgcagaagccataaaacaagaagagagtgaagtatttttagtgttgagagagaaaaccccgctagtatagaattctgtctctgtgaaatgtgaaattatccttcacatgtgcagcagaaagaatatcctttctcagacaaacaaaaatagagggtattttttgccaatagatctgacttgcaagaaatgcttgaacaagttctttttttctttttctttttctttttttttttttttttttgagacagagttttactctgttgcccggtctggagtgcagtggtgtgatctcggcccactttgacctttcccttctgagattcaagcaattctcctgcctcagactcctgaataactgggattacaggcgtgtgccaccacgcctggctaatttttgtatttttagtagaggcggggtttcgccatgctggccaggcgtgtctgaaactcctgacctccaaccacctcggcctcccaaagtgctgggatttcaggcgtgagccactgtgcctggccctgaacaagttcttcagagcagaaaaatgctttaaactagaaactcaggtctccaaatcatttgatcatttttaaattggacttgtttatgttttgttgttgttatttgttgttgtttgttgttttgctattgaattgagttccttaatatatcctggttattaattccttgttaattgaatagtttgcaaatattttttcctattctgcaagttgtctcttcactttactgatggtttcccttgctgttcagatccttttaagcttgatgcgatcccatctgtccattttttgttttggttgcctgtgctcttgaggtcttactcaagaaatctttgcccagaccaatgtcctgaagaatttccccaactttttcttctagtagtttcacgggttcagatcttagacttaagtctctaatcaattttgatttgatttttgtgtatggtgagagataggggtctggttttatgcttctgcatatggatatctatctagtttgcccagcatggtttattgaagaggctgtcctttccctaatatatgtttaaagaaaggaaatgcatcagagaaagactaagtgaaggtaaattaaaaacttttacttttcttattcttattcataagattattgaaaataatggaaacaatgtattgtattatattatgtgtatatactacgtataagataaatgaatggtaacaatgatataagggatgaaagacttagaaataacttatcataaagaactcttgctacccattaagaagtacagtgttatttgaaaattgacttcattcagttcattgtaaatgtatattgaaaattcttgaacaacaaataaacaagttaaagaaagataactgatatactaaggaaagaaaattaaatcatataaaatgctcaattgaaatagccaaagacagaaaaatagtgaaagacaaaaactgaaataaagaataagggcaacaaataaaatagttacaaatatagtatatattaatctattgtatcagtaattacctgaaaattataattatctaaatagctcaattgaaaggtagagactgtcagagtaaataaaaaaaaacgagacccaaccagatattgtccacacacacacacacacacacaataagaataatgacacgtgaattaaagataaatagatagaaaaagacatactatgctaacatgaatcaaatgaaagcaggaatggaaatattgatgccagatgcagtcaacttcagagcaaggaaagttatcaggtttctaaacgggtattacctattatcaggtttctaaacgggtattacctaatcataatggggtcatttctcaaggaaaatatagtgatctttaacatgtatatgtttaacaacaaagcataaaaatatgtgaggcaaaaattaatacaacttaatgagaaatacaggtgtccacctttatagctggagactttaacgctgccctataaggaactcattcagcaagcagaaaaaaaaaaaaaaatggaatacatgaacccaggaggcagaggttgctgtgagctgagatcgggcaattgcactccagcctatacaacaagagcgaaactctgtaacaaaaaaaaagggggtgtggggggagaatacaaagataaaaagaaaaaaagtaagaaaaaatgggaaaatttgggaaaaaagagaaaaaaataaaatcagtaaggacgttgcttaaccaatcaagttcaatcaactatatatgtcatctgtagacgaattaatccaataacagcagaatgcatacacttctcaagcttgcctagaataggcaccaagatagatcacaccctaggtcatatgacacactttaaaacattttataaataggaatcatactatgtctgctctcataccacaatggaattatactacaaataaataaaagaaagctagaaaatactccaaatgcttgaagattaaacaatgtacatttaagtaacacataggtccaagaaaaaatctcaaaagaaatttttaaatattttaaactaaatgaaaatgaaaacacaacaaatcaaaatttgggggatgaagtgaaaccaatgtttagagggaaatttccttgaatacatatattagaatataagaaagatttaaagtgaattatctagacctctacctcaggaaactgagaaaagaagagcagattaagttcaaagtaagcagaagaaaacaaataataaacattgtagaagaagtaaatgcatttcaaaacaaaatcaatagagaaaattaaaactgaaagctggttcttttaaaagattaacgaaattgctaagtctatacctaagctaactcagaaaaataaaagaagacagagatagagaaagaaaatacacaagaatatcagaaataaagaaggaataactactatagacagcattgtcattcaaaggataataaagtaataccatgagcacctttatgccaataatttgataaccaaagtgaaatagagaaattcctcaaaaggcgcaatcagctaaatgtcacaaaggaagaagcaatctgaacagacctttatatccatcaaacaaattgaattaataatttatagtctccccagacagaaagcaccaagcccagacaagttcactggtgaattctaccaaacatttaaacattaaattatatcaattatctacatgttatttcaaaagatagaaatagagagaatactttctcattctatgaagccagcattactgaaatgccaaaaccagacaaagatatgacaagaaaaccacaggccaatatctttctaaacatagatgcaaacaccatttacaaaatattagcaagtcaaatccaacaatttataaataaactatatatcacacccaagtgggatttatcccaggtatgcaagtctggttcaacgttaaaaaatcaatgtaaatccaacacttcaagataataaagaaaaataatcataaaatcatattaatatatacataaattatttcacaaaatttgatacccattcataataaaagctttcaataacaatgaggggtggaccttccttaacttaataaaggatatctaaaaaactacaacttacatcattttttacatcttagtgagtaactagaagctgtccccactatatcctctctcactaattcttttcaacagtgtactggaagaactagcgaaagccattaagacaaagaaaggaaataaaaggcatattgattgggaaggaagaaataaaactctctttgtttgcagatgacatgatagtctatgaaaaaagtctgaaaaaacacctgggtatagtcaatgattatagcaaggttgcaggataaaagattaatatgcaaaaatcaattaatatgcaaaaatcaaaagtataccagcaataaacaagtgaaatttgaagttgaaacaaaattattattttaattagcaccccgcaaaattaaatactcagccgtatagctaataaaatatgtacaagatctatatgaagaaaactatgtaacttatgatagaaaataaaagaagaatgaaataaatggagagttatttcatgttcatggatagaaagactcaatatggacaagacatcagctcttcccaacttgatctgtagagtcagtgtaatcccaacaaaatcacaagtcattatatgaatattgacaaattgattctaaagtttattacatagagaggcaaaaagacccacaataaccaaagtaatattgaaagtgtaaatgtgtaggattgacactatccaacttcaatacttactataagctacgataaacaagactttgtgatattggccaaagagtaaacaaataaattaatggaacccaataaaaacctcagaaatagacctacataaatatactcaagtaaactgacatgtcacacatagttaaggcagtactatggtaaaaagatgttattttcaacaaatggtactggaacaactgtaatccataagaaaaaatatatctagccacagacattatgcacttcataaaaattaactcaaaatgtaatattgacctaaatataaatcaaaaaattataaaactactagaataaaacatggcagataatctagatgaccttggttttggtagtgaatttttggattcaacaccaaaagcacaatccatgaaagaaagattttttttttttttttgagatggagtctcgctctgttgcccaggctagagtgcagtggcctgatctcagctcactgcaacctccacctcccaggttcaagtgattctcctgcctcaacttcctgagtagctgggattacaggcgcgtgccatcacgcctggctaattttttgtatttttagtagagatgaggtttcaccatgttagccaggatggtctcgaactcctgacctcatgataagctggactagtataaaattaaaaatttatgctctgcaaaagacattgttaagtgaatgaaaagacgaatcacggaatgggaggaaatatttgcaaaacacataactgacaaaggactattatatgatgtatacaaataattcttaaactctatataataaaaagaagagcccaattagaaagtgggccaaaatacttaatacatacctaattaaagaacatatacaaatagtaaataagcttatgaaaagacatttcaaatcctatgaatcagggaaatgaaaattaaaatgagctactgtaccactgcaagcctatcgaaatggtcaacatctagaacattgacaacaccaaatggtagatgtgaagcaacaggacatctcattcattgctgatggaaatgcagtgatacaatcactgtggaagacaatttagcagcttctcaagaaaataaatatactcttaccttaaaatttattatttgagctccttagtatttacccaaagaagttgaaagtgtatgtctacaccaaaaccgcacactgatgttttcagaagcttgtttcataactgccaaaacttggaagcaattaaaacatccttcagtaggtaaatgaataaactgtggtagatcccagcaatgggctgttattcagcactaaaaaggaaagagatagcaagccacgaagagacatggaggaaacttagatgattattactaagtgaaataagccaattttaaaagactacctactttataattccaactatatgacaaatatagttttgctttgagaaaagcaaaagacactaaaaagatcagtggttgcacatgttggaaagaagggaggaataagtaaagggagcccagaagatttgtgaggcagtaaaactattctgtatgataaaataattgtgagaaaatgtcatgataaacattttcaaacacatagaatgtacaaccccaagagtgaaccttaatgtaaagtataaatttggggtaatgatgtgtcaaggtaggttcattgattgtaacaaatgcacccctctggtgggagatgttgctaatgggggaggctatgcgtgtgtgggagcaggggatacgtgggaaatctctgtatctccctctcaattttgctatgaaattaaaactggtctaaattaagtctatacaaatggaattttaaaattattctttgtagtttataattgctgggcatcatagcagaatgttttcctgatgttaaaaaattacaatgtatatggttaatagtttgtaacagtgaatacctgtacgtgggaaagtcaaaagactaaaagaaaaagaaaaacattaataaacaaggtttaccttctagtagacatattcacatgtgtgtctggaaatatttatcattactccatgacaaccacacatttatcacctgaaagactggctattatactgaattacactaatctaaataataaggaagaaacaagaagaatcatagatgttggggaaaagtgaatatacagaataaaatctaaaagaaatataattatataacttcaaatattccagaaaagaagttatatacttcagcactttatttctaaaccctgggaaacaaatggcacacagattacaaaaaacgagtgaaattttgctgttgtctatttggcatatttgaatcattttcatcctttctataatatgtaaaatgaaaatatcatggttgattcataaaaacacagatgaatgaggtcttattggatgttcagtcctaatctccttttcattcatccccccttatgaaagtatcatgacagtaggatccaatggttattgtgagtgaaatattacatgaatacccgctcctcaattttagctatatacatgggcccaaacttgaatcacaagcaattaatcagaaaatctgagaaagtaaagagaatatgaagtcacatgatgatacctcctatccaacgcaggtataaggaacatgaaattttcaatattaaatttgttttgggatgtgttttatttggattatttttgcatatccttccattgcatttaagttaaaattatttgcaagtaagttattctacatagtagagttaaactttctattaattatgcattctgaaataaaacatagaatacatcaatattttaaaaaccttacagccatatttgtattttaaggtaaccacagtatacccttttactcttcccttttctaaactaatcattctcgaagctgttttcatgatttattaattgcatgaaatccttacattctggcagggtgtgcttattaattaatcaataatatcacctctcatgatataccagatgacatctgacaggggcagagtgcatggacatttactgtctttaatgtggaaactctctctctctctgtgttaatattaataaaacataacatagtattagtgtttctttaagtaactaaatattttagttacaaaagcagtaccaacatatataatttatatttaataatatcaccttttatgatagactggatgacatttgacaggggcagaatgcatttagacattcacagttttaatgcaaaatctctccctctctgttgataaaacataacatatattagcgtttccataagtaaccaaatattttagtttcaaaagcagtatctatatgtaattttatatttaattaaataaaaatatatatactttaaataaaattatataatttaatttaatttaattatatataatttaatttaatttaattatatatgatttaatttaatttaattatatatgatttaatttaatttaattatatatgatttaatttaatttaattatatataatttaatttaatttaattatatatatttaatttaaattaattatatataatttaatttaattatatataatttaatttaattatatataattaaattaaattatatataattaaattaaattaaattatatataattaaattaaaatataatttgattacattaaattatatataattttatttaaacactcaaaaatcaaagaaatgtaaaaagtagaaatcaaagaccttaatcaatactgatcctatttgctgcctcatacataagcattaatatttttttccttccttcccaataattttccatgtggtctatagtttgtaaaaaataatatcctaggatacacacacactcacacacacagatatttctatgtactacatatatacatatataaattttagcaaatttatgtcacatagaaatgcagctgcaataatgttccatttcagcacataaatctcttcctcattcttttcataaatgagtagtattccatagtgttagatataataatgtatttctctgcttctttattgttacactttagaagaaactttcaatatttttataatggactgttctgttttgaatatccatatatataaattttgtaaatatacagtaagatactagatgtagaatggaaggccaaaactgaaaaattctggcaaattgcccacagaagtctattccaattcatggctgcaataaaagcaaagaatgcatatttctctacaacttctgacatattaaatatcaccaatttattttttgacaatctggtaagtaaaagtttttattttgatgttatttaagatttgcatttgtctatttaggttgagtctgagcttgtttctttttttggttactttgttttaattgtcttttaatatctttacacactttcatagagttatttaaccttttctcttacttgttgcttatatcatgtgccctataatcatttgattttgtattacttgcaaatatttatttatatgatgctatttattacatgaaagtttatatttttatctgcaagtttatgaatttcataaatttttttcagtgttgacattttcatttttaaaaaatttcttaaaattgaaagtttcagtaatatatttccaaatgtaaattctccatgcatgccacgacagtgatgcaggtaacactgattgagtgtggcacatgcatcagctattacaagtaacctacaggaattagtttggcactattaccatctttgttttattaactaagcaattcgaaggatggggagttttatgcaatgagttagtgggagagccagctaatttagttctgatacacctccctttaaacattatgctatgcttgttattatttcctatttaatagtaagttctaaaatatggcaggaatttatataatgttaaccagtctatacattgtgaaacttatccacattacattttgtgactattttgacaaacaattgcctcatttactctttttaattctacagacaatatcaataatgattctggtattacttaatataacttacacgaggtcaggagatggagaccatcatggctaacgcggtgaaaccccgtctctactaaaaaataccaaaaaaaaaaaaaaaaattagccgggcgtggtggtgggcgcctgtagtcccagctacttgagaggctgaggcaggagaatggcgtgaacccaggaggcggagcttgcagtgagccgagatcacgccactgcacaccagcctggacgacagagcaagactccgtctcaaaaaaaaagaaaaatattatatatatatcttacaatggataggagattcgacatgtaaattatgtgtgtttcaaatatagccaaccaaggttaagtaaaatattcacttgataatacttatggtatttattataataaaaaagttaaaaataacctaaatgtttgtcagttggtaactggttaaatatatggtggtacatacatacaacagcatagtatgcagcatgaaaaaataaaagacaactctaaatattcttttatagattatagctaaaactcagtgttagttcaaaaggctcaattatatacagttagtatattatttgtgtaaaaataactgtatgcatttgattcatatgtgctgatatctgtgtagaatgtctctggaaaaaaattaatgtaataaaaattaaaattaaaaaggtcaccaaaaacaaaaataagaattgtaaaggctactaactaaccattttctcttgttaatcttgaatgtcctttcagtaatatttaattatttttaatttaaagatatttgtttgcatattaattcttagtaagaaaaagaattaaaatcagaattcactagttctgtcttctctctgcattgtgctttagttcatcgtatatttgtaccaattgttaatataagaaaatgtttgaatcattttcttgctaagaatcatcaatagccacatttccacaaatagtatactcctgtatgtcatcacaaacactggcataatgcagaattttttaaaagaatcaattgaagaataatgaaaactaacacacaaacagaccaaacaacattaagatccagtggtggtgggctcttcatccatctttacttactctgtagatcttacttacttggggcccttgatcagataatgttgctaaatctgtgtgaatcactgtctcttacagacatctgattttcagagctaaaaaagtttattcacttctagatttcttctattcttataaacacccattcttcaaattatgatgcatgtgtatgtgaggtacctacatactcagataagaggaatgatatggaactgtgatctgatcaaaagtgttttatatccttagtgtttttttctatataagtctcagcatttgtagagtctgttcaatctttggaccattgtagatttgttgtttgcttgctttttttttttttggtaatcctagtgtatatgcttcctaagagcaaattttaatatcctatatccaccattatgataagaaacataacagtttccctgctctgaatgttctaaatgtcccacccttcctctagtccctggcaactacagactttattattgtcattatgcatttgtcatttccggaatgtcatatagttggaattagaaagtatttagtcgtttcaaactgcctcagttgccttagtaaatatatttaaagttctatatattttcatggtagttagctcatttattttttattagtagtaattttcagttttaccgatggaccacagcttacttacccattacctactatccattcacttattgaaagacaagttggttacaatttttggcaatttataaatagtgttactgtaaacattcatatgaagactgttgaatgaatacaaattgaagtccccaacccttctttagttttttttttttttttctgtacctatttgaaatctttattaggagtacctcatgcccaattcttctgtctcactttactccttgtcatcaccaaataacttccttgttactctttttttggttgttgttcagttgtgaggcatgaaacattataataagttttctagttttcatcaattgtgaaaaattacattcactgttatatattcaaaatttgataaagacgacattggaggatgaagttataaatgaaaagatatgcatatatgttacaaagattattttatttaaactattttcttgaaaaacgtgaataagttagaagtccataatcattttatagttaagatctttcatacaaatggatagacatatttaaaagaagacaacacatacaaattttgtcttctaaattttgaaataaaagcaacccttctgaagtatttcaaatattttaaaattttaaaatgttttcttttttattattttaaaaatgttttgaaatattttgatagtttcaaatgtggctagttagaggaaagaaacctacttgatgctgtacattttattaacaaaatattttcatttttttcaaaatagaatatatacagtaggattttaaaatgtgtaccaattttgcaaaataattgatacagttttgatgagaaaatctatctagaaaaaatggaatttcttcctttttttctgagtgataatatatggtgaaacaaatttaaatggtaaagcatttctcagtggttttcttaaattaaccaagttggatttatttggaggaaggtagaattgggtgattttaaactctgtttttttccataatgcatccatttttaaattacacaggtgagatgtttctctttatgtttctaggaaagatggatcaaaagaaccaatagtggagatgagaacagaggatgaaagagttactaatcacgaagatgggagcccagtaaatgagccaaatgaaaccacaccactgacagaacctgagtatgtggcttggagtgctcacttatgttcaaatgggtattggcaaaatgataacacattattattgttgtattacatatttaaatattaattatttgtaaaagaattgtgcttttacttttttgatgaaagtacatgtgaatatctaaaatccattttctaaggagacatttttcatgaaaactttgtatgaatgtcagagaaagtctgttaaaccatatatctgtaatttaatgcaaaagtataaaaaggtaagtatcttacagagtttgaggttttcaacaatagtctgtctttttaagatagtgttgttttctctttcaagataaaataattatatttactgaaataaggacatgttaggaaatttgtcatcgctttgaatataaatgtcattgaaatatacgcacggctattttaaaaagaaatatttgtgcagaggagaaaataatattaaagtgtttatcattgcaatatctatgtagtaaatgatgcttggtttccattcttgatgttatttattttgcatctctaatagctctgttaaaactatagtagatatcaaaagctgaaaagatgaatatacgcctagattcatgcacagaataattagaataattcaaagcaaaggcattattacaaagtagtaatagtagtattcttctattggatgtatgtggtactaacaaaaccatggtggtcacacacttctttactgtgcaccaaaaaaactttttaattttattatttttcaaaacaaatatttatttttgtaacacctaatattttcttgcagagtaaactgatttaggtttctcatcctaaatcaaagaaaaaatgttgtcacagatgaagaaaatgattttattttcataaattccctctgtctacccacaaggggctgaaataattaatatttacacaaatgcaaagtactactctatagaaaaaaatttaatataaatcctcgggccaattttagtgattgcatttagagattattacaatgtaaattcaaattaactgtattagatgtgggttctacattcttcactttagaaataagaggtgtacatgaaaactagttaagaatatgctcttggaccaggctatattttgggaaaaaagggtaatttaataactatttcacaattatagaaaattaatcaccaatataaaataatatgattaacagtgatcttaaacatattttacctatacgtaagtggtgagaaattctatacccagaaacaaactatcaatttggtgaaagcactgggtcattaaaaacttaatatatatttcatgagtaagagatatattattatgctaacttactatcagaactctaatcagaactctttctctacagtttgatgcttgaggtgacacattgcttttatgaccttgtattgtcaatattttcagtacttgtgaatgctaaaaaggaataactgagactgcactatttataacatatataaaatagcctgctctcgttggtacaatgttttttaatgtttttttcattcccagcaatggatattactagtttttgcctattacttcttttgattagttctgattgctttgatctgcagaatgttttacccttctcattcaaaaatataaaataaattacaaataaatcccagatgaactagcattgtaactttcactccattataacatggtaaggttaaagtcacagagatggattggaatactatttctttcttttttttttttttccgagactagtttcgctcttgttgcccaggctggagtgcaatggcgcaatctcagctcacctcaacctccgcctcccaggttcaagcaattctcctgtctcagcctcccgaatagctgggattacaggcgcacgctgccacaccaggttaatttggtattttagtaaagacaggctttctccatgttggtcaggccggtctccaactcctgacctcatgtgatccgcccgccttggcctcccaaagtgctaggattagaggcgtgagccactgcgcctggcctggaatactatttctaacttaattttcttggtgtggaaaaagtatgttgttaagggagaaaaacccatctccaaatgtcatgtacacaatagtaaacaattgaatttgcaagttttaggaaaatcttgaaagcacaattcattggcatcgaagtagggtttatgacgctgtcttgatattaagaaataaagttggtattgcttcataagttacaattgcaaacaactcaaaatccgtgttgcaaagtgacataaaagtgacaagaaaaacaatgtgaaaagagacaaaagaaaacatatacaataaatattaaaaagtgagcaagtcctaaaatatgttcatttgcattaagttctaaggaatattgttaattcacttagtttctgaattttattttattttattttaataataattattattatttgagatggagtcttgctctgttgcccaggctgaagtgcagtggcatgatctcagctcactgcaatctccacctcccggttcaagtgatttccgtctaatttttgtaattttagtagatacctggtttcaccgttttggccaggctggtcttgaactcctgacctcaagtgatccacccgcctcagcatcccaaagtgctaggattacaagcatgagccaccacgcccagcctggtttctgaattttatgtaacagaatatggcaacaattattaattgttttcactggagaaaacgtagtgctaataaatcatatcattgacatttaaaaatattttggcattttaccttccataacatgtaattatattttggagatcaacaactagttaccaaatctaagccaccctatagtgagcaatttggtgcatctatatctacaaatatattgtttcattcatcattctgcattacatttttaaaaggccaagtaattgtttttactctcttttagatctttttaaatctattttatattatgttaataaatttaatttttcctttctaattattgtagcacgttttctctataaaatagtaacttatttagcatatataaaatgttagcatattattggagcatattttccttacaaaacagtaacttaaaggttaaggtacgtctccttaaatacctcagaaaatgaagcttattattttttatcttccagaaaattgcctttaaaggaagaagatgggaaagaagctctaaatccagaaactatagaaattaaagtttctaacgacatcattcaatcaaaagaagacgacagcaaagcataacaacaatattacaggggcttgaacaacactacgaagagtatttggattgcgtgaccctatgaccaaaactattccattgaccttaatttcttgggaaacttctagcttggaatagcttgtacacatatacatatgatcaaatactcctgcccatgatccattcccttttgttattgttgttgttgttgctgttgttgttaattttgttaagaatttcaatatcaagactgactggcaccaacactttggtattcaatttgattctatgactgaagtactggaatttattatgtggctaaagtgctctatttattaagaactatatttaataccaccaacaaatataggggttaaggaaaaaaaacgtgagctacatgtgtaagaaggccctgcatgtgtatgagtcctattctgggcaaatagattcttaaagtggctttcaacttcaagatgaaggagcttaataatggttactcattttatcaggggaatttcagggaacgtaggcgtcaaagagccagttatctttagcagatattaaaaattgaaaactttggagaactcatttcaagttatgattcagtgcattttcaacattgatttttgatagactgaagtgccagatcaaaattgttacccatttgaaagaatattagttgtatataaaattagattagaaagactttctaaatctctatctctttatatatgtcctattcattcacaatggattatacaaaaaaaagtgtattgcaagtgaaataatattgatttctgccctcagcttcaaataaagtaaattgaaatgggaacaatatcaatatggtgtcttgatatatttataaatatgtgattatcatttatttttaaaataatttatcaaaaaacaagtctttagtgttcaaatacttcaaatcatatcctcagatatatttttagcccatggttttatataatctttaagaactaattttaccactgttataggttcaccattaaatataattggctaataaaaattttaaggttgactaaattaagaagaaattatttaacattttaatgtgccataaaagagtaaatgataaataattaaatgccactatgtgttctattccggatgttctagctagaagtcattttaagattttgataaacaactttggttgaagaaattccttaagtattcaacacaaactttctaatatcttttgttagggttataccagaataaaatgcttctttacttccaagctatgcaagctcccagaggtaatagagtgacacatgatttaacttatatgtaaggtttaaaaaagtatttatcattataaacatacataccatttgggagcaggtttattaaccttgagagccaaaggtttccttaggccctgtaacattcagaacctttggtgtttcaggtggtattatagctcaaatagtgacaggacagggaatgcgttccaaaggaatattggagcaattttaacattgcagaaacctgctctgggtgtgtctctctgtagagataacctgatgattattaaatgtaaaattaaggcaactcatgaatatttttatttacaaagtgcttgaaactcagccaaggagagaaaactaagtacttttatataattcatcacttttctggctacagcaggacagaatatgaccatcttcgtttgaaggcaccaaatcgtcgcagtgtctttgccataagttgcagggttaaatgcgggaatctctccttgcgttcctgtctggcgtattctgaagaaaagaacagaattcttgtgcctacctaagaatttgagtagtgtctaaacaaacaaagcagttaggtcattttaactgacttgattatccaactggtctttgacagatttgactgttcatatttagtttatgtttgtctgatcatccagtttgctttattttgctgtgttttattttgttgtttgttttgttttgtaccagtgtactaaaactagtcaaaatacttgaattagtttgtttgtgcaaagtgtacaagcttagtaaagtgtccatgaagcaatagccatgaatgctaattatttctaaatagggccacatggttttaaactaatgatggtgaaagaaatacgatgactgagaaagtcatttcgcatgtttactattgttatattcgtgctttacttcaagagtgcagaaatcataataaataacaaactatttttgtgttttctcaatgtgacatttctgtttctctcatttattcggattttccttgtaaagaaattgacatatatttcatatatatatacacatatatatatatacacatatatatacatatatatatatgatgttaaatttcctgccactcatgtggagtaatgatctgaaattaacagataatctgaagctaattatattcagactatttcaagtgcactgtttcagttgcccgggtggtccttacctcttgtccttgaaatccatgccatgctgaagcaaggcaatactgtgataaagtattttttttaatatttcaatggaatgctccaaatgatttataaaaatttcaaaataaaagatggcttgtagtaaattgtaaaatatgagtagaactgaaataacctgtttcattcttattctagattaaacaaacatatacatataaccatataaatgttatttttattgtctgagagtactcttaaatattagtataaagtgtcaaaagaattgactgaatataagtactgttaaaataatttgaaccctatgatattttaaaccaagaggcaaagatatcacctaaaacttggtatttcttgataggttaggtgcaattaggcagtgacaatctgtattcaacaacatataagaggaaagagtaatatcagaattttgacacaaattaatgtgtcaacatattttacaatgattgtcaaaggaatttaagaattgtatttttaaagatttatttattatttttgtgggctaagacattgccattctattgatactaatgtctaacattaatgtttcttgttttcttttatttttaatattaataactataaaagcatttttcaaaggctatttgatccagcacacttcatatggatcttagtctttgaattaaatatttatataaatagattttattaatcaaattatttatttgtgtgccaacaattaattgtaactttatgatcatatctttgtttatgcttcttattttaaataattaagatgtatctgtgccttttaattagcatgacagtctgctttattaaaagaaaaaaactacaattaacatcattactagtatattttgcttagatttgagatactcaaatgatgctgtcttatttacagtcagtaattaagttcaattcaaactattttaccttgaatataaaatctaaatataataaactatactgtataatttactttaattcatgtcaaaacaattctttttatacacacacatgaaatattcttaatctgttctgtattgtttttctaaacaataaatacattctagatattgttgaaattaaattttgccagttgtaagacaaagacaacagataacttttgaaaatcaagcaaattactatggtgtttcttgggtcttcattattccatttatatatattttttatttcgaataataaatcaacctttatttttggcaataagattatcactgacgaaaatatgtacagttcaagaagtagaaataatattttccattagttaatttaggaaatattggaatagcatattataattatttatgaggttcccaatgttgtttttcacagaaaataaggtaaacattcaacttaaatcccccatgaagttttttcatgctcatactcataatcattatcacataatgtgcttattcaacaaactttgtatctggatatatttttaacaataagtttgttagcattatttatttatctttagagagaaaatatttgcatctgtttatttaccctttgaagcattaatacttagtcactcacattgaaattgcatatggatgtatcaacataggctaaaattaaattatggatgtcgcagaaatgaaatacttcatcttagaaggtaaaattttcaagaaag

SEQ ID NO: 16916 - DNA, 28315 bp, Human
ctggagaaccagaaagtctcctctgagggaataacaactgaaggatgagtaggaaatagctacaacagtggttctcaaatgcccagtccacgtattacctatgctatgctaatgttgctggagataaatggatcagaagatggaggtaaattcatttttagtctttagatttttccatccatatttgctttctgtgttatggtgccatcaaaaaatccactcattcactccttaaaagacagttatgttacaggagatatttagatttatgaaaatcatgatacatgtgaaaggtagtccaactggatgggtgaacaaaataataatggcataagactgcaagatagcgtcaataaaaactccaggtatatttgttaaaaaggtgtatatgtttacataaaattaaagatatttactgaagacaatttatagagcattccgtatctttcaaacaaggaaatatgcacctggaatatttctatctttccttgacagaaagctcatgttctagatgtttcaattaaaaactgggcacctggcaaacacttaaatcagggtacctaccttgggctcttcaatctggagtgtaattacaaattcgatttttggtggcagcgcctcccttgtgccttccaaatacctctttatattcgtcagggcatttacatcttcaagttttacttctccttggttaggaaacatagaaaacagcatttccatctccagtagctgaagctgaaggctttctttcaccgaagcagacatgttgcctcgcaatcagcctgcctggaaacctcacaaggctcagggacgctgggtttgtcaatgccagccggtatccagcgaaatttcccgaaggtccctttacgtggaagcaattctgcaggaacgctttgcaccgagagctaggggcacaaaccagacacttgcactcttctttatttcctgactccaaaatctagtatgcacaacatcctctaaaacactccgtaaaaacccatattctgcgtacccgggctccgggttcccgcctcccgcaccccgcactagataggggaatctgcactttcaacaggtgtttggaactgtcccgctgcaggtggcaggcagacacctgcagacgctctgcaagcctgaattctgggaaaggctggggcccggcttccaatcccacccggggctcgggcttgggcggagccagacgctgcggcgagagaggccgcagtgccagcaggatgggctccgagttccccagcgccagtcgccacccctcggtcctggactcgcggaccgcccccccccaacaccgcggtggccttttcgcttgggccgcattccagggctccggacgtttacgattcactggcctctgccccgagggacccaggataagggtagggggtgtctcagaggtcattaaataaaagatgtttacagtgagctgggggaagggggtacccggggagacggcagccggagaaggcttcccagattcaaaggtttgggagatgacctcgacgtcggagagggggatgcgggccgccggcggcgctcactgtgggcgaggtcgccctgtccgaggcccagcgacggggctgattccccacccccgcccctagccaagaccactaggaaccccggcttcccaggaacgcagggcctgccgcccccagaggcccggatttggaggcggaggctgtgcctccgcggccgcagtgctctgagggcccgcgaccctcggccccaacccccgggccaccgcgggggcctcaccctttctggtcactcaatggtaacagccccagaccccgctcggaaccgcagccgcagttcctcaggcgccagctgcgcgcgacctgcggcgaggcgggggcggggctggcggatagtcctctgccgtgattggccagggggcgtggcgacgagccggaagccacgcagggccacgtctgcggttctgaggactgggtttgggtgcagacgttgttgcttgggcgcttctccgctgcgtgtaggtgaagggggcttcctgaccgaggtaagccgggccccgaggctcggagttgagaagggagactaccggtcggcaagggctcggtgggagcgggacaggtcagattctcggcccgacggaggggctagtggtctggcgggcgactgaccgagcggcggagcgcgcgggacacacctacaggcccctgcgccccgcgggcgggctggtcgggacgggccgcgggtctcctgccggggctctggtacgtggacctaggcggggacctcagggtggagtgccgggaatcacccttgtgcggtgattcgagggtaggcgggagagaggcaccaaggagatttgaagattgaatggagagtagggggatactcttaactttttgcgtggacgctggatttggcaaatatgctttcaataaaggcattcgcagaggcattgaaagtagttgtagggcctaaaacgcatgaaaggatgaactcatattatctggacctttttttttttaatggctttttggagttaacaggactggtttacactcttatgaataatcatgacacataactgactgctcagtttttacaaatatgtattcatccttaggaaagagatctgatcactgtcttgaactaaattagtttactgaatgccagctttttccaactggacaaaagcaagtatttttcaccatttcttgcaagttctgttcattgaagcaatgaaggacaataaagaaaacaaaattatgaggctagcagctggcggactgctcctcatctctgggctaattgggaattaattgacccaggaaatgtagtatatggactactgaaggaaaactactgactgaggttggaaaccccaagttccacttaatgggagtatcccagagaaaacagtattagtgggctaagggccgattttttgttgttgtttgttttgagacggagtctcaccctgtcgcccagcctggagtgcagtggcgcgatctcggctcactgcgacctccacccgcgggttcaagcgattctcctgcctcagcctcctgagtagctgggactacaggcgcgcaccaccacgccaggctactttttgtatttttagtagagacaagggtctcaccatgttggtcaggctggtcttgaattcctgacctcgtgatccgcccgccttggcctcccaaaatgccgggattacaggcgtgagccacctcacctggcctgttttttttttttttttttttttttgagaccgagtctccctttgtcacccaggctggagtgcagtggcgcgatctcggctcactgcaacctctgcctcccgagtagctgggattacaggcgccagctaacacgcccgactaatttttttgtatttttaatagagaggcggtttcgccatgttggccaggctggtttcaaactcctgacctcaggtgatccgcctgccttggcctctcaaagtgctaagattactggcgtgagccaccgctcccggccgatgttttatttttaaaagtaaaggaaaaaggtggcattctttcagaagaagatattgctagttttagagcaacatcttagaagggtgtcctgattgtttttagcaaatggaaaaagatctgggtagtcttggagaagaaactgttgccttttgcttttcctttaagaatatgtctctgtagtttgggagaaatagcaaaagaaccacaaagatttctcagatatttggggatatgtagtttcagtccactcaagaatctgactttaggcctcaatccgtcaccagctatctatgttaatttaggttagtttccctttttgtaaaatgaaatgatctttgagctcattggagtctctgaataggtgtaaaatcttcattttagttgagagtggaccaatttaagtgtgcccggcgtccaggatagtcctggagctaaaatgggaggagagtggggacaatctgctatctgccctgagtctgcccaggagtggacataccaagttggacaacatcttgtaggtaattctaacccacaggacttactctcctgcccattgctctgtcaaacatagggttctttgaggaggttcaggatgagacagacctattcgtttggggtggcagtttttgaagcaaatggttcttaagaaattacttgttatgcccgaaacaatatttcttaattttgtagacatggatttaggtgctattacaaaatactcagcattacacgccaagcccaatggactgatccttcaatacgggactgctggatttcgaacgaaggcagaacatcttgatcatgtcatgtttcgcatgggattattagctgtcctgaggtcaaaacagacaaaatccactataggagtcatggtaacagcgtcccacaatcctgaggtaatgggtttagtgccctgataaagcagaccattatttacaagaccaagccttagtgtctgagcaaattgacctaaagtacaaattctaattctaggaatgtgccttctcatttatatgtgctttggatgtgaaacaactttttttttttaagagcatgatcattaagctcatgattcctaagggtgtggaaagaatgaaaagatactgtcattttttggagtgtccatattagagaaataacaatgtccttccaaatttattgatttaagacattttcagtaattgaaaattgtttcctttgttaacttagcagtgattaaagatattggggttgggtggggaagggtaaagatttgaaaagaaacattttgaacattttcagacaggtttttatagctcggcaataatttcttgttctgaatgaacaaacaggtgagctttggcagaatattgatgacgcctgatagttctagtctttgtgacagttagattttaatcaaagtattctttttgacacaattattttttcagctttattgaggtataagtgataaataaaaattgtataattcaagtcatacaacaccatgttttgatatatgtatacattgtgaaatgattaccactatcaggctaattaacatatccattagctcacatagttaccttgttttgtggtgggaatacttaagacgtacgctcaacacattttcaatatatattattatgaactatagtcaccacgctgtacgttagtcttccagaacttattcatcttataactgcaagtttatgcccattggccagcatctccccatttcccttaccctctagccgccaccatactactctgtgtttctgtgagtttcacttttttacataacacatgtatgttatgagcctgcagtatttgtcttcatgtgtctggcttatttaacttcgcataatgtcttccagattcaaccatgatgcaaatggcagtatttcttttttaaggctgaataatattctattgtgtatatataccacattttcttcatccatttatctgtttatgagcacttttgttgtttctatatcttagccaacctcttgacacaatgtagttattctttattagctataggccattaatacagggtttgaataatatgcttctatttgattgctggggctgtgggatttttgcctttgtagctaaatcagcagcaagttaaagtggtgtaggtctgtgaaggattgtaacctcctcttcccccaaacaagggcattgcttgtccaaatatgtgatcattataaatgtgtatatgtctaaatatgtaagtcaccataattgattgactgattgacttctaggaagaccctcacatttattgctagttccagaggcacttctcaaaatgattctcttttctttcaggtgacattcactgtgaactacactttctttccacgaatttgagcagaacagtgttgggaggcagttttcagtgtctgtcctacccgctggttgacaagctggctagtgtgttcttggagttccgagtcatagtgagaaggatctctgtgtgcccttattctgctccacttgtgccctagtcagtttatggatagtggatgcacagatcacagccttttacaaaggctagtgtggcatagtgtttttaggcgagtaagatagacttgctgttttaatatcagtactgacatttgttagctgtatgatcataagcaaattacctaacctctctgaagctcagttttctcgaagattgaaattaaaataggattattagtttaattgattatgtgtgtcatgaggatttaatgaggtaatatatatacataaaatacctaatccagggtccagtattaatatttggtgtttattgttgaagctgctcagccatcactgtctttggttgaagggaaacagcttttgagttctgttctcaactcagcctcatgagtatgcacagattgcttattgtttgtttttcttttaaggaagacaatggtgtaaaattggttgatcctttgggtgaaatgttggcaccatcctgggaggaacatgccacctgtttagcaaatgctgaggaacaagatatgcagagagtgcttattgacatcagcgagaaagaagctgtgaatctgcaacaagatgcctttgtagttattggtagagataccaggtgatgataagagttactggtaaaaaaaaaaacctttgggaacgtgatataaacgattgtatcagttttaatccaagacaaatggaaagaagtaaagtggaactaccctgagttgcatgtctacctgcctggcctttctagtaggatgtagtagctaagtcactactgcagcttggggtttggagtctgactctggtttaaaaccctactccaaaacccaagctgcagaataatgtatgtaaaatacttcctgacacaagagaagcactcaataaatgtctcccaccccctctgtaggtttatttttttttccctacagagtcaacacatgatttgaactcattatttttaaagatttactttgtaatctgtgttattattgtttcaaatatttatatcattttcccatgctggagctcactgtaaactacaatattattttccacatagttctgttttgcagcttttgcctttcttaacaaaaatgtctttttgtaaaatattagatgaaaagtatactttgcaacagtagcatttccttttgcataagatctggttttaacctgagattatttcaaaaggaaatttctactcaatctccaatacctggactggtttttttaccctctgttgtattaccagagggttttccagataccgacgatggtagcagagtaacttatgttctgaagtaaattatcccaccacagtaaagtcatcccacatgtatttggttcttaactattaactaatgtaagtgatgaaacattttttcctacaaggcagtttttttattatttttcatttttttgatacggagtctcgctctgtcaccaggctggagtgcagtggcacagtcttggctcattgcaccctctgactcccagggtcaagtgattctcctgcctcagcctcccgagtagctgggactacagctgtgtgccaccacgcccagctaatttttgtatttttagtagagacgtggtttcaccgtgttggccaggatggtctcaatcttgtgatccacccacctcggcctcccaaagtgctgggattacaggtgtgagccactgtgcctggccaaggcagttttgtaatctgttttattttcagatagataatttgttctgactttacaaaatggaaaacaggttctatatccttggcagcttaatacaagtactgtcttatacacactgtgtatattcagtgtttattgttactgttcttagagttcagacatgttgctgtagtcgaacttgaaaaggtatttgggtatgctgtggttagagtgtcctttatatctattttataaattcatttaaaagccagaatttttcctagaactagattgtgaaaggctactggaaaatgcttataatttaccagttatcttgagagttcatagctttcagttcagataccaggaacttactattttgaaatttgtagcatgtaatttttgcatttgcttgcagaaccagcaaccctgccagtttcaggatgggatatattattttcttccttttctttcctaggcccagcagtgagaaactttcacaatctgtaatagatggtgtgactgttctaggaggtcaattccatggtatgtagttatcctgagttggaaattaaactaatatttaaaaaactttaatttacaaaagtaatgtatatttatttagaaaagtttgaaaatacagatgaacaaaaaatgtttaaaaaatgaactcctagatacaaaatactaactttaaaaatcatcttccaggtcgtttctgggcaggcatgttttgtcttacctatggtagtactataggagattatagctgggaaattctgaactaatacaacttcctttactttggtaaggctgaatttcctcaaataaaaacctttttaagtacttgaagatgatcattctggggagcttttatcaatattattaggtcttccctaatagctggttccctgtgaaatcagctgttacctgtcaagtagtgatgggaaatatttttgacaggtagttctttatgttatatcaaatgacagagaattaagtgaaacaaaacagactaggatccccttctcacactgtgtctgttgtgaaggcactgcctccaccatgttttgaggtgaatattttcctggtgtgagatctttctcattaaaacaaacgtccactcttgacctttgaaacctcctctcgagttccgactgtgttcccttcctgcacggtcagtctggcctctgctgagggctagctctgcttaccttctctgtttcctcctcttctgtcattcttcagctttctgcaggtgagtctgtatccttacctctccttgaaataaatgtctccccagcccacccctgacatccatctgcattgttattgccaaatctggtgggtattgtaaagtagggattattaaccagggacctctgtggcatgtctgggaaagctgcagaggacctgtggacctcatgatacgatgtacagagtgttgccggcacaagcactttcccagggagtgcatgcgtacctctcctcagatactcagagggggctgtgatctaaaaataattttaataatttatgctttaaagatcttacagttgaagtctttgtagctttccataatgttaaagctctttctttgagcttctacttgcttggccactattccatattggtcttctctgttggctcctcttctgtctctttcagggagggcattcctcgggaccctctttcattctgcatgatttctgaatgattatctctactgccatagcttgagctaccttttttcatttatttatttatttatttacttatttatttatttattgtttgagatggagtctcactttgtcgccaggctggagtgcagaggctcgatcttggctcactgcaacttctgactccctggttcaagcgattctcctgcctcagcctcccgagtagctgggattacaggcacatgccaccacacctggataatttttgtattagtagagatggcgtttcatcatgttggccagactggtctcaatctcctgacctcgtgatccgcctgcctcggcctcccaaagtgctgggattacaggcatgagccactgcgcccggcctcattcatttgttaattcatcaaacatgttttactacctgctgtgtacatccctctagtagtctatttctgtttcactgtgtatcacaacccatagtaagaaacccattatgtgtcatgacatgtcaatgtgtgcttgtgtgtataactgaaataatagtttcaataaacaatgctcatccagcctacatgacatgcagtcatctgtttaaaatgcacaaatgctggttgtgtctcactaagtaaattccatggcccattggcaggctgtggcctgcagtttgtaaagcattggtctgagtggtgtcttcccttaggtggcctgcttctgtctcatgttcaccctgccccaaactgtattctttctgtcatccccagaatggttgtctttttcagcattttcattctgtcgctagaaccatcactcttctagtgttttagtctagaaaaagttgagagtaatttttttaacctttccttcatttctctcttcagcttagtgtatttcagtaaatgaaaaaaggttaatgtagctgcaacatagggagaagaggggctaggagaagagagtagggaggtaaggtgggactaattcatacaaatcttggaggtcatggcaagaacttgggctctattccagatgcaatgggactccattgaaggattttatgcaagagagtgatatgatcacattttcatttaagccagtccctctgtttgtcacagagagaagggaaaggaaagttgttaagaaagggaaacagaccagctaggccgctcttgaaaaattggtattgcattcaaaggattttgtgatatgtggggagaacagaactgtgaagaacacattccaggtttctgagttgatgagttggatagataatgcttttcactgggtatatatactagtcatttagtaaatgtttatttggtaattttgatattggtcacaaaattattttgtttcttactttagcatgtcttttagaataatgggttcctctagtaaacacttccattaaactaatctaagctcttatttgtattttttgagcttctccatctcctcccatctcatcattataccagagctaaggttgccttcataaggtaccatttctgttaaataacttcagggctcaagaatttaaagtgactcctttttgcctgcagtcaaattcttgtgtttgaggttcaggtccaactgacaggtgtagtcactgagtatttacttattggttactggtccatctttgcgatccatttttctttgttttttgctcatggtgcttttcttatatgttagctatgtttaactgtaagctggttttctttctttttgtttttgaaaattatgggacgtttttgaggtttacaatgaaagtatagtcctttggtaaagtttagtctggcttctgctgggtacctggggcactggctgggttcactttaaattgattcatgacaggccgggtgtggtggctcatgcctgtaatcccagcattttgggagtatgaggtgggtggatcatttgaggtcaggagtttgagaccagtctggccaacatgatgaaaccctgtctctactaaaaatacaaaaattagccgggcgtggtggtgggtgcctgtaatctcagctacttggcaggagaatcacttgaggctgggaggtggaggttgtagtgagctgagattgcgccattgcactccagcctgagcgatacggtgaaactccgtctcaaaaaaaaaaaattcatgacaaagttcctttggactcctgtggttatgtatgttgggcaggaagtccatgcaagggcctgtgcttggtaacagctcttcaagaatgggttttcccgtcttccctgctcagtgttaagataactgtcctgggaatggtgacatggggtgattaatttctgactcatcctcggactgaagatatagttctttgggatttcaacttcatgagagtctggtcttctactgggttctgcatcttagatcagcatgggctttttttgctctgaaaaccgtagctcaatttctagtttagaggaataacttcagaacaaaactggcttccgaactagcttagatcttggagttcttgccttcgggtatgttttggcctgataattctgtcacttttcagcactgtagttctttttaaaaggaggtttttgtcttttatctagcatgttggttgtttccaggaggatgattcatctgaattatgtagtttgcaatgttactggaaacagaactcaattattacttgtctgtattgctttatatttacattgttacctgtttatatgtaatgattggttttttggcttcttatagtcatttatatttctttttaagatcatttttatgttttctaagatgtctgagatgacacaaaaggatttgtcaccctgaaattcctacacatgaatgcatttaaacttttttctctttgttaagaaatgcggtgaattgctttttgtatttctatgacagattatggcttgttaacaacaccccagctgcactacatggtgtattgtcgaaacacgggtggccgatatggaaaggcaactatagaaggttactaccagaaactctctaaggcttttgtggaactcaccaaacaggtgaaaagtttattgaacatggttaaagttaaacaaatgaataaagtaacatggtctactgaacaaattatcttgtttgtcatgcctcctctttccttttccaaagatgctgcatatctccttttttgtttttctctagggctacacaaggttctggtctatgtatcctgctaacttacattggcgtttacttggcaaattatgtagtacattctgagatactttggggaagcaaacatggtgggggtcttgacgatggtatcataagtattcattcagatgaatttgatcttagttaatgtaggtgctgttggcttaatacctgaggcatgtactattgagattttcttctaggtatattggcttgttaaatgtagagagatttgagaagtataattcgtttgatcaacaaatattgagtatatgtccttaccaggcacaattaactaaaagcccttgctctcatagaacttataatttggggtgaggatagctgggagaggagacaattagaaaaaaaacaaatctgcctgatgatgatgtcacatactataaaaagaatgacatgtcattactgcccatttgtctgtgtgcttattcttgcatttgaatggctcccttgtaatattacttttaagagaccctgttaattgagactaaattctaataaagctctatgctataagttgttcaatcagcaaaactattctgttgttccaggtgtttttaaattttactttagtgttttataattttaaaaattgaaaaatgaacacaattataattgataaaatttaaaaattaaaatgagttaactaaatatttacatatgcacatatgtatatatgctttatatttcacatttatttttataacttgaaatttttcttccatgtgtctttttcctttgtaggcttcttgcagtggagatgaatacagatcacttaaggttgactgtgcaaatggcataggggccctgaagctaagggaaatggaacactacttctcacagggcctgtcagttcagctgtttaatgatgggtccaagggcaaactcaatcatttatgtggagctgactttgtgaaaagtcatcagaaacctccacagggtatgtcgtactagcactgcaaaaatttgtttttaatgctctttgaagccaatctcacttataaactaaggtggtaaagtgagttaagaatcttgcagctattcctggctctgccacatttagacattgagaagtcttcccactctcagagccattgaaacatggtctgctctctctgcctgtaaatcacaccattcctcatagtctacaggaaatcaggtggggaaagcaaagtcaggaaatggcattctagagcagtggttctcaaactggcatgtgtcagaatcactttgagggcttgttagcacacagattcctgggctccacttctgagtttctggaggtctggcataggatttgcatatgatagaaatttgcatttctatcaagtttgcaggctttgttcccagtgcttgtctggggatccctttttgagaatcacagatctacaggggagcatagtaagtattattagataccttatctgaattaaatacactatggaaagcaaatgtaactctgcttatacagttgttagcaatcagtgttttccactcagtgcagaataggaggaagacttttcttcagattttagttgtagtaagaggtgttctggatttatctgcattatagaccctaaattatttgcttaggccaaacctgacttgcagatatgttttgtttggctggctgcatttgtgtgtttgtctgtgtgccactgtttaaaaattccgtgacttctcttatatattggaatctctagcatctctttaccaaaatcagaaaatgttcacacatggcattagtccactgcagtcagatagatgctgctcccctaaaataggacatgcattctggaactctacagacttcatccagttgcctcattcattcatgttattatgctttacttagtaagcatttaaaatgtcagtgtagtcaaccaatttgagctccttttcattgaattgcttgttttgacatttacttgacagttcagttctgccacttatttatccatttcttaaatactgagctcttactctctatgctctaggctttgggactacagtatgaacaaaaccatagtccttgctttcctgaagcttgcatcatgtcctttcatcaatcttatgatcccattcctgacaaaagccttttacttcttagttgtctcatgttgaatttgtcactctgctgctgtcatggctaaggaatagccaaattttctaataaatttgatgtgacaattgctgagatttcagcaactttatgtaaatttcacaggccagttatctctcaaagttataattctttgctcttaattatcagtgtttctttttattggtggtatgaacaaataaaaatcatttctgttagaattaaagcacatacatcatctagtgctgattattttttctatgtaaaggagatcacggtcctaggtaaattacattcagaaatacatgtagctttcaaaaaacctttatgggacacctgtctagccaaaccaacctgcttataaagtggaattttatggtagtattatagcaaatatcagcatagattttgaatgctccttttttcactttgcagtgaaagaatttgacctgtaaaaaccactaataaactatgtactatttaaagattatacactatttaagattaagacattgatttttaggtggataattttaagagaaaattctaaaactctttataataaattcttagactgaaatgcatgttaaattatcctgtgtgctaggaatggaaattaagtccaatgaaagatgctgttcttttgatggagatgcagacagaattgtttattactaccatgatgcagatggccactttcatctcatagatggagacaagatagcaacgttaattagcagtttccttaaagagctcctggtggaggtatggtggggggattggctaccctctaaaacaagacttagtagtgaaatagttccatattttacaatcatttgtcagaagggcacaatttatgacaaattctttacattagtgggcagaaaattaaaaaaagagcagtggtaatacccagtcatttgaacatttgaggcattggctttggaacctgaaggtactcttttcctccttatactggctgagttttgtgatttgaagctttaggaagttttgcttccatcataattgaaactttgatgacagttctgtggtcactccataaaagccctaaattctaataggaaatctcatcatctgatatattaactgattatgataagcttagtaatgtgagatttgtttcattttgctattttagaaataaatctcaggctagctttaagtacacaatgtaattggaaattattataatctggaaacagcatactttaagaatttaatagattttttttttttttttttttgagacagtgttgctctgttgcccaggctggagtgcaggggcgtgatctcggctcattgcaacctctgcctccctgggctcaagcaattcttctgcctcagcctcccaagtagctgggattacagatgcatgccaccacacctggctaatttttgtacttttagtagagatggggtttcaccatgttggccaggctggtctcgaacttttgacctcaggtgatccacccaccttggcctcccagagtgctgggattacaggcgtgagccaccgtgcctggccagatacttttatttaaaaaattaaagaggtgaagatcaggagatacaggcttcttaaaagaggaattctcatagaattgttttaaatagtgttcaaatgtattttaggcttttttcctggcatacatgtaaattttcagtcagacatttttggcataaactaaggcacaactgaactggctgataattttggtagcctttagaactctcattatatttgtttttgtagaccatacttttgatggcaagttaagtatcattgtttttgtctagattggagaaagtttgaatattggtgttgtacaaactgcatatgcaaatggaagttcaacacggtatcttgaagaagttatgaaggtattgaaccatttttgttttctggtagtttcttaattaagatcatgtttctgtgagaaagatactgccctcataaaagtgattatgttgtagtgcatgaagctgagctgctgttcatgtaaaggtaaagagaaataaataagaaaaaatttagttgtccttgatgaataaaggaaaacttctttccttccttttcttggagttttcctttagaaaacttggaattctttctctgtgcctttgtaatgaatgtaagtctttctaaaggcctaataagccagttttatagctcaggaatacttttctttaagggcctagagtcaccaatttcaaatataaacatcaaggaagatagctcacctatctcccagtctcaggagagtttaacttaggtgtttgcgtccaatttgtaactatctacctgtcacagaggtatgaaaagttttattactcctttagagaagggcagttaacacaggtggccatccctgttaccaagtaagtttaggataaactatgtgtgtgacaaatggtggtttcaagttttcctatttgaggactagtgttaaagaaaaaataattcatgacacttgttaaaatggtaaggcagacttgattcaggactgttgtgataggtacagggactaatgtgatggagttttgcagtggtaggagaaagattgggctcaactccaaatatagtaaggaaaagtagggctttatagccaaggagcagggtgtgtggggggtggtcagtggatgaaaaattactgagaggaaacatgagggtaagtgggtggtattttggctaaactgatctaacaggacttttgctgaaggtaggccagggcggtcacatattacctgggggatggtagagaatgagaactcagatcagatgtcaagagtggtcatgtatcaggatgagggattctcgctaagctcacttagcatgactcttattaaaatcgggctattggaagacatgcctaaggacaaggcctagtcaggcccacctaaacctaactaaagtttggtcaaggagagaatttttgtcattagccatcttttatcttagcaaattgtattggaatgtgtccgcttggctatattaaagggtgagcgtttatctttgctatctcttagcaaattagcctgtgattgaacatcagtttggcttaatacttattcagtaataaaactgtttcttacccttcttttttttttggagaggttttctggggtggtgggagattctgtttctaattatttccccggtgtccaccaggtgaccacccttggcaccacactacttgctcggagagttaccagggttcatggacaaaactggaagtctgtttgcctatactttctcattatcgagaagttttccaacttttttgtacctcattttgtacctcgttctggcatttatactagttttagttacctttccattctctagaaagcaggaattacaaagtcagattcctgcaggatttggacaggtaaagtgaatgagggcagcagggggctaaaaacaggtcagtatgtgccagctgatgtcaactgtagtcacactcttcaagagaagcaggaaatctgaattttcatgtgatgttcctatttgtttaaaaagaaacagtggctgggcaaaacgaaatatatcttgaggctgctagtttatgacctgattttaatatatggttataataagctcattcaagggattccatctggggcccatttgcctgcctttcacagggattgggttatttcacagtacttgggttattgttttaggattttcattttctgtcttaaaaatttattacagataaaataacctagtttaagaaactgttacttctcaactcactgtcttccagatgaaatatttttagcccttgccattcctgaggtctcctacatccaatctaatgctgatctttcttttgcagtttttctactatcaatctttccttaaccattcttaaagctctctcagatccatccatccatgactttccctattcactattgctgatccagccactatttcttactgggattagtcctagaagcctcctcattccatttcttaaccttctaattgaacttgctgctatttgcaaacaaagttttattggaatagagctatgttgatttgtttatgtatggtctgtggctgcttttgcactgtaatggcagagtaattgtgacagagaccatatggcctgcaaagcctaaaatatttactgtctggcctgttacagaaaaagcttgcaattctgctctaagctattctccacactgtagctaaacagctttctaaaacagttaggtcatgtcacgcccccacttgtaatctttcgtgtcttataaggagaccctcatctctctcaccgtgctttacccttggctgcgtgcttccagagtgtgttcatgcttccattgtatacgtaccattttgtattttaatgcttaatcgtcttcctcactggactcggccccagtattttgttcccctttgtatctctgggatactaggtatgcaagaaacatttgacatctgagtaattgctgtatttctttaaatgcatgtgttataggtacctgtctattgcactaagactggtgtaaaacatttgcaccacaaggctcaagagtttgacattggagtttattttgaagcaaatgggcatggcactgtaagttctcttaattatagttggccttagctggcacttttctttatgatgagacttctatatctgggaggtaataataggtaatattgtactttgttgaaataattggatgtgacaaaaagatcctttggttatcttatatattgatgtattatgaaactgtgattctcttttacatggtaatgattcttctttgaatgtgaagagatatactaaggtgttttgaatagttttttaaaatttacagttcttaatttttttataagtatgttgtctatgcattttccggctggccataggagaggaaaagaaaaattcagtcgctatggtgaattgcaaagtgttggaaagttgataattaataagaaatgaaaatgaatttaaggtaactagtgataggcataaaatgtttcaatttacattttacataaaattacattttaaagtgtataatttagttttttgtagattcataatgttcagaatatttttaaaatgtttttatactcacctcatttaatgaatacacttgaggtggctatcagaacatttgaatcaaagccaaataattttcctcattaatttaaaattggcttttggagggcataaatataaaaaggggaaaaataagttcctacaaaatgcaattaagatataactttagtgatcgaatggagaagttggtaaattattttctaaagggtagagagtaaatatttttggattttcaggccataaggtctcttacagttgtttaactctgctgatctagcttaaatgaatctgtgtggttgtgttccagtaaaactttacaaaaacaggtgactagcctgtgccttattttatcaagaaaaatgtatttcatcaagtagttgagcatagtatgctaatcttgctcagtattaggcctctagaaggcagtaaaaaagatgagtatttccaaatgagataagactcttgaggagcatgatgaattatatattgtaatgactatccatgacattatttgccatattttgatgaatactatgaactcttaattttgcctagctcatccccttaagttttagaataaaactatactagctgcaatgaattatatccttcaaagtaaaaaggatacagacaggctctaagtaacctggttgcacagaaatgatttagctggttaaagggaaaacatgaacttactgtgtgtgcttgcctcttgtcaaggtggtgttttctttgtaatcagatgtttaaatttttataaccagttatataatccgcaaataaaatttttcccctagtactatcctctgggttttaatgtgatcttacattaatttcatacattttaaggctgccactatttttcccctcagtttctccagattgactaggagggaaaagtgggttagctagaataatagtacttatgactaggttttggatagtgttttgagactgattttatattcttttgctgcaggcactgtttagtacagctgttgaaatgaagataaaacaatcagcagaacaactggaagataagaaaagaaaagctgctaagatgcttgaaaacattattgacttgtttaaccaggtcagaactgatggggcagtggactcttggttacctttacattattcagaagatggacagaacagagtgtgggtgcatacaaaattaaagtggagacgtcctggcctggtggcttccttctaatagtggtatattcagttgagatttataatgaaatggaatgacagaacattttttaatatgcttcccttcccctacctcttatgatggaaattttcaagtatattgggtagcttctacctaggatcacagattcagctactcagtgtatacatatatattattaatttttttttaaccaaacctcgatgaaattaagtaaaaataactggttgtcaggccaggcacggtggctcatgcctgtaatcccagccctttgggaggccaaggagggcggatcacgaggtcaggagatcgagaccctcctggctaacagggtgaaacctcgtctctactaaaaatacaaaaaattagccgggcatggtggcgggcacctgtagtcccagctactcgggaggctgaggcaggagcatggtgtgaacccgggaggcagagcttgcagtgagccaagatcacgccactgcactccagcctgggtgacagagcgagactctgtctcaaaaacaaacacaaataactggttgtctcattgacaaaggacatacatgtgggttagttggggttggagtgtcgtttggctatggaaaagcagtactcagggtagaggaaagcgattcaattatttgagtgtcttgcacacactggacactttatataccttgctgtgtaatccttacagtaacacagggagaggtgttactgtaatttccattttataagtgaagaaacagagatttatcttcagttatatcttataccaaagctcatatttctccattttaccttgatgctttctatcaatcattgtggggtaatatctcaaaagggatctatttataaaaagaaaaatgagtgatggaatgttaggctgagccttagagttatccagtctaatttcattttataaataaggagtactaaaggcaagtttctcaagagctagtttcagtattctttgttatacctttcattgtcttccacagagatcttcacctcattgttcgtattttatccatccacaaaaacacttcatttaatcatgctgcatgtgagaaagcacatgatataggctgagtatcccttatccaaaatgcatgggactagaagtgttttgggttccagattcactggattttgggatatttgcatatatataatgtgacatcttgggtatggcactcaagtcggaaacactaaattcttttgtttcatgtatgttacataagattaaaggtggttttatagaatactgtaaatttagtgcatgaaacaaagtttgtgtctactgaaccatcagaaagcaaaggtgtcactctgtcagccacccgttggacaatctgtggttgtctggcatcaccatcattcctaaaactctgaatttatatgctatcaatcaataagcaatcaatcatttttttacacttattcacacacaagtattttaatagtaaaaaatatgatacatatctggcatgcatggaaacgatgtatcatagctgaaggaggctgagagggtctttttcccttggggatgctgaatgaactgcgggcctgcctttagtgggttttttttgttgttgttgttgttttgttttgagatggagtctcgctctgttgcccacgctggagtgcagtggcgcaatcttggctcactgcaacctctgcctcccgggctcaagcaattctcctgcctcagcctcccgagtagatgggattacaggcgcccactaccacacctagctaatttttgtatttttagtatagatggcgttttaccatgttggccaggctggtttcaaattcctgacagtgaggtcaggagtgcatttgttttttattaagagacaaggtcttgctatgttgcccaggctggagtgcattggctgttcacaggcattatcacagcacactgcagcctcaaactcctagcttcaagtaatcatcccatctcagcctctcctgagtagctgggactgtaggtgtatgccaccacacctggcagttgtatacccacattttgacctgtcacaggaggccaggtgtggaatttttcacttgtgattattttggcactcagcatgtttcagattcaggttgttcaacctgtactgtgattggttttctaagaaaaaacatccatttccaagatttgcttgtgttaagtggtttcttccatttgtttccccatttgcaggcagctggtgatgctatttctgacatgctggtgattgaagcaatcttggctctgaagggcttgactgtacaacagtgggatgctctctatacagatcttccaaacagacaacttaaagttcaggtgtgagagaaactttaaagtaacttttttgaatattagctaagtaaaacctattatcccaattctcattatatctcactgacatatgtttcctatttcattctgtacatacacatatgatacatagaaaataaggccttatgggccaagcgcagtagctcgtggctcatgcctttaatcccagcactttgggaggccaaagcgggcggatcatgaggtcaagggattgagaccagcctggccaacatggtaaaaccctgtctactaaaaatacaaaaattagctgggcgtggtggcacacacctgtagtcccagctacttgggaggctgaggcaggagaatcacttgaacctgggaggcagaggttgcagtgagccgagattatgccattgcactctggcctggcgacagagcgagactccgtctcaaaacaaaaaaagaaggccttatgatacctaattgtattctcttacagctgaaaaaaaaattatagaataactaagttcatttacttaacattctattgtctgtgaagtatttggtttccaactttatgatataataaataatatgaatgacgcatcacttttttaaagagattttattatggaaaattaaaaatagatataaaaaaattaaaaatagatataaatgtagagaaacaacataatgaacttttgtgtacccagcttcaacagatttcaattattgccctatacattcttcataccccctcccaatactcttttgtatattttatttagagacgagatctcactatgttgcctaggctggtcttgaactcctgagctcaggtgatccttctcccttggcctcccaaagtgctaggattacaggtgtgagctactgcacctggccccaacattattttgaagcaaaactcagatgccctgtcatttcaagtgaaagtacttactctgcattatgtttagttcacagagtacttcctgagggagagaattcagataaattgctaattgatttctgtacatgtttatgccagtttacacattcaccaacagaatttgtgaaagacaattggaggtactaaagccacagttcacagaaatggctgattgttcagattatttttggcatatttaagaaattcttatcggtcttcttatataatgggctaccacttatcctgtttttgtgtgtgatatgggacttagtcatatcgtatttactggccattatcttagtggtaactctaagcatttgtggaaatattttttgccaaaggtaattctttatagactgaagaaaaagagaaaagttgcacaaatgttgaaattaattaccctgaccttggagaaagaagttttaatgtaattttatatttagtctggcacttttcgtagaatgtatgtttaacaggttaagcttctgaaaggaagtgtaatagagtaacaaatatgaaatgcttgcacttaggttgcagacaggagagttattagcactaccgatgctgaaagacaagcagttacacccccaggattacaggaggcaatcaatgacctggtgaagaagtacaagctttctcgagcttttgtccggccctctggtacagaagatgtcgtccgagtatatgcagaagcagactcacaagtaagctgggatagttctattgaaaaagagcctaatattaggtgatgggcaggcaaactattttaatggtttttagaatctcactatgatgattaaggctttattttgttgagccttttaggttcacattaagactacaaaattattttcaccagcagtaattatacaatttaacaaaattagacccacttagtttatttccccaaatatttttgacttattctagacttcctgaaagtgtcatatttttaaccatggcaggaataactaataaatacttagtttatgcactataaggtagatgatccttttctcttcttttaaaaatatactcttgtgacatgaaaacaaccagctttgtagttcatttctaagtcaactgatagcattctggactcttgatttgtttttcaaaatatttcctttaaatgacagccttactctgtgcctgtttccctgacaggggtcaagacttgtggtctggatttttattatttggcctcttcacatactccttaaagtgtgtgcaaagccagggcaaagtacagtgagtgcgctgaatagggaatcaggaggagacatttggcagctttcctgcagaagcttaagccatctcagagtctaatgaatatccatgatggatgaggagatggcaacagaggcattagtacttacttactgttaggccaattgtggattaaagttttattgaattttttcagttgtggaatgatagctatttttataatctgaattgattaaaaacttaccttatttagaagaatttggtctgttttccgtttatttaagggctttggaatttgttactgaaagatgaaaaaaggttttcattagaatttgttagtgaaacaaaatcaagaatcacccctctcttccccagagttccaagtaacatggtcttgcccatgttagacacatgctatgtctttctcatctaatctcttttaatgtaatttgcaggaaagtgcagatcaccttgcacatgaagtgagcttggcagtatttcagctggctggaggaattggagaaaggccccaaccaggtttctgaagataattttcatattcctgagaaactggactttttacaagtctttacaaaactgtcaataataatggcagtactaagagatttataatcataatgtttacaatgcagcctactggattgtctctagatctgtttttcttaaacactaacagaataattctttataaataggtaagccttacacttgttaaagaaatttacctctaatttcagtctcactaatgtaaaatactgggacttaagtatacaattcagtcactaactgtacagttttatgtggggaacaattcatgcaggctactggaaaattaaatcttattaccaactccttgtgatatctttgccatcaccatcacatgagcaagatgatgttttgcagcattccccattgctgatacaaatggagagggcagagaagactttatacaaccagtttttccattgcagagtcttaagaaagattattagatgacttacctatatgactaatgccatcaggaactcagaggtatgaatagggggttgtccatccctcttccatactgaggtggagatgctcatgcaatacttttaaggatgcatggtccagccttcagttattcttcactgctcttggtgaaggtatgtgggagaaaaactaattataatacgtttcccagcctctgatggagaaggaacaccattctgataccagaacatggttaataaggaaaagagaaaaatccccaaccaatcttaattgaaccaagtctgaaaccaatggaaaaaaaaaatgggtagtgtatattttgcaggtttaagacaactcaggacaataaaaacaatggactttacatgtgtatatatatagctctcttaggcaccataatcagtatgagccaacaatatttaaacttgattcaggccacattcagacatttgctcttatatacaaatatttaaattaaatacaatctgaaatgtgttctgttacatacaaaaaaggaaaaactatacaacgcagagcagtgtgtgtgttttaaataattacatttacatgtaagctaaatggaaccagcaatggtgctcaagtttttatcatcccttccagaaaatctttttctaccatctcttctattttttgcctggctttgctggaacatggtttgtggttctccagtttcatgtccttattagggaaggcatttgagtagaggataggactccctgagtgtcctccacatcggcttgtgactttgctgttgaagacttgactgagcacattgaagaacggcaggagctgctccatactgcgcacggtgcagatggtgagcagcaagtgccctggctcccaacccaatgttctccctgagttgtcttcctctggatttttctgcagaaaacaaaaagtgaactggtattaatacaacagacaatgtggtatgttagaaaaattaaaaatatataaactttggcaattggtcaagaaatgaatacaaatgacattaagtttctaactcctgacctgatcaaaacccttggtgcttctgagaccttttactgccatttattagttttacatggagcagtctaacattgtagtaatagttcccaactagaatgcgcagataagcttagttaacagaaatagctttgaacaggaatagagtcaaacataaaagttttatgttgtgctttgtatttactcaaaaagctcccaggtttctgaaccctcactactgtaaccaaggactaggtcacaaaattactacagaaaaaaggaacaaagtgctttatacatttcataatatatccccttttattataattagttaattcccttttatctaaatggcctaaatttgccatgatggtagcagtgtccaaagtgaataattactgtcagtactgcatcacagagaaaggaagggatccctcaggagacactgctgtctccttctgggttgtgctaaacaacatagggaggaaagctggacctggagtcaaaggaattgagttagtgtgctggctctgccatacttacggcacccttgggcaggatatacaaaggttcctcacttataaaatgggacagtctaaaactaccttttagtagagaagtcaaatgagaaggtatgtgaaaactctgtcaactaaatataaagactaataatttgggtattaagaggctagtttgagaagccacctgaattacacaaacacagctacagacatcattctgtctagagaaagataagagagaacaggttggttgaacttgggcagaatcacagatacaattccacactaaagaatgaaaataagcaatgaactagacagaaggaagaaatca

SEQ ID NO: 16917 - DNA, 14315 bp, Human; identical to SEQ ID NO: 12645

SEQ ID NO: 16918 - DNA, 11241 bp, Human
ctgcctaccaggttcaagcaattcttctgcctcagcctcctgagtagctgggactacaggcgcatgccaccatacccggctaatttttgtatttttactagagatggggtttcaccattttggtcaggttggtctcaaactcctgacctcaggcgatccacccacctcggcctcctaaattgctgggattacaggtgtgagccaccgtacctggccatattaagttttttgagagaattagaaaactgggtttcctcaactccaagatgttatcagttgtaaaatgtacccgtatgttttataccactaagaaagaaaaataagcctccaattaagcaacatgccatcaattgtaaaatataaccagaggggggagaaaagtagtgtttagctgggatacctccctactccctgaaaaacaagtcagggttttattagtaaatgaaaatgggagaatggatatttggtggcagtcatgataaccatttcatttctatatcattattaacctcttaaaatatccatcttaagtacattatggcaaagcttcttaaaatggtggcattggaatctcaagaaagtctcttctcatcctactccttacacagttgaaattaattgttgctgcctcctttctgtatctttttctttggctatcatttcttatccttttaatcaataaattcaacaatttgatacaatcagataattatttcctaaagtttgacttagagttaagcattgtacttaaaaagctacagggtagtctttcaattaaaatttatcttttaaattccatagggaccaaggtatttgttgatagcttcaggtctgataacttaaacaaaatgttctggcatcttgaaaaacaaactgcatggaatttattccagcttctcttccaaaggtgtcatggccccccttccttaggtcaattttgacacttacctatcaagttttcagaaatgcaatgagttcttgcttcttctgttgtgtatgtgttagtgataggaaattttttggtctcttcttagataataaatatcattggaatatttttcaaactgtgactaaaatgtctttggcattctccattgtactttttatatatgtttatgccctccctgtcttctgtatctgtaaggaatggacctgacattaagacttctccatagagcacatgagtaaggatttactaacgaactacattaaacccttgatagccctgaacaagcatctaaagaatcactcctctctgtctttaataagtcatggtaaaaagtatgggtaggtaagtttatgactgtattttaatgtttatgaatatgattaagatggtcacactttgaacagactcacaaaataatcttcaacttgttagtggtttcatttttttgaaaacggaaattctaaaaattacttatggaatgtctggtgtttgggggatgatgtcagaaatgaatctgttctgttggcctcaaccccacatcagactcatcagagtctgcatctcttttcctttttctgcacatctacttttgtttcttcctaagtgcccagtaatgtaaggaagcaagttctagttcccctgtagagctataaagctataaaggagactgaacattcacattactttgcagaaaggtgcttatgaaaattcagagacttggcggctttggaagatggctatgtaacattaaagtatgttctcttctctaatgatttgatcattttaacagtatgcattaacccacaggatttccagtagacattttcaattgaataggaacggcaataaaacaaattactaaagtgactataatccatttatatgtctattatttatatgtaatatatatatacatttacagatgctatattattttgcttgtaggtatcataacgtgattctagttctgcctccttaactattcttatttttattttttttagaacactgatatttgcatttaatggggaacaaaagatgaagaaggaaaaggaatatattcactaaggattctatctgcttactgctacagacctatgtgttaaggaattcttctcctcctccttgcgtagaagttgatcagcactgtggtcagactgcatttatcttgtcattgccagaagaaatcttggacagaatgtaacagtacgtctctctctgattgcgatggaaggtgataaactgatactcctttattaaagttacatcgcactcaccacagaaaaccattctttaaagtgaatagaaaccaagcccttgtgaacacttctattgaacatgactcatggagaagagcttggctctgatgtgcaccaggattctattgttttaacttacctagaaggattactaatgcatcaggcagcagggggatcaggtactgccgttgacaaaaagtctgctgggcataatgaagaggatcagaactttaacatttctggcagtgcatttcccacctgtcaaagtaatggtccagttctcaatacacatacatatcaggggtctggcatgctgcacctcaaaaaagccagactgttgcagtcttctgaggactggaatgcagcaaagcggaagaggctgtctgattctatcatgaatttaaacgtaaagaaggaagctttgctagctggcatggttgacagtgtgcctaaaggcaaacaggatagcacattactggcctctttgcttcagtcattcagctctaggctgcagactgttgctctgtcacaacaaatcaggcagagcctcaaggagcaaggatatgccctcagtcatgattctttaaaagtggagaaggatttaaggtgctatggtgttgcatcaagtcacttaaaaactttgttgaagaaaagtaaagttaaagatcaaaagcctgatacgaatcttcctgatgtgactaaaaacctcatcagagataggtttgcagagtctcctcatcatgttggacaaagtggaacaaaggtcatgagtgaaccgttgtcatgtgctgcaagattacaggctgttgcaagcatggtggaaaaaagggctagtcctgccacctcacctaaacctagtgttgcttgtagccagttagcattacttctgtcaagcgaagcccatttgcagcagtattctcgagaacacgctttaaaaacgcaaaatgcaaatcaagcagcaagtgaaagacttgctgctatggccagattgcaagaaaatggccagaaggatgttggcagttaccagctcccaaaaggaatgtcaagccatcttaatggtcaggcaagaacatcatcaagcaaactgatggctagcaaaagtagtgctacagtgtttcaaaatccaatgggtatcattccttcttcccctaaaaatgcaggttataagaactcactggaaagaaacaatataaaacaagctgctaacaatagtttgcttttacatcttcttaaaagccagactatacctaagccaatgaatggacacagtcacagtgagagaggaagcatttttgaggaaagtagtacacctacaactattgatgaatattcagataacaatcctagttttacagatgacagcagtggtgatgaaagttcttattccaactgtgttcccatagacttgtcttgcaaacaccgaactgaaaaatcagaatctgaccaacctgtttccctggataacttcactcaatccttgctaaacacttgggatccaaaagtcccagatgtagatatcaaagaagatcaagatacctcaaagaattctaagctaaactcacaccagaaagtaacacttcttcaattgctacttggccataagaatgaagaaaatgtagaaaaaaacaccagccctcagggagtacacaatgatgtgagcaagttcaatacacaaaattatgcaaggacttctgtgatagaaagccccagtacaaatcggactactccagtgagcactccacctttacttacatcaagcaaagcagggtctcccatcaatctctctcaacactctctggtcatcaaatggaattccccaccatatgtctgcagtactcagtctgaaaagctaacaaatactgcatctaaccactcaatggaccttacaaaaagcaaagacccaccaggagagaaaccagcccaaaatgaaggtgcacagaactctgcaacgtttagtgccagtaagctgttacaaaatttagcacaatgtggaatgcagtcatccatgtcagtggaagagcagagacccagcaaacagctgttaactggaaacacagataaaccgataggtatgattgatagattaaatagccctttgctctcaaataaaacaaatgcagttgaagaaaataaagcatttagtagtcaaccaacaggtcctgaaccagggctttctggttctgaaatagaaaatctgcttgaaagacgtactgtcctccagttgctcctggggaaccccaacaaagggaagagtgaaaaaaaagagaaaactcccttaagagatgaaagtactcaggaacactcagagagagctttaagtgaacaaatactgatggtgaaaataaaatctgagccttgtgatgacttacaaattcctaacacaaatgtgcacttgagccatgatgctaagagtgccccattcttgggtatggctcctgctgtgcagagaagcgcacctgccttaccagtgtccgaagactttaaatcggagcctgtttcacctcaggatttttctttctccaagaatggtctgctaagtcgattgctaagacaaaatcaagatagttacctggcagatgattcagacaggagtcacagaaataatgaaatggcacttctagaatcaaagaatctttgcatggtccctaagaaaaggaagctttatactgagccattagaaaatccatttaaaaagatgaaaaacaacattgttgatgctgcaaacaatcacagtgccccagaagtactgtatgggtccttgcttaaccaggaagagctgaaatttagcagaaatgatcttgaatttaaatatcctgctggtcatggctcagccagcgaaagtgaacacaggagttgggccagagagagcaaaagctttaatgttctgaaacagctgcttctctcagaaaactgtgtgcgagatttgtccccgcacagaagtaactctgtggctgacagtaaaaagaaaggacacaaaaataatgtgaccaacagcaaacctgaatttagcatttcttctttaaatggactgatgtacagttccactcagcccagcagttgcatggataacaggacattttcatacccaggtgtagtaaaaactcctgtgagtcctactttccctgagcacttgggctgtgcagggtctagaccagaatctgggcttttgaatgggtgttccatgcccagtgagaaaggacccattaagtgggttatcactgatgcggagaagaatgagtatgaaaaagactctccaagattgaccaaaaccaacccaatactatattacatgcttcaaaaaggaggcaattctgttaccagtcgagaaacacaagacaaggacatttggagggaggcttcatctgctgaaagtgtctcacaggtcacagccaaagaagagttacttcctactgcagaaacgaaagcttctttctttaatttaagaagcccttacaatagccatatgggaaataatgcttctcgcccacacagcgcaaatggagaagtttatggacttctgggaagcgtgctaacgataaagaaagaatcagaataaaatgtacctgccatccagttttggatctttttaaaactaatgagtatgaacttgagatctgtataaataagagcatgatttgaaaaaaagcatggtataattgaaacttttttcattttgaaaagtattggttactggtgatgttgaaatatgcatactaatttttgcttaacattagatgtcatgaggaaactactgaactagcaattggttgtttaacacttctgtatgcgtcagataacaactgtgagtagcctatgaatgaaattcttttataaatattaggcataaattaaaatgtaaaactccattcatagtggattaatgcattttgctgcctttattagggtactttattttgcttttcagaagtcagcctacataacacatttttaaagtctaaactgttaaacaactctttaaaggataattatccaataaaaaaaaacctagtgctgattcacagcttattatccaattcaaaaataaattagaaaaatatatgcttacatttttcacttttgctaaaaagaaaaaaaaaggtgtttatttttaactcttggaagaggttttgtggttcccaatgtgtctgtcccaccctgatccttttcaatatatatttctttaaaccttgtgctacttagtaaaaattgattacaattgagggaagtttgatagatcctttaaaaaaaaggcagatttccattttttgtattttaactactttactaaattaatactcctccttttacagaattagaaaagttaacatttatctttaggtggtttcctgaaaagttgaatatttaagaaattgtttttaacagaagcaaaatggcttttctttggacagttttcaccatctcttgtaaaagttaattctcaccattcctgtggtacctgcgagtgttatgaccaggattccttaaacctgaactcagaccacttgcattagaaccatctggagcacttgttttaaaatgcagattcataggcagcatctcagatctacagaacaagaatctctgctaagtggacctggaatcttccatctgcatcttaacatgctctctaggtgtttcttgtgtttgagaaccatgacttatgactttcctcagaacatgagactgtaaaacaaaaacaaaaaactatgtgatgcctctattttccccaatacagtcacacatcagctcaaaatttgcaatattgtagttcatatattaccgttatgtctttggaaatcgggttcagaacactttttatgacaaaaattgggtggaggggataactttcatatctggctcaacatctcaggaaaatctgtgattatttgtgtgttctaatgagtaacatctacttagttagccttagggatggaaaaacagggccacttaccaaactcaggtgattccaggatggtttggaaacttctcctgaatgcatccttaacctttattaaaaccattgtcctaagaacaatgccaacaaagcttacaacatttagtttaaacccaagaagggcactaaactcagattgactaaataaaaagtacaaagggcacatatacgtgacagaattgtacacaatcactccattggatcttttactttaaagtagtgatgaaaagtacatgttgatactgtcttagaagaaattaatatattagtgaagccacatggggtttcagttgcgaaacaggtctgtttttatgttcagtttgtacaatccacaattcattcaccagatattttgttcttaattgtgaaccaggttagcaaatgacctatcaaaaattattctataatcactactagttaggatattgatttaaaattgttctacttgaagtggtttctaagatttttatattaaaaataggtgtgatttcctaatatgatctaaaaccctaaatggttatttttcctcagaatgatttgtaaatagctactggaaatattatacagtaataggagtgggtattatgcaacatcatggagaagtgaaggcataggcttattctgacataaaattccactggccagttgaatatattctattccatgtccatactatgacaatcttattgtcaacactatataaataagcttttaaacaagtcatttttcttgatcgttgtggaaggtttggagccttagaggtatgtcagaaaaaatatgttggtattctcccttgggtagggggaaatgacctttttacaagagagtgaaatttaggtcagggaaaagaccaagggccagcattgctacttttgtgtgtgtgtgtgtgggttttgttttgtttttttggttggctggttgttttcgttgttgttaacaaaggaatgagaatatgtaatacttaaataaacatgaccacgaagaatgctgttctgatttactagagaatgttcccaatttgaatttagggtgattttaaagaacagtgagaaagggcatacatccacagattcactttgtttatgcatatgtagatacaaggatgcacatatacacattttcaaggactattttagatatctagacaatttcttctaataaagtcatttgtgaaagggtactacagcttattgacatcagtaaggtagcattcattacctgtttattctctgctgcatcttacagaagagtaaactggtgagagtatatattttatatatatatatatatatatatatataatatgtatatatatatatattgacttgttacatgaagatgttaaaatcggtttttaaaggtgatgtaaatagtgatttccttaatgaaaaatacatattttgtattgttctaatgcaacagaaaagccttttaatctctttggttcctgtatattccatgtataagtgtaaatataatcagacaggtttaaaagttgtgcatgtatgtatacagttgcaagtctggacaaatgtatagaataaaccttttatttaagttgtgattacctgctgcatgaaaagtgcatgggggaccctgtgcatctgtgcatttggcaaaatgtcttaacaaatcagatcagatgttcatcctaacatgacagtattccatttctggacatgacgtctgtggtttaagctttgtgaaagaatgtgctttgattcgaagggtcttaaagaatttttttaatcgtcaaccacttttaaacataaagaattcacacaactactttcatgaattttttaatcccattgcaaacattattccaagagtatcccagtattagcaatactggaatataggcacattaccattcatagtaagaattctggtgtttacacaaccaaatttgatgcgatctgctcagtaatataatttgccatttttattagaaatttaatttcttcatgtgatgtcatgaaactgtacatactgcagtgtgaatttttttgttttgttttttaatcttttagtgtttacttcctgcagtgaatttgaataaatgagaaaaaatgcattgtctctggtttgaaatgactgttattttgtgggctttctctggtttttaggttttccataaacgtaaaacacattgctatgaatataacagtgatcttcaaggatgttttgcccttcttagaaaaataaaggggacaaaaaagaaggtggctagcaagttagtgcactagaaacagggtaattaaggcataactcaaagtgacaatcagcctatggcctttctcccatgattcagtgtgtaactagttgatcactgtaaatttttaaactagaaaatagtttgtgcagtattcaaaattaatgttgactatatgtatatacatacacacttcattttaggataagactttatcagaaggcttttatccagtttttaatgggtgtggtttattttaaataaaagaaaaaggagtttaataattttccaaaaatgaatgtgtatgtatatacacgtgtttacatgtttaaatatatgctgtatgtgtataggtaatgagtaattgataagcaacatacatactcaataagtattagagaccagtggattccaagaaaaaaaaaaaaactttgtacccaggtaaacttaacagcttaggaatttttatttttacaaataatgataatttatgagaaagacattttcccaaagaggaattctgtttcctgggacccagataggtctattgtaatccatgcagcttctctcttaataggtttataaatgtctaaaaatgttcaagtaataaaaatacttcctgctgttctacattattaaaatgttgaaaaattgcatcttgctatttgtataataacagaatgagagatgcacaaccatgtcttcttttatttacatggtgaaaaaccctgacaagtgcatcaagtagtgaattgcccaggagggatttttatgaagagaagcaccagttagctattcttgattataaaatagtgcctgtgactttaatatggagggtctttaaaaatcaattcagattaaaatcacatactatataaggttctatttcaagcttgttagtgtggaaaatcatcaacaaaagtaattttgaaatttattttcctaccactggtatcactcaactatgacctgtttggctgtaggaaacaggttttaaatgttcattattaagcatactggtaatttttttgtttattccataaaacttgtatctaatactacctcaccttataagggttggtagaggaagcttttggcatcatttagcatcatttaatactccaattctctataagtggctggcacaacaatatctacaacatttttcagattccatcttcataaataagttaaagactctcactctaaaagccaaaatttatgtacttgagttggaggccgaataataggaaatagagtcccataaattccagtcctggggaggtgctgttgcacttttgatgtcctcttatgagtgtctaaaagtacgcatataaaccttttaatcagtaaaccaaattttgaaatagtatacctttgcagtcagaagagaatttttgagacattcaaaagtcttcttacagcctttatgttgacacaaagtcctagacaaccacctgctttccctctgttgcctttaccaaacttcattggtatgtgttccaaaccttaagaaaagctgcaatccttttggaatattcattttcctcacttcagctgagaaacattcacctctgagatcacatctggaaaagaaaatgacctaacgttttatagttgtcatagcccacatttttggaaagctatgtgaatgatgccacacaatagagccgcagtgcaggtacagtgcattgtctgagattgtattttcccttagctaattgataaaataattcaagaatagaaccatggggtaattttcttatcattggaaaactacaattttctctaaaggcctaagggttgcctctggcaaacattaatagctgatctttccacaagctagcttcaagtccttaaaaga
